United States Patent 12,344,895 (LONG NON-CODING RNAS (LNCRNAS) FOR THE DIAGNOSIS AND THERAPEUTICS OF BRAIN DISORDERS, IN PARTICULAR COGNITIVE DISORDERS) - sequence listing, part 5

SEQ ID NO: 3378 - DNA, 2184 bp, Homo sapiens
cccaagatggcggctcctccgggcgagtacttcagcgttgggagccaggtgtcgtgccggacgtgccaggagcagcggctgcagggcgaggtggtagcctttgactaccaatccaaaatgctggctttaaaatgtccctcttccagtggaaagcccaaccatgcagacatcttgctcataaacttacagtatgtttcagaagtggaaataattaatgaccgaacagaaacccctcctcccctagcttcactcaatgttagtaagcttgccagcaaagcacggacagagaaggaggagaagctgagccaggcctatgcaatcagtgctggtgtctctctagagggccagcagctcttccagaccattcacaagaccattaaagactgtaaatggcaagaaaaaaacatcgtagtcatggaagaagttgttattacacccccatatcaagtggaaaactgtaaaggcaaagaggggagtgcactgagccatgtacgcaaaatagttgaaaaacattttagagacgtggaaagccaaaagatactgcaacgttcacaagcccagcaaccacagaaggaggctgccctgtcatcctgagtccgtacacatggaggactcttccagcatccagccaaggaggcgctggtggtggcttcagcggaggcaggccgggggagggaagggatcctatatgtcctgttggctcttaacaaagggtcagcatttccaaatcttagacttgaacaaacaaaacacccaacaaaaaagaacaagagaataatttaaaagttgaatcattacttgactaacagacttcggtccaccatgtccttttcacagccctcttctggaacagtcaccttgttaattttatttttgaaaattattttcccactctgccctttacttctgactttcctttcctagtttgttcctgccattctgtttttataagtggctacacttgccttctgaatgattgaaagaaacttttacatcttttcttccaaaataaaagtaacaagctgactgtgattcttaagttgagaccagagcagcaaacgtctcactttaaatttttgttttcttttcctttttttttcttttttcttttttctttttttttttttttgcacagggcatggcttgaattagttttatttttcttaactttaaatatatatatgaaaatatatattaaaatgttctctaaatattttctgcttcttgcaggtctctttttactagatcatggctgttcttcccacctcatccctctgaaaataaaaatgtattgccctctccaccatccatcatagccaggccactaacttgacttggtgcaagagattcttgctgcgaactttgtagagccagtgtgcagatagaatttggctttgagggttcctgatggctttttagtctttaactgtgtgtgtaccagtctcacatttggcccaaacctcaggattctccctctgcctgtcttacttcatggtactagaagaccttcctcgccactctctccacatgagagagtcagctgccctttctcctgtgcctctgcaggaagaactctcttgcatggcacatctcagctcctcattgagggatagttttctttgataagaaacctggagtccatttactctgacctctctttaaatctatatccagagccactagcccaggaaaaacttgggtgacccgtaatttctcttctcctgctgtccttttgctcttacgccccaccccaactccccttaaattttacaggcttatgacagtttgtatgtgctcagccaatgagcagaaaacctggaaagaatttctggactttagcccaccagtttgtctggttgactaacctgctgagagctaaaattggcacccattgccccgtgccttcaggcagtctcctggggcagagtatgccaccatccgaatatcaggcactgagtgggatgtgggtgatgctcacatgactggctagagctttgggggtggggtgggggttaactactatttttttggccatgatctctttccccttccttttttttttaattaaataaatggatcaaattaaataattcaagccctgccttcaaaatgaaattttttttttagtattatttagcaaaaacaataaaacccaaatttttttaaccatcaaaaaaaaaaaaa

SEQ ID NO: 3379 - DNA, 267 bp, Homo sapiens
acagcaagtctggctagagtttctcaagggtgtgcccatggggattagtggaaagagctctgtgcttgggttgggtggtttgcccactccaccttttattctccttgggtggttcataggaagaggccaagagagagagaaggatgctgtatttatgggaaaaggctaccagaatttccatccgagaaaaaccctgaaatgaaggaaggagtctaatccttttttttctggaaggcacttcttgacttctgtactttatctcatcat

SEQ ID NO: 3380 - DNA, 3953 bp, Homo sapiens
atttgtcttgccttatttgctttttaaaaatttctaccttagttttttcctggtttactttgagtgtttttttgtagtcggaggagattgttggtgcggctgggtgtaggtatgaggcagaggaggaagagtaatttattccatctactgagcctttcatttactttctgttttagcagtagagtgggatgtcggaagcttttgttgggtgagagtcaatctgtcagggtaaatcttaaaaagctggatttgtggtttagttactagttactgtgtctccagtggagacaaagattagtttttaagatttagccttaatggatgattcacaaattgcaatgcagagtattgaagttaagtccaaggtcaagcacacaagtgggtaaaactgaacatatgaaatgggtgtgtggctggcacccacctctgacctttactgaaataaatgaggaagacggtgctgtaagtggaatgccacggaccaggagttaagaccagagtcctctgctaggccctgcatctgaagtctgcagagcatggcttttcattggctcagtgaggagttgagtcctggttcagaaaaagttaccgaggtctgtaaaagtcagtaggataccggaacaagaaagagtgggagagtgtacagttcccagcgaacattgccagtggaggctaattttcaccagtgaagggcgattttgatagaaaagcacagtgtctcaactacttgtggtttttgattctgaaagaggaggctttggcaggagcaataatacacgtggcctaccacctgtttggctttttccccacaggttgcaagctgcagggagggccttgctaattctagtacctccatccccgaatcgtctaaatgtattttacccaggacctgtcatggtttatctgagtgaccagtttcctttcctctcttgcttatttatcatgttcatatttatatttttcataatggggcctatttatatattttgaagtagttctagtgattttaagatccagcaaaacttcaaggtcatctggattttggtgttctatttaagttttctaacttgatacagtctttttttttttttttgtattttgtatgtttttctacaaaatgtgagagagttaagcatgtataattacatatgactgctgttttcactttgaaattttaaatcctgcttgggagaatggaataagctattgtgttttttgcaggcagctatgggatatcccaatttgtccctccctcctccttaattttgaagcctgagagaggaagtaataattttcttttttttttttttttttggtagggatggggtttgactatgctgtgcaggttggtctgcaactcctaagctcaagtgatccgccctcctccgcctcccaaagtgctgggattacaggcctgagccaccgtgcctggtctgaagaagtaataattttaagattcagtgttgagtgaaataaatgtattcttaaaaatttctaagagtgtttaactctctgacctaatatttaatattttccccaatcattaggaagtgcttttttgttgttgttgttgttttttttccaggcagggtctcgctctgtcacccaggctggagtgcagtggcatggtcacggctcactgcagccttgacttcccgggctcaagtgattctcccacctcagcctcccaaggagctggaactgctcagctaattttatttttgtagagacagggtctggctatgttccccaggctggtctcaaactcctgggctcaagcagtcctccaccactcctggccaagaagtgcctttttttttttttttttttttaaagtagctgctgaacacaggagaatctgcctttttcttgaatcgtggtttttttgtttttttttttttcaagacggagtgttgctgttgtcgcccgggctggagtgctgtggtgcgatcttggctaattgcaacctccgcctcccagattcaagcgattgtcctgcctcagcctcccgagtagctgagattacaggcacgcaccaccgtgcctggctaatttttgtgtttttagtagaaacaggatttcaccatgttggccaggctggtctcaaactcctgaccttgtgatccacctgcctcggcctcccaaagtgctgggtttacaggcgtgaaccactgcacccggcctgaatcatggttttttgaaaccattggcatctgaacctgtagctctctctggtagtgttgtgtggttttaaatgtcatgtgagctgagttactgacctcaacctactgccagatgaaggtgtgatcctgtgataccaatcttgagggtcccttctagttttagcagtcagtgacttctcttgtttatttttgtttgaaaaagtaaaaggctctctttttggctatagagttgcatcttgaaatttttgacaaattacatagagctgaagaaggatacaagttttgatatcttaaaatcacagggttgaagcttgaaaggacagtattggcattgcagctaagtgggagtgtgaggaagcgccttctctagggcaggtaattgcatctgttaatgtggtccttgggcccctgagttgctgccttccaatcagaattcccttagcattagccagtgacgcctgaattaatctcaggtaggacttctaacttttttccaaaattatttttgtgcagaggtttatctagatttttcttctaaatgtcctcctccccacttgttttattattactgtttttttctctctttaatttttttttttttttaatagagacatggtctcactatgttgcctgggctgatctcagactcctgggctcaagtgatcctcctgcctcagcttcccaaagtgctgggattataggcgtgagccattgcgcctggctctgttactgtttttctaacctgagttacttaggatcatattttcattcttttttaaaaagatgggagttttctgaacttttccttaactaaaaagtggaatgcatcttaatattttcctttttttacttgtgtttctccccagggagggaaaaacatatttattgtgacagaatttagcatattttaggccacattaaaatactgataaatgtattaatcagtgaaaataggttatagtgaaaaatatataccatttgattaataaaaatgttattggaaaaatgcaagaactgctgtaagaattgctaacattgtgttggaaaataaatatactaagctaagaaacaatgggaaactgtcatatgtagggccaacagcctttttttttttaaacccttccaatttattaatatctagtctaataaaccctgatttataggacctctgcaccttttttgactttttattcatccattcttaatattctacactatgacaaaatccttaaaactccattattgatgaaatgggaacagacttttgtttttgtatgttggtgttctctgagtggtgaaggcccagggagaatgttttgtttggtggtcacttagcatttgaaaacatccacttccttgtgacttagctgggtatcttttaacatctggaagccacgtccctgattgaaatctctggagacaacttacctttcaccaacttgtctgccaaattgcaccatggaccaagattgcagtggctgcatcaagtctaggcctgccctgaagtctggatttgtaagtcccccatttcaaatggggcagaaggcagaggagcagaggagccactgtgcctttcgctgtcctggagccagttggccttctggttttggtgaaccctgcttttataagaggactccctggcatcttccagtttcccgctacttgttttatgtattattttatgtctgtgtttgtcctggagtgctgtaactcctttcactgtctgctgtaagttcaacttcttcaataaaagaaatgtttcaaattgga

SEQ ID NO: 3381 - DNA, 1569 bp, Homo sapiens
atcctcctcgttcttactggcgtcaatcttcgccccctccgactcggcgctgcccccttcggtgcctccagacgcggttccgcccccggtcccggctccgcttcccgccgccgccgctgccccctgtgtcgccgccaccatggctccctcctgctcgcccgccgagccgcctaccgccgccgttgccgctgccgccgccccgtccccgccgaactgctcctccgacatagtgctagtgtctccgccgctgccgccgagactacacccgccgctgccgcgaaccgaaactagcagcaaagtaatccccgccgctgccgcgcgcccgctctacctcgcgaagcacacaagacagggaaggcgcgcgcgtggctgcaaaggctcctgcgcctctccctggcctgcccccttcgcctcccactctcgcgcggcgcacactcccgctctctcccgctgcactaaaaaagaataagcaccagcggcggccgctctcgcctcctcctcgctttaatggcgccgccgcggaccacctaaaatggccgacggaagaacggcgcgtcccggtcacgtgacgcgagagcgcgcccttcgcgcgtccccccacccctatccccctagttttttttttttccctttcctcctcggtcccgccctctcgctaccctttataccttcctctcacgctccgcgttgcacagccttgggggcctttaaaaggaaccggaagtgtcgtgagctaagacagtcgcgcggggaccatcgagaacaaggagtgctgtttcgaagtagcggctagaggggccccctgcctccgcccccgcccttccgaggattcctggagtccactcacccctccccaccactccagtagcggcgggagcagcagcgttaggccggggtgtggctgcacctctgcgaaggctgtcgtgccccgtgcagctgcggcgttcgggtgggggaggggaggctcacaccctgcggcggcttaagcctggatttacgcactggaggagggaattagccctgagatgtcagccctgtgcccctggcgctgtccacccggacgcccgcggagcgccaggcgccgcagcggaccgcgcgcgcactgattgccgcagctactctccctgccgtcgccgcccgggaccgggtgacattgaggttttcgtctatcgccgctgggccgatagggcttctttttaagatttggctttccaagtaagatttttgtttgcctgcttttctcctggaatttttttgtttttggtcgaagaagcagctcccactttgcagttgtgtcagccaatcacgacagcttcccagacttccgtgcaagtgcctgctttgaggccaaggtggccataaatggcagctcctcaggctcctccacaatctctggtttcttatgtttctccatgagctcagctttttcatcaactccaatgcttcaagccgaagtcattagtgaatgttctacaatccttcagctgcagctccagaccttcactcctccagcttctcctacatccatctaaccctcaattcctacattaaatctctttattccagaat

SEQ ID NO: 3382 - DNA, 689 bp, Homo sapiens
acaacaagtccccagggacagctaagcactccagtgtctagggactgtgggaaactggaaagaaacaatccagtgtaaatatgacttctaagctggctgttgctctactgctttcttggcagttgcatgctttctgtagcactgtgtgaagtgtgaagcttattcatgaagagacctctgcctgaacatacagcaaatttaagaaggttgtgcagatagtctgaaggaggaccagcagagagaagagattccatcttccagaggttgccactgtctgcctccccacttgtccccatccacagtcatcttttttatatatataatgacacattagttgtctagttcttcatagttaatgtggtttaagtctgacatcttttcttttgccatgaaatttacaccttagtgttattctcactgaaaattgcctttgagtttgataaactcttatcccagtgatattgactgttttaaattaacagatttatcaccatttctgagctgtgtagggccttaattgaaaaagtatctttgattattttttcacattttggccacatgcctataataatggaatatttacagtactttttagtggagaacttttttaagtagaatttcaataattaatgtttgatggagtttggaagttaccgtattttgaagtatcgtttaacattcttctctca

SEQ ID NO: 3383 - DNA, 1552 bp, Homo sapiens
cctctcccaacacggcggcctcagcaaaaaagaagaagaagaaggggaagactatctccctaacagactttctggctgaggatgggggtactggtggaggaaggacctatgtttccaaaccagtcagctgagctgatgaaacggatgacctggaaggagatgtttcgacaacttggcacagtaacgatgacgatgtgtatagggcgtctccaattgaccgttccatccttcccactgctccacgggctgctcgggaacccaatatcgaccggagccatcttcccaaatcgccaccctacactgcttttctaggaaacctaccctatgatgttacagaagagtcaattaaggaattctttcgaggattaaatatcagtgcagtgcgtttaccatgtgaacccagcaatccagtgaggttgaaaggttttggttatgctgaatttgaggacctggattccctgcttagtgccctgagtctcaaggaagagtctctaggtaacaggagaattcgagtggacgttgctgatcaagcacaggataaagacagggatgattgttcttttggccgtgatagaaatcgggattctgacaaaacaggtacagactggagggctcgtcctgctacagacagctttgatgactacccacctagaagaggtgatgatagctttggagacaagtatcgagatcgttatgattcagaccggtatcgggatgggtatcgggatgggtatcgggatggccaacgccgggatatggatccatatggtggccgggatcgctatgatgaccgaggcagcagagactatgatagaggctatgattcccggataggcagtggcagaagagcatttggcagtgggtatcgcagggatgatgtctcagaggaggcggggaccactatgaagaccgatatgacagacgggatgatcggtcttggagctccagagatgattactctctggatgattataggcgtgatggtagaggtcccccccaaagacccaaactgaatctaaaccctcggagtactcctaaggaagatgattcctctgctagtacctcccagtccactcgagctgcttctatctttggaggggcaaagcccgttgacacagctgctagagaaagagaagtagaagaacggctacagaaggaacaagagaagttgcagcatcagctggatgagccaaaactagaacgacggcctccggagagacacccaagctggcgaagtgaagaaactcaggaacgggaacggtcgaggacaggaagtgagtcatcacagactgggacctccaccacatctggcagaagtaagtcagcccaggatgcacgaaggagagagaatgagaagtctctagaaaatgaaacactcaataaggaggaagattgccactctccaacttctaaacctcccaaacctgatcagcccctaaaggtaatgccagcccctccaccaaaggagaatgcttgggtgaagcgaagttctaaccctcctgctcgatctcagagctcagacacagagcagcaatcccctacaagtggtgag

SEQ ID NO: 3384 - DNA, 3177 bp, Homo sapiens
taaaatacaaaatgtacaagaacacacaattccaagtgctgtaaacataactgagaaccagttcctttactaaacatccattttataaaacacaaggtttcaatttgagcccatctgagccttaaagatccattctgaataccaaaaacagggcttcacagccaggcccagaagaggtctggtgataatggctggccctgggtggggatagtttacacccgggcagcagcaccacacatgaacccaaagacatgttctttttaaagctgttttcagccatgtttctctgtgcatctccagtaagcagaaggctacccattccattcctcaacccaagagctagcacagttagagtaggagggggtgcgtactagcacgtgcccagttgctcagtgctgctagtagaaattgatttgcatagtccaatggatgtgtgctttaacaccactatgttgcacaaaaatttaagtctttatctacaaagccaaaaaatattgactcttaacaccaaagcttttacaaagctgatataaaactgcttacatagtatacaaagctctattttaaaatttaatgtttattttaaataggaaagcatttctagtgctacaggcatcaaggtatttagaaggcatcaaaatttggtgcatagcaactctggatcatagaggcttttaattcttgagggcacaaagggtattgcaaggggaactcttgcaataacctcatgtgaggcagctacaccaggggcaaaagggtaggggcaagtctggccatttctctggaatgtcaaccgagaggccaacttcttgcccctccaaaggaagctgtgggcgtccaaccacaggcccagaagcaaatctcactatccacattctgtgacacaactcacttttcaagaaaatttgaaaacacccagctccaagaggggccacagtgatctgctgaagaatagacctttttctctaactaactttaggggagaaatctaaaatatattttgttttttttaaagaccatacttcctcatcctgagtcaacagctcctaacctactgacaacaggtggtgggcaataggccagctccctttcccagacctgaactggccttagtagagagagtcctggcatcaagggcctgcagtctcctggaataacagcatcaggccttcaaccagcacactgtctcacatataggcactcaaaaaatctgcttcctgaatcaatggaagtatattatttcatttgaaagcatactgcaaacttcagaggctctgtaatgggcccaggaacaggtaaaaaaaatcccattagggagaggggtaagggcaggttttttttttttttaaagtacccaactcgggtacctcctttggtagacagcaggctgcagtttctgctgggccctgccttggacaccagtctcaccagcagcagcaccagggtgtctttggtgtggagggtcaggttatcacttctggatgtgctcagagccttctggggaaaaggctggtttttagatcatacagacaggacagggtaggccagaatcatttcaggctataaatagaatggcagataagccttccatgccagtgtgactcttaaaaccttcccatctggagtcctgtattttctctgcccatgctgatgtactgctcatttgtgctttagctctgcacacagcctggcctctagctagagttagaactgcaaagctgcctaaaccactgagactggcttcaaaggtcacagaacagccaaaggcagatgcttctgtttggaaaaggttctacgaccagatgacacaaacaggaagcgcactccacagcctactagtttttatgatggcaagaaatgaaagtgaccaagctagaaccccaccattcagagtcaccttaaatgtagccatcttacccagggtcctgagggaaaaagcaatttcaacatggagccagtatggagagattgcaagattacctagaaagttaccaaaaggctatgctctggaatgtctttttatattccaacacttcaatgatggaatggtctcttctcattttatctaacaacagtttagttttataaagaggtatgagctacatttggctttatttcctataaatctatgaacgtcttcaggacacatgctgactttctgaggcataggtgtgggcttgggatatttttttctttttctttttttcttttctttttttttcttttttttttttttttttttttttttgcttctagaaggtcttatcaaaagttcctattttaaaaattatcataaaaactaaagggcccttcaaatgaccataaagcagtacaaatcaccaatcctagctaagtaaccaggtcacctgcaaaagcagcacctcggaaacaagagagcctgctgcattcacactcaaagcacccatcatataaaagtatcctagttaaatataaaaagcaaagttcatttccccaaagctcaaacagcctatgctgctcctgttcttttgccaaatctacccaaggcctgaggtggaggaatgctactttccccacaaatggtgggtcccactcctggccccagacctgaaggctgcagagttggaaacccaaggtccaaggagagaaacatgctgagaagttggtggtggacacaaggctgcagtaagcactgttagagcccatcagatcttcctaaatccagggactcaggactcgggaggggagcctgcctgctcacccctgctccttgggaaacagaaatctgggacatgtctctcccaattatctcgttcactgaaaaacaagaaaagggagagtgattagtgacctctgagtgattagccatatgatgcccaacgctgagctctacctcagacatttcccttcccatggctttctgtaaagataaaggcagtgtctgaagcctgctcctgagctgagtggcattagagatggaaacatcgctccacaaactactctggacctctttttctctctcattcagttcattttgggttgggaagggggcttaccctcactctaaaggtatgtttaaataagtattcaccttactctaacttttctttaattcatatctctttgagaaagtttttattttctacaatgccacctcctatgtaaatggaatgaaaataaatgctttggtcagaataa

SEQ ID NO: 3385 - DNA, 603 bp, Homo sapiens
agaggctgaccgtaattcttgacttcaggctcctccatcttcagagccagctgtcagctgattagccaccttagttccatctgcaactttagttcccactggctgtgtaacctaacatagtcacaggctctggggactgtcacgtggacatctttgggaggccgttattctgcccaccgcaccctccgttcatcccctgccctgccgggcacctcgctctaccccaggaaaatgtgagctcgttttcctgctcggcatgtgctccccctaaggctctgctcctccctgggcctgaaagttccttctcagcctgagagggggcccttcggactcaggcatgactcagcccggctgatgcctctgcagtgctgagtcaggatttggggccggctctcttgggtccgtccccttttcccaggtactgccttacaaagctgtggccaggaagtggccggtataaaggatgcccaaggtctttgtacgtgtgtaggagttagcgtgtttgatattgttaatataataataattattttttagagtactgcttttgtatgtatgttgaacaggatccaggtttttatagcttgatataaaacagaattc

SEQ ID NO: 3386 - DNA, 2415 bp, Homo sapiens
aaaatttctaagcctttattgcatattaataaaacaaatctttgaatatacagcaatgtaaaacttttaaaaatattaaattcctataactagggaccgttggtatgaagaagggatgatgagcactggtacagagcactctgtaccaacacacagaatttactgttctgcaaatgaccaatagtaaaaattttaaagatggcacaatcctagcaggcaatctttcttttgtttacaagatacaacattttaacagttatttaaatgtaatcctgaagcagcctgcaaattttaccttttgcttttagttctgtcagtgtggtccctatctttgtggtacctatccctgtccttttctccttctctgtgtttacttttctctcgttctttgtccttctcatagtcttcacttttaggtttatctggcttcttgtctacattcctactatctctgcttgcttttccatctgttcctcgatcaccatgtgataaccgtgccctctctttatctttgtgcccttcctccctgctttttctgtctctgtccttgtcttggcttctgtctctgcgtctatgcctttcagattcttgctcccattccttttcatgtcgctctcttttcaaatggtgtgaatcactataaaatctctggcggtcccctttacccctattaaatggcctatccagttgctgttggtcttgcctaccccaagggtcactatggcgcctttctggcctccgaatgtctttaacctggtaaaaattctgcgggcctatataccttgatgcttgtgagagaggacccatcatacgctgtggctgacctgggagatgaacaacaggtggccagggaaccatgggattttgagcaaagccaaagcctggagggggaagtaatggaggtggcaaatgtggtggaaatccaaacatgctttgtgggggaaaattaggaggccctggaaatggaaatccaggtgggctagacttgagatgctgaaggttgggctgctgtggcctcatgggtgaaaagtttgtacttgttctggggctggtgcttctggaagtaaaggtgatgcttttagaaggaaattctgatggacatgtgtttccaacttcaaaatgagatgtcgctactgctgatcctcttcgaaatgggtgcacagtttcaatattttgcattaaaatatcctcctgtaagggttttgcttgttctgcttgagaagtctgtatgttttctactgatggtgagttttgtgcaacttttaaattgtcactctgctgaacacacgagtttttctctgcagaacacaacttttcctctacattgatttgttctgttaagtgctccttgttgtgtgacaggccaggcagcatgtgtttttctccattccggcaactatctccatctttgctttctgaagtagttacaggctgacttcgtcctgctgcttgcctaggatcccttttcaggttgataaactgtggagacctcgctgtattagcaacaaggttttcactacagctcacattaccatctatgtttccttttcctacattagatctgcatggagaactatttgaagtctggttatcttgcaaattattctcttgatcttcctgaagctgtctttttaatgttttctctttactctccacagtttcctcttgttttgactgaattgataaatttgttaaaaatgcttctgtagaaacatctggtggcttacctctgagactaagactcgtcaaagaccctgcagaaatggaagaggaccctactactgatgtttctatttctgctgacttatctgtagattctgaaatattatctactttaacttttatctccttgttttcaccatcagttacttccacattatctgttttctctatttttgagttggtctgctcatttaaaaatggaatttctttaacagtgttttgttccatcactgactgggcctggtcatatacttgaccagtggtgcccaaaaggctttgaagtatatcatccacaggaagaggtttatttgctaattccagagtagtaggttgattctcccaggttttttcagtttcagtttatcctcttccttaaaatgctcaacgcctgggtgttcaagctcttccttcacgtgactattggttttcattgctggggcctgttgctgaggcttatgacactgtttctggctagaatgtgatacatgtccagtttgtgcaggatgatgaggttctttcaagcaaccaggatgagcgtgtgacttatcactcaaagaatgagttaagggcttgaaaatttgtactaaagtttgatcctgtaatgtttttttcagtacagaatgagcttggtttttcacagatttaaccccagaattgcaactctgaatctttggctccttatcaatttgtttt

SEQ ID NO: 3387 - DNA, 1227 bp, Homo sapiens
caatcctgtcagcctctgggaggctatggtttgagaaccagctgaaaaagctgtggctcgcatcctggttcccgtgacgacgggcctggggttcctggccccggtgccagcggattggggttgagtgagacaccagccggcctagggagagagaaggctatggagatgggacaaaacaaggacagattgagggggggaacatggatttactctggtactgccacttacctgagcggttgcgctggaactccttgacaatcaccatgtttgtgaagtaggggttagtctggaagtacagcttcattttgtagcccatggagatatgtctgagatcctgtacctgctccaggtgggggtgatggtggaatctgtcccccccccaacacaccacggcccttcccacccacctcccgtcacctccaagaaccagattcgtgcccgatcctactaaaaaatgtctctctggcctgacctgcagattggtcaagtagcggaaaatgtcttcatcacgtcggttgatcaaaattgaaattctggggtggttgaggaactgatgagtggagcagtttaggtcaaggattgactattccgtgaaagggagggagggaaggccaggaagggcacagtaagagaggctggagcatgaggattccttctgtgcttatgtggtgtgttgctttgacccagaagcctgggatatgctggatgatgaggtctctgcgctccaggaagggtcttcgcatctggatgaacttgcgcttgagacgcaggaaggctttgcctgccttgatgttcactgcctccagatccagctgaatatcctccagtgcctgcaggatgctctccatcctctcggcatttctctctctgctttccctcttcaccttcctctgcttcctcctccgccgccgccgccgcctcctgctgctcctcatactctcccgctcatcctcatcctcatcctccactatgatgatcgcctcttccttgctcttcgggtcaactaacctctggggcgcccaccccactgcgctacaggtttctagggccccctctccaccaaaactgctcgactgtacaacctgaaaatcgatttccaggctcccccccgaggcctcaggagtggggagtgcttccaggctctccgtgggcgggggcgcctccccataccccgactcgatggtagaatcccagccgggacactcagcaccgagcgtgaagtatgcg

SEQ ID NO: 3388 - DNA, 2331 bp, Homo sapiens
atttttaatacagcggagatgtttcttgctttgttttcagactctcctttttaatcaggacaacatttgaaagattttattgtgcctctaaagggtatatttgggggttgggtctttttgttaaactctggatagtaataagtttcaggtcagtataggcccgaatcatgtggtttcaggtatgtttttcttttttctttttcttttttttttttctttttttttttttttttttttgaggtggagtctccctctgttgcccaggctggagtgcagtggcatgatctcggctcactgcaaccctccacctcctgaattaaagtgattctcctgcctcagcctcccgagtagctgggattacaggcacgcaccactacacccagataatttttgtatttttagtagagacgtgatttcaccatgttggccaggctggtctcgaactcctgacctcagctgatctgcccgccttggcctcccaaagtgctgggattacaggcgtgatccactgcacctggcctcaggtatgtttttctatctacacacaaaaagtttattttccttcctcttatttgatatcagaagaatgacaggaatcagtttttaacagagatagtttttccgtttctccattgtgttaatcagagcgcagacttacattctcagtcatttatcttttctggtggagaataaaaagtcacttatagttaaagatcagaaaattatcacaccaaatccattacatatgttagaatcaataatttactcaaaaatcagcttttataggtatgttggcaccttatccaagaacttatccctgttccagtacccctgtgcttcattcagtatcagtaaccctgcaatgatttttacaaatatctttttctagtgggttttttacttagaggaaagaactttgtaatagctcttaatgtttatatataagagaagacagaatggaaaatgttttttgaagtcaaatattgcatgatgtaaagaaaaaactttaaacttaaatgagtaggttgtcctgaattacactggtaactctctacttctttattaaagaagttatagtaagatgcctttgttacctgatttcagtgtacattgtttttatgtggttttctgataatgtcctgtcagaattgtattggtttaggccaaaggccatagcaaaaacatagagaacaaatatgatcttaaaaatagattgtaacattttaaacaattagtttagtaatttgggaaatagtggatgcataatactttaacagaagtcacacatctgtaggtttatcttttgattattctcctgaggcattagatagtttttctattataagtgacagattgactcacttaatataaataagtagcatacactaaaagcttactatgtgccagatactgtgctggacacttacatagataagccattgaatccacacagcagccctgtaagaaataagtaaaatctgcataaagtgttgaaataggaatatacatttcattatgaaaaatgaatagattatgcctatctgaatcaatattgcattcaaataagtgattacttaaatcatatatcatagtttacactccttaaaaaaaggtacataaattcagtgaggtttttttcttaacatacagaagtactaaatactgcttgcagtataatattgatattggaagctgcagtttccagaataagtggagtaataactaaacagacatttaattttatttcaatatctatggaaaaaacacttattaaatctccctgtattttatgttgtctttattacagaatcacttgtctgtttgttgtgtgccacttactgacaaaactttaaacagtacttgatgccagctctctactctgtggctgtgggacctgtttcttttaggtacttgtgcttattaatctacttactaaattttcacattgacatttttggggatgatactaccatatacgaaatggaaaatgtaatatgctcagtgcttctgtaaaatgcagcaatactggtattactttacatcagtaggcatctttgacatgagcatataaatattttgttgactcagcaaaggtgacactttgtgactaaagtatcccattatatataatgttttttgaaatgttggaaattttggggaattatcaaatgtatagaagttgcatgaaggttatagagaggtgtaactgtttgttaactattacatggatttcatactaggcagtgacaactaacatgttacttcaactaaaagtgtataatgggttgtctttttatttatgaaaataaaagtaattttacttacaatttc

SEQ ID NO: 3389 - DNA, 1861 bp, Homo sapiens
ggaaattcagacattctgtaacacctgctgtctcttcccacgcaggtgaacccttgctgaagcaggacagtaaacaggtccaggtggacctccaggacctgggctatgagacttgtggccaaagcaagaatgaggctgaacaggaggaaaccaccagtcccggactacaaccatagggccacccaccacattgaaaaccagaagagcattttgctgccgccgagcgtggacgcaggcggatctccgaagagctgggtcgccagcctctcccgcgcacgttgcctggcctccagcacctacttggtcccgcgcgctccctcgtgtcgcccctcggagcagcagccgccgcggtcgccgctacccggaaagaagtcagagacgccgcgaggtcgccgccaccgccatgcccaagaataaaggtaaaggaggtaaaaatagacgcaggggtaagaatgagaatgaatctgaaaaaagagaactggtattcaaagaggatggtcaggagtatgctcaggtaatcaaaatgttgggaaatggacggctagaagcaatgtgtttcgatggtgtaaagaggttatgtcacatcagaggaaaattgagaaaaaaggtttggataaatacctcggacattattttggttggtctccgagactaccaggataacaaagctgatgtaattttaaaatacaatgcagacgaagctagaagtctgcaggcatacggcgagcttccagagcatgctaaaatcaatgaaactgatacatttggtcctggagatgatgatgaaattcagtttgatgacattggagatgatgatgaagatattgatgacatctaaattgaactcaacattttacattccatcttttctgaagattgtcctacaatttggattttgatcatgacaaagaagattaaaatttcattagcatgaatgcaatttgttaaagcagactgatttgtttctaagatatttttggtttttttaaaactgataataatgctgaattatcttaagtgagatgttaagcccactttgttcttttaatgtaatggagcttatgggtagaagaccatgtctactaattacaaaaaaaaaaaaaaaaaaaaccatgcattgctgcttttcctaccacttccagtaagaaaatgggtgttttgaagaaatcatttgccttgtcctcacggaatctgattaagccctggcctcttgattgtatagagtcattgtgtatattccagttacctagatattcccttgagattttgatacaatttgagggaggcagaagtctgcatttgaagaaaaaaaataagtctgtttgtcatatttaagtagcctgtggctatttttatactgattttgatatcatgttcttttcatagtcgtattttgccaccgtaaacataaaaaaaaaaaaaaaagatttccaaaatgccgttttcagaacctgggttttaatagcagtattgaatttgtaagcttagtagttgcagaaattgaacactaggtggcactcagttatcttaacaggggaagtactgatataattgttgacttttcttttactatgtgtaagaaataccccaaacatgaaaagattgttttgatcatatgcatgtatgtagaatatttttgcagagcagaaagattatgttagaagtgtgatttttattttcagaagtcatatacatgtaagctacaattttgagtgctttataaacacttaagatatatatataaattttaatttcatagcaacttgtaaaaaataaaatacttgttgaaaagcctttttcaacatatccctaagctaagggaagaggaaggaataacaactcagtgaaaagatggtctcca

SEQ ID NO: 3390 - DNA, 3782 bp, Homo sapiens
gaaatgagcagccaaagacaaaaagatgtaactctttcctgataaggcgaattgcttgcttccttgaattctgctctcaaagatacccttcattttctacctaatattaataactttaatcattcattattccattactatgctctatagtgtatacaatttctgttctttgtcatgttattaactaaattatttattgggtccagtaacgtattccataaatattgtacacataaaaattgtgttatttttattcctgtatgctcagctgcccaataacagtctgaggattaacatatttgttaaatgctcaaatacattctttcacaaatattagtttaataattttatattaaactccctctatacttacaatatgaattagataattcagaataaacattccattggaaaaagctacacaatttgttataaaacatccttaaaagcatcagaaaattaatacagcaatgaagaattacaggaccaaattaagaatggtatgaaagcctgtttgtgacgcttatgtttgggttatctctttatttgagtgactataaatctcaaaagagaactaaagggagaaataaccatatctactaacatgctaagggtacttaaacatctcttagtaattgagaaaattgaaagaaaagaaaaaagagaaagggagaaagagaaacagcgaaagggataatgaaggcgagaaagaagaagagaaaggaagaggaagaaaagtaaaaaggaggagggggaaggaagaaggaagaaaggtgaaaagaaagaatggtaaactttttaacaacataatttatccttctagaatatgaatgttggtctatttgatgatgtcccacaaattcattagtctctgctcattgtttattttttattctttctgtttctcagagacagtattttccattttcttctcttcaagttcatggcttcctctgtgtgtgcaaatatactcttaaatccctctggtgatttttaaatttttatcattgtagttttccactccagaatttgttatctctttgctgatattcctactttttaatattttttctgattcctttatttctttgtttatgttttccttttgacatttgagtataatgaagagagttgttttaaagtctttgtctggtaagtttgatgtctgggtttccttagggatattttctgtcactttattttgttcctttgaatgagccacactttcccattctttgtatgccttgtaacgttttttgaaaactggacattctaataattataattactatgtggttactctgtaaatcagacctccccctacaaacacagtaatgttttgtggttttaaattttctttacttattatattgttaaggatttttttttttagtgaaattttccaaagtgatttacaaaactgtttggtttataaggtgtggtcaccgaagtctttttgtttccttaacaaatgttaagctaatgttttgacagtgattttctggtatgtcaggaaccaatcaaacaggcatatacaagaaaaacaaaaagaaaagcaagtaatcattgtccagcaaaatatgtctgtaggccatgcagactggctttgtgctgggttctttaaagccggcacaaagtgtgtgttcactcttgcactgagtgaagttcaagttcactcttgcacagagcttgcactgaggggagggatcggccaaggtaaaagtgtagggtcttcttatgacatttgtcagcatgtggcttaacctatgaatacgtgtgactttgtagactctcccatgtacgtgaatgaggcatgcgccaccacgcccagctaatttttttgtgtttttagtagagacgaggtttctccatgttgatcaggctggtctcaaactcccgacctcaggtgatccacccgcctcggcctcccaaagtgctgggattacaggcgtgagccaccacgcccagcagatttatttattttttaatctttctttttttttttttaggcagagtcttactctgtcacccaggctggagtgcagtgacacgaccttggctcactacaacctatgcctccccagttcaagtaatcctcccaccttagcctcctgagtagctgggattacaggcgcctgccaccacacccagctaatttttgtgtttttagtagagacagggtttcaccacattgtccaggctggtcttgaactcctggcctcaagagacccacccgcctcaggctcccacagcgctgggattacaggcatgagccgccatatctggcctatttattttttaatttttcaaatgagaaggttgggttaggtaatttttaaaaatcgcttcaagtttcttaactccacaattattttcctgagactcttgcaagcaactgatctttataggtcatgcctcaaattcccaattgatgtcatctgggcaaatcagtccaatgacagccacaagtggtcagaaagctttcttagcagccctcttggtcactaggcacactacctaggagtcaagctgtgacaagaggctgcttcttaaacttacaaaagataggatcttccaggatgtgctgctctgatgtttttgaagggcatagagaaacacacgggcaatgtttgcagaggcaacagactaaagaaagcacatctatagttgtattggctttgtgtgggttgtatggtaaacaggtagtcaccctgcttaatgtgggtatcccattttccataaatgtctatttcaccaccccaaaaagccctcttatcatgaaattaatcatctgatgcacttcaagtaccagtcacaaaaatgatgaactcaggcagaattccactgctagacaagcccagacaaaaactgttactgttagccaaggaaatttgcacacaattttgataagtggcactaaagccacataagacaggaaatgggttagaggacatcaatgtattgagacagaaagtgaaagggtgggcaggatttgcgaggttaccagtttgaatatggccattcctgcttttactaaaggtcaatttagaatacaaatgttacagaattcatttagagccaaaaagtaattctgacaaagactgtcttaaaatgcaagatttttaggtccaaaatttcttacgtaacctaaaaaatggaaatcttcacaatgtaatgagattgggtcatttaaatagtgttatatctaaccagtccagacagaccagctaaacaatcctattattaaaagcctctagagagtgttcaacaaactccttagataatgaagcttggggcagcaacacatccctcattatagtcagaaagttctcttaacatgtgagccaggttattgcgtgcatttatgttttcccacatgctgctctttcctcaaggaatgcgattctcctccccgactccctgcctggttcgctcattcttcaagatcaaacacaaaagtcactgtgtgtgtgatgcttctccaattccactcatcctggctgccattcatgcactagtgcatgtatgcatttttacattttttaaattacaaaaatcaacctattataactgcttagatatatatgaagtaaaaatgaaagttctccctttacatgacccatcccccatcatttccctctttatcttatactgtcagcattcccagcttgtagcacagtgtctggcaatagtaaatcctcaaaaaatgatcaatgaataatttaataatgattaataaataaattaatgatgatggtgaagataaatttttagcatttatt

SEQ ID NO: 3391 - DNA, 347 bp, Homo sapiens
atacttacctggaaggggagataccatgatcacgaaggtggtttttctcagggcgaagcttatccattgcgttccggatgtgctgacccctgcgatttccccaagtgtgggaaactcgagtgcataatttgtgatagtagggaactacgttcgcgctttctcttggtgcttctgtggtgcgaatagtaggtgagccgtaagtgtttttgtaattcagggtgcgggctcgtgttttgtggctgtgttctgtccggtcagttgtttccgttcgcaacggttagttttcctttgtgaggccatgtttggggacagcttagaactatccacttgctctcttgggaggcgaa

SEQ ID NO: 3392 - DNA, 1716 bp, Homo sapiens
gccgcgtggattccttccagacggccggagcccctcccccgcctttcctacccggccccggcgccgggcttccccccgccttaggaagctcgcccttccagccagcggccccgactgtactggctccgcggcagccttggctcaggcggccagcgctggacagcggccggggaatcccgtgctgcgcggcgcggccgaggggcgggcctggcccggagagtaccgcggcttcggccctctgccgtgcgcctcgcgcgttttgcatcgctgagcgaagcagagacgtaaggaaatggtagcagagcgcggggcgagggcagaggggagtcatttcccccagagtttgggctggttgggtcctcggcacctccggacgtgcgccaggcttccaccctgaagacgcgcccgtcctgggaacatgacctcggaagcagtcgcagccgccgccggacgaggggcgtggagaggcggtgccccggcagcccagggatggcgcaggccctggggccccaggaagacggcgccgttggcgtcttgagtcttgctgccgcctctggctgcctagccctcttgctttcgctcttcttgtttgctctggcccccatttttccgagagtgtacgccaggcccgggccctgctcctggactgatttacctggggcggcaccgcccgcagccatgactcccgggctctgagtttagcggcgccctaagcgccggaaccgcatctcggcgccggtgacaacaccgcgcccgatttcctttcagcaccgagtgtcagacgttgtagtgtttattcgaccggaggcagggagggcgctactatcctatcacaggtttgggataacccaacagaaacgcagtgggaaccccttggctaggagtcgaacaaggatcccgggtcgtggtagtatagtttacagtgggggataaagcagtaactttctagatagttgttaataattttttctgagctgcaagtatctccttatttctcacaaaaatctgcgagctgaattgaatggttttgaattttcaaaattaaaaaagctgtggggcagttttagagtattattggggaaattttacattcgttgctatgcctttccatacaggcccccccttttcggtctccttaactggttcgtcttcgtagttggaattcctttgcatgaggctatggaatatacactaccttctctggacgttaactattagctacagcttgaggactcccaaatttatgcctttagcaacacgatccgagccctgcaacttttcgacctcattttgagccaacattattttgctcccttattttgttgaagtactttctccagttatttacttaaaatgttcacatgagagacatactatttgattccttgcttgtactaagatgtaatgattgtaacgacttcattttcctagacccagataaaagtctcgcttcattcatgaaactttttacaatcagtagtgacctctgccccatcttatctcttttaacacttactatatcattcattagtcgttagccatatactttcattgtgtaatcttctgatgtatatgcattttatctctcacatgaattagagtcataaacttttatgaattcttcaaagcacttacttcagtgtttacacaaaagttacttgtttggcttattacaatatctaacaccaagcaggttaccttctattttttgttgtt

SEQ ID NO: 3393 - DNA, 392 bp, Homo sapiens
tagaacaataaaccaaccattacatttagacctgggcttttgaaaaacttgcattccattttaacaattcgtatgtatctaacaaatacataaatccagatcacaaataatcttaagagttaaacaattaagaaacacaaagaataccacatagatctacctttaaatatcagcattcatattataagaaataagaaaatgttaaaaaaataaaattaggttaagtcacaacataaaatagagaaataagataaatgctattttattaatattcatacttatttctaatttaccttcatatagtcttaactttttcaaaaggatccaagatatgatcaaataatattttagtatctgaacttgccagccttagcttataccagagcttgtta

SEQ ID NO: 3394 - DNA, 1516 bp, Homo sapiens
cccagtcatgggggacaccttcatccgtcacatcgccctgctgggctttgagaagcgcttcgtacccagccagcactatgtacatgttcctggtgaaatggcaggacctgtcggagaaggtggtctaccggcgcttcaccgagatctacgagttccatgacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtggagaagagcgagagcggtcagacctcccaccttacggggctccttcccctggtgctcaggaacccacagccacaagccccctgccaaggctcaggcagcctggcccctgggaggactccggctctgttaggggccctaaatgtcctccccacactgtgggtcgccttctctcttagtgtgcaccctgtggtggctgtgggcatctgtgcatggcaggccggggcggggcatgtctgcgtgttctgtctggatgggtatgggaccgtctgttcattatgaagtgggctcagagctgtgattctgtgagcatgtgtgcatgcatgcatgtgacctcattgtccagtgtggtgaaggtgacatttccaaatctgagcattggacatcagtgtgtctgtgtccctgtgtcctcaccatccctgatggctgcagggagccgctgggccctgcccctcagtcacattcccgcacctctggcacaggttggtggttctgtcagatgaaagcaaagcgaggctggatcccagcatccttcctcgagcccctggacagtcctgacgagacggaagaccctgagcccaactatgcaggtgagccatacgtcgccatcaaggcctacactgctgtggagggggacgaggtgtccctgctcgagggtgaagctgttgaggaaagacgacgtcacaggctacttcccgtccatgtacctgcaaaagtcagggcaagacgtgtcccaggcccaacgccagatcaagcggggggcgccgccccgcaggtcgtccatccgcaacgtgcacagcatccaccagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtatatacgtgttctatagagcctggcgtctggacgccgagggcagccccgacccctgtccagcgcggctcccgccaccctcaataaatgttgcttggagtgga

SEQ ID NO: 3395 - DNA, 29133 bp, Homo sapiens
gactccgcccagccgcgccacccaggtaggtgcgcctgcgctttgcgaggttcctggctagggaggcggccttggctggcttgaccgtcatccttgaggcctgcggggcaacggtggctgtccttggcccggctttggaatgtggctttgcagggctggtgttggcgccattctcgcaggcccacgtgctcctgctcttccagggtgtcctcggctgtttctcctgccgcggcgcagcagcgctcccaggctgcccccgcgataacacgcccctggcagccaggctcccagctctgttacgtgcccgggcggggaagagcttcctggtgtctcccggctcctgcccttctcccgccccaggggcgggctgccgccgccctctgcagctgagtcagtgcagttcctcacctaccttctctgctcaccgctgtgtgctagcaatcggaggacccttggcacacggagcgacaggggcctcccccacagacacctcattttgggaaagaagtgaagtctcgctctgtggccaggctggagtgcagtggcgcgatcttggctcactgcaacctccgcctccccggttcaagtggttctcctgcctcagcctcctgagtagctgggactacaggcgtgtgccaccccgtccagctaatttctgtatttttagtagaggcggggtttcaccatgttggccaggatggtcttgttctcttgacctggtgatccgccctcctcagcctcccaaagtgttgggattacaggcgtgagccactgtgcctggcctgtacaagtttttatccacagcctgtttctcttcttgtactttctcccagggcagtcccatttcacgtctgtaatttctagtaccacctatatactcagggtagcaaaggatgtatctctaacctagacttctccctcaggtgacagtcctggatatctgactattttgtggacaactcttggatgatctgaaactgaaagattcattccacaaatagttatgtgtatctagtatgtgccaagcattgttgttttcttgtccctcgtccccactcccctggtgttagtggggatatagcagtgaaaaacaaaaacaaacaacagattaaaagtcctgccttgacagaatttatattctagtggaggagtcatacaaacaagaaaagtgagtacattatgggtgttacataattataatagctaattcgaaataaagcaggaaataaggctaggtgctaggggcatgggagacctatcaattttatagtggtcagagaaggcttcattgagaaggtgacatttgagtaaagacttgaaggaggtgaagaaatgaaacttgagacttgtgactaattgtcacagcattccaggtcaaggaagcagccaattcctcgttctaaggcaggaagtcgtgttggggatggcagtaagagtgagtggagcagagtgagcacaaggaggagcattcggagatgaagtcagaggctgggccgtgcgccctgttgtaggtcagtgaaaggactttaggttttactctagggttaaaagtccctaaagggttttgagtagaagcttgacatagtttgattaaaaaaatttgttttttctagttgtttggttgagaatagactgaagtggggcaaaggcagaagcagagagaccagataggaagctgctcccaataaggctggtgagagggtggcttggatctggtgtaggtgtggtgctcgggcccgagagatgcagtgagtcagtgccgaggccatgtcgggggacagactgccttgctttcagtggagcttggttctggatctgggacaaaagtggtgggaagatcccagctcaattttgaaggtagaacagattggacgtgacgtggtgcacgagagaaagaaaggcaaaagagatgaacctaaggtttctgattaaatgttagacattgtgtaggaaaaaaatcacatagaggctctggcaaaaaaaaaaaaactaaataaataaataaaaaataaataaataaattgcatagagactgtggctgatgttgtgtttctccagaaaggatttaattttattctggcaagcaattagagtaggaacggatgactttttttttttttttttttgaggcggagttttgctcttgttgcccaggctggagtacaatggcactgtcttggctcactgtggcctccacctcccgggttcaagcaattctcctgtctcacctcccaggtagctgggattacaggtgtgcaccaccatgcccggccaattttgtatttttttagtagagactgggtttcaccatgttgatcaggctggtctcgaactcctgacctcaagtgatccacctgcattggcctcctaaagtactgggattacaggtgtgagcccctgcgcctggcctcagatgacctttaattagggattcagactttgtgagggctgatcattttctagtttggccttatcccagagctaggcctttctattctttctcaacatgaacatctgtggtatttaacaggtccccatctttgggtgaccttgaactccaatttttgtactcccagctctgtgagactgttgaaatgtacacttagcattttagctatttagcaactgtttggtttcttgatttccagtgcccttacagcttagaattcagcaaatgcctcaaggataaaagccaaactaaatgtcagactggcttctctatgatcctcctttctttgggatctgtcccttcaagtcctatccgcagttttcaactccaattttttatctccccgtatctgaaagggccctgatacctccaggtcactgctttctgctcgccataaatgccctgcacaaaactcagcaaatgacccaatcagaaaaagcaatggagaagttctgtatcactttatgcatctgtcttctgggatcccagtctctcatgtcttgaccatcttggttgctctccagtgtcttcaaacagcctgtgtagtttttgttatgtgtgcttttttaaatgttcagctcttgtgcttattcccatgagaggactggtttaatttaaactattcaattacagctagaggccatgataaagttgttgactagagtatctggaagaatggagttgccatttagtgatagagggaacgctggggaggatccattattggagtgagcattagcagcttggtctggggcacatcaagcttggaaggcatgttagtcatccaagtggagatgttgagtagacagttggacatgggagtctagagtttcaggagattggtctgggctacagaagtggatttttgaatcaacagccatgagacttgataagattaccaagggagtgtagagagataaggccttgagtgttccaatatttagagtttggaaagatgaggaataatcagcaaaggagactgcaaaagagggccaacaaaatggtagaaaatgcggaaagcctggtcacctgggagttaagtaatgaaagtgtttcaaggagaaagtaatcagctgtatctaatgctatacatgtgctaagcaagataagaacattggatctagcagcatagaggtctctggtgatctgaaaaaaggcaactttcatgaagttgtagaagagaaagttcagttataatggatcctgaagagagtgacagaagagcgatttatgactcaaggaaagaaaaaacaaatgggctggtagttaaagggaaattgagtcaagaaaaggttcaatattttttaatggtagaattgaccgtatgtgtatgtgcttctagaagtgattcaggagagagggtggaatggatggtgtgggacggagggaagaattggtggaatgatgttggcaaaaaggaataggcttttgtgcataagttgagggattggccttgcctagaaacatggacaattcgtctatagtaagaagagaaaaggtagatctatgaccacagacatagtcagataatcattttaaaattctttaatcaatagatgtttctgatgtatggcaggcagtaagctaagcagtttacatacctgatttcatttagttattataacaatcccagtctaacaatgaggtagattctgatattattcccatttaatttgcaaggaactgaaatttagagaagttaaaatgacttaccaaagtcatatagcaagcaagtgacaggaccaagacttaagcccttgactgctggactctagaacttaagcaagaaagcatcagcttatgatgttcattgtcctcccactcccagatcccccatttcttgccccttttgcttgttccccctcccctcattctccatatcccaataatcactaagtcctgtccattttacttcctcagtgtttcttgcttctggatcctcttttttgtatccttcctattcctaccagcctttgacctcatcattctgacctcatgtagtctaaattaaatcgtctatggaaccaaacaataatcgaacagaatgtgatccttgatcatgcttgctccataacccactgcctaatgagttcaagtttcttaaactatgctataagcctgccactacccggttactgcgtatttttcgaatttcacatctcactgatttctgtcttgtactttttttctcagcagagctgagcgcttgcagtcccactgcatgaactatcatgtttccacgctgtgtttgtgctttatgatttttccttgtctcttttcctggattttttttctactcctcttttaaacctcagctcctgttgctttctccaggaaggcatttctttttttttttgagacagagtttcacttcttgttgcccaggctggagtgcaatggtgctatctcggctcactgcaacctctgcctcccaggttcaagcgattctcctgtctcagcctcccaagtagctgggattacgggcatgcaccaccacacctggctaattttatatttttagtagagacaggatttctccatgttggtcaggctgatcttgaactcccgacctcaggtgatccacccgcctcggcctcccaaagtgctgggattacaggcgtgagccacagcacccggccaggaggccatttctgatgcctctaacttgggttcatatagtttgcagccacaacgccatcttttacttgccacatggcttttataatgatttgctaacatgtttgcttccactaggccatgacttccttgagggtagggatcatgttccatttgtatttgtagtcctaccatattacttaatgtttggttataatagttttttgaatgagtgaatagcaggggtatacaatttatccaagaaaagaagcagcagcatattttccatttaagtgtgcaaaaagtgagtgaaaggctatggtttcagaaatgtttttaagtgtaggtaaatgtattagtctgttatcacattgctataaagaaataccagaggctgagtaatttataaagaaaagctgtttaattggcttatggttctgcgggctgtacagcaagtgtggcggcatctgtttctggagaggcctcaggaagctcccagtcatagtggaaggcaaaggagaagtgaggtgtcttacatggcaggagcaggagcaagagggagaaggggaggtgctccatgcctttgaacaatcagatcttggccgggcgcagtggctcacacctgtaatcccagcactttgggaggccgaggcgggaagatcccctgaggtcaggagttcgaaaccagcctggccaacatggtgaaaccctgtctctactaaaaatacaaaaattagccgggcatggtggtgtgtgcctgtaatcccaggtatttgggaggctgaagcaggagaatcacttgaacctgggaggcagaggttgcagtgaaccgagatcataccactgcactccagcctgggcgacagagtgaggctctgcttcaaagaaaacaaaacaaaacaaaattaaaaacccagatctcgcaagaactcattcactatcctgaggacagtatcaagtagatggcagtaaaccattcatgaaaaacacctccatgatccaatcacctcccaccaggcccacatccaacattgggaattatactttggcatgagatttgggtggggacacagatccaaaccacatcagtaagagaatgcaagggagaacttaatatagttcattatttgacagacactaagcaccttccctgtactgagcagtattataagagcttcggatagatgaagcttttgtcctactgtagggaagtagataataggcaaataaatcaaaaaagaaaaaaagaaaatttcatgaaatgataaaagctttggtgaaaacaaaacaaaaactttgtggtggtgttggggggcatgagtagctgccttcagttaagtagcagaaaaggcctgagaaggtaacatctaactagagaccttgtgacataagaagcagcgaaccacatgaagttctgggggagccgcccagacagagggcggtggctagtgcactgttcctaaggaaggaacaagcttgtatgtttaaggagcaaaaggaaggccagtgtggctagaacatggaatgacggggaagagtggttagacgtgagcttttagagcattttgaggaagctgggggcaaattggagggctttgtagaatggaggaggagttgggattatggggagccattcaagggttttaagaaaggatatcatctgagttatattttaaaaagatcactgattgctatgtgaagaatggattgtaagaggtgaagattaagttgctagttaggaaggtgctgagtaggttaatgagaggctctggcttgaattagggtgatagtagggaaaatggagagaagaggtacatttgggagctttcagagaacgaactaagtccctttattcctctactcctcactgccacttactaatagtaagtagtggaggactacagaatgactgctaagattttggctttactaaactgacaggatgatcatgttatttatgcgatgcagtcaattgttggaaagagtaggagaccaagagttttgttttggacagatgctattggacatccaaatacatacgtcacattggcaggttagagatgcgaatctgaagttcagtggaactagagatataaatttggtactcatgagcacttagatggctttaaaacattttaaaggagaagggaaactgattttgccaaatccaagggttttaggaacagtgtgttcaacctggtcagataccactgagaggttgagaaaggtgagacttgagaagtaatcattgagtttgccaacctggaagtcatctgtaaacttgacagtcacacagattctgtgaagaggaggggactgaagcccatgtagagtgattgaagagagaatctagttacagaggcagagttgcaaccctaggttattctttccaaaagttttgctcttgtcttcttagtgaagtgcacgaagcctttggacatctctgcaaatgggtagcagtagaacatgaattaataagcttttgccacaaggtgtcactaattcttcattagcttctagtaagcgaaataattgcagcccaggtataccttgtattagggaaatattatttttaaaaatcatatttacaaagtaggccaacttggcccggcgcggtgacttatgcctgtaatcctagcactttgggaggctgaggcaggcagatcacctgaggtcaggagttcaagaccagcctggccaacatggtgaaacaccatctctacaaaagtacaaaaattagacagacatggtggcaggcacctgtaatcccagctattcgggaggctgaggcggtagaattccttgaacccaggaggcagaggttgcagtgagctaagattgcgccattgcactccagcctgggtgacagacagaaagagacccagtctcaaaacaaaaacaaaaacaaaagcgaaacaaagtagctaactagaaggcagttacttacatggtggagaggtttcctttcaaaagacagtctctagtatgtttaacaaatgtgcatggccgtcaagtggtgcgtggagcactgggctagcaatcagaagaccagagttctgggtgtagagtattggatttggagtcagaagcttcgagttcatctcctgttttgttctcactagctatgtgacctcatgcaaaatttaaattattctttgtcttattttgttgttgttattttaaaacgatagatagtaaatgctgttctggccatctcaagcaattatttttgcataccaaaagagataatgtgtgtaacaatttagaaaattatgaagtgctatgtaaatataagatttaaaaaattttataaaaattatttataccgaactttacagcaatataggtattatgtaaagcagttgtattagtgagaacccccggttgcataagggagaaatccaatttgaatttgcttggcagaagggcatgttttgaagtttatggggtggttcctgtgccttcagggatggcagcattgtgggtgggctttaggcattgctggaatcagagattggaatgacggcagcatgtgtacccttcattcccctttgcttctgtctggtgcctttattctctttggcccaaacttacctcccctaccttgtgggggaacattttgatattgtgattgtagggcacctgcatgacaacatcctatagcttgagaaggtgagaagctggggctggagaagtagacgtagaattaccttgattttgatgaagagaataagaattttgaatttatgagtgccattgtcagttaatgctgaccttccagttttgaaaaataaaactcacatgctctgaaacagtttaatatccttgagtctgcatgtctttgcctgcctgcccgtccgcccgcccgcctgcctgcctgcctgcctgcctgccttccttccttccttccttccttccttccttccttccttccctccttccttccttccttccttccctccttccttccttccttccctccctctcgctctctctttctttcttttctttctttcttttctctctctttctttttcccttcccttcccttcttcttcccttcccttcctgacagggtctcactctgtcacccaggctggagtgtagtgatgcaaaatcatgactcactgcagtcttaacctcctgggatcaagccatccactggcctcagcctccagaatagctgatactacaggtagttgccactatgcccagctaatttttctattttaattttttttccagttttaaatagtttaaaaattagccaggcatggtggcgggtgcctgtagtcctagctactcaggaggctgaggcaggagaatggcgtgcacccgggaggcagagcttgcagtgagctcagatctcgccattgcactccagcctgggcgacagagcgagactctgtctcaaaaaaaaaaaaaaaaaaaaagtttattcaagaaaaagctgggagtggcccattcaggaggaaaagactccagagaaacagggtcagtgctccaaacgtcaaaggtaagttcttaattatagaggcagaaaacaaagacattaacaggattacaaaattttttatacaaggctggtttaagatgaaactctaatatataggacataaataagacttctaaagtgtgttctaagaacacctgccaaaattatcaaaattctgtcattgttcctgggattcatttaaaatgacagggctggggactcctggtttaaagtggcattgactgaagttggaatttcttccaattctaactaaatacccatggcagtaggacagggcatgtcccatttctgtctagaggagcacagtagctggaaatgggagggagctgggagctggacattgcagtctgttttttagcttgaagaggagattgacaggcacccaggtagatagaaagtgaggccgaggacaatatgatgtgtgtctgttggtgggcaccaggtctggatctgttctattcattggaggaggaggtgaggagaaacataaaatctgcgaaaaaatgctgtcaagtaggaggaagggaacacacatttgaataatcagaggaagacagagctctaaaaatgaaactcattggtatccctaaagatgctgtttggtaccacctttgaataaagccatgcagagaattcttaagatgcaaaaagacggatgtgattgaaaaagactgatattataggcaaaaatattttttaatgcttaccacatgccagcaatggcgctcggggctgaggatataatgatgaataaaattgccatgattcttgtcctctcagaatctagtgaggtaccagacaagggaactggcatttccaattcagtgtgaaatgtgtgataatagggttggcagggcacaatagaagcacgaggactccgagccatccttggcggtcgtggcaagcttcctacatgaaagctggagctcagagcatatgaagatgtaggagtttgccaaatgaaatgacatggtggtggagagtgtttatgaccaaagaatgccgtgtgtgaagccctagaggtgagaaaaaacccaagatgttgtccaggcccagtggctcatgcctgtaatcccagcactttgggaggccaaggcaggagaattgcttgagcccagaagtttgagaccagactgggcaacatggtgaaaccccatctttacaaaaaaatacaaaaatttgctgagtgtggtgacacgcagctgtagtcccagctgcttgggaggctgaggccagaggatcgattgaacctgggaggtagaggctgcagtgtgctgtgattatgtcgctgcactccagcctgggtaacagagggagaccctgcctccaaaagcaaatacaaaaacaaaaccctagaatgttgaggaattgagagaagttcaatgtgtctgaatcagagtatgaggcagggaatatcaagagataagtgattaaaaagcaattaaagatgaataatagcattcacatccacatagagagaatgctgttgaatgtcaaatgagggatgtgaagaaccacctaacgtatgttgccagaatgcagagaaaaggattaaaaatattggccgagtgtgggagatgagagctatctaggggagggaagaatgagtcaacgcaagaatcttaggtattcctatgggaaaatagaagcaacaaccaaagacctaattaaacaagtgtttcttgtgctgaaaagaacttgaagatgaagatcaaaagaatccaccacagggctgggcgcaggggctcatgcctgtaatcctaacactttgggaggctgaggcaggcagattgcttgaggtcaggagtttgagaccagcctggccaacgtggagaaaccctgtctctactaaaaatacaaaaattagctaggtgtggtggcgtgtgcctgtaatcccagctgcatgagaggctgaggcaggagagaattgctcgaacccaggaggtggaggttgcagtgagccgagattgcaccactgcactccagcctgggtaacagagcgaggctccatctcaaaaaaaaaaaaaaaaaaaaaaaaagaatccactgcattccaagaaaaaagaatgacaacattttcacattacaaagatataagaaatagaccatatgagcattcagatagaaaaaagtaagtttcctatgcaggaacaaaaatctctctggccataggcttttttttaaaattttttaatttttttattttttgcaacacccaagatcagaagacaatgaaaccacacgtagtagagttttcagggggaaatgttgggaacaacctcatgcccaactaagtctgttgtctttcaaggcaacagcatatactttcagatttgcaaggcctggtaccatagaccttcccgtcctttcattaacacatctcaaagatctgctactcaaaagagtggtcaaaatgaagatctcagtaatgaggagatcatgatccactttaagaccagcattgttcatgctggacccacacacaggtatttgattggcctccatgtggtctggtcagttctgtggccacgggctgtggtttggcctgcaagaacctccttgagctgctcctcttaaggtctccgtcatttcccggaaagtggatttcttgcatcacatgctttacctcatgtttcagaagaaatgtcatgattgatgaccacatgaaactgatttggctccagggtctgtaatattggccaaactatttacatggttgagagccaatgccgagaagaaccaaacacttcctcttcctcaaaaccagagctgtgtagtgcatcgtattcatcattagcatcaccaagagcttcacatgttttctatgtctttttttttttttttttttgagacagtctggctttgttgccctgggtctgctcttgaaatcctggactcaagtaatccttccaccttagtctcccaaagtgctgggattacaggcgtgagccactgtgcccagctgttgtctgcatctttaagacttcaatggttacctgatttctctgacttttaactaggaaggaatagtaaaaggtctaagcagccacgttgtcagaaagcttcagttcatactgtcctccacctgggacttgtgaatgtccctgtgttacctatggctggactcagtatattcattatgttcatataatgcaaatatttagaagtgaggctgacctgttttttatattttttaaagtaaatctcagaatcagagaaattatcatttccttttgatctaagaagttagtgactcactttagtaagagaaatatttttaaaggcacagaaaaaagactaagaattataataatataagaaaatatttctgactagaaatattacagtataactattgctgggtaattagccctccgcccacctctgaaattactgacttgaacaatgtatttggaaccttcagaaacaaagccaatagtgtataaatacatacattataagacctttattatagggaatttattatgaggaattggctcatggattgtggaagatgagaagtcccatagtctgccatctgcaagccggagacccgggaaagctggtggtacagttccaggctgagtcgaatggcctgagaaccaggggcacttgatggtgtaagccccaatttgagggcaggagaagactgatgtcccagctcaagtagtcaggcagagggagcaagttctacctttccaggccttttgttctggcctgcaatggactggggaaggaacactggggaaagcaatctgctttactcagtctatgattccagtgttaatctcatccaaacacctttacagacatacccagaataaggtttatctattcaggcatcttgtggtctagacataaaattaaccatcacaaacaacatgcatttattgtgctcaagggttctgtggatctggaatttcaacagggcacaggagggagggtttgtctttattccctggtgtctgagacctcagctcagtaagactcaagctggcaatgacttggtagctgggggctggaagcatctggaagctctttcattgccctgcctggtgcctgggttgtcatgacttgaatactaggattactgagcggagcagtcaccagcttgcccagattcagagaaagggggacacagaccccaacctcaatcagcagagtagcaaaagaatttctggccatactttccaaaacgacctggtaataacttgttaacatcggttttctttggctcataggatttgggatggtgttctgtgttgaactgtgtcccgccacccccttccaaattcatatgttgaagttctaacccccactacctcagaatgtgactatttggaaatcgtgtgttaattacttaagttagaatgaggtcatactggagtggggtgggcctcaaatctaataaaaccagtgtccttataagaaggggaaatttggatacagatttgcacactgggaggacaccatgtgaagatgaagggagaggtcagtgtaatgttctgtcaaccaagggatgccagagattgccagtaaaacaccagaagctagctgggaggtgtggaacagacccttccctcacagccctcagaaggaaccaaccagccctgccaacaccttgatcttgcacttctggccttcagaactgtgagacaaaaaatgtctgttgttaaaccatgcagtctgtggcactttgttatgacagccctcgccaacaaatacagatggttttaaggttttttatacttttcatatttttgacagggaacatatatttctttaataatgagaaaaatagatttgatttaatttaatgttttcaatttctttgttccgtaaaaacatgaaaatatgccaaaatctttccatggttgtgtctaggtaatgtgactacaggtaattaaaaaaatcccatctactgaaaacgttttctctaatgagtatgtgtcacccttattatggtgaggaaaagaaggctggaaaagccaccatgggaagtagaaagagcacctgccctgggtcccactccgctggggagtagctctgagtccggctcccagtgtgtaacagggggagtcttcctcagtgttgggagaggcaaatgcatgcatctatgcagacacacacagaatcccggaatccagtatctggcgctggggcctggtgagctgcactttgcctccattctccacagtgtggtttacagcctgtggctgtgattacgagtggtggtggaagatgtcagtactttaagatatacatatatatattttaaaatatctatatatggatatatatattatatctataatatatagattatatatcacctatatatagataatatatatatagagtactatatatatataatctatctatccatctatatgagagagagagagagagacagagagagagacagagacagagtcttgctctgtcacccaggctggagtgcggtggtgtgatcatagttaattgcagctttaaactccctgggctcatgcaatcctcccacctcagcctcctgagtatctggggccacaggagcataccaccatgcctggctaatttatttatttatttattttgtagagaaagcatctcccttatgttgcccaggctggcctcaaacttctgggctcaagtaatcctcctactttggcctcctgaagtgctagggttacaggcatgagccaccatacctggccacaaaaaatatttcaaccacaatcatgtctcttttcatgctgacttacctcgttgaatggccctggagtggtcatggggattttaggactaggctaagggaaagctgacttatggatatatttagtttgatttcagtgaatgtcttaatccatttcagctgctatagcaaaatcccataaactggatggcttataacaacagaaatttatttctcacagttctggaggctgggaagtccaagatcatagcaccagcagatttggtgtctgatgagggcccctttcctggttacaaatggcactttctctcttaatgtcctcatgtggtggaagaggtgaggggtctttctcaggcctcttccatagggcactaatcccactcatgagggccccagcctcatgacctcatcacccccccaaatgcaccaccccttagtagcatcaccttaggggttaggatttcaacctaggaatcttgagggaacccaaacattcaggccatagcaatgggatttacttatgtgctttgcaatcacttccttaagtaggtaagttattcataactatcctggggtgggaggggctttcaaagatagtcctactgaccactgtgcctactcaccaggcttgtgacgtgtgctacgagaagaacactttttgcagagcctaacattggcagtatgtaggtagtagaggaacatttgaaatatatagaaccagcagtctgcaggtatttttccagattttatagctcctatatgaaaaacacttggcagagatttctccaaatttgtcaataattctaacaatttacatgacattatcaatgagttgagaagctgaaataaattattctaaactattaatgttggaaagaactccaaattttagccaaattaaaggaaaaacaacttttattctcactagagaaaataattttaaatctttattttttaggaaaaaagtgttttaaaagagcatgcaactaaaaaagataggaaagggagcactaccgaaatgtcccaggcagttagtaaaaatgttatttcatattttggtgaaaaattttgtttgctgtatttgtcagcgttattaaatttatgctttatgtttttttgttctagatacatatttgtgtttatgattaaatttgcatttgtaagtttgccttctttttcttgtagagagcctccaaaattataaaaacacagagcccctcaaaatctgagtctgacctgaaggagcccagctttcaaatcgatccttgttttcccacaaagttgttatttgagtctgatgctactatttagaattgtaggttctctgtttttccatttcctacagaagaactcagattgagaaaagctatttaccaatcatttccttttaacctaaaaggtttcagtgactctctctagcaagagtttgagggtgcatgctatttacctagtcagagcaaaaccatgattcagagtgtgagaaaatggctctcattttcctaggaagttttcaatataaaaacatgctgtgcttttgaatgaaaagtaaaatttaaagccaatggatggaaatttcttgtaagaagatgtaaaaaacccctagctgtttctattcttgaaaataagagttgttttttcacagggtctaagacttgaatacattttttcgaaatgaatttggcctgttgtattaaggcctgtgataatacgatttcattccttggtgcagctccttaagtaccttccttctgtagccactgtgctttggtgttttaaagttaaaaaactcaggaaaaaatagtcttgggtcataaaattacatttgcatatatggggttttaatttgaagccaggggtttctttgcctttatctctgatcaaagataagcttcacttattttgctgaacttattctgtggtttaaaaaatatttcctgttttaaaatataacagatctgttacagaaagaacataaactaagtatccagcctagaatatttgtcccctttcccctatgctgggatggagaaaaagaaaagagcatgtcttcagaatacagtagccttatgttaaaatgtcagctccatctttcattagctgtgtgaccttgggcaagttacttagtcttctcatctattaaatcatgcgtattaatattcatcttgtgaagttgtgaaaattacatgataaattaaaaacaagaaaacaatcaaaaaaccttttcccatctagttatagtaagtacctggcacaaaaaggaactaagcaaacacttaaaatatgagaaagataaggccttaagcctgctcctgaggagtgtggaatctggaatatggcagaaaagaaggatcaaaggggaagggttaaattatggagcatttgaagttggtgcatttcgaaggaagtggtggaaagaagttgagtgattctagtttggagaaagttttatataaagctgaggagtaagtgataaattacatgtaggggaccactgttatattttcttggttgaattaaagagtagaagttcatttatttctttattcttttattaattcaacaaacatgtagtgaaatgtttaacatgtgccaggaagtttttttagttctggagaatacaaagagaaaggagacccatttctcacccttaaggaagttatagtctactgggaggagagaaacaggaaaaaatggtagatattaaaatgtggggtacaaaagagaaagggagggaggtggggtctgtgagttctttaggtgtcagaggtaattcttgagctgaggtgtctgcatggctgcgaaggtccggtggcagggtgtgtggactgtgtagacattgtaggtagggaactggaatgaacgaagtcccaggtgtacatcagctttgcatgtgtgtgggagctgctccagagtaacagcatgtggggtcagtgatggagggctggcttgcatgcatcagcacaagcccgtgaggggccacgtcagggaataatgacagtggctgtggcagtgactccaagaacaaatagatgtaacctagggcaggggtccctgatgcctgggccacgaaccgggtactgggtactactgctctaggggaaggtctgaaagaccaggtgaaagggtgggatttgaaaattttgggaaacatgatgaaggtggggtttggaatgtgaggcttccaactgtatatactgctcaaattgcatgaggaggtggcgcatgcctgtaatcctagcactttgggcccaggagttcaagaccagcctaggcaacatggcgaaaccctgtctgtataaaaaatacaataaaagtagccgggcctggtagtggactcctgtagtcccagctactcagcaggctgagattggagaattacctgagcccaggaggttgaggctgcagtaggtgccagattgagactgtttaaaaaaaattgcgtggggaagacagctgagacaaggatattaaataagaagacattttataagcctggccatttgaagatataggcttagaccagtagattgtaatttaaattttacttttttattttccaactctttaatctctaggaataactggaaattttaagaagttactatctctgctatggggatggatagtcagacagcaatgttcacaaattactcttgaaacttgatgcaaacaacctgtttaaaaactgatgtaacgagaggaatttcatggatgcaaatgaacacctgtgaaaattcttcggcaagaactgtttcatttagcaacaccaggttagcagtttgagagaggatcttttttgggtctacatgcccaaatttacagactgttttgctacttgaatctgccataatgtttgttgaataaataatctctatctttgagggagctgttgaatttttttacaatcaaaatcctgaaaggaatacatttagattgtatgcatctcaatgtgctccgaggcctgtggatgtttgctgttctttttaaagaatttaggcatcttaactcttggcatataaaattattcttaggaacgatatggatataattcaagtgtaataccacctatacatttgccagaaatcacagatatatatgtgtgtgtgtgtgtgtgtgtgtgtgtgtatatatatatatatatatatatatatatatatactttttctcatttctagtaacaatgaaaatcctgtaactttttgctacagatgaaaataactgggatcatgaatgaaatgaccagatggttgccccatcacctaacagtgaggtgcccccgcttgaaatgttgcccccgcttgaaatgtttctggtttctttttttttttttttttcgagacagagtctcgctttgtcacccaggctagagtgcagtggcgcgatctcggctcactgcaagctccacctcctgggttcacgccattttcctggctcagcctccctagtagctgggactataggcgcccgccaccacgcctggctaatttttttgtatttttagtagagacggggtttcaccgtgttagccaggatagtctcgatctcctgacctcgtgatccacctgccttggcctcccaaagtgctgggattaaaggcgtgagccaccgcgcctggccaacatgtttctggtttcttaagactttagtatattgttcttaacatttatttgggatgtatttgcatttttggaagctgaccagtttctacacatatctaaatgcctccttacatttgacagtacatttaacatgctaaagtacttttcttagatatgatcaattttatccttgaaataagcctattgggagccatggacaccagctcattgtggtgaggacgctgaactcaatggtgcagatacagtggtgaaggagacacacaccctgtggtatggtggagtagactcctaacagaccaaccctgccacaaatatagcaactataaactggacaaactaccaaaagtaactacttaagagacctgggaagtgagcaaatgcaggcagaggggagttgaatcttggaggagagtgtgagtttcctgtttttcagccttgtccaaaagatgggccctggtcacaaagtgtctgggggtggctaaaactcccatagaaagactgccatgtttctggtctagggaaccaggggctggagcctggggcaatcatggccacgagagtgagggagaaatcccagagaggacagagccagagaagggggcacccaaatgctgtatctgaactctgcccaagtctctagctgacccgtgaaccacatgcacacaaaccagattcaaagccacttgcagctaaggtttggagtactgaattgagatttgaatggccactcaccatgagagacatggagtttacagccttcagtgtaaccaagtcaattgcttgttaaaacaaagtatcaacagccttggaatgaatacaacagaatttagagtcttgacttatgaaacatccaccatgtccaaaactactcaaaatatgaaggaccaggaaaatgtgatgtattggcaacaaagaagttaataaaaagaggtcaatttcagatgaccgaaatgttgaaactattagtcaaggaatttaaagcagctattgtgctcaatagagtgaaaaaaatgctcctaataaatgagaagataggaacttttaggaaagaaatggaaaatatataaagaaaatatacaaaaaggggaaattttagaactgacaaatacaatacatgaaaaaaaaattgctggatgggctctaatagcataatggagatagagaggaaagaaccagtgaatttgaagatagagcaatagaaattgtcccatctaaaggaggaggagaggaggaggggggcgggggaagggagtgagaaacatagagagcctcaggaatgtgtggcacaatataaaaaaaactgatattatggatagttaaaatatcaggaagagaggagaaaaagaatgggatggcaaatatttgaaaaaatagtggctgaaaacatcctaaatttaataagatgtttacattttctgattggataagctttgtgaatcccaaatgggataaatacaaagaaaaacaaactagacacatcatagtcaaactactgaaaacaaacaaaaaacaaagaggaatcttaaaagcgtaaataaaaatgacacattttatatataggagaataatgatttcaatggttgtggacttctcagcagaaattatagaagtcagggacagtcgaatgaaattgttgaagtgcttaaagaaaaaactgtcagcttagaaatctctgtctagcaaaaatacccttcaagaatgaaagcaaaatgaagacatcttcagatatcagaaaactaagagaattcatcaccagaagacctgcacttccagaagctaaagaaagttgtacagactgaagggagatgatatgagaaaaggaataaaaagcataaaaaattataaatattggagtaaacatcaaagaccaattttcctcttaatttctttcacatatgcacaactgtataaaggacataatattgacttaaggtttatatcacatgtagatagattttatggcagctatggcataaaagatggtggcagtgttggtggtgtggccggggagggtaaatggaccagtaaaattgccagtagactgagaagttaagggattatattatagtctctagaggagcttctaagaaatcatgcaaaagactaaaagaccaataggtaagttaaaatgaaattataaaaatattcacttaatccaaaagaatataggaaagggagaacaagagggactaacagcagaggagacaaacataaagcaaataataaaataatacagcataaccaattagttttatcccaggaattcaaggtttgtttaacattagaaaatcaatataactcaccatattaacagaataaaggagaaaaaccatctgatcattttcatatgtagataaaaaatatgacaaaatttgatatccatttataagaaaaattctcaccaaactgactatgaaggacttcttcaacttcataaaaagcatctatgaaaaacctacggtgagcattatacttaatggtgaaatattaaatgatattctaccaaactcagaaaaaaggcaaatgtgctcattttttttaccacttctactcaatattgaattggagcttctagccactgcaataaagaatgataaaatgataaagattggaaagaaggaagcaaaatcgtccttatttgcaggcaatacgattgtttacatatgattgttttctacatcctaaggatctaaaaaataattagaagtagtatattattccattctcacactgctataaagaactacctgaaactgggtcatctttgaagaaaagagtcttaattgacccacagttccacaggctgtacaggaggcatggctggggaggcctcaggaaacttacaatcatggcagaaggtgacagggatgccagcacgtcttcacatggtggcaggtgagagacagaacgaaggcggaggtgctacacacttttaaaagaagcaggtctcatgagaattccatcacaagacagcactagaaggatggtgctaaaccactagaaaccacccttatgattcacctttcaccaggccccacctccaacactcagtatcacaattcaacatgagatttgggtaagtacacagaaccaaaccatatcattttgcacctggcctttaccaaatgtcatgtccttttcacgtttcaaaaaacaattatgccttcccaagaatcctccaaattcttaactcgttccagaattaactcaaaagtcccagtccaaagtctcatctgagacaaggcaagtactactcctctgcctatgagcctgtaaaataaagaaacaagttagttagttccaagatacagtgcaggtacaggcatcgagtaaatgctcccattccaaaagggagaaattggccaaaacaaaggggctataggcctcttgcaagcaaaacccaggaaggcagtcatttaatctccaagctccaaaatactctcctttgactccatgtctcacatccaaggcacactgatgcaaggggtgggctcccaaggccttgggcagctctgcctctgtggctttgcagggtacaacccccaaagctactttcatgggctgggattgagtgcctgcagctttttcaggcgaacagtgcatgctgtcagtggatctatcatcctggggtctggaagatggtggctctcttctcacagctccattaggcagtgccccagtgggaacttggtgggagctccaaccccacatttcaccttcacactgcccttgtagaggttcttcatgagggatccagtcctgcagcagacttctgcctggacatccgggtgtttccatacatcctctgaaatctaggcagaggctcccaagtctcaactcttgccctttgcatacccacaggcccaacaccatagggaagccatcaagacttggggcttacaccctctgaagcaatgacctgagctgtactgtggccccttttagccatggctgaaacgggagcagctgggatgcagggcaccatgtcccaaggctgcacagagcagtaaggccctggacctggcccacgaaaccatttctccctcctaggcctctgggcctgtaataggaagggctgctatgaaggtctctgaaatgtcttagagggattttccccattgtcttggctattaatatttggctcctttttacttatgtaaatttctgcagctggcttgaattacttcccagaaaataggtttttcttttctactacatggcaggttgaaaattttccaagcttttatactctgctttccttttaaatataagttccaatatcaaaccacctcttcggaaatgcatatgagcatatgctgttagaagcagccaggtcacttcttgaatgctttgctgctttgaaatttcttccaccagatactctaaataatctctctcaagttcaaagtttcacagatccctagagcaggggcacaatgccaccagtctctttgctgaagcatagcaagaatgacctttactccagttcccaataagttcctcatctccctctaagacctccttggcctggacttcattgtccatatctcactatcagtattttggtcaaagccattcaacaagtctctaggaagttccaaactttcccttatcttcttgtcttcttctgagccttccaaactgttccaacctctgcccatccaaagctgcttccacattttcaggtatcttttgtagcaatgccccacttctctgataccaatttcctatattagtccattctcacactgctataaagaactatctgagactgggtaatctatgaagaaaagaggtttaattgactcacaattctgcaggctgtacaggaggcatggctggggaggcctcagaaaacttacaatcatggcagaaggtgaaggggaagccagcacatcttcatatgatggcaggaactttatatgttatagaagttagccccaagaatgaaatcgtgtcctttgccaaaacatggatggagctagaggcctttatcctaaggcctcgattctgtcctcctcgtcctgcatctccagagcacccatccactcctcaaagaggtcgcttgaaagtagcttccgggggatacttctgaggaagtcctgggggatgagagtgggctgttggcctattggtactgtatgatgtcccatgtccttgttttcacccggttttcgttccatcgcagggtgctctatgcttagcccatcatagattgtggcccttcattcctgcatttgatgaatccagggaaccctctctccaacacccttggcctctctgcaactttctaacatcaggcagagtcagaggcaccatccccagaagctacaaatcttcagcattctccactctgtgaagtcagaggaatggcgggaccatagctctgagctcattggcaaatacaactaatttcaatttctggaatggaagcagtcagatattcttctgactgcacgcgtatgtgggagtgccatgttgaagagtggaaaatatggaagatcagtccctacaaacttaataggagaatgacattcagatttcccgagtattttgcatgtccaactgaaaactgaagtaggtttatgagagaatgcacgcctacctggatgggtctggggagtgtgtcactgtcaccgcagataattgacaagggctgatcaaatagcgatgctttcaagtctgtctccaaagccccagaaaaatctgatgcaggggagagccttctcatgagaaagggccaggacagcaccttctttctcttcttaacttctacagccaagaaaacaaggcaacgagaaaaattagactacagtgttaagaagcaaagatccaggtgactggtcaccttgggttttccaggttgctgctttaggacagaggcaaatacgaatcgctgcgggaagccttgaacctagatctggcaactgggaattatcagcaaaacgttatcaagatattctgtccttctgaaatccacaagatgtgtgtgcaatggatattgcaatctcaaacatttccttctttcttttcttttccttccttccttccttctcctttcttactaattataaaggctatattttctaaatgcattggcatctgtttctatacatttcagattggcaagtggaagcatgatgagaaagaagtggcctgtctttatggttcaggagaactgggtcagggttacgctataatgaaatgcattatgaaaaaagttgagagtgaatggtgggtcctttgggatttgagatcagcaacagttgcttcataggctcttggatgcattctccataagagaaggaagaaaatggaaaagacactgtgtgtttttcaaatgtgtgcatgctaattgtcgaaacatacatggccaggagattgaaccgcattaaaaacgcttggcagaactggggattctctatggagaggctctttcctttcccagcactccctgctctagtgagttggagcatacctgccatttaagggttaatgttctgcggtctttaacagaacaacttatacaaaaaaattcctagtagagtaaaagcgctgtggttttgcaaaccaagagcactggttgttagcacttacataaaagatcggtatgtttttaaaactcaccaatgagctggcaaatactgtcttcactctcacatgatgccaacaggggatgttccttgatatcaccctaaaaacatttttatttcagttaaatatagtgactgaagaaacctatcgagtctttccccacaaaacacacatacagcattttattcatattaaaaatgaagtcagtagagtgcattgatgttttttctagcttctagaagcaatattaaggtcttgattgtcatcatataagatcctaattaatgtgcttaatttactacatgtgtgatgttagtttactactcttataattactattcaacccaaataatattcaattaaaacaaagttttccaccttctcacagtacagataaaaagtcttaaaaattgctttcttacctctgattgacattcgattagtgtctccatattattggcgtttagtgtttttgactaaaagagaaaaaataaaattaggtaaatatcttttggcccttgcctgtaggaaacgtgaatgaatgaatgtgagaggggcactcacagcattgtggctgcttctcagcttcatcagtattgcggctgactgtccaggggtggatttcactcccgtgtggctgtgcctctgtctacaacgaatcacatggaaaggagttaggagggactcacacagtaggccactttcagcgccactttgccaaagcacagagtttgaaactatttatttatttttctcttttgctattttttcacttgcctttactttggaaaaaactattacatagacaagttttcatttaaaatcagttctgttaccagatgttgtatgttgttaagagcagcatctgaacacaattatttctaaattatttaagtcaactatctttaccactctaaacgttgttaccaatttattccgttccatcaagagataatctggatatcaattacgttaacattttaaattaacatgaacattaacttttttggtggagtgctgactatatgccagctgtcgtagtaggtgctttgcatggattttctcatctaatccaaaaaggaaaaaaaaaaaaacatatccctaggatgctaaaatagtaaacatgaaacaaagataacatttacagaactcctacaccaaaaaggtgcagccttcacgttgaagcaaagctttgtcctgagactttataaagtgagagcatattccacgggatagctgttttctgttgcctgtgatctgagtgacctgtgacttgcgaggcagcttgtaatttctaggcatgttaatatatagtgtacttacccttggagggtctctagccagagttcttttacatccggtgagctgtaaagaatgggagaaacagcataactctctgctccttctagtccactgggagagagagagaccgagccggtctcccttcacatgctctgcattataagcgaaggggcgggcaggtggaaattcagaatattacagagaccggaaagaacatcatgggctgtcacacggacggagccagccagacactggagagctctcgcttcctcattccttttagggcagctatgtctttttttttttttttttttttttttttttttgtgtcttccacttcaaagtaaaaaatctgtaaactactaggagtggaaaacatgacattcagcccataggtgaaggctctgattaatgtcataggtgggatgtgtgaacaagaaattgtgttattctgtgcataaacatcactttattttctaaagtggtaatttcaagtgcctctttttgcatcctgtttgggtgctctttcccctcccacgtgccatctgctctgtccaccagcaccacacgttgattagcacccctggatgtgggacactgttacagaaccagaaagaaacccaagacagtcccttccttgaggaacaatcaccgtccaaagccaggttagtttcctttggaagtagaaagaaaactccctcgagtcagttgtcaatatagtaaccccctcctcctttctgtaactcctggtcaaaagtattgatacttaatttacagtcagagcagctgtcgttctgacacggaaggaaaacaaacaaaaaaattcctttgatcagaccaacttaaagtaggaaagagatggtgaatttcatttgtggatcactcttctgcataagagaatttctgatcttttctgtagatcaagggctatatatgaaaccactcaaatgcctcgacacgagaatggatgcataaattgtgatccattcacatagggaatgaatgttgtatagcactgataatgaacagcctatgactatagccaacaatatggttggatctcataatatgacgctgagcaaaagaagccagacgtgaaagtgtatatcctgccggctcccattaatgcaaagcacaaaattagcaaaagtcgtctgtgctgttggaagcaagagtagcagtttcccagaggggatggtaatgacttccaggggccagcggggggcttggtgatggtccattcttgatctgggtggtgctaggcttatgtgcacacttccctatttatgtaatttttcaataaaaagttttaaaataactt

SEQ ID NO: 3396 - DNA, 557 bp, Homo sapiens
aatgcaggtttaaaacataaccaaaagaacaaaagagagagcttgacacaccaatcttgaggttatcacgctataatagagaatggactcattaatatgggattacagaggaaggaatggttaagaaaaagacatggcctctgactgctccaaaaaaggataagcagggcttcacagaagaggtgacaggtttctggatggcagatcattcaaccttctttttcttgagttttctactctgctgtcatcttccactcatttctgcttcattttgtgattcgttaacagaaaaggaagtggaatggaataaaatcccccaatacagtacaattatacattaatggctgtaatgtgaagagcatcacacacgaagagagccatcttccagaaataagtttatacactctctcctctaattgcatcaggactttaccagataatgttcttccagatctgaaaaggaaaatgcctaaaagagcttccaaactcatttttgaataatactaggctacaaagaattacactgtgaattcattaagggtaacaccaaatcacta

SEQ ID NO: 3397 - DNA, 685 bp, Homo sapiens
cagaataccacagtctggaggctatgaagtccatgattaagaagccagcacgtttgctttctggttccaagatggcatacctttttgctgcttcctccagagaggaggaacactgtgttctcacatagtagaagatggaaggagcagatgcagatgagcatggcaatgtgagaatatgtcagaggccccaggatgaaatgagctcaagtccctgaaatccctgttagaagagtctttccactggttgggaatgctaattgtattttgagaaagaaaacagaatttgtactcatatcagaaggcaatcaaagaacatacacataatatacattctattatagaggagaagaaatgcttactgccaataccatgacagataacaaattatcaggcatgtatcttagcatgcagagaagggactgaatgaatatgcccaaagatgtgtaacactcattgtctctggggagatgaagaagaagtatggaagaagtaagatgaagaagaagtatggaagaagtaagttgtctgtgtaacctcattcttcctggacatgggacaagaacttgggacccgctgaatgatgggagcaaaaggagctgtatcatgttcctggccagctggctaaactgcagatggtgacatgctcccagactgtgggagtgaagagtggcaacccttctggcgg

SEQ ID NO: 3398 - DNA, 2280 bp, Homo sapiens
ggagaaggtcggattgtagaagctggggtggccggcagctcgctcatcggtgttcgtgggctttgtcggtccgtgcctcgtctctccctggaaagggagggaggcttcaacgtcgagagggagccgctgccgcgttagttccgagcttgaagtcactaggacttctctcaaacttgagtgctgaggagactcagatgttggcctcagctcctaggctgaactcagcagatcggcccatgaaaacttctgtattgagacaaaggaagggatctgtcagaaagcaacacttgttatcttgggcttggcagcaaggaagaggacaggtagtggagatcctgcaatctgaaaagcagactgaaaggtgacaaagaagctgaagatgggtggtagagagaggtataacattccagcccctcaatctagaaatgttagtaagaaccaacaacagcttaacagacagaagaccaaggaacagaattcccagatgaagattgttcataagaaaaaagaaagaggacatggttataactcatcagcaggtgcctggcaggccatgaaaaatggggggaagaacaaaaattttccaaataatcaaagttggaattctagcttatcaggtcccagcttactttttaaatctcaagctaaacagaactatgctggtgccaaatttagtgagccgccatcaccaagtgttcttcccaaaccaccaagccactgggtccctgtttcctttaatccttcagataaggaaataatgacatttcaacttaaaaccttacttaaagtacaggtataaaataagacaaatgtttaagtttagttatgttcacagatagttgtcaattggtctgaaacaaatttgctagggaatctatttgtgtagaactaattaatgtaaaaaaaatagacttcatctcgtgttgtgtgcactgtgatataatggtagtatcagtgcaacttaaactaatgattgtaattgatattaagtgttctcaactgagtaacttttaagtggaaaccaagtttagatttggggagtggtaaaggaatcagctttttctattgttaggggaagatagtaatttatcattcatggaccagtagattgttgaaagttggtgaatcggattataagcttctggctaacacaaggattcagaattaggtaaacatctgaaggtttagtatattagaaacacccaaaccagtaatatgctaacctgatgcactgctgaaagaaaatgtgaatttttcgtaataattgcattttagtgaattgtacagtgggtggaaagggcatttggagctcattagaatgagacatagtacaccccaatggccctgtttattaaatgtagtggattaagtgtctgtcaacaaatacaccaaaaccattttttatagaaacagtatttaatggtcactcaatagctttcaaaatacatttttgtattacagcactgcacaagctattctaatagtgatctggcctcctcattcctgccaagcttgctttggggagttggataatgtgaaaattttaagtacctaggggagaaagagccatgtaaatatctgtaataaacttgtagcatatgtaaagttttcttggcctttatcttacaaaaatggaatattttagtatgaatttgctgaatgtaagaccgtggactgttttttataatatggcctaattttaaaggtccaaaataacttgtttttaaagtttgcccttgtgctaaagtgccagtgtatgtatgttatacttgatttggttgtaaactatatttcaaagtaaaccctagtgtaataagttttataactaaaaaggtttaagctgctaaaactatttttaagagatgtgaaatgcagtatgggactatctttttttcctcctctaagcccaaagattaactagagtccctccaaccttatagatttttggctttcacaatcttataacctaggatacaggtagtttcgagtatggtgccagtgatgttttgtttttgtttggtcaaggggtaggtgcaacccaatggaccacttatgcaaaagatgtaaactcttgcataatacatcgataacatgttttgccaactttaaatgcttaaacataagcgaaaccagtagcaagtatgtgggtcagtttaaaaattttgattgttaatgccctattttctaatttggcacctcttttgatgcctaagcaggtaagcagatgcctaagctgtatttctccaaataaatcaagaggaagtactgcccaagttaaat

SEQ ID NO: 3399 - DNA, 350 bp, Homo sapiens
cgtggaggtgtctggaactagcagaggtggtgagtggggcaggtatccacctaaccaggctgcaggggaggaggagggaagccgggaatggggtaggaagaaagctagaggtggcctgcaagctgggctggggcccccgccggcggccaccataaatactatgggagtttagccaatcccgagctccgctgtgtcttgtgctaaacattcctttctctccgtgcctctgtctcccctctgtcccccctcccaacctccctgtcccggccccctgctaatccgacttctcgccatcatcctcctggtgggtgtcaccatcgtgcccgttcttgtcttccttggagaggtgg

SEQ ID NO: 3400 - DNA, 2751 bp, Homo sapiens
agaaaatgattagagctgataaattcagtacagttgcagtatacgaaatcaacatacaaaaatcagtagcatttctgtgtgccaacagtaaacaatatgaaaaaaattagaaaactaatcccatttatagtagccacacatgaaattaagtacctgggaagtaaccaaagaagataattacaaagatctctgtaatgaaaactctaaaaccctgatgaaagacattaaagaggacacaaaagatggaaaaatatttcatcttcatggatcggaagaatcaatattgttaaaatgtccatactacccaaagcaatctaccgattgagtgcaatccctagcaaaataccaatgacatttttcacagaaacagaaaaaaaaaaaatcctaaaattcatgttgaaccacaaaagacccagaatagccgaagctctcataattgaaaagaaacaaactggaggaatcagattacctgacttcaaattatactacagagctatagtaaccaaaacagcatagtactagcataaaacagacacagaccaacggaacagaatagagaatccagaaacaaatccgcacatctacggtgaactcattttcgacaaaggtaccaagaacaaacactggggaaaagacaatctcttcaataaatggtgttgggaaaacttgatattcatatgcagaagaatgaagctagattcctcttttgccatataaaagttaaaaaaattatgttaagtatcttctctgatcacaatggactataactaaaaatcaataacgaggaattttggaaactccaccaacacatgggaattaaacaatatgctcctgaatgaccaacaggtcagtgaagaaattaagaatgaaattaaacaatttcttgaagcaaatggcaatggcagcacagcatacgaaacctgtgggatatagtgaaagcaatactaagaggaaaatcaaaaaagtagaaaaacttcaaataaataacctaatgatacatcttaaagaactagaaatgaaggagctaaccaaacccataattttaaggacagaaataataaaaattagagcagaaataaaatggagttgaaatgaagaaaataatacaaaagatcaatgaaatgaaaagttggtttttctaaaagataaattgacaagctttcaggcaggctaagagaaaaagaagacccaaatcagaggtgaaaaagtaggcattacaactgatattgcagaaattcaaaggatcattagagactatgaacagctatatgtcaataaattgggaaacatggaagaaatagataagtttgcaggctgggcgtggtggctcatacctgtaatcccagcaccttgggaggctgaggcgggtggatcgcttgaggtcaggagtttgagaccagtctggccaacatggtgaaactccatctctactaaaaatacaaaaattaaccaggtgtggttttgcgtgcctgtaattccagccacttggaaggctgaggcacgagagtcacttgagccctgggagggggaggttgcagtgtgctgagatcatgttactgcactccaccctgggtgaaagagtgagactgtgtcttcaaaaaaagaaggaaaaagaaatggataatttcacaggcacatacagccttccaagtttgaaccatgaagaaatccagaacctgaacataccaataacaggtaatgagattgaaactgtaataataaaaagtcttccagcaaagaaaaaccccaggacccagtgacttcactgctgaattttaccaaatatttaaagaagaactattaccaatcctagtgaaactattctgaaaaatagaggaggagggaatacttccaaacttactgtagaaggccaatattaccctgataccaaaaccagacaaagacataatcaaaaaaacaaaacaggccagtatcccagatgaacattgatgcagaaatacccaacaaaataccagcaaaccgaattcaacaacacattagaaacatcgttcatcatgaccaaagtggggtttatcccagggatgccaggatggttcaccatatccaaatcaatcagtttgatacatcatatcaatagaatgaaggataaaaaaccatatgatcatttaaattcatgctgaaaaggcatttgataaaattcaacatcctttcatgataaaaaccccaaaaaactggttatagaaggaacacacctcaacgcaataaaagccatatacaactgacacacagctagtatcatactgaaaggtgaaaaactgaaagcctttcctctaagatctggaacaagacacggatgcccactgtcaccactgttattcaatataataatggaagcccttgctagaggagtcagataagagagagaaaggccgggtgcagtggctcacacctataatcccagcactttgggaggctgaggtgagtggatcacttgaggtcaggagtttgaagcctggccaacatggtgataccctatctctactaaaaatataaaaattagctaggcgtggtggcgggtgtctgttgtcccagctactcgggaggctgaggcagggaaatcacttgaaccccagaggtggagattgcagtgagctgagattgtgccgctatattccagcctgggctatggagcaagactccatctcagaaaaaaaaaaaaagaagaagaaataaagggcatctaaattggaaatgaagatgccaagttactcttgtttgcagatgattgtt

SEQ ID NO: 3401 - DNA, 863 bp, Homo sapiens
gttgtacaggctgaactcaaactccagggctcaagtcatcctcctacctcagcctctgacgaagctgggactccgggcatgcaccaagaagtccaggtttaccgcaacagtctgtggaggaggaagagtctgaaatggcaactggaccaaagcttctgcagctggaagttcctcttctgacaccaaagcattctgcaccaaaacctggccctgggacagaatttcaggctgcacttgtaaagactgcatagactgcaagggcagtggtggaatctgagctggaggagatgtcgacatctgtggaggacttgcaattgggattggagaggactgcagggatgaatattgctggtgtgatggagagacaatctgctggcctggggataccaaggcagactgctgaactgggccaatgtgtacaacaggggaagctggaagtggaagatgggatggaagattcaactgtgctgtagcttgcacctgattagcagtggactgctgcaaatttggccctggctggagagctgatgacacaagagggtgtggctgaataagtgcttgtggatgaataattatagtaggagactgacttggtgaatgaggtggtggaggagacaccactacagactgctgtgctgactgtgactgattaggagacactgttaaaggagagggatgactctgaatcggtgaacaatgctgtgactgggcattactgggagctggaggaaggccatggttctggagtggtatacagtgctgggatgggggtgggtcttgagttgaattctgaagtgtgattggctgaatttgctgttgctgctgttgtaatatcagctgatgatgggaaactttggaaggtg

SEQ ID NO: 3402 - DNA, 4025 bp, Homo sapiens
gcggccgggccgtgtcctgctcgcacccgagcgcgcgctcctccctcgctggagccggggggccaggggccgcacccgcaggtggggtgagcagggaatccgcaggtggggtgagcagggaatccgcaggcttcagcggcgggggttgaccggcagctggcgtcgagaggcgcttgggaaatggggtctaatttattttagaccctgtccccgactgccgcgccctgactggcaccccctttcttaaagggtggtgggctcgaggtgggtgaggttccggttaagcaggagccttttcaggttgaaggagagtgggtcacccacttcccaggacacggagatgagatctctacgacagggaggcagatggaggcttttttgtccctgaacccttgcctctgagcattcctgggtacagtcccatcctctcaaaatgcacccagtgcagagggacaaccgtattcgggtcttttaatactccatcttgttttgttcaccacaatttaccccgaccacttgttaggaagcctctggccccaagtgaaacggacgcttgaacttgctccggatttttaccagcatccccaagatacccaaacagatacagtcctggcagggggttttcagtgaggaacgtctgtgacaaaggaaaatgttgccctgttttggtgaaaagcagagtattcttcaggaggagaagtgatagttctcctcttgaagtgggtctggagtgcctgcaaagatgccttactcctgcccctctccttgcaagacccacccataggacctgctcaggcaggctgacaacctcagctggcagtcccgggtaggctcaggcttcgggcagtccccagcctatgctggctgcccgttggggtttggttttcaaatgtagtcatatgtagtctattgttttagtcaaaagtgggtaaactatcaatatcaaccatatctgtccaatcaactggagttagatgaccccaaatagtcaaacagttaccaaagtagaagaatcacaaggtttcggctagcataatattgtttttttttttttttttgatggggtctcactgtgtggcccaggctggagtgcagcggtgggatctcgactcactgcagcctccacctcctcgggctcaggtgattcttctacctcagcctcccgagtagctgggactacaggcatgcgccaccatgccagcctaatttttgtatatttggtagagacggggttttgccatgttgtccaggctggtctcgaagccctgagctcaagccatctgcctgcctcagcctcccaaagtgctgggattacaggcatgagcctggccaatattctggtttattaagcaccatctttctaacctctgccctttataagtcctcctctagctcctaagataaaggctatggactgaatgtttgtgtccccccaaattcataggttgaagtcctaatccctaaagtgatggtattaggaggtgattaagtcatgagggtagagccttataaagggggccggtgggattagggggaagaataccagcccacaaccttttcaccatgcaaggacagaaagaaggctctgcctaatagccagacactgagtctgcaagggtcttgatcctagacttcccagcttccagaactgtgagcaacacatttctttttttcttttttcttttttttttgagatggagtcttgctctgtcatccaggctggagtgcagtggcatgatagctcactgcaccctccacctccagggttcaaacaattcttctgcctcagcctcccgaatagctgactacaggtgtgtgctaccacgtccggctaattttttgtatttttagtagagacagcgtttcactgtgttagctggatctcctgacctcgtgatccgcctgcctcggcctcccaaagtgctgggattacaggcatgagccaccacgccaggccagcaatacatttctgttgtttagaagccacatggtttacggtagtgtgaattgttacagctgcctgggtaggctatgagggtccaccctgtctcacttcctaaattgactttggtttcaccttactttatgtccttggaagtgctagaaaagtgcatatcccaagggcaaagatttgcagcctgcctgtccctggtctgcagtctttctctcttgctacaaagaggccccagagggccaagaagaagatggaaagaaggaatgagtcagtcatccaagaagtctttattttcccacttggttactgttctggagcttgtaccctctgagctctgagatggggttggggggacagtgccagggagggcctgtggggctgtgcagttgcttccctctgggctggctctgagcccagggcaggatcaggcacttgagagccccccaccgagcctcattggcatagacagtcgtgcctctcacagggctcaggggaggtggaggtgtgggcaagtccatccccaaggctgtaaggaaggagcagctcctccataaggccaagcagaagcattagggaaatcatcctcagttttagcactgcgtgttcttcaggagagaagtcctgagtgaggaggcccagctgttctccagatccaactcctcgggggtttccacagagagctggtatcaaggcagctgtcaggggcggcgtgcctggtgatgcggcatcttaccttcatccccatctcagaatgggcagccagtctcagattcaaggaggaggaatcctgaggtgtggcgttcagtcctgaggtagacctgaggtcccctggaaattgtgttgatgctgagatggatgaggggtgctcattctctcaggtagacagtgaggagtcctggttcagccgagcctccatgtctgcatggatggttatgaccctgattgtttttggaaacagccaagctctctaggtgtactcagcaaatgcaaggtatagtgggtcctgcatacccagggtattatttgagccatggaagcaaaacagagactgcttagcctccctaagagtagttggtgggagtggccagcaaccatggaggcaggagcagctcctctttgcctctgagtagtccccacatgttccctcttccagagatttcaactgccaggcctggtcacctctgtagcctactcttatgacacatgggtggaggcaagggtaaccagagtccttgttctttcttttgattggggtcatccagcccttccgatgtgtggtcagggagcagagtcactgataggatgttgagacttggagatcaggaccagacttttccccattcttgcatctggcctgtgcttgggcaggacctcgggtgaaggatgatcttggaatcacccttttgtcagccccaggaaggagtggctggagtggcttctagaaacttctctcattacttttccctcatggcagctaagcacttatgttcatgttatagaacaggaaactgaagctcacaaagagtgtctcagagaacaccaggacacctgggcttctttctttgtctgtcataaatgccagctcctgtctttaagttcagagagacattggaggttccccttactgtccatctggggccaacagaggaagcagaggagtggccagtgttgaagacctggaatccggccccttgtccttactgctgctgcttcctgtgactgcaagcaccactaaggaggcactccttccccacaccaacccaaggggtacccccagatcactcggcccactttccccagacccaccttcccaggcttgagggaggtaggcacctgggccaccggagggtggcaggggtcaggggctgggttcctcaggcagctggcctgcatacagggccaaagtgtggtgcaggaactggtactgctctgccgtctggatcatcccccctctgcaaggagaaacacacagaccatgagtgaaggagggtcagggtgctggctgaatggctccagtcaaacatccctgtggtcctactgggaaagtcctgactttctcaaagaacatgcc

SEQ ID NO: 3403 - DNA, 549 bp, Homo sapiens
atgctggcttaccactcttctctcatggatcctgacatcaaactcatcggaaacaaggcactgttgcctatcagaagtcaattcaaacgacctgcccccagagagacaaaagatacagatattgtggatgaagcatctattacttcaaggccaatatcttcttcaaaaactatgaaattaagaatgaagctgataggaccttgataatatataatgatatatataactctctacatttctgaatgtctgaagaaactccaaaagtgcaattccaaaagccaaggtgagaaagaaatgtatacactgggaatcactaattttcccattcctggaaagcctggttttctacttaacgcaatttatgccaaacctgcaaacaaacaggaagatgaagtgatgagagcctatttacaacagctaaggcaagagactggactgagactttgtgagaaagttttcgaccctcagaatgataaacccagcaagtggtggacttgctttgtgaagagacagttcatgaataagagtctttcaggacctgggcagtga

SEQ ID NO: 3404 - DNA, 1164 bp, Homo sapiens
aaaacattctttttttttttttttttgagatggagtctcactctgttgtccaggctggattgcaatggcgcgatctcggctcactgcaacctccacctcccaggttcaagcaattctcctgcgtcagcctcccgagtagctgggattacaggtgtgcaccaccacacccagctaatttttgtattttttttttcgagatggagtctcactctgtcacccaggctggagactgtctcaaaacaaaagaaaacaaaaaaagttggtctcctctgcaaagacttgaacactaatctggtggaaaggcttcctttccctcgttttctcttctactaatccctgcttccaaattctctttctcttgtcccttgaagaaccaacaggatgtgcgatatttcaagaacgtaatgagcaactcctctttcacaaagggaataagcaatctggcatagcttggagtctagtattacggaaatacagtgatatactgaagactacacaccaaaatacatccattcctttagctgaagtctcaaacatgttgggactgttgccatggaatttcataaaaccttttttcctgagacagacgccatgccacaaagaaggataagccatttgtgcagtctgaggtggaacattttaattactggcagcacatagacgagttgagttggagccgaatgcataagccccttagaaataaaacactaatctaccaggaatttgggattcttggctctggtagaaatgttacaaattaagctgactcttaatttgtaaataggctccatgaagttgtccctggaagcagaatttattttccctaacataatttcttaaaaagtaaaaaaaaaaagaaggctttggcaaacagctgcatgtgccaatttgtgtgtatgctttgtggcaagatcaaaatacctttctgttttttgttcctctccaccaccttcttcacattcacaactcagtggttaaaggaaaaacttaacacaccattttcataccaaaggaatgtgaaacatgtattcatataaatactcttctgcttaatatccatacattaggaggtttaaaaaataccttgtggttactgcataatcacatatgaattaaagctagaagggacctaagagaacattgaaatctaattcctattttatg

SEQ ID NO: 3405 - DNA, 507 bp, Homo sapiens
gtgtaatggaatgcaaaaaagccaagccctccgcctagaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaa

SEQ ID NO: 3406 - DNA, 12707 bp, Homo sapiens
cttccatttcccagagaggccagaggcagaggggtgcagaagagagagcagagcccctttgcctgggcacatctgggctcactacatgggaaagggccccaggacaagggaagacgagaagagacaggccaggcccaaggagggagaggacctgagatcgaagataggagagaggaagacaagaaggagaagcagaaatgagaagttctgggggctgagaagtccaagatcaaggtgctgccaatttggttcctggtgaatgagcaaacagcacagaaaaagaaacagcagtatatgtggaagaaagcaagaaaaatcaactggcctggaacctaagacttgtccaaagatgtcacagagagtaaaatgagaaaaatccagtagcccgtgcccagagcagttcctcgtacccagcagaaggctaacaagccctgagatgaatgatgctcttcccaaggaaggcagaggaggcgacagtccatttgcgttctctcctctgcaagtacaggatctcgtttgattctcaaaaccaccctagaggagacaggaggcacctgaggcccagagacgtgaagccacctgtccaaggccatacagcagataacttattctggaggaagacacctgccatgccgtgaggacagtcaagcagttctgtggagagatccatgtggtgagaaacaggggcctcctgtcaacaggaagaacaacctggcaggcctgtcttggattcagagcctccagccccagtcgagccttcagataactgcacccttggctgtcatctcaactgcaatctcacgacagaccctgagctggaactactctgtttaccaatgcctggcccacagaaagactatgagataaaacaagtatattgtttttagaagatatgttttggagtaatttattatgctacaatagataatacagaatttggtgattttatgattctcaactcctggccaaagcaaagcacacaacaagtctcaaagaaaagtctcacaagtggaattgaaagtacaaagctggccagacaagcttgtgcagacatgtatgtggtggagttgaaaatcacacactacgactcacacaagtgagtaaaacctgcgtctttcttaatttttcttgtactcttctcatctagatctaatgagatacttcctgctgttgacaggcaataaatgaatgaacgacaaaaacaaaacaaaaagaaaagaaacaaaacagaaagaaaagaaacaaaacagaaagaaaagaaagaaacaaaacagaaagaaagaaaagaaatctttaacttgcccactacaggtttctctatttctgcatgttcaagcaaatctcctttcagcaaaatactcatcgttttctccctattccctcttctgctagccagatgtctctcttcctggtgcagggagacatttacagacctcatggtggtgggaagaggagttcaaggtcggtgtggagttctctgcattcttcccacataccttccccacacacaatgggacagggctggtcgggcctggtccctgggatccctggtggcattggtgatggttggggatggagaggggtactgatgaagtgagtggtccccgcacaaggctggtggtgcagatcctacctctgtgttcttgatttctctttttttttttttttctttgagacagagttttgctctttttgcccaggctggagtacaatggcgtgatctcagctcatcacaacctccgcctcccgggttcaagtgattctcctgcctcagcctcccaagtagctgggattacaggcatgtgccaccatgcctggctaattttgtatttttagtagagacggggcttctccatgttggttaggctcgtctcaagctcccgacctcaggtgatccacctgcctcggcctcccaaagttctgggattacaggtgtgagtcaccacacctggcctgtggccttgatttctaccctttccctgggacctaggaccgcctggctgcattctacccctccagaagaggcagagttccgagagccacttcctagactgcttctttagacatttctaaactacctcctgggcagcgccataatgtgttacaccttcctcaatcactgctttcttaaaggagttcactgaaattccccacagctgtcatctgagagtcaaattccacctaccttgtgcggtgaaatttagctgcaaatgtggctggggtgtctcccacacagccctctgagtgtccactggggtgagggacagagctttttgcttctcaccttctctcttccttgagtcctgctgttcagtagctgtatctctccatcccgtcctacctcatccgtcctggatgacttgcttcgattcaaccctacacttacttccccgggcaatgaacgtcaccttagccttcaccctgaagggctacaggagaacgagaattatagaaagtgaaaatacatccctttgctattttataagtgctatttctataacacatgcatacccgaagcacacacacttgcatgcagagacccagagacaagctgattccaagaccccaaacacactagagacacaccacaaacaccctagggctgaactggggcctgctcagggaacccttgcctgtgacttctcagtatcatccaaggggacccacctgctcctggagcctccagggggatcccttgtttactctcaagatgattgttctcaccccttctctcaaaggccctgggagtgaggcaaagaggagggagcgccacctctaatcagatcctcctcaggataaaaaaaaaatcagcaactggagatgcccctggctggtggactacttctttttttttttttttttttgagatagatagatagagtcttgctctgttgcacaggctggagtgcagtggcgcaatcttggctcactgcaatctccacctcccgggttcaagtgattatcctgcctcagcctcctgagtatctgggactacaggtgtacgccaccacgcccggctaatttttgtatttctagtagaaatgggtttcaccgtgttagccaggatggtcttgaattcctgaccttgtgatctgcccaccttggcctccctaagtgctgggattataggcatgagccactgcgcccagctggacttctatagcttctactgcctcctgtccctgcaggctcttagatgggtatctgggctcagtctcctttgctgagcgccagacaccttggtcagctgctccaggactctgtctgatttcccaaaggcatctccaatgcagccatcccaaactgactcatcctcttccccaggacagagacaggcctctctccatcaatccctcatcctctggccctctattctaactacccctccctctctctaacactgcgatgggcaggggcttatcttcttcttcccacctggtcctcctgtttctacctgcctccaaccccctcacggcaacagggggacttatcttgattggaaagtgggtctcatggatttgcagcctcacgttgaaaaacctgtcaccaactccccagcgcccacaggatcacacccttgggcagagcagtaagccccatccttccctggcctggcccaagtgccccgcacccagctgcagccgaggtgagcattgcagggttcccctcctgggcctggcaccctctggcttcggcccctgtcacacacagggttggaatgctgtagctccttgcagtcctgctgaactcatttttcaagatcctgcttgagtcacctccctagggaaagcatccttagtcagagtttatcattcccttctccaagttaccctggaaccatattcaagtttctcccaaggcaattctcccatcctctgcctggctgcagcaccctcacctctggtctggactgtcaaagtcgcctcctgactgccccttgcccttgccccctgccccttccagtcggctgtggacccaacagcccaaatggtcctttgaaaatgccagtcaatacacatctctctgctcacaaccctccagcacctcccatttcactcacggtcaaagctaaaactgcacagtggcctccgactcctccctctctggtcccccttccctttggaccttcacttctaccctccattctctctccaccccagcttgcaccagcctccttgaagccctgaacactgcaggcccctcctctctctgggccttggcacgtccccagacaccatgctcatctccctcgccagggactgtctttgctgcagtcttgccttctcagggaagcccaccctccctgccctggacaccactgcaaccagcccctacttcctggccctcctccccctgccccacttttctttctttccatagcatgcgtcaccttctaaacatattatttaaccaatttttaattttttttatactccatctcccttgcaaaaagtgtcagcttcactagggcagggtctttacctattctgttcaccggtggctcctatgagcctagcagggtgctggtacacagtgtgcacttaatgttcaagcaatcgatccatccactaaagctgttcattggtttttgtgggggctccctcggcagttggggaggtcctggagactgagttcatgctcagtcacctctggatcctcagggcttagccactgccttggccacagtgggtatgcaagaaccatctattgaataaataaatgaatggggcctgctccattggtcaagggagagacttatgggctgtgcagatcagaggatccctctgccaagtgatattattgccagattgttcctggactcctcacctgtgccaggacctcactctctccagaatcctgcctcacccctttccccttgggtccagttccctctgccagtttggaagtggttgatattcatctccactccagagaggctgcctgaatactgcataaaacttgatggtttccgagagaagcatgaactgtgagcaggatcaatccctcaccccaaagatttgaagcaaagtggtgcaacctgactgcaaaaggtgttctggtggcctgggcataggcatcaagccagccctgggcagggaagctgctggtaaccccaatagaaggtgtcttgcccttcctaggtgtctttctaaagacagggacttggtgcaggggctcaaacaaccctacacacagagctggagcgagaagccacagtggcccggggcctcgctcaccccatcgccttccatttcaccctctcctcgaggcgctcgggcgctatcaggaggtgatcagggcgggactgagctccccaggcccaggctggatcccattgtaggctttgggggtttcaggctgtttttggaacctcggtcatgtgtcctcccatgtaacctgagccccctgacacggcatgagtctgcactccagctctgagccacatctgcttctcatttccgccccaggaaaacggcccaatttccaggagccactggcctaagccaagcctccagcctctcagcagccaactccacccagcccagctccattaccgagatgagaaacccgaggctcagagaggccctgtaatttgctcaagaacaagaaaccactacatctgagatcttatccttctgacccctcgatccgggtctttgcacaggcatggcaccactcttgagtacccaagttaaaattccagctctatcctttaggaatttgaccttggccaagttctcaaagtctcctgtgccttactttaaaaaatacgtttctttaataaatgcacctcaataaagttattgagggataatttacatacaacaaatgcacagattttatgtgcccagcttgatgaattttgacaaatggatacccccatgtaataaccacacagtcaagacgtggaacattgttcttaccccagaaagcccttccttccgtgcaaacaaaaggaagcaaacaaaactatctgcctcatagtgttaggaaaatcgaatgagataatacaggtgagatccttagcaaggcgcctggcacgcaggaaacgctggataaatgcattgctatcattccctggctgtccccctccttgactggggcagggatcagggcatatgctgaaccatctcccttctccagcctaaggccatttagccagactagaagaagactcggggggatggaatatgtgtcttggaggagacttggaaccattttcgtaagtctccagaagccatgatggggctgggggtggaggaattggccagcttttgcctatgtctggcccaaagatagggttttgcaatcatagctcactgaaacctcaaactcctgggctcaagctgtcctgtctcagccttttgattagctgggactacaggtatatatgccgccatgccatgctaatttttaaattttttgtagagacggagtcttgctatgcttcccaggctggcctcaaactcctggcctcaagtgatcctcccgccttagcctcccaaagtaagcctggccatcctctgttcttttgagactcaaaggatgaaggcgctcatggcagggccagcttcacaggttggtgaccaaggcagctgcacagggccttgctgtcagaaagtccccacaacttggattaatgctcccatgttatgtgaaatccttaataatttttgaacaagggatcttgcattttcattttgcactgggccctgtaaattatgcagctggtggtgatggtggggagggtggagcaagctggctggtttcctccctagaaaagccagtgctattgccctccccacttccactcactgactacacacagctacacatgctcattcacctccatggtcccctctctgtccctctccacagtggggcatctaggagaatctgggtcactcagggccctccgctgccaggagacaccaacagaacctggaagcctgcttggcctggaaacccccttgggaacagctcctgctcacagggcctgctgggcaggccacccgaattcccatcctctgacactcctctccagccgcctccacccagctctgcagctcaagtgcaaaaccacagctgggtgccagccaaggggtcttgggtttcatcacattcaacttcccacacctcggccagaggccagggtcgaatggggctgctggccagaggcctgggctggaaggcagaggagggggtggggtccagtcctaccctcgcttcctatccatggcagagtaccccctctcttaggcctcagcttcccctctatgtaatgggacaggactccacagggctggagcagatgccaaggatgtcgggaaggaaggcctcagaggccaaggcatcgaaggagctcctagaacttcactgtccaatatggtggcctcaagcctctcatagccatttaaatttaaaggaatttaaaggaaagaaaattcatatttcagttcctcagtcactccagtcacttttttttttttttttttttttttttagatggagtcttgctctgtcacccaggctggagtgcagtggcacaatctcggctcattgcaacgtctgcctcccgggttcaagcgattttcccacctcagcctcctgagtagctgggattacaggcacatgctgccacacctggctaatttttttggtatttttagtagagactgggtttcaccatgttggccaggctggtcttgaactcctgacctcaagtgatccactccccttggcctcccaaagtgcggggattacacgtgtgagccactgagcctggcctccagtcacatttcaagtactcagtaggtagcgacaggtggctcatggccactgtattgaatagcacggatacagaacatctccgtcaatacagaaagttctaccgagacgcatgccctggctaggaaagaccaggtgccagggacactagtagctttactctcctggggtggggagctggggcagggggctgtgattgagaaacactggagacatcctctcactcctctccccacctcaccacggatgaggtggactcgccatgaggggagccaggagcctgacacccagtacaggtgtggacaccccagaggcagcttccatcctgactcctggagtggaaagcaggcttcctgggtccctgggaagaggcactgggggaagcttcagagagggaggaagtggccagaagcaggtgctcttcctagcaaagggctccccaggagctacttccaaatgggaaacatcagccctccccaatcctcacctctggatgaattccctgaaggcttcaggagcatttgcatgttacagtacaatggtcctcaaacttcagcttgcatgggaatccctggaagcttgctaaggcacagccaactaagtacaaacttgaaacacgcacacttccactgtctatgcggcaggccgaaatagggatatctgggttctgtccatcatagggttcattattgtgtgggcctgtctggggcagatcattgaaagatattaggttggttttatctgggcatcttagggatgcagcagagagggtgatatggcagacctcaggagagactggttgggggagaggaaagaaaggggtggaagcgagggatggaggacagggagggaggagggaagagggggatggagtgggagcccgctcgtgcatctcctgctgaccttgttcttcctacctatcttctcacctcctcctcacaaccaccttacaagtcggcaaatgtgtggctctgagagattacacaaccttgcagcagatacatggtccctagggagtcaggctggactctgtttcctctaccttttctccctccaactctgagtattttcaaacgaaataagcctgggaagcggggaagactcagagctgtgaatacatttttttgttttctgagctcattcggctttgacaggaagcttggctgcgtgcgggcaggcgtctgagccctccctcaatggtgctttttaggcatgcctttatacagaatgtaaagagtcgcagttataaatatcagcgggcttctgtggcccactccgtccctcagcccccacgcccagctgggatgtcctgggacttcccgcttgccctcctcccccaacccctccagccagtaccaccctcagtgcatctgggaagggtgggaaccgtgatgcgccttgggctgggaaaccaagggggagtgaaacccaaaactgaatttctcctttttcggaagaaaggttgttttcagtgtcaggaaacccataatcctacagccagctgtgaagattccagaatgcctctcactttacaggtgaggaactagagggccccctggaaagcttatgaacaccctgaccccagagctcaccctccctcactgggaaagaaagtccctcttttcactttgtcacccccacccacctcccaaggcacccacagcatggtcactctttgatgactgtttgtattataagcggctcctccaactctgttctacagtcccctccatggatgccctggagggaggaggcaggcgagacgcggtcccattttacagacggccaaagagttgagtgactacacagctcatcccaggagagctgcctggccctgcttcctgatagccggcctgtgcccctagacctcccccgaccccacaggccccctccccctccctgtatgcaccccctgtcccctcactgaggcccaggagcacagttgatttagaatttcctgcccttctgacaatctgcgtgcacaaaacgggctttctttaaaccgcttcgaagggcatctcctccagccccttcccctgccttcattaaacgcctcgtctgaagcaggataaatcttcggtgattagaagcatgctccttgttcctgtccctgccccgatgggaagcgcatttctcaaagggttaattaacagccttcacacaggccgcatttagcaacgaacacaaagccacacacataaataacgtctggggcggaagaagagggtgcagatggtttgtgactttgccgtccagagttttctaaaccggtgtgaaccacgtcctgtcgggaccaggaccatgagtcagggtcaggctttaaggtgggccaggccagagacgctagtggccaacttggtgctctttgaaagcaagtcctaaaggaaaacagagcgtggagccaagatgtggggagagagggaggggacggggtagggaggagggcctgctggctgacctggagagaaaagagccaaagagagccagagatgcgaaccgggaagaaccaagcaggaggccagagacattgagtcccagctccctgcaaagtagtgctgaatttaccaggggctccacccagaaattcagaccctggggcatagggtcccactctggccctgtagtgagagtgatggcaagacatccccagcctaagaggagttgtgtggggctgagaaaagggtttcaggaaggatagccctgaggaaccctggaaagttctggaagtggcacagtgatattcgcagtattccgcctcatccatgcatagggtctgttcctctacgcagccttcagctcccctgggggctcatatgccccttcccaaagctatgggaacacatctgaggtctcaaaatgcatggcaacaggaacacaggattcactttacagagatcagcactgttgcaagggatgcctgaagccaaaacagaggaaaacgagagccaagaagcagagggagcgatgcagatgtgcactggacatccacaaaccgcaacaggaatggggagaggagagaagtgattggaaagccagtttttggcattcggctggctgccattctcttcacctttgtggtccctccagtttgccctcctcagccctaaggggtcctcccctactcggagaggccctcaccatgctcactcagaccctctcctcctaggagccaggaggtgggacatggggagggggacagtgagtcctgaatggatttctgccctggaggtgagggcacccctggtgccagggagaggccctaccacagcacaaactgggctgcccttcctgacccagggatgaaccagcctgggcactcaggccacggctgtctccctgtgccaggctcagcgccctggggatgagggcgcaaagaaagagacggggccgacaacacaggcccaacagcaggccctgtgtctgggagcggcagtttctccccaagtaattttccacagtttggcttttcctccacacacaggcttgctcacagagttcagatggtggctggtcctccagagggttactctgggccactcacctgctcggtgaccccacctgcattgatttctgccctcatcactcagctgtctccagcttgcttctcaaagccctgtgcccatctcagggatatggcttctccagcccccagagctcacttcaccccatcagggcctggatcttgggtagttatgggaacccctaaatgcaccatcctctctgggccagggccaacatttctgttttctcagaaggatcaaagcccctttcctagccctgccaggaggaagcagttttgactcgtgcaaatatctgaagcccatttgggattttactttggtgagaaataaatacacagccatctgcaaatgatggaaatatgacttaagtaactttttggtcgaggctcctgggccagaggccagatggaaataagaccttgtatctcagtcctccttgcacactttcagaaaaaagaaaaggctgggggaaaaagttggtggaaactgaagttcaaaatggagtgtgctaaatttcttggcctgggaaaggaaaaataaacatcaaacagctaccccattcaagtgtgcgttatcttgctcatcctcgccaagaactcaccctcctcccttctttgaccgggaattgctgtgcccacgaacagcccccacgcccacccctaacccagggcaggcaaacaatgggccagaaaaccctgctcagccaaggcctctccccctgcagcccccagaggccataagattgggaaacacaggctatttttatgtgttatttgtctaccaactgtggctccaggagcctgagcaacagtatcatctgtgggaggtaccattgatttttttgttttaactcgctcagacaaagccacattttcgcaactttcagaaaagccaaaaaagcaacactctgcaaggctgacctcttccctggcttgcctttctgccctccagggagctctttctgggtgtgtctgggcccctgttgctctgtgctggcccacaccaagcacacagccccagatccagagggcccaaaggatagccagtgaaacaaggaagggtgaggggggcagagagaggatctgaggagaaggggtagtgtctccaactggtgagggaggcacaaaccctgccctgggggtgccagtgtgatggagcagtggggctaacagaagagtgtgagaagtcgcacacagagaaaatggctgcttgatagccatccatctcccaagtccacgggttgggatgctctgtgcagcgggtacacccagaggcagatacagggctgagagggtgcaggccaggtgcgactgcctaggctggggctgaaagaatccagctggcagaggtggctcacacctgtaatcccagcactatgggacgccgaggcacgagtcc

SEQ ID NO: 3407 - DNA, 745 bp, Homo sapiens
gctctgagcaggccgacagtcatagacgagtagaccttaggcgagggaaggcatgtactttccctaagaagcgggaggagagaaataaatagagggcagtgggatgagaagaacctcgcgggatgggaagccgcggagggaagggccgtctttggttacctggagagcgggagcagctgcggatcccttatgaagtgcccggatgaagctccagcgctcacgcgctttccgcattgagtgcagcgccatcttgagaagggcggagccgtcttgtttggaatgacgtctgttcagagagccaatcccagtctcgcgactcctgcttgctgggcgcggcttgggcctccaggctgcgcagcgcagccgctatcgggcggactgcagttcttgccgagcagtcgcaatgatttgtatgacagctgctagcccaagagagagttccagaagagggctacctaacaggtgctgtggcatttagaagaggaatggagccattgtcaacgcacagcttgcaggggagcaggagagtcagtctaagaaggaaatgtgatgatggaaacagaggttggaagatggaagaggacccagagtcaaggaatgcagatggagtcttgctctgctgcccaggctggagtgcagtggactgatcttggctcactgcagcgtccatcttccgggttcaagcgattctcctgcttcagcctctcaagtagctgggattacaggcgcccaccacacccggcta

SEQ ID NO: 3408 - DNA, 884 bp, Homo sapiens
tttctatatttcctgcccagtactaaaatcagccatttctccgaggagccctgattccttttaccatggaaagggagctgaacttcagcagtgaaaaggactggagagctcccgcgggtctcgaaccgcccagagaggtaaaaggactggagagcgcccgcgggtctcgaacaacccagacaggttgcttgtttcaattaaagaactgtcgaagtaaccgctgagctaaagccagcccggaggttgctttcggattatattttattgactggtgagaaagacctacgtcacaaagagtgagtcaaaaagagagtgcttcagcatgactcagcgaccaggactgtccaacacgcccccgacctccagacaattgaggagttgtccatctggggacacacagcagtgacaaggacgtagcctttcctaatccctgaagagctcttccgcaggtactctgaagggcaattccagcagaatgtacattccatgacatctgggactttgatgcgttgccccagaagataataccagtacctacagcatgttcacctaagcactggtcaagtggatattactcaaccagaatgcaaacatttctattggttttagtaagacctgaaagaggctgggcgcggtggctaacgcctgtaatcccagcagtttgggaggctgaggcgggcggatcatgaggtcagatgatcaagaccatcctggctaacatgtgaaaccccctctctactaaaaatacaataaaaaaaaaaaatagccgggcgtggtggcaggcgcctgtaatcccagctactcgggaggctgaggcagcagaatggcatgaaccaggaaggtggagcttgcagtgagccgagatagcgccactgcacttcagc

SEQ ID NO: 3409 - DNA, 753 bp, Homo sapiens
gcagtgtccttcaggcatcagaaactaagcaaagagtatggaaagagatcacagggctctccgttctatggtgacaaggggaataaagcaggacaaaaaaagtggagatttcacattaggtaccatcttctgctctctgctctctcttcctctatcttggagcctacctgacattccttgaccacctcgtttatgcggaatgtttggtgaccttggtgttcctgagacagttcacaaacccagcaaatgacttttccatcctccttacagaagatctggagtttttttccatggtgctcacagacatctctcttctgcccctcctgtgggctcatcttgacctctttgactctctcaactatgttggccagatgccgattaggtcggaggttcccaggctggaatctggtctgacacacaggacagctgctttcccctcttgagatgatcactgactccttgatctttgcagtgatgcaggcttggcagaagctgtggccacaatctaggctcagaggttctgtcaggagctccaggcagatggggcaggtcacctccttctctatgtctacctttactgagaaatccattgcactgctcccttggcttccttctgtcttgactcttgaagttcttggtcacaaactcctgcagtgctgagaatgttgaaggggacagggtaagaaaagaaggaatagaaagaatactgcttttacagagatttagaacaggacaaaacattaatatttaaca

SEQ ID NO: 3410 - DNA, 1596 bp, Homo sapiens
cgccgcaccccgggcgggaggaagtagcgctcgtgccgcgtctggcacagcagccgcccggggtcggggtcgtggccatccagcacctccagctccacggccaagggcgttcgcacgtcgcgcttcaccagccgcaccaaaggtttctcgggctccaaggcccagagcagccccatgggctcaagccccgcgaagctgccgcccagcgcgggcgcgcgctccaggtccagctcgccaagagtgtcggcgcggtagcgcgcgtgggcctggaaaagcgcgcccttctcgtcgcgcagggacgcgcgcagcgtgaccggctgctccggggctaggccgcgcacggcgattcgcaccggttcgtcccagcagcagcggcccgcaggctccaggatcagcgtcgccgccatccgagcaggaaccctaatgatctgaccaacctgcctcagctgtggagaccccaggaactgcgccgaactcttcaggctccattggtacagccgggacgctcgaaggacagcaggagatgaggccattttgaattcagacctgagaacaactgaatgggggtggggagaaagaagcttgttagacatcctctcgggctgccgtcgcaggctaagcgcccactagggcagagctgtctgctaacgtgagcggggaaggccagagtccagccgatcagccagaccaaatatagacacactggaacttgcttaaagtctcctgtgttgaaacctccactttatgttggaaagctacttcctaggtttgcttttcagaagcttgctggcctgcggaatgggctggaccagggctggttcttaaagaaccaggcagctagcagtctccaggctccaaactcctgatggcgaagaggaatgcagagctggagttagttttgatcactttgttgaataattcacactcattactaatcttagggcttttctttcaaaatctgcaccatggtgttttgcttttgtgttctctgtatatgcctatcctccacatcaatcccacatcgaagggtgctggcttcttactagctgtgtgacctctgagcttcattccttacaagtgtaaaaatagccaaatggggtaataggtagtaatttctcaaactcctgactttgtaatccgcccgcctcagcctcccaaaatgctaggatttacaggcatgagccaccgcgcccggctaatagttattattttgttttactggtttctcaattattgtcccagtcaggcaagggttactttttttttttgagagacagggtctcactacattgccagactggagtacagcggcagtttaccatcactgcacttacaaacctccaactcctggtgctcaagccatcttcctgactcagcctctcaaatacctcaaaggactaccggagctccccatgcatcgcgcttttttctactttttcgtaagctattggtttcaccagaggtgtggtgtttttttttttcatcacttaagctttaggcccctgccaagcccttgtacctgattttataatttcctacctgtgtaattagagaaagctataaatgtgtaggcttcaaacccacaaaacctgtgtt

SEQ ID NO: 3411 - DNA, 2593 bp, Homo sapiens
tttctatgggtaataagaggatacctttatagtttcatgatgtggagaccaagatacataagaaagcaagaatgagtctccgggtgttccctctgatcagcaaacatgaattcataatttcatttactctcatttttgtaatgcactctgagcaatcctccaggcagatcctatttactaagcttcaggcttttgtcccattttataatgcccaaacacatggagaaaacattttgttgtttttaaaaacaggtatgggatttctgatataatcaattttattgacttcttgggagttgtaatgatctgtgactcactgcataatattgtagttttatagggtggcacatcaccctgtgtaaaacaactttaatgacctgaggactgatgagtacaggaagtgaggtttatcatgagtagcatttattaagcatctgctagaatcaaagcactgcattagctactaaggtacaaagtaagacacagtttaataaggaagacagggcatctacccaagtcaacagttcagtgacatctgttatttgaaccacacaccaatgcaaccgaagtaaatgctgaaagggtgagaagaaggaatagattactatgcatttttgagaggatgaagaaggcttcttggagaaggtttctgaaaagagatacggaattaagagaaatagaaaagagcactgacgaagcactcaggatggctattcaaggaattggggatccacagcagctgtgcacaaccatccctaatgccagaaaaatggggtaagggtgaagggaactgggtctagagctttgcatgtttttttctggttaacccttagagtcaccctgaaggtgtggatcccatcttataataaggtgaggacactgagtcaggaaactaacttgctaaaatcaagtcctcccagtcctcccatcaggtccttccagatctggaggagccaggatttgaactcacatttgtctgacttcaaaatccatgctttttcttgtgttccaaattgcacaatggagtcactgccagttcaagctcctatgaaaagggatggatgtgaaaagtcatttgttgattccacagatttttagtaggtaccatgtctcctgcctttatcactatcctactcctctgctacaacttctctgctacaggcacccactgcagttacttgatatgagttaaatgaatccatccatccaaacttccattcattgaataaatacttagcaatggcttcctttgtatcaggcactattctaggagctggggctacagtgcagatggaaaccagcaaagctcactgccctcatggagcttatatgtaagtgaataaatctcagggtggttctcctgtcataggtcctggctcctctgccagctcttccaaatgggttcagagaggttttctccttgtcctgttgtgtaactgataatcccatggtggacctcactttgctattcatatgcactaagtagtttatggtgtgctttgtggctggcaattgtgacagattctattcttctattggtatgtggtttctttggggcatttgtttggatactgatggcatcttccgggggtctgaggcacctacacaaacctcaggtcactatcacgtgatactggagttgcctgttaaattatatttcttcttccacaaaactgcaggttccctgagggaaaggtctatgtcctgctcatttttggatccctaatggctggcacagtacctggtgcataatatggttcaacaaatatttgtaaaatgaatgaatcaaatagtccttcaaagcatcttcagaatcaagattgtcatctagattgcacccgaagtttatctttctagtattcagaatataatcaatcattgcttaaattattccatttcatcattcttgaataaaagctactaattttaaatactaatatctgagatatcttcgaaaagaagattagtcgttgtatgtgttgcttataaattttctctatggtggaaaatattcccaaaccatgtctaagcaatgaaaaaccagtgttctggcaggaaataaactgatgtttgttgtgttttgtatctgtcttcccgttccaaatcatttatatatacttgatggtctgtgggcttgacttgcaagtattttcctgggagacatttttattcaaaagacctgtattgcctgccaaaccttcatttaagagactcattatggatgtcatctgcatcattgcaaacttttctggtcgtctctataaatagcaagataatatttacagagttttacattggctcttgaattttaaaatattcttatagacaaacattaattggaatggggggtaaggaggtaggaatggcttacttgcggaaatgcaggctcattgttgtgtctagtaggtgctaggtgcattcacacatctcttaagctttaaacaacctattgagccggtttccatttccttgatctattagatttaaaaaaatgaagcataaaggagttggctcttgccctaagtcatactactgatggaatgagaatacaaaccaaaaacactttattcaagtccaggaaatatctgccttg

SEQ ID NO: 3412 - DNA, 2931 bp, Homo sapiens
gctattttgaagaagctagggtctggagggacagagaacagttccctgattaacagtattaatagcgacattggtaacagctaccatttatagagttttaatgggagtaggagctatgctaagtgtttttcatgtattatcgtttttaatcattatccccaaccctatgaggttggttattatccccattttacagatgaggaaactgaagctcaaagaggctcaatgactttcccaaggtggtcgtagtggtggagttggagtttgaacacaggcctgaccctagagtccacaccctgacccaatcaattatattgcatcttgggtccataaaccctaatccataatcccatcaagaaaagctctgctgctcttagctctaaataattcagaatctattctcttctctccagtcccgttgttatagtcttcactcatagacttaagatgatcccatcaccagagaggtttctctaccattagcttccctcttccggccattcttcacaaagtcatttttctaaattctgtgtcacatacgatgatggcatttctggaaattccttcaggtgctctcaagccctgctgcagagatccttttcagagcacacactgttccagcccatctgtctcaccctctcctgttgtatccagctccacgacaaacttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggcctaattcatagtggagaataaatagtcaattgaataaatgaataaatatctccaccatcgtactaatcttaatcctccctgcccactcccaccactgaaaatgcaacattgtacacatcactggttgttgggagggacttaccttggaaagttgctattctaggaaagagaaaccttcatattcctggaaacagcaggtagtttccagtgctggcaatgaattccccagaactgctgttttggattttttcttgcctggcagctgttgggagcagggtgcagtgaggatggggtgagagtgggcagtttcttgtgcagatttgcctttctttcatcctggggctgacttgcagctccacacccatccatctctcaaatttcacagagggtaaaataggcatttggagagaaagaactctggcctgattcctttctctcccacaaatgtcctttattcataaaacaggaataataattcctgtatctcccaactacatggaagctgcagccctcacagaagaagatgatctgagaaattctttgatttcctcagtacagttatacccatgcatcataatactttaagcctggaaggcatcttaaaaataatgcaacagtcaaacctaattttacagagaaactgacatgaaatcacgcagctaatcatgataaagctgggtggaaaacttatcttgatgggcagtacaggaagatgcagtagaccttaagatgtcctgaaagtttcttatctcaggggaaactcccaggtaggctttatgtcagggacacagaaaaatgctccctgaaagtcaaaatattcgggctagacagacaaattcctgtaagtgtggtttgtctgggaaccacagatgtcactaatcctggtttgctccagagttctttttgttcactcctaccccccatcaccatttgattgatctccttaccctgtaatttccccttcttgtcgcttacctgcagtatctttcccacccaggcatgccttattctttctaaaggaaagtatgaatggagaggggaaagcttgggaaactgatagatttccttggatgccaaaacacctccatagcctgtctgcccggccctatgtggaaacagcattgagtttcaagtcctttatgcctccacccagggatagccacttgtaatccacatggcaattgtgaaacaagcaggaaatgcgtaattgtcagaattttgtggggaaaggactagggaataaggaaaacaaagatcttccttgtgttttagagctgtcagctagaggagcacctgcttgagtctgatgccatctaatggtcccagaagaaactgggttttgaacctagagttccatggactcttaggaattagactactactactactaagcattcactggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgactccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagtattcta

SEQ ID NO: 3413 - DNA, 6644 bp, Homo sapiens
agtttacagaaaattgaatcgaggtttcctcattgaatcctaagactcaaagcagacaacatgacaggacacatataactaacacaggctttaaacaggtggaggcgtgaatggagtactattcacgacattctaaagctactggagcacgggacacgtgtctgtacgctcctctcacaccccttactcggcagctgccccactcccgccgttgccgttgccctgagtcttccccactgttctgctgtgccagtgtgagcatctccccggcactcaagtccatgttctctccctcccgctcttcctcctgtctcttccatgctccctgttgcacgggacatcatgtgggcttgatgccgtacacagtccctgaccatggccccctactcttctccagaagtgtcacactagacaggagctgctgagtcaccaactcacctttccctagaatgtgggtttgttttttctcccccatcacttgcagaggtcttttttcaattatatgatcaagaatgagtctacaagaataccagcaccagacatagtgccaaatggccttttgtaagctgtttcgtgcccttgaggctcgcacttgtgctgggtgagcccaggaccgttagccttttcttttctaggtctggacactccggggttggttaggctagccactggggagaatacagctctggccttttttcatattttgctgcttctctttgtacagatctttccccctccacataccaaaaggaatcctaacctagttgaaatgctagttgcaattcagtttcatgagaatgctgaagtaggctgctgatttaaaattttcctcttccctgaaaatacacacacctagagaatttagggaaaggctcttagggcttgggaatcttatcttttcattccccacaaaatacctacaaagaaatgtctagtattccctcagtattcctcctcgtataggctctgaaagcaacctcattcccacccagcccttgcacaccggcattcaagatccatgcatgcagttgttgaaactgttttctttgggatcctatctttatgacaactggaatgattgtagatttatgacctcaaagagtagagcattccttttcctattttcccagctgctaaaatatgactgtctccattagaatttagaatccgtcttaagcttagagatggtaagagctgactggatgagtctaattctatgatttgtgagacatgcattaaaaccgtcagcagaacattctgatgatccacctacactcaaagaaaacacaattaacaccacagttaaaaccttctaatggagcccctgtcttagggatcaaggtattagaggtgctgcttcagggatggtgctacttcaaaagaactgaagttggagagacacctcccttcccaaatgcttctgcaggccactctggtgattcagaaaaccccaaccatatattcctttaccagcagcgcccacccttttccgtaactcagcttaccaaaatcagtgaaaattgagacagtgcttacccatgaaatatgtggtttttgaacaaaaaccccagaagttagttattcttataggaaactaaagatgccaccattgtaaatcataatactacagagacaaatgcacaggtctcccaaccacctcaaagtcaatacagcccatgttttctgagcacgtactgtgtgctgggcaccgtgctggacatgtgtgctgcctcatgacccgacaccaagcaagtcaccttgcccttggcaaggcaagtctcccctcatttctttcatttcagtaggacgttcatcttcaaagaacagaccacataggatggtctgccctctctgaacactaacctggtttgctttctcacgcagcagtgccaggtagcctcccaggcgcactgtggcatcgcccccgcctctgtgagctgaactccctccgtgagggtctggacgtgagggcccctccagagtcttcctccctggtcagtgatgatgacaggagtgcagggaggtgccgcagtggttgacagggtgggaagcctgtgtggccgaggggaacttgaactccggcaccccttgcctgcagttagccaaggcagagaccaggaaaccctcttgcacttcccatcttctctctccagctcttgtagcgctaccctggccgttccttcggggctcctgctgtgttcaggagcatcttgctcagctggcccctcctcctctctagaaaccgggggtctggggttctggaattagatcagtgtctgctctgcctcaggcctccctgcctcctcatgggccctgactgccaagaaataacagttgctggagacatatcttgatttggggtcagcgtaagaactttctagaacccagaatccagcaaaggcatgagctcctttgaggtagaggtctggttcctgtcctgccacatttcacgtggaactgtggtaacttgtcagggacattgaacaagggacatgggtaccaagctgacctgaggactcagctaactaaagttccacatttcttccctccttcccttgtctacctcttttccgtcaaacgtaagtggtcctctaggggttggctctctcatggtctttctcttctgatctgctctgccccgtcgtgggcatcttggaaccacctcagaagcaaggccacagctgtggactggtcctcgtgagagtctccctggatcctctgtacctgtaataggtacacagttacgttattatccaacctccaatccccaaaaagcctccttaatttgaaagagaaaaggtatatgtgccttgcattttgttatcggtccagattttgcatctggtggtggctggggtgccattgggattttggaatgggagcagtttgattcctccctcggaaggaactcatggctctcacaaaccagtgtctgtggcagtgacaagtcacagaatttgtgtttcaaggcttattccttcttccctttaagactttttcaacttcctgtcacttcgggctgagtctcaatttcagtcatgttttgtggcttcctttgagcacagaaacctctccttttcttccgttactggaactaagatcccagcgtaaactcgtgagagtcatttttccacgtcatcattcgttggagctattaagcccgaacacagaatgacattagtgttatactaatgtaagcagcagccactctggtgatgttgcattgaactcttttgttcttaaaccagattcacggcgggcaggcacagagttagaagagtgggctgcaggaagacacgtgctcagcggtggctgctttcaagcagcattgttttttgccttgaaaaccacatttcattatgttagaatcggtgatccccttaatactgcatctctgaaaatgggcaccatgaaaccaaaaccaaagttctggatgtgggggagtggagcttttctttcgaagcactgggagcttgggcagggcgtcccgactgcccctcagttttgccggagcactcggaagggcctcctcttttcctagtagttgcctcatggtgactctagaaagcaagtgtgtgcagcctgtgcctccccgacccatggcgggcgtctagatcaggccctaggagcctccccatccctgcctcttctagccacttcccggggggctgtagagcacggtcacaggaaggcctctgctgggccgagtctgcggtccctgagccatcacagcactggcgtcttcagacacaccctggctgcaaggcaggacactccccctgccgagagacaccatgtgcgtcatcattgcctcccctggaagagcccacagccttctatgatctcccccccgggctcgccctgccttccacggccatggtcacgttgggtatgcagtacttttcaaggataaatttttgtttatgttttttaagtgcctaagcaagatacagacctctggaacctgccagagagtcggcctatgccctgtccccatccctccccaccctgcactggcccttgagggtgggcacagggcggctgcccctctccagtgtccctggcgttctgcaggcagaacaaggcaaggacaagctagcgggagagatcgcttcacagccatatcaggctggcttcgtcactgttttccagcgtttctttctttagggccgtttctgtttatgtggtttggtcttggttcatagagaatttaagagtctgcttagggaaatctcagtagccactaagaagacaggagagcaagacagcctcagagcagcattccagctctggctttggtaggagttggaaatgtgtccacatccaagagggcgaagcgtcgaatcatcctagctcatgagcctgctgactcacctgccagcgtgagccaccggagccccagctgcctttccgagccctctctgcctagactagagggatcagggtgtctgctcgggagggcttgggaaagccagcaatcaggcgttcagatcccaagtgtgtctttggaaatgagtgtgagagtatttgtttcttttttaaaaaataatttaagtctgacctaaatacggggcctttattctgtgatgggtgtacgacagattattttgtgactgcagtctgttcaaatcacatcactaagcagcgctgagatgatttgttggtgcattaaaaggttttgcatcatggaacaatccatacccaggcactttattttcattaataatccagcatttttgttcagacaatgtaataacccaaacactgggtattcatatttgacacatgggcaaacttgccagtggaatggaattgtgacctgacagagaagggaaggcaggctgacgaaggtgatcgaatgggagaacagtgctgtggtgatcatgagaatgaggcttttctgtagcatgtaaaccaaaccggacccttggcagttcgtcgtccctcagttctccagatgctattttttgcaggttctaccaagtgcttgttgattaccctagttgtaattatctagggaagagatgaatgtaagtgagagtgcagagcactggggagggtgacagtgaaatgcaattagaggcagcaagagagtcctagtctgttctcacataaccggacttgaacgctccagtgcgagcagagtgctgggggtggattccactgccgaaccacggcagctttgctttactcttcagcatgggggtggtaactagctgcacagcaagttatgaaatggaaagcaagcttaacagctgtaatctcatcggataccctggagcaaatgccttgggattgcctgaagtgaagtgtttagcatccaccaaatagttgagtttctaagatgggccatgcgggatccctgccacacgggtgtgggggcagcgcgctcctccctgcctcggctgctgtgtgtgttagtcttcatgtttccccttggcgtctcctctggtccctgtccatcttgtgcaccatgtgtccctgagggcgagtcacacctgtgtcttgagtctgctgtaaggtgttcagtctacctcaaggggtcatcatggtaagctctatcccacggcatcctccgtccatcaccacacacactggaatgtatcccccccgccctgccccttcgataacctcctgaccttgtctttcctataatcaccacaaactcctagtgcaaattggatgctgctttaaatgtgaaaacaattgttcaaaagctataaaacctgaatgaaagctgaagctgaatttataagccttgttgcatatgagccaaaagtgcaaaaagctctatataatgaactaacctgccactcgtataaatataaatatatataaatatattaaaatcagactgttctacaaaattgtgtatttgtatttttgtgtacgtacaattttctgctaagcagaaggaggatgtagtataggatgctgtgagaagagatttggtttaatcctatttctttgttacttatttttgttaacatcagatgcctgtctttgtcttatatgtgtatgacactgtttggaaagctgcagtatctctcttcctgaggtccagaggccattaaagaataaacatggggcttagaggtgtcttggccaccaaacacagccccagttacctggagcttctcagaacccactttgccggtgctaaaacacaagagggggtgaaagtggctgccagtaatggccagaaaccaaccaccagaggccaggctgaaagacaagctccgggtgtccaggggctgacgggccaaccatgtggcaggtcccaggccccacccactgcgccatccgcctctgagctccacagtggtcccactaatgggaacctcctctagggagagtgatactgcaccttcacccgtaggactcatatttataacaatgtgtaatggctgtagcaaaaagcccttgtttctagatgtaaatggtcaaagaaacaagcgctctattgttttgaataaaatagttcaaatgagtcctgtatcattgtatctcctattctggattagtgccttttggacagtagactgttctgtaattaaaatgtagtatactgcttttttgtacagttttgttttaataaaacttttttttaatttgtgtttattttagtattgtacctattagag

SEQ ID NO: 3414 - DNA, 2279 bp, Homo sapiens
tttttgtgaactaaaaaaagtgaatgtggcttaggctaagctgtttttttttttttttttttaaagatgaggatgcggactccaacaaaggcattaagaaagtactagatgaaaatgagaaatatgtgaaggataacatgtgaaatgtacactcaggtctaacaaatacctattatttctctggttaagaaggtttagcaggagcctccaatgagcactgtatgtagagaaaagggaaggagcaggaggaggaacagatctgcacagaatttttttcttaaaaaccacaaagggtgacttttttcttctaagcaagcaagcctgagaggcattacatgggctggctcctaatatcaaaacaaaatatttctttgccacaaaggaacttgactatgtagcaacacatttacaaaactactgcaaaacactcccagagggcagtgacctactctgctccccagaggctccaagaagcaaggcctcaagtgcctcatgttccatggggctgtgcagtgcaatgcagaaggcggaaatcctgctgtgacgccaccctcgagaccttctgcagcctgagagggggtgatactcccacaccctttgatccttccagatggctcagcctagatctagcagtgagagagccctctccatgcagggcagatggagtggtggacacttgtgaaaacaaaacactaactgttccatcctgttatatttgctgtgaggaaaattaagattcctgttgtatgggctgcactgtttctggaagactacagaaaatctaacatggttgacacttcctggtagcccttctgtacatacacacacacacacccagagagaagacagagagaaaatcctggtccaaaagatcacatgaccttactagtgtttccccaatgactgtaatttataaactaaaaatttttacaaatccactgctatcttcttctgtcctgagtttggtagactttaatggatgctccagcaataaccagaatctaggacatgcagactcactgtgagcgagaggctagggatctgccctaaacataggaacctgtttctatcaagcctgaatgaggtcagctctggtagaattaatgacaaatcaatgtcagtgaaatattctgcaaacagggtagcttttgtgctttcttttgattattttctttggggagataaaggtattgcaaccatgggtctaactaatctatcactaaaggactgtgacgacattctcaataaagacagtcatggtgtttactgtgccaaggagggaaaatcccagatcatcagaatcccagtgcaacagaaaacagcaccagtttcaacaattctgatgttggacaaagcctctttttgtcagttaagaaagcgtaagcacaatctctcagtcaattgcattaacaggaatccattcatgtcactgaaaaatacttcttggcacagttcactttcctgacccaaagacaccaacaacaatcaaaactgcactttcagggtagtatattgttacactagcccagtcaaaacatactcagaacatttaaaaatgtataaattactgttagcactgcagttccgttttattttcttatttatttattaagacagagtcttactctgttgcccaggctggagtgcagtggcatgatcttggcttactgcaacctctgcctcccaggtttaagcaattctcatgcttcagcctaccaagtagctgggattacaggagtgcaccatcatgcccagctaatttttgtattttagtagagatggggttttgccatgttggtcaggctggtctcaaactcctggcctcaagtgacccacctgccttggcctcccaaagtgctgggattacaggtgtgagccactacacccagccctgcagtccctttttaaagagtactgactgttttcctgcaaagtactttcaaatccataccataaaggtagaatttatctggaagaatgtgttttttgaattccacctggcacttggttaaatctactttattttgccctttatttatttgaacagaactttagaatgctctaggtcaggaaaagaaacagtgtgttcgtttttaagaaggatgtgtgaatagtaagttggcattcagactcaagtcccatggtattgttcttatccaatgggacctctccttgggaatataattcctttcccagaggtatcatggtatcccaagaatataactgctctttggctctgtgtgtgaagattgggggagaggatgtaaactaagagtata

SEQ ID NO: 3415 - DNA, 7090 bp, Homo sapiens
tgtgtgtgaaatactggtttttattggttggcacaagattacaacctacaatttcaatgcccttccctcccacacagctcaaatggaaggaaactgattaacacatagaaaggaacggcaggctcacaggtttaagcatttgtttttacaaaaaggagtgggatatgggggtggtcaagttttacgggtaataacaacattctctctagatggcagggggtaagtctgcctgtcctccattgctggtaccacataagggatacattagtaaagtagggaaagggttatatgtgtggctggcctgttctttagagaggaaggtgggatggtatctgctgtgtacctgtctcagaccaaacctggggctggaccagtgcccctttcttctcagccctcctccacagcctgactgtactgccagccgcacccatgagaaggaggtgtgaaggaagcctgaggacatccacctcgagaaaaggaaacaggaaaactatttccttccgccttctctggaccaaatttcactcccctcagctccagagagtgctgcaaaaatcttccttagggacgctgtgaagacacggggaagaggccagccctgagcgggcaagaagaaaagcttgaactttccatgcagtaccaagcaaggctattttggaaacaagcaaacaaacaaaaaatggaaaccaacaccatataaccacaggttgggtagctcctaaatcctggacagcatttggattgggggtaagggcaattttactccagctccttgttttataacccgcacaaggtgccaagaggtttaaggaccacaactgacctctctttccctacaagcaccattccttggattcccagttttgttgagctcatttgaggtcatccttgccatcctcttaaaaaatgacacagcctcttggttattccattttctatccctttctacaattatgaacacactctctaaacaggagatctatatatgctctcatcctgcaacccaagagattaggtgacctaatgatgagaaggctaacttatttgctttcctgggtggtcctgatggaaatgaacagcagcagagttctggtgggatagagcagtctagtctgagccactgtgtgattccccaggggactggtccctgggtacatgggtccctggctctctgtctcagttccacagatattactcaacttggccatttacgcctcagctaaaacatatgagcatgagggaaaagggacaagaaatacttttgtcctctagaaaaacttaactcaatacatcttggctactttgcctcaacccacggggttccctggaaacatttgttgaacttggccaagaggagattgtatatggatggcacacctggaaaaggggagaaagcacactagttcatctcttttataagtagaatggtcccagggatgttaacctttctgatgctgatagtagatgagtggagtggaggtaatcgtgagaaaacttaaaaacccttaagctgtttggagactacacaccacagtggagcaaaccaaggtggggcctcactgcctcctcagagcccatccctgaccatgtcattggataggatggaagacaaagtctttgaaatggaggctgggctggcaaaagtaagtatgaagatgctactactggccttccacttcctctctctgatacacctaagaaggtgagagacactagcttcaattccattttacaacagttctcaacaacctgaaatattcttgacttccttaagcacatggaaaactggtaagctatatctttctaactgaaattttacttattctaaccaccaaccttttctttgattatcaaccagtttgacagtcttcagatcacaaaacaatagaacagacctgacatttacaaaactgtactacatacttatttcttttacagtagagctgaccaattacttttctaactactaatgcaacaccatgccactgggccctggactctgatgtttctgatccctgagcaacacatctatgtccattcacagatggaaatgaaagagtgagattctcagaggctaaacaacattctgggagcaaattggatttttgaagggagagtcctcttagaaaattctgagcaaacatgctcccagtcacgagggatggggtgagcgggcaggtttctgtctgtgagctatagctcccttctgaactccctcatgttcttgggaggacacaagcctcttgctcattaagcaaaggccctccaagtctcctttttacttcagcactttggaaactctccaagacttaacttccgatctggggaggttctacgtggagcagacctatcccttcttattcctgttcctgggtgtctccataatcagcctctaccttccctggcataagtcatatctgttatgctgcaggaactgagtaaccaaagctagatatcccttggaccactgattagtgacacattttctccacaacaaagggaggttaaagacaaaggtttaacctgagaaactttttttttggcaagataataaagaggttaaagaggctacgtggatctgtcactgctttagcttaccattttcaattcagcaccaaagtgctcagaaagacaggctcagatcaggacgacttcttaaagggattcacaggcaatattactggcaaaatgattttccaaagctgagccacgcgccccaccctacagggaggggagtagaatcttatggcccagcattggcattgaggcatcttgctttttttcctcagaattccacaaaggcttaagagtgatctaaatgcctggctggaagctcaagtctaggagagctattttactgcactgttgagatgttctctgcaaggtagtcacagataataagcaatttagtagataattattctatacaagaattaatgttctctgaaacagtgattaatagaatcttcacatctggcctggctgggaggcttgggggcaggaaagggagggtggaaggatgggtagcacatcaaaatggtgatgaacctggcaaaacgacaatgctgctgtttttgtatcctttaaagcctatatccagggttttaaatgacgctttttttgtgtgcttcctgataggaagtcaaataagttttagtattaagaactggggatataaaccaaaggaaacctagagtcaactgactgctggaggaacagaagcaatgacttctttccaccttctagatagtaatcttacttttgttggctaaaagcactttcttcagcattctgagttaacacgggttccctataagctcccctccccaggtggacagtcttattttctaagacaagctcaaagctcaaactcaccaaattaccactataaacaaagcttcagggaagagacataaccttacttcaaaagcttcaggtcagagacagccaaaatcatgtgactgctagcctcagctcaagtagtgtgcccaaatcatcacaaaatgggattcccttcccttttcttttttttttttttttttttgagacggagtcttgctctgtcgcctaggctgcagtgcagtggcgggatctcggctcactgcaacatccacctcctgggttcaagcgattctcctgcctcagcctcccgagtagctgggactacaggagcgtgccactacacctggctaatttttgtatttttagtagagatggggtttcaccatattggtcaggctggtcttgaactcctgaccttgtgatccacccgcctcggcctcccaaagtgctgggattacaggcgtgagccaccatgaccagccctccatttattaatttataaggggactagaaggacaaactatttgattaatttgaaggtgagaggtatcattttctcagatgctccaactaggcttctcacatccctcaaaggttatcagctaaagacaagagtttctgaggctaatgcaaaaacatggtcaaatgtgaaaccgcccttttagaggcagggtttgtgaaaggctgctggcctccaaaggagagtatgcctaaactctctgggctcccaggacctgtggtgacctcaagctaacctgatgcacagacaacagtatcttttagggactgcagccaatgttccccaatttactttttttttataccttaaaatatcaaatgtttcatttttaggtgatatcccaagtgacacagaaacacagctcctccggatggtgaagtctccgctgcaaaactcacgaaacagcacagaggatgactctagggtgctctcccacttgctccaagttaggcaggtgccctgatggaggcaaggctgagccattaacatgcacagctccatatcctggaagcctctgtagccttgaggagataggctctatccaacaggactcagaataaatgactgccacctcaactgagcagtatgaactgcccacctcaactgggcagtctgacctcttccacagtctttaagaaacagaagagccatttgcattatttaatcaccattcaataatctcctccctccccatagctgcttgagttaactgtcccacaagtgtcctgtgttttgtaaagatgagggttattttctgaaatgcagatgggactaggatgaagctgtattatcaattacagagacagccaactctcatttctcttaaagcaaaaattcattccactgtgatttctccaggtatttcctgcaattctaaatccgcccttgatattagagaatattaaaatcacacagttgtggcaaaaatcacattgtggctattaaatcctttttgtgaactaaaaaaagtgaatgtggcttaggctaagctgtttttttttttttttttttaaagatgaggatgcggactccaacaaaggcattaagaaagtactagatgaaaatgagaaatatgtgaaggataacatgtgaaatgtacactcaggtctaacaaatacctattatttctctggttaagaaggtttagcaggagcctccaatgagcactgtatgtagagaaaagggaaggagcaggaggaggaacagatctgcacagaatttttttcttaaaaaccacaaagggtgacttttttcttctaagcaagcaagcctgagaggcattacatgggctggctcctaatatcaaaacaaaatatttctttgccacaaaggaacttgactatgtagcaacacatttacaaaactactgcaaaacactcccagagggcagtgacctactctgctccccagaggctccaagaagcaaggcctcaagtgcctcatgttccatggggctgtgcagtgcaatgcagaaggcggaaatcctgctgtgacgccaccctcgagaccttctgcagcctgagagggggtgatactcccacaccctttgatccttccagatggctcagcctagatctagcagtgagagagccctctccatgcagggcagatggagtggtggacacttgtgaaaacaaaacactaactgttccatcctgttatatttgctgtgaggaaaattaagattcctgttgtatgggctgcactgtttctggaagactacagaaaatctaacatggttgacacttcctggtagcccttctgtacatacacacacacacacccagagagaagacagagagaaaatcctggtccaaaagatcacatgaccttactagtgtttccccaatgactgtaatttataaactaaaaatttttacaaatccactgctatcttcttctgtcctgagtttggtagactttaatggatgctccagcaataaccagaatctaggacatgcagactcactgtgagcgagaggctagggatctgccctaaacataggaacctgtttctatcaagcctgaatgaggtcagctctggtagaattaatgacaaatcaatgtcagtgaaatattctgcaaacagggtagcttttgtgctttcttttgattattttctttggggagataaaggtattgcaaccatgggtctaactaatctatcactaaaggactgtgacgacattctcaataaagacagtcatggtgtttactgtgccaaggagggaaaatcccagatcatcagaatcccagtgcaacagaaaacagcaccagtttcaacaattctgatgttggacaaagcctctttttgtcagttaagaaagcgtaagcacaatctctcagtcaattgcattaacaggaatccattcatgtcactgaaaaatacttcttggcacagttcactttcctgacccaaagacaccaacaacaatcaaaactgcactttcagggtagtatattgttacactagcccagtcaaaacatactcagaacatttaaaaatgtataaattactgttagcactgcagttccgttttattttcttatttatttattaagacagagtcttactctgttgcccaggctggagtgcagtggcatgatcttggcttactgcaacctctgcctcccaggtttaagcaattctcatgcttcagcctaccaagtagctgggattacaggagtgcaccatcatgcccagctaatttttgtattttagtagagatggggttttgccatgttggtcaggctggtctcaaactcctggcctcaagtgacccacctgccttggcctcccaaagtgctgggattacaggtgtgagccactacacccagccctgcagtccctttttaaagagtactgactgttttcctgcaaagtactttcaaatccataccataaaggtagaatttatctggaagaatgtgttttttgaattccacctggcacttggttaaatctactttattttgccctttatttatttgaacagaactttagaatgctctaggtcaggaaaagaaacagtgtgttcgtttttaagaaggatgtgtgaatagtaagttggcattcagactcaagtcccatggtattgttcttatccaatgggacctctccttgggaatataattcctttcccagaggtatcatggtatcccaagaatataactgctctttggctctgtgtgtgaagattgggggagaggatgtaaactaagagtata

SEQ ID NO: 3416 - DNA, 2546 bp, Homo sapiens
gtagtgaaatactgtgaaaatattagtgaacagcattttgctgtaatgtttatttcagttattaagatttaaagagttagtcatcagggtatgttagataaacatagttatcatttattaaacaaacagataattttctgtttgcatgcaaattattttaataagtgtgaaaataaaagtttggaagatagtatttttacttttatatctggacttttttttcccccaatttacactttgctttcttgtaataccacctcctgtgaatgtgttgtaattagtatcacattgattactttatcattttaatttctttgaggccctttaaacctacgtaaaatctgggtccagccatagcaaagcaagtacaaaatgaacaaagaattttgaagaaaagcctaaatcttaaattgctaagaaaaaacactgttatatttaggcccgtgagagcatatacatgtataaacctaatcctatgctagatatgaatagtcagtgagctgtaatatttctcataaatgctaataatgtttaaattcccagctttaagatcttagtgtgtgtatatatttataaaatctgaattgtgtgtttcttctatggcttactgtgtgtttctctttcagcaataggatgctctctaaaacattcactagcctactagcctacttactaaatttttgtatatgtgtgtttgtgcacttgtatgtgtgtaaagttttttccccaacttgacacaccttatctcagacattcaaaaaaagagaacattttgtatggaggacagtctgccaactttttgcctctctacagctcttagcctgtatatttactgcttgatcattcattatgccttctagataaccagtccaggttttgtcatatacctgtgtccctctattctttttatttccctttttaattttttttcttttttttccctccccagaaatcaggcttgtgttggaattcttctctataatactttgtttcccgcagatgcaaagtaacaaagtaactgagtaaaattagaaatctcattctgcacaactgtgcgctcagatatttaactcagccttctaatacttttaagtacgtttctgttatttatctttttgttgtttttgttttaatcccatagattgtcatcagacaataatagagtgattgagagagaaagatataaatgccacttctaactttttgataaaacttttttgagcatttttcaaaaatttgtatgtttgtggtaatggggaattaaacaccttttacagctgatgtatgttggaaatcattttatgtacatttaccaactggtacttatcttcaagttggaattttcacatccataaaagggagacttgcatcatatataattttcagtatactttgctgtccagccttttaaacaattacagtaacattttgagttctgtgatgaatagttctaggggaagggatggaactttcgacatgtaaagtccattgttttaaatgctaaccccatccccaatatttttgtggaacgtgaggctttatgaaaggtttatcagaaatagaatattctaaagtcacttttatggcttatttcaaaaactagtgtgaaagtattttcatgcttttttgtttctcatcttttagcaaagcttctttaccaagttttgattaaattgcaatataaaattaagttttttcacggtgctatattttgtggaatatgggtagcactcaggtttctttcttttttcttttctccttccttcttccttcattccttcattcctccctcccccctccctccctccctctcttccttccctccttccttccttcctcacctcggcctcccaaagtgctgggattacaggcatgagccaccgtgcccggcctatatacccttattcttgattatttcttttttcatcttttcaatcctgcttacttttatcctcacttttctttctgccatgaaaactgcacctaatttaccacacttaagattggcaatttttgattcattgatgggagaagtacagtagaaaggccctgcagtttagaattaagttgtgtttgtttatttacatgtatgcccatttcttctaaattaaatctagaatgtgagactttgacatataaaagcatgataagtattttcttaaaaaataagactattgatacataatgaaaccaccattggtaattgaattttaaaatgatatgcaaaaatatttagaaatccagttgggaaatgtgtttttgcatatgtcaccagatacacattaggcagtactacaaatgttaattcttaaacaatactgtggtgatggcaatcagtaatttatttctttgtcctgtaacttatcattcttgtcttttgtaatgtcttacacagtattaacataactgtaccttttttttgttcttggtatccatacattttaagatggaaaatcagttcatagttgatatgatattgtatatgggcaaaatgtccgttaaactaaaattcagtaaaaaaggtaatataaactggcttgatttat

SEQ ID NO: 3417 - DNA, 2829 bp, Homo sapiens
actaacaaaatttcgtagctaaagaatgccatggccgggtgcagtggctcacgcctataatcccagcactttgggaggccgaggcgggcggatcacgaggtcaggagattgagaccatcctggctacgacggtgaaaccccgtctctactaaaaatacaaaaaattagccgggtgtggtggcgggcgcctgtagtcccagctactctggaggctgaggcaggagaatggcatgaacccaggaggcagagattgcagtgagccaagatcacgcccctgcactccagcctgggtgacagagccagactccgtctcaaaggaaaaaaaaaaaaaaaaaaaaagaatgccatgccaggagaagacagctggtttcaaatccctgcccccaggcaagtaaaaccctgacttgctcaagacagaagatcttttctcctgtttttcaaaataaacatatatagggatggaccctgtgcattgtggcctgccttggtgtcctagaattggagccagtctttagcttaatgtctgaagtatttatacggccaatatgtgttttcttatgtcagaccacactgtctttttgaatatcagttcatttcctctcaccgagtgcttttcggtgagaggcaaagagaaagaatgaacaatcaagtattgacagactggcattagcaggacagagccatactagtgacaagggcatcccaaggcacttgcccagagctgcagagttgtgtgtgccatacctgcggctcaaagggaaggccttctatcccctgagtttctatcagctgaaaatggcaactgctgtctcagtaaaagctctgtcttgactgcagaggctccaaaagcattcacagttgagggggagaaagacagaaagaagaagccaaagataacctgatccctgcctgtctgttggcacctgtcatcctctggcttctgctcccaaaagcaagtctggatgactgagttttgtggacatggcactcccggagacagcagtggccaccatggcacccagagtttgcccaagtactgaatgttttgtgagcaaccatgttccccaagtaggtagccagcgctgcagaaaccaaacagcctcttagctacctgactttaaaaggaatgacctaggtgttctgccaaaggagttatctatcatctctggcaaacttgacaatcatcacttacctcgacaaccctgccccacatcactttataaagtcagcaggatgtcttctcacccaccctgtgctggtgtctaacaaatttatcttgtcatgctcaaatgtgtttggcagccacaccgatcggctgggtgctgaaccgcctctctgtaattgtagcatcaaaatgacaacagcagcagagcagcgaatcttgcacagccccacagcatgcctgagacaagactccaacaagtaataattagctttttttctcctgccgcctacagtacctgtctaactaaagagcttcccaaagtggagggaaaggccatagaatccaggtgtcattcagagccagtccttgctgaaatgtggtcttccagtggaagcacctgtattattgagaggaaaaagtgttggatgcaaagtaacaccaggactagagagaaagagaaaggtgaaccatcctaaggagctttggatacttttttagaaggataaatattatgcttactgaggagaaaaaaaaaagcgatcacagaaaaatttcacagctaatatttttacaaaagttgtgccagacattacagagtgaaaacgtctctcaaggtggaatgctttagagagcaaaggcttagcatagacctagacccttgtgtgggtatgacatgacatgacatgtccatgtcaaaattcactttagtcagaaccagagtattgataaacaaaatgtcagttacctggagcagtcctggagaggttaagacattctatactgttctacgtcaaccatttctacaaagttgtccagacacctaaaagcagctttcttggttatccagatgccagaatcaaccttgtatctgacaatgcacatctgttgattctaaagtatatttatgtgtgtgtgtatgtgtgtgtatacagcacatatttacatctatgaagacatagacacttacagagacccacatgagctggcactttctgagcctttacagcctttaagactcggaggttgagaattagagacacaagagaggctgtggatggcctattaaaatgattaaagatgtaaattcagtgccattttaaaactgttcatatttatcaaacaattactgtctacagctacattttttgttaacttacttaaagtcatgtcgcaagaaagatcaaacccatgaatgcttagtagctaaggctagtgttcaaaagcactctaaaagacattttgtccacattttggaaaagaaaatatttgcatgtttaattcataatttaggctatctttgagtatactgtaaagtgctgtgtgatataatatcaataaagtacttattaaatggcactttaatgttttcttttaaaataacgcactgttctaaacttcagtattgactattgactcgtgcatagaatccaatgctgtaattagaaagtaatctgtgactagaatagacctttgtccctgttagtagccctgttgccatgttcaggcttttaaaaaatgcttttgtgtcaccaaatatatctataaagaaaacaaaatttctgttcagaggcctctgaaacttggctttcttacatgtggttggtttatgtgacaatccctatgaaatgagtggacgtatgatttttgaattaaatgacttttcc

SEQ ID NO: 3418 - DNA, 1178 bp, Homo sapiens
agctgaggacaggcactcctgccttccacctaaattttgcatttcccgagacaccttggcccgccattcccccgtcctgtgcctgtaaaaactccaggccctagaaggcacacacgcacaagtggctggacttcgtgaggaattcataggggaagaagatgcaagtggctggtcatggagaggactttttgacgagcgccggcaaaagagcacagcgaagaaatcccaggatacggaaagccctctgtacttgcaacaagagtctcactgtgtcagccaggctggagtggcatgatcttggctcactgcaacctccgtctcccgggctcaagcaattctcctgcctcagcctccagagtagctgggattacaggtatgagccttgcaagaagacatacatattttgctgattgccaaggggataatgcattgggtataagaagaaggaaagtagaggaaccaattaagaaatatttactacaattaagaagagatgataataacttcgaccaaggtggaggctatgaagatggagcaatgcgaatacatggagacatgtttttgatgtagactcagcaagaaattctaatatattagattttatgttttgggagaaaaagagacatctccaagattatggcttgaatagattgggactaatagtgaaacttgagagtgatcacatatggagatgaaagattgaaagacctctcgctgaacataatatagaaggtctaaaatactctcaagtcccctccatctcaaaatgacagcagtaacagtgaaaactaaacatagctgtaccaagggcctgtgtatcttacttcgccctccttgtgagttgccacttcctgttcatcctcctatcaacgtgatataaacaccaaaatagaccaaagtaattatctggggaatgtccagagggtgtttaccttcagaaaattaacagctttgagactaaatcgatgacccagcaagaaggttctcatcagtggctgaccagatgccagaaacatgccattggagtgcccagccttcagaacagaaacatggctgtataagtagaaaactttgaagaatttgctgtaagtaacaaatatgtttagaaaggttacagactacaatatctaatttagaagtcctttgtatttctacatattagtaataaataattggaa

SEQ ID NO: 3419 - DNA, 422 bp, Homo sapiens
ggttgagcacagggtactttattgatggtacatgacaaggtgcggctccctaggcccctcccctcttcaaggggtctacatggcaactgtgaggaggggagattcagtgtggtgggggactgagtgtggcagggactccccagcagtgagggtctctctcttcctcttgtgctcttgctggggctggtggtccaggggtcttactccttggaggccatgtgggccatgagcttgacaaagtggtcgttgagggcaatgccagccccagcgtcaaaggtggaggagtgggtgtcgctgttgaagtcagaggagaccacctggtgctcagtgtagcccaggatgcccttgagggggccctccgacgcctgcttcaccaccttcttgatgtcatcatatttggcaggtttttctagacggcaggt

SEQ ID NO: 3420 - DNA, 777 bp, Homo sapiens
gaagaagaagaagaagaagaagaagaagaagaagaagatacaaaagcatctgtgctcttcatattatacagtgtgtgcccaatgggaaggatggagggaaacaggggagaggattctgctgccttctcaactcagttctactcaccttgcagttagcagagagattgccagtgttaccttttgtctgggatacacagctgaaggaagaagacaaactaaatgcaagcaacagacgtgtggtattaaaagaggaacagagaggagaaaagcagagaaaagggaggaacagttcatggaatacaattctaaatttaggtgcaaaagcaactctgtaatatgaggcttctttacaaaacagctcaccgatcatactagaaaatttggaggaacacacacgtttccattcccatttatccactaaaagctgctttgccggcttttagaatgtcagaatgctaactgggcagtttaaaccttggggatcttattttgtatttgtttgagcactagaggaaaatctctaaggtacagtttttcttagaatgtcactttgattctgaccgttctcctcccactacccccaacacccagattaatttatgaaaaacggaagcaggacatgctacacctgtgcatggacctggagcatggagggaaaaggagggccttaaggggctgtcaccctggggaggatataacatgaaccataaaaacatagtgaatgtctttgacaccaatctgtaaatgcgtggcagtcatgaagtaatcagtggcctg

SEQ ID NO: 3421 - DNA, 2122 bp, Homo sapiens
ccagaggtgcatttttcttatttccatatagtaaagttgagcttttacagtgcataatgtgacatttggaatgcttatcaactgcatgtaaacattaataacctgcacttttttgtcttaaggtttgttgagctgttttgttcactgtactttaactgtgatatggaaaagactgcattctctgtgctgttactaattaggaaagagaattgctttgattttgtctcttgtttactatagcttcttaaagttaagccttgtactacaggttgttggagtactcctagatcactgtttcatagtagccagcaataagtagtgcaagtcaacaaaaacacagcaaacttaggcaaagtgtcctttctttgagatgcgagttctttcatgaggttttctttagggccagagttacctaaagtgaagcctttcttatctatagacttcagattctgcttggaatcccaccggctcaagaagcacatgtattgtgcaattaattgtctttacactaaaacagtttaatacaatctaactacgattttgaaaccagtgtctgatttatggtcagtgggtttaaaaagaaatccacatgcagatcttttaagacttaaaaagtgatcatagaaaagactaagtgactgtaaagatgctctttttttaagcatctcactttacctccccaagcaccctcccaaaccttgtcttccctcttctgttgcatcctttccctacccttccctcccaggtgctcggtactttacctagtttctatatatcagtgttttatgttggaatttttccttgtttttattttactagttggtaaaccctgtttatgctgaaacaaataaggaaatggtatatttgaccatatgtgttattcatagaagacagtatgatcaaatgtgccaaaaacaagcaaacaaaacttaattcctgagaagtatgccttatttttattgatctgctttgtcttacaattaaggtccaagagcttggttaaactgtattatttgcctaagtataaaagaaaacttgaactgcattgcaatattgacgttctttaaaatgagagacactgtcaagtaatttaatccagagatcagccaccagatttgaaatgcttatgtatgtgtgtgtgtttggagttgtttttttcttttaaatcaccaaattttttttaagctactttttatttgtgcctcctatttatcatgctgatgttagaagcagcagtcatccagccacagagggagctaaagttaactaaccagaactgtagaaatcattatacatgcctttgacaacaaaggaagttcataagaaaagccatgtcggcttttcctctactagatacagattggaggtagatgaatatttgccaaatggaaaaaaagacaatgctagtcagaaaagacaaactgttttccagcttctcaaaaagccatggagagtagaaaccaaaaccaacagggaaataaaaaaccttgaaagtctcactttctagttgtcccatgcaggggttgaaatttgattccaagcggaaagtatattatgttttttcaggccttcacatctagagagatggataacttccaatttgatttttcaggtaatagagaaagctgctagtaattttaacccctgcctaaagaagacatatacttcatttgggagcaaatacttattgccttgaaaagtagcactgtaatagcctatgataattagttgtagaataacctttatccctttcaaactatgcaaattattaaataagtgtaaattaggattcaattaaagatagttgattatattgcaatcagatggcattcacaaacttaactggagcatatacaaatatattagtctaagttttgtatgctaacagaaagatataatttagctacctattctaaaaatggtgaatattattaatattgtataataggagtgggaagactgcctccttttttgaagagagagattaaggatttttataattgtttttcatcaaattttaatatttttgtcaaatttttaggtatttaatttgtaaaacagtttgctttgtactggcatacagaaaatagggtattgattttaaactttttgaagccaagtg

SEQ ID NO: 3422 - DNA, 4233 bp, Homo sapiens; identical to SEQ ID NO: 3303

SEQ ID NO: 3423 - DNA, 4230 bp, Homo sapiens
cgaagcttggccaactcctggtccttgccttccttttccgtcagggcatgagccagtgcctcttgcagggtagcgaactccacacgctgctcgttgagggcgttctgcagccgcatctcaagctctgctctggccgccttctccagggcaaggtcagcctgggcacggccccgctcctgggtcagccgcgccacctccctttcctgctgcccacgctcctcctgctgctgcccctggctctccatcagcgcggcccgcagccgttccagctcattgcccatctgctctgcctcccgctccatagcctgcagcgctgcctgtgtgctgcagaactggcgtccctgttgctcttccagccactcgggctgtctgtctcctgccctcgcaggctccttgactaactcccgggaggctgtttcctgctgctcacctgccttgcgcaccaaggtctccaagcgggccacctctttgctggtggcagccatcttttcctgcagagtggagaggtcatctgcaagcttctgggccctgacttccttctcttggacctgctggagtgctctggccaggttggcatggagctcagctagttcgttctgctgccggcttatctggagctcgctgtgggattctatgcctgccaccttctcctttgcctcctgcagctcctggcgggccttctcacattcctccttcaaagtcatcagctgttcctggaacatggcgccatactgtgcctcctcttgctggctatcctcataccgctcacgccaggcagctacttctttgacgagctgctcacactcactctcagctgtgtgctgggcagccatggcctctgccagctcccgccgcaggacttcagtctcagcctgatgggcctccccaagctgctgtaatcgagcctccagccccttgcgcccagccctctcttcttccagctcctttcgttcccgcttatgctgctccaccaggcttcgggtctctgccttcagctcagagatacaacgctgctgctcttccagggcatctgcagccctgcgcttctcctcttcaaggctgcccttggtgaccttcaaggactctttgagggcctggagctgctcctggagctggtccttctcctgggccaccctttctttctcagttgctttttgctgctcagaccgcagctgcaactctagctctgcaacctgggcctgggcctcatgctgttcctggcgggctgtctcaacacaggcctggagttcctccaccttccggctcagctctgccttctcccgctgggcctgtgtcactgaggtctgggcactgtcccgggcttcattagccacctgaagttgctgctgcagaatctccagcttggcagccttctccttctccagtgcctccagctgcttgagagccgcatcccgctcccttaaggaggcctctcgctcctctgcagcagtggccagttgctgggcatggtcctgcctagttgcctcctgcttctccgctacctccttcaactgctgctccttctgcttcaggctactgcttagctgctccacctggtggcggaggccctgggaggcctgttcttgctgttggagggtctgtgctagctgggcctgcttctctttggcctgctgcttcaggccagccagttcttgatcctgttgctggatggtggcattgagtgtggtgagctcagaggtcagagaggccacctgggcagtcaaccgggccccatgagcctgggaggcctgctccagctcttccttggcctggctgaggttggagatggagctctgcaggtcagtgatcaggctagacagctgctgcttttcttcttcgaagtggccccgctcagcaagcagcttggcttcctgctggcctcgctcagtctccagcatctctaccctggcttggagctgtgtgttgtttgcagcaagagtggctgcctcttgcttcaaggtttccagctggtggtataaagagacaaactgggatcagcatgactcctcagtcatcaagactcctctggaaatggaggaacaccaggaacccaaatgtactgaatgtgagtccacaccaaccagcagcacacaggtctttctgtgcattcctacctgcaagacatcacccagcacctcgcccttctcctggggtgggttatcctgcagctgggacaagtgttcttccagctgtgaaagttttccctgaaggatttcgttcttctcttcaaggcatttctgggagtaaatgagacccatgtgaacagagagggggaacaggcaccagattaccacacaagccctcataaacatcagcaaacatggggcccatcatcttgttaccaagatctccttttgccctggcctagaaaaaagcagaaaccatggaactgggagcatgagggacctgattctctagacctagttctaaggcacaataaagtcataatgtaacctgcttactacttccccaaggctgctgagtttacttcaaatttccttaccgtatacccttcctcagataagtcttgagtcctagattatccaaatcaccaccagctgcccaccatcctctgggcagcaataccactggcagcagctactcgttactactcccattttagggaaaggatgcttagaaaaacagactgattaacttgtccaagatccacatcttgtgaacagcagagataggattgaaaggtgtactataaagtgagggcattgactggggaaaaaaaaaataagttaaaaaaaaaaggtgtactagactgaagcccacaatctttcaattacagcacactattgaaccttgaagagaaagcaacttaatacccaaaggcccagaagagcacagtggtaaactggactcagctttgcacatgtggtcaagactgtggctgtgaccccagcagagggttaccttgtcctgcagggctgcgctgagctccttctccagctgggcctgcttctctagccactcctgagtggccttgctgtgctcctccgtcagctcattgagggcatcctgtagctgctgcagatgactggcaaactcccgcagctgagacgggcaagtgagaatccccatcacccagagtcaacgctgaccccaccactgctgtctgctcccagaaccccaggggctggatgcctccaattatcctgccaaccctctacaaaccaatcacagccatcacacctctaattcagaactacaaatcaacatttagggtcacagcccagtacccgggaagccgccaattatgggataaggaaaggggcaaaatatgcaggtctctggagagactgaagcataagacaggtgctgggacattcttctcaaccctctcttggggagccttccagaccacctcagccctgaggggcctccatgcacacaccaccttaacacccaccttaaaggaaaggtctccattctcctccgaaagctggttgattttgcgatccatctggctcttctctgtcttcaggtcctggcactgcttcagggtttcatgcagccgcatgcaagctgcttcttcagccgtctcatctggaactgtggggtctgcaggatatcacccatgggagaagctggagaacctgagagaaagctgaggagggagaaggcccatatgcattggtctcatgaggaacctgaatacaaggaacatcaaactcaacggctagaactcgcctagacctccttcttacattcctatcatccaccagctgacctcttcatcagaagaccagcagaacgatcactctttctactgtagtaccagccgaggccattgatatattccgtacttagattccttatcattatttcctggtttatgtatctgcctttccacctagaacatgcactacatgacgggaaaaacattttttaaaagactgtgggccgggcgcagtggctcatgcctgtattcctaacactttgggaggccgaggcaggtggatcacctgatgtcaggagttcgagaccagcctaatcaacatggtgaaaccccgtctctacaaaaaatacaaaaattagccaggtgtggtggcatgcgcctgtaatcccagctactcgggaggctaagcaggagaattgcttgaacacgggaagtggagattgcagtgagctgagatcgcaccactacactccagcctgggcgacagagagagactctgtctcaaaaaaaaataaaaataaaaataaaaagactgtattctc

SEQ ID NO: 3424 - DNA, 3466 bp, Homo sapiens
gttaggcagctctgcgtccgactgccccgcagctccggggaggcagtgacgagggcgggggactccgaaaagtggcagaggtggcgggggggccggtctgagaggagtggcgggaatcctagcgacagctatttgtaagtgggtgatgagccgcggtgggttgtgtcccgcgcggtttcaccgtcagggaagacgctctgcggagggaagcgggcggctgggcgccccggggcggctgccgcagggcgggacgggggctcttggggcgcggcgcccctctccccccacagagccagcggctctcgcttgccccttcctcctggccgaggggcttgggttggagggatcgggacacagctaaagattttagaaacagcgcatcaggatcgagcgccgtttattggtcgcaacaagtgacggcgcccccagccccctcgccccggcgctgcagcggctttttccacccactgtccctcccggtgcagcggcgggacctcgtccagctgcccgccagggaagcgaaaaccgtcggtgccggcgggcccccgaagctcccgatcccggcgacgacgcccgggcatcggaggaggaacccgcggcccggggcgctgtccagggggtgcctcggagcccggaagctggctccttccggtgccaggccacgcgcaccgctctccgcacgccttccagagagggtcccgggattatgcgcgcggctccggggaagctttcagggggttcagtggtctcgcccagcagcggggcctggtggcggggacacattcgaactgaggcaaagatgaaaataagcaaacgcgcagaaacgaagtcactaacacgagtagccaccaccaggaaccgaggagctcgggggcgacgcttcccgaagcgtgggaggggaggctggctgcgctcgcagaatgggagagtagagggggagggggcgggaacccggggcccctcaccctgcagggagactccgcgtggcgttctccggatcccagggaactgatcccagggaaccctcaccctgcgggaccgtcgtgggttgctttcggaagcaggacaaccggcaggcggagggcggggagagtcaccacctccctgggccagggttcacacctttgcaccacaggacttgtgaactgtgtgtttcctatatgactaagagaaaaagggaattctaattttggagagggagtaaggcttcggtaactctttgttctgaattcagttccctggaaagtaactcgcgcggacctgtagttaaatcagcagcagccaagggtttcgctcagccgaggtaaccgttaagcgccagacagtttggttttcaggcgatttgaaatttgtggccttggccagggtttggctataagggaaaggttcgagatcgctgcgctccagcacccctttcgttcaccaccagcagtttatttctcttagccccgggaatcgtaacctcctaaccttttagcgctgcatcacgttgccttaatagacaggatccatttctctcgtggttcttctgttttctgcctcttacttccacctctgtgctgaacgcgacacttcagccaaagtgctgaagtcgtgatttaccgcaacagaggaagaaaaaaaaattacagcagggatcagcagcatcacagcagcccttcatttgggccagcatttggggctctggatgctcactttggtgagctctagagagctcggggtcaaccagtccaccagcttatgtgcccggtgcctaggagggccacgtccctgctcccgacaggtgggcactcaaaaaaagtttgtgaatggcccagggtgccaactttccaggaatagctggaaagcattatactgaaacacgtgcttccggttctctggggagcccttggtttttgttgctaaaacttgtggttacacactattggctgtttaagtgactctgtttttgtagagttaatgttatttaggaaataatgaagtctgaagcaccagttcaaattatgtgtatgtgtgtggtatagtcaaaatatattgattcaaaactctgaaaattaactttttacagatatcagcaaataacagatttctgcttctagagactatcccaataaaagcatggctgctttaagccatcctaagtgcatattattaatataaagaagtggctgcacaaacctacttttggaatgattcatttctgcccgcaattataattgcatccatttgtgatactaacattaggtaaaagatttggggctgattcagctatcttactcttctcatttatgcaagacaatttagcttaatatttgaaacctacagaggcataaaaccgcacattttctccactttgttgcatgcaattcttttggaaagaaaaaaaccttaacccccatctcccacaaaaccagatactagatgagctccttttaaaaattgtgaaaaattaagaataccatgtttagcgaggttaaatgatctagatgaataaaaatgtagatctaaaggttaaatagctatttgacctattggtatcagggtaccaagggtctagactcaagcacatcacctttggagctacttaataaatattaatgacattaaataaatcctttagtttatccattcattcaacaaacatatagtacaagtattttgtgctaagtattctgttagccacagaggacttaaagatgaacacagcgccttcatccttagcaacagtgggattgtgtggcagaaaaggggggagcgccaggagggcaagtacatcagcttgacagcagtagcagacaaagcttcctggagaaggaattacagtgtctttgaaaacttacttcattatttctaattataaaagtaacacaggctcattgtggtacataaaagaaaaacaaatttataattaagtaaacgcgctctcttcagtgttcaccatccccaaccttactacacagagcttgctgtgttcagtgtggaaactttcagtcttttttgtatgtatgtttatacacacgcaaactcctcctttaaaaaaataacaaaactaggatatcatatatatttgtctataatttcctactttaaaaagcgtattatggtaattagccttctagatagtctccagtgatacccgcttcctggtattcacacccttatgttaactcctcccacgctgtaccagggttggtctgtgtagctaacagaacctggcagaagtgatgacggtcactcctgactttaggttatactgagacttccatcttgtatgtccttttttctcttgtatcattgagtctggggaagccgaatgccacattgtagggacattctgcctatggaaaatcccatgtggttgagtaattgaggcctgataaccatgtgaatagctgtgatgtcatgagaaaacctgagctcaaacaactcagttgtttctggattcctgaccatagaaactgtgaga

SEQ ID NO: 3425 - DNA, 573 bp, Homo sapiens
actaaagaaggcttccccacaacccatatgcatctgctttgactggtggtttctatcatcctacaaagactgtgacttattggtgagggcagctggacaactctgagagcaacttagagaaatccatcttgggcacactctataaaggagctccttctctgcaaatagcaccccagataagtgcacaaaagcaagataccctcgtggacctacacgtcctcccgcttttcaacaccctgatgcctgaagctatggttgatactaaaggaggttttcccactatccgtatgcatcttctctgttttgagattgcaactatggacagttatggctaatcctagtagattgtcttcccttttaacatcttggatgaatttgggtcacactaattgttatgtgaagatggatgttgaatgtaagtttctctgccattcttagccaatatataaaaattacattagcctaattgctaacaatgccaagaatttaggtttactatccctctggacaatgtagcttcttgttttcttaccatatagataactctatagattcaccccagccagtcatctt

SEQ ID NO: 3426 - DNA, 611 bp, Homo sapiens
atggcggaggtgcaggtcctggtgctcgatggtcgaggccatctcctggtccgcctggcggccatcgtggctaaacaggtactgctgggccggaaagtggtggtcgtacgctgcgaaggcatcaacatttctggcaatttctacagaaacaagttgaagtacctggctttcctccgcaagcggatgaacacccacctttcccgaggtccctaccacttccgggccccccagccgcatcttctggcggaccgtgcgaggtatgccgccccacaagaccaagcgaggccaggcttctctggaccgcctcaaggtgtttgaccgcatcccaccgccctacgacaagaaaaagcggatggtgttcctgctccctcaaggttgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacatggagaagaaaattgacaaatacacagaggtcctcaagacccacagactcctggtctga

SEQ ID NO: 3427 - DNA, 595 bp, Homo sapiens
agaggggtctgcagaaaggatgtgtatgaagcttagataataatggctgtttcgtaaactgtttgagacctattaatgaaaatgactatttcttgctgtttttatccaacgtctgcattttccccctttaaagctgcggtctcctgtttgataaaagaatattggccagtattgcagattttaactgatttggctgatcctccagggaccagtttctgtgggcgtgtattggagcagatgtatcggcaagcagtgtaaacggaggacttggggaaaaaggaccacatagtccatcgaagaagagtccttggaacaagcaactggctattgaaaaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccc

SEQ ID NO: 3428 - DNA, 2781 bp, Homo sapiens
gaagcattgcgtattaactgcattggttaaccaacattggaacccaatactcttgtattaggcccgcatttacctgagtaaactcagtggttttctgtcctaagcatgcttgcctgctacatcccatggagaaaataaacagtgaaacactttcctcatcttcaaggcaattgtctcaggcatcctccaggcatcatgaaggagggtgagcgagggtgcgaggtggaaaggtccaggccgcggctgtgactcccgcgggtgaaccacagctccacagccccaaatccaaagatgctcttgctgcagcacgacaagtgttcaaaagagaaccaggcccagcccggagaaaggaaagccaaaagccaactgaatgaatgaccctcccccagaagagcaaccctgcccccaggccatccaagtgcggtgagttgagaaatgaattgacagacgctgcagggctggagcaggaggcggaagcaggttggaaggctgttgtgtgccacccctccctgggagctggggagattcccaagtcttagtgcagtgtttctctacaaacggggtcaggagaccctcactggcaggctgacaacttggaagcagactgtgggagcaataggctggagttttcattttccctttaaactcaagaccggaaggtttgtgttatgcgataccatatgctgtgtagaaaacagggcctcagcttcttagatgttgtagttctagagtttaggtacttccaccctctctcctatacataaacactctgtggaagaggttctttgaaaattggggtggtgcaggaagggcaacggtgatggtgagcaggccccagggtcggccctgccgccctgccgtgtggggtagggagacagctggtggtgtggacacattcacagaactttgtactggtcctgggaagatacaagtcctcacttggtcgccatccctcatattttctagtgttttcttttccagtcaacttttcttgatgaatgactgcatgtaagaggatattaagaaaagtggccaaatgatttcctttttttttcctttctctccaagaacattaccaggtgccagcagggaaaggactccgctgcctgacgcctctcccacctgagagcgcagagttcaccctttggtgacctccaccgtggctgcagacttcaggtggtcctcacgcattcacagaactgtctgcttaggttacagcactttgggaggccgaggtgggtagatcacgaggtcaggagatcgagaccatattgaccaacatggtaaaaccccatctctactaaaatacaaaaattagccgggcgtggtggcgggtgcctgtagtcccagctacttgggaggctgaggcaggggaatcacttgaacctgggaggcggaggttgcagtgaactgagattgcgccactgcactccagcctgggtgacagagacttcctctcaaaataaaaataaaaataataaaataataaatggttcttttctatgcgtctaatgaatttaagtgcttgttaagactaaaaaccatgttatgcatttcctgctcttaaaactaaattatgtagaaagtaagctagggagtgtaagggtaggcatctggatataaatgcttctcccaaatcaagattttctcttcaatctgtgcctttgaccctgtcaccaaaggcaggtgacagaaaaaaaaaattatgtgccttttggaagactcagtgggacggttctgatttcattcacttctggtgccagcaggcccccataccatgtggccattgctgtttcgtgtctcttcctgcataaataatgcagagaggccatgcaggtatgcaattttctggagatgaggcagggagatttgcaaggaaaagtcacctacctccccaagctggtgcccacagagggggaggcacctccacctgacgcaggtgtctgagcagcagtccagagaggtttactcaggggatttggggagcgcacactctggagcagaagtacaggtatgtgcccgaatcctgcctcgtgatgggcattcatgatacgaaccacacagcctttaaagaaaaggttttatatgaaaggttccattttgtttctgtataaaggcttttatcctgtaaggaaaaaaaaaaaacacaaaaccctagacataataaatgcctgttttctacaaaaacaatgtctaactctgggtggactgatctcttctcaacagcccagggcagggctggtccctcattcacctgtgtccacagggccgaagacactgcacacactaggacaggatttgattgaatttaaatcctgccacccaccaaggagacctcgggatatttaatgtttgagggccacactaaacgatcactgcagagaaccacctcttttctttactgtagtttaagtatgataagtgggctttgctattacttattggaaaaaccagtaagaaaagctaattttcaggcttcaatgtgatttgacatgcaaacgggaagttttgccaggggttaataaaggttgtgaattccaaattcctagccgaatatggctttgctggtaagccccctggaagggaggttgggagggctgaccagatggtcatcggggcactgggatggaggcacgctggggcctgactgcctgctctgctggagactgcagaatggatggcagatccacagtgcatcccccttccaaacccaggaggcatctgtcgccttctctttggtagacagtctggagacagcagaaaccctctgctctatttttt

SEQ ID NO: 3429 - DNA, 5094 bp, Homo sapiens
cttctggctttggcagcctcagctgcaggacacaaacaatctagggctgctgggctggagctgccggggccaggaggaaggtggggatgggggcatggcctggaggggcagctcctgggggcactcaccgtggaagggctctggcagagctgttctgtagcatcagtgacacctggcaactgcattcgccaacccggttcctgaagaattccaaagatcaataaagatcaagaggccctctgggcaaagggcctgttcagtgtggacttgatcacaggctgctggccagcggggaagatggaagtcgccggcttgactgagacattcaccccagccttagatttagggcaggaccctctcactgtgtggtcaccctttattttctcagctcttatttaaaaagaagaagaaaaaaagaatgtctggacaacagctaaggcaggcatccagaaataggaacacttttctaacacagcccagatgcaaacatcaggagcagacactgcccagatggcggctttaccccagctggactcctctgaggctttggtggtggacagccctgtgccgcaagctggagtaagccgattctccccatgggggaagcaggctgcagcagtcaggagagctggctgcctcgggagagttgaggaatttcctgtcttgcacagactgagaaggctcaaggacaaaatgtttttgtctttctatagcattccctgttcctgcctctctgcaatctcagcgagtccccagccttacagagcttcatgcagatgggctcaaattcctagatgctacgggaacgtcaccaactccagcgcactcccctttaagcctgtggcagtctcctcttcaaccccaccttctctgggttcttcccacagcccctgtttcctgggggtttggcaaagccaagtcaccctgtgggtctcagccattggggactaaaagcctatctgcctctccctcccctgggagctcagaagtatgcatgaaagggtggcctgggagctgcctcccacctggcagctcactggttccacctgcagctgtggaggggatcctggcctcaggcaagtctgcctccgtctgaagccccacttcctcatcggtctctacggggagtcgtggtatcatcacaggactttgggtagttttaaagagataataggtaaaaatactttgtacaaccattcattatcaatgagaacatttgtacgagcctagcatgagaactgactcacatctatccacttgggctcaattactcaatgggtttatcagcagtcaaagaaccaatggagtctgggcttcacccaaggattatggactcatttttataggacctgaggcaaatactattaggaatacaaatgcgttgcttaaaaatatcatgggatatatctcaaagtaaattgaggacaagctttcattgcaccccctccaggagatgagtgagtgaacttgggggaaaccggccgatcggcagacatttagttcggtgtcactcattgcccccggtcctgtgttttgttccccaaagccctacagcaagaaagaagggaagatggaaatgattgggagtgaatgttcagaacgagcctgttctcagaccggcaaggtgggacccagtcccaactcaccattccactgtactggtgtagagaccaggagagacttaactaacgggaagtgacttggctaacatcatggggccagtgtgggcagacccagagctcatgcccaggccttctgatgacaaggccgggatgttacgtaggcgtcccttcaaagggaaccagtctcctccaacggtgcccatggtgaccgctccaggacaaacacactgtcagctgacccacatcctagatccttgacaactgagaaaaactaaagcagaacagagacaagccagaatggaaaaggattgatcgggctgtcgtccaatgggaaagacaagcacaatgactaagaataagcccaagcagattgctgacaagtaaaaacgatgccatgtagacgaagctgttaataggacttaagaaagagcaagaatggagaaagggaagaacagagagaagagaaagaaaaagaggcaatgtgaggaagagagagggggaaaagggaagcaaaggaagggggagagaatgagagacagacagatatacgcactctcccctttatgattctactgacccatggagtttttccgtccttgccattttggctgtttttgactcactagaagttgtttttgaagccagttcctagtcatgaaactaaacatgaaatgatcgctctggtgaagcaaaagcatcaaacaaatgacctatcaggatccaagagcagccatgcagaaagcccatgggctgaagcaggtggtggcctggtgctgctgctgatcacctggactactgtgggcagctgacatcacctcctgagcatcactttcttcatctgtaaagtgaattcggaagtgtcaagtggagttgttgtgagaattaaataaaacaagccagcttttctagccaattagactttcctatcaaacaattccttcttaaaaacaaattgatagtggttttactttaaaaacctaatataaattgatacccaacatggcgttttggaaagcttttatttagaggaagagttaggagcagtttgctacctcttgcactaattcttcttataaaataaccagtaaagcctcttcttcaaacccagcaccaggagtgaggcctttacctcctctaggacctgacactaggaacccactgttgcctttgtcctggtggctgaccaggatctgccatctccttctgcactacaataattctcctgtcttcccttcacagcccttccttttctttccgttgttttagtaggaaaaacaactaaattctgaatttctccttataagtgtgtttttctacctgccaacatttgctggtcaacttgctactttctgaagccccaaggtcctggatccaaatttgcattcaacacatgtttgccttaatcttggatctaccaaatattttccttaggctttgaacatgagctgtattccttagttattacaatgcaaaatgccattccaacagcaattctgattcactccaaaccctgttatactatggaaattcaacagatcaccaattgagggggcaccatggaagcacagtgcccccatctttctttatttggagttcaaaatccagcatggtccagggatcaccaccagcctcctcctttccctaaattccaggattgttaactctggaggattcatcaaagaagagttacattctccctgctgacacgccacacagccccttcccatttccagggggtttgtgcaagctgtaaatccccggggcatctgaattccccttaaacaaaagtctgtctcctaaccaaacagaaccttcttgaagtcagcaaaatggctactttgtggcattaaaaggatttttcctcccatagccttgttttcttttggcctcccttcctcccagaacttaagaagcaaatgggaagagaagtgtgcgaggaaaagaatgaaaggaacaatgacgtataatatcccaaaaaagatctctgaccagtaatgatagggttgctagctgggaagcaaggatcactgaaaccacagcctttccactgtcttagaagctataatcacactctaaacataaaggtatggcatccaaaccacccactgttccctcccagtgcgggcctggaagccacactctcagttacactgtcatcacatgggtcacattttgccactaggagctcaatcctgcgattctggatagcattcttgatctgggtctctatgtaattatgactgactatgggctgtagaggtggagagttataaagctctataatggccctattagtaaaatgaggctcaaattctatggcatgggcacaaacgtacatgtatatgctcagaagtctttctgtaacacaaagaacccatgtggtacacaaacccaattctgtactcaacctacataaaatgaaaatattggttataaattttaacatgtaattaattgcttgccttcttacagtttaaaggcttgtggacagatgttttgaataaactaagcttcttaatatatataaaaaaggcaagttaaaactggtatttattcttcttcaatatatttttctgtagccaatgtaagtatttaagaagttgtcagtgtttttaagcttgaggaggtcaggatccatacgttatgttaactggatagattgtatagtgtccaaagtacctgtgcataaccagggaagacaaaggaggtggctccaggctgccccgcagagtgcctggtattaatctgaaaacaaactgtgcctctactcattgccaagcaaacgctgacttcactgatgcctgttgtcttcattagaagctctgcatcaaaacaaatactctaataaatatgcttgttatattttattatctattctagagatgatcttttcatctttttaacctacccacattttatgtccttagatgccttaaacaggcccactaggccttcagttaaataaacaaaccgttaggctgagaaactatgtcaaatgggcacaactggcaggctattaataaatctagacacttaagaattttagccttgatggagatactccagggggaaaaaattttaaatattctagcccaaggaagcccccagcaatgactcagtccaaacgctgtgaaatatatactgtatttcagatattcctgggctctgcaggaatttgaattaatcatcctggatcaggactcatcctgggtcaggaggaaagacattcattgcttggttaactattggggaattttttttccctagcctgtgttggggaaagaaggaatatttgttgagggactcttttttttttttttttttttttttttttttttttgagacagggtcttgctctgtcatccaggctggagtccagtggtgtgattacggctcactgcaactgcagtctcgacctcgcaggctcaagcaatcctcctgcctcagcctcctgagtagctgggactagagg

SEQ ID NO: 3430 - DNA, 4709 bp, Homo sapiens
agacttctcacctggccctccacctggctcagaatgcctgcctctcgcctgccaactcctacccatctttcaaggcctggtcaaatgtcacctccactgggaagccctccttgatctcccaggctgttaggggcctgccccaggttcctgcagactccctgcttctctccatcacaaacctgagcagtgtggggctgtcattatcatgtgtgaggttttagtaccaggaagtggggtactaccatagcaaatacccaaaaatggggaaatggcttggggaatggaaagaattggacaatgagcacttgatagaaaaagcctagattgccctgaagaggtggtcagtagaaatatggatgttaaaggtgccccttctgaggtcctaggaggaaatgagggacatgacattggacgtgaagatggaggtggggactgcagtgatgcatccacagatctgggagaccaggatgctgcagccatcacagctgggggaaagggagaagacaggggtcccctgagagcctccagaaggagccaagcctgccgaccccttggttgagggcctctggcctgcagcactgtaagacagtaggtttctgtggtttaagccattcagtctgtggtcacatgttacagtagccctaggaagctaatgcgggggctgctggtaccctgcccactccttgactgttgcctactggcccagctcccacctgcagctctgctcgaaactgtccccactctgctgtgctcaaaaggtcagagtgccagggaatcaaggcccagccctttctcagggagcagctgttcactaaaggttgtcaggaggttgtcggggcaggggtggtggtgtataaataccccagctccatcgccccttgggcaggaatgcactgaacttgctctatgctggctccagggtacccagcaggcttgagcccccagaaccatgaccagctccatcactaaccatgtgttggccccttccctcccatgacccctgggataacctcccaactcaactactggcatccaaatccttgtctctggatcagcctgtggaggagaccgagctgagacgacatgtcagcacctcaccaggtcttccgggcaagaccacagatggtgtccccagtgccagtcacagggctgggccaggtgtgctggtcaaaggtgggaaaggtggatggatggagtgagggaataggaaggaggatgggaaatggcccacaaagcctctgggtatggaagatggtgtaggccaggaggcctccctggaggaggcaacagagaggccatgtggagactggagacacagacgctgagggaaacagaggcctggagcccacctgtgccgagctggtccagtggccatagcagcagacccatgaccaaggagagaactaagaatgggtgacccaggcccaccaccaccacctcaccagttctcctacaccttgggcagacaagctggggaggagcacgggcttaggggctggcagctcgtgtcaaaccacagctccgttacgggcagctgcgtgcccctgacagatgaggtcacctgtctaagccttgctgtctgtcctgtccccgggatgtaagggataatagattcccctcaaatcccatggggttgctgggatggtgtatgtgaaggcacacagttggtgctcaatagatgtttgttcatgcaggctctgtgggtgacttgctccattcaacaggccttccaggggtcttcgggggtcgccaccccccagcctgaggccaaggagtggggacagcctgctgtccccgccccgtggaggccgctgcctggtctgccaagaggcacccagggaagtcagggctgtggaggctgctgtaccttctgcagttcttcaaatttggggtccttccgggaagtgggtggcaggtatttcttctttcctcctggaagcagagtgggtatgacaagcgcatggggaccctgtggggcgcttggccacactccctgcaggtcacccacagatttcagcaccgcagacccaggggcaccggtcctgccacttccgccccagcgtgctttccctcatttccctcacgaacaccagctcatcctcagacactgcagcatttatactttgagacataaactcggaagttatttcttgattacttgacattcaaagttaactgggtatcctatgtttgatatatctggcaaccctacctatttaggtaaagtgaaaccccagccagagaggggaggaggtgcccaggctcaccaggctctaaggggctaaggtgggacttaccccaggtctgccaggcccctccatggcccctctcgtagtcagactccccggggtggccctcagaggcccagcagctccccttccccaaggccatggccagcatctgcccacattttagactcacagaacccacaaaatgtcagggccaagaaggacctctgagatcaactagttccaaggtacatggggggatactgagtcagcagtggcgactgtcttgcctaaattcacaaaatgcatcatctctcatgtgaccccaataaaggcttttcctaggtattctgaaaaccttcaagtactacccagacccatgtcttctgatgaaagggaaggcaacagcgtcatgggctgttgtgcccagcacagggcaggctctcagcaaacacttgggcgggtgagcaggcgaatgaatgaatgaagaaaggaaggaatgaaggaatgagtgaatggatatggtgctgctccttcctggagcagacttcttgccgcttgaatcatccaatgtcccagctctgcttgccagaacttttagtaatttaaatcagttgtaaaacaaaaaattaatgggtttttttgtttgttttgtttggtagtaactaagtcctactattctaactcagcaactttcctcaggacactttctaatcttcaatgttttaaacacagaataccagatggtgacaaagacagccaggtgactctggaccaagcttgtcccttctggggtctcatctgccgtgccagggaccctgttggcactggagttctcgctccataacacctacttaaaaggcggcattcagggctgggtgcagtggctcacgcctgtaatcccagcacttttgggaggccgaggcgggtggatcacttgaggtcaggagtttgaggccgagctggccaacatggtgaaaccccgtcactactaaaaatacaaaaattagccaggtgtggtggcaggtgcctataagcccagctacttgggaggctgaggcaggagaatctcttaaacctgggaggcagaggctgcagtgagccgagatcctggcactgcactccagcctgggtgacacagtgagatttttgtctcaagaaaaaaataaataaataaacattaaaaggcggtattcacaggagctggagaaagccgcattctgctcccttcccttaaattatttcacacattttctttgtcagcacatttatgtttttgtggttacataaattccaatgagttcacctaaagcccttccccactgggacatctcgctgcttccttgcaagctgttgttcatttgtttctttcagagaacacagagagggtgacagctctgggtacctgcccatgtccttcttttgagccatctcctagaagggaggttgcaggaactgtggccgccaaccccccaaagggctcatgacacagagctttactgaaagggcgacctatagtcgttgaattgctccatcctatgctcaccccacttttgaaagggacccacacgtgtgaggggagcacgtcaggagccccacaccctgcaaagtatcactccatggtgggcatcgctgcgtggtccgtgtggaacctcagttctgggaccaccctccttgggctcagaacccaggtccaccacttgctaagagtttcctgttactgtggcacgtcaccccttgtgcctcagtttcctcatctgtataaagcaggcactgatgcccgcccttgagaataaatgagttgctattggtaagaggtgctggtgcagtaggggcactcagaaggctcacaggatgagagcaatcagtattcaccatcgtaatccacaccgtctctcatctggagagaagaggttctagctctgtagaaggtcccaggaggaggagttaggtcaagcataaagcagaaggtggaggcaggggtgagcagaattgggcgctcagctgacagctgggaaggtgctgcaagtcccaggcatggccaggctcactcttgccacacagaccttcaccctccaccctcagacctgcgtgggcacacaccttttgagagctcctcctccgctgggggctccacccccttggggagctgcagcaggtcgtacaagaactccggctccatcgcctcccaagcctgcacagaggaggcaggagagggcgtcacggtctgagaagccccaaactcactgagcccctcattttctctagacctggaggcacagaaggagggtagaagccaggttctggggacacgtcagcatgccagcctaggcagggggtacgggccctgtgagaaagagcccttgagccaacccttgcggggtgacgggttagaaaaaggcacagaagctgagggcgggcacagccaagcaaaggcttggcggaggaagtggtccttcctcaggcaggtgcagagcggcc

SEQ ID NO: 3431 - DNA, 6983 bp, Homo sapiens
actccatcttgatgagagttggtgtttgtgggttatttgtgaagccggaaagaagccgtgtcctggagaatgtagctgaaggcctggccactttcgacaagaacgggaaagagacgactaacttgtactaatatcttagtgcttggcagggcattttttcattccaggaaagaagagaatccagctgagatcaagggagggacgtccgacggaggcgccatctttaacaagggctatttgggaggccatcttggcgcagggcgtctttttgaaaggttacctgctagagattacgacctatcggggcatgcatagaattggatatgttccttgttattcgcgtcagcagtcactcatccaaagaccccaaagcttctagtgttctaaaggctcacaccttctgtgacaggaatcttgattcccattcttctcaatcaagacctaccctgaatggatttggagtagtgtggtataatgggaaaaattcaagcttgggggccaggcagatccaggtttcaaacccatctctgccacttcttacctctgagacctttggcaaacattttgacttaattgagccttagtttcctcatctataaactggagatactagcaccaaccttccagaattgtgtggattaaataaaatcaaggacatagattttgtgagcacaggatacttagtccagttcctggcacataatgaacgcattatgtaaatataagtttctcttccttatttcctgaccaccatgaacctagctctagtttctggccactagtctccatgacaacaactgaggaagagcacccaaacaagaagaagaaaaagaatgttttgccaaatatgtgaagatataatacctatcaccaaagactttaataagaataatgagactccacactatgtgtaaaaatacagcttttattctgagacattgaccttcactagagtgggacctgtggccccagcctggctggagaagcagtcccagggcctgagtgacaccatttccctttcctgaaataggaacaagttattccaaaggagaaaggagagcccagagagatctgtacaggacctctcttgcacatggtgactggaggcagagggtggggagctggagaggagtccagtccctccaacaaatattgagggcttcaaagagctcttcctggacgtttctcttaatctggatttaaaagggacaggaggtatcttagggtccaagaacataacaggaatgggcaactctagaagtgtttgtgtgtggaaggccctaacctggccctgtcctccctgtctctacctttggctttcatgaagagagattcacagctcagaggaagggaggaatttctccagtcttcactttaacaaactcttttaagttttctgcctaccttatgttccctttggccaatgacccactccctgggaacaagatcttgttgactttcttgggaatctcctaagagataagtgctttgtgtcggagacaagttcaggtaaaccaaccaaggcagtgcctcccacagtcaaagagagaagctggagggccaaagcctatagagttgggcactacagctgctcatgctgcagaggagacagctagtcaggaaccctggagattcaagacaacttgctggtcccctttgcccagggctgtggtcctaatcacagtccttcacctttcccagggttagcctgtgtttcaaatgcatatgacctgcgctgagaggacaacagggggtcaggaacctggggttctctggggggcagactaagacgactccgggatccagacccttctgcaccttcagatgggagctccaggcagctaaggggccgaggagaatgggcagagatcatgctacaaggggaggttctggggatgaggcagtaatccccaccctcagtacaggtctgggttcgccgaactccttgagcctcagtcctttggcggtcccgggctagggccacagcagcatcaaaggaaagactacccccattcctccaagaggatcgagaagctcgggacccccaagccctttctccaggagtcccatcaagccggccaggcctcgggcatggatttgcaggtgccacatgaatcttgctacacattgcactgggcatcttggcaaactgtggcttggggggcaccacaggcacagagcggacctgttggacctgaaccagagtggaagctagacgcatgcccacgccacccaggccaagagaacaggggcatagacagccgtctggactgggctgcccctcaggctccatctcctctggctgaggtggctgtggggctacctcttccatctcagaagagtgaggattgccctctttggcacagtcaacctccagggacgctacacctgaaccttcagagagggtgtcctcttctaaatagtaccctccagccctctggtctccctcagcctctccatccccactctcccgttccttgctgacctcccctgctcctccttcagttgctgcttctgggcttctgctgtcttcaccatctccttggtcttttcttgcttcatggtaccccttctccctctgtcctttgtcctcatcctctctgactccctcagcctcttgtttctgtacaacttcccatttctcctcagcaacttgatcttcctgggccccttgctctaggtcccttccagcttctacctgggcttcctctctttgttcatcctcttctctctcaatttctttttccttctcatctgtatactcatctcctcctggttcctccacacctttagcctccatactgtcagccttcttctgacctttggacttctcttccttggcctctgtctcttccctactcccttctctcaatctgacttttgtctcttggcttcccccagcctcccctctatcctcactggcctttccagcctccaccttggtctctggacttccctctgcctcttccctgatgtctagcctgcctccaggctcagcctgcttgtcctccccaacttcccagcatgcctgctcttccccaccctgtcccagagcctgccttccacatcctgctgcctctccctccagactccctgaacccttccagattgggggtttaggtcccagaaggggacttaggtcatcataggcactcaggaaaacttcctccccattttcctcctcaacttcaggcctggggccagcggagtccagggaacagcagctgggggccaagacaaactgtgcctcatccagagacaggtcatccaggggtggctccacagagaactcctccacctgtaggcacagcattgtgactcaggaccaggaggccctgtccacccttgactccatgccacccccaaacccagcacggctctccttacctgaggcccaactcccaggagctcctccaggtagcccatcccagggtcgtcctccccaggggagaaggctgctcctgctgcttctgcctgggccacctccccatcctctgcccccacccactcaggttctgagctgcttgagtcctctaggaaggagaaggagtcctgcacctcctgggacagcgagtcctccagggcaggagccaagtcgtctgggcctgagtctgccaggggacttgaggctggacttgcttccaacttttcatctgttgggggagaagtagtcccaggaatacaaaggtcaagccctgacccttttcagtgtgagtcctcctagcattgatatagcaggggcccagcactcccagcattgctactctgcatgactgatcctttcagaccaatgtccctagttattggcttgctaccttaattgagaccctaccaggtgccaagcactgtgctatgtattttacaatgcattggcattttttcctccaaactattatgtggggtattgtcctcattttacatatgaggaaactgaggctcagagagattaagcaatttgtctaaggtcatgtaatgaataagcagtacagccaaaatttgaacccaagtctacttaactctatagcccatgttcttacccactatcctatcctgcctcaggacttctcatgagtgacacttcaggaactggagtcagagcaaggatcagatcctagctctgctacttctacctaaatcaattgcaaattgattaacctaagtctcagtttccactgctgtaacataaggctaacaatacctatgtcataagattatgagaaaatgaaacaaaccaatcctgcaatcacagcacttggacctttttttttttttttttttttgagacggagtcttgctatgtctcccaggctggagtgcagtggcgcaatctcagctcactgcaacctccacctcctgggttgaaccaattctcctgcctcagccttctgagtctctgggattacaggcatgcctcaccacgcacgcctggctaatttttttttaattttttttagtagagacggggtttcaccatgttgaccaggctggtctcgaactcctgacctccagtgatccaccctcctcagcttcccaaagtgttgggattacaggtgtgagccaccgtgcctggcctagcacttggtacttaataaactgttttttgtttttttttttttaatttgagacagagttttgctcttgtcgcccaggctagagtgcagtggcgtgatctcggctcgctgcagcctctgcctcctgggttcaagcgattctcctgcctcagcctcccaaggagctgggaccgcaggcatctgccaccacacctggccagttttttgcatttttagtagagatggggtttcgccatgttgggcaggctggtcttgaactcctgacctcaggtgatctgcctgcctaggcatcccaaagtgctgggtttacaggcatgagccacggcgcctggctggtacttaataaactcttgctaaatgttagctgatagtattgatgttactattattgttacccatccatctattatatattcccacatttgtccttagtaatccctgctgtatgtttctgacacaggcccctattcttgggtacatcaatgttctgaaggctgctagagatctcctctccatagatttcacatagcctgataatattactggatttccctaatcctgaatctagggaggcagctaaaggtaaccaccccaaagcccaagggctgaggcctctgcccttcctagggtggatcttccagcatcagagcttcagcctagagttccagtcccctttcctagtcttggtcaatcaatgggtcctcacctggggggccagggccaaggccagggccagggccagggccagaggcagggcttggccggtgctgtagagcagggcactcaaggccacgggtgagcctggccaaggaaacgttagagatgatgttcgggggcacactgaggatagaggtgatgtgtagcgggaggttgacattgtaggggtctgagatgtggacaccagcacagcgttctgcacggctgctgcccccagcccggatggctgaccgcccagctcgtggtgtgcctggttcagagtttgtgccacccagtgcttctgcctcaggctcctgttcaccctctgctgcctctatagaatcgttctccaagctctcaggcagcaatgggcttggccgggggctgctgggccccaccagcccctctggctctgtggaggaaaaagagggccaggtaggcaatagcctaaactccaaggggcctagacatctcaagaaggctctggagaatgctctctgctttctcaggcttgaaagcaacgatagcctggaaggcaccaggcccagcttcttttgatcactactgcaaacttttcacccagccagtaggtcaaagatcacctcaccttcacatacctagggaactcccttccttccctgcagatacagtcactggccgttgtcaccaccaccaccaccaccaccaccaccaccaccaccaccaccaccaccaccaccaccaccaccaccaccaccaccaccaccaccaccaccacatacccatgctgtcccatcccatacgaacactcatcaacaaagtcatagattagacaatcaactcaccgtagcattcagctacatttacaatgtggctggtatataataggcactcattaaatattttttgaaattattgaacacagttggctgcatgtacacacaagcccacgctggtcacatagcacacacacatacacacagaaatgcacccctatactcaccatcactggccccagctgcagcactcagtgagtccatgcttttggctggccgcagtgtccccttgttggatttatcctctgtaagacagggatgtgtgtagagccagggccttgtgcaccctcagcagagctccccccatctccccagacttacccctgtcctcagccccccgtggaagtttacgcttagtctcatggccagagcgacctaaattgaagatagacctccacttcctgaccttcaaagaccccttcctcctacaaagaatggaggggcataattggaggttggaacatgaaggtcggtgcaggggaggaaggcccaggaaggaggccttacttgtgctctgcaatctcgatgatagtatggtagggccgcatctgtgggggtccatcgccagcctgcagtatgctaggcaggtgataaggcagtggcctgggcataaggtcctcggggctgcctgatgcccgggtccctggaagcgatcgccacccactctccacctcaccacctgggaaaagaaaaggaattggccagccaggaacagagccaagagagggacctcaggcacccaatccttcatcacccctcgccaactaccaggttagggatatattcagaagcccctgaagacagtgcctccatgtccatcacctcaaaagagtgccctcatggacaaagagggctgggagatccgagaacgttggcctggtgggctgggggtggatatgag

SEQ ID NO: 3432 - DNA, 953 bp, Homo sapiens
gtggatcttgtgagctgggttgccttgctgtggtgctttcggactcgctaactatgttatcacacagttttgcaaccaaatcgccactagaagtcactgtgttctgttgacatgcagagtctgcacaaagtttatcgtctccagttgtagaacaaatggctggaatcaccacagaattctgatctactggagcatcagcactctcctcacgacttcgtgaagtttccgtttctgctgttttttcagtggaggtttcttcattactaaatgcaagtgaagactcagcaggtttgttaccatccagggaactggcagcaggggcacagtttggaacactgattttatccacaggcttacttgtgacgtgcacgtcagaggctccagctgtgccaatattagagttctcaaatctttcctttgtactttcccctccctgaagcacattcttccaaacagtggcatctgggttcatgagcccatgttccatttcccctgcagtgtctggggtactgacatttgttgttgaaatgcctcccagttcacctccagaggaatactgggctgtgcctggctccatgaccaagtctctctgaagcacagcatctccactgctcagggactcctggtctgtgggcattccagaagattttgttccagtttcttcatttctgtttccacaggacgaaaggccttccgtgccctttactccacaatcaggcaagctctgaaggcagctgtcttgatcagatacagttccagagtccacaataggtgctggctccacctcttccccttttctttccacgcctttatttttcttcctacaggaacggtctgtattctcctcctcaactatgcttgacaaatcacagggactttcagtctgtgcaacagggctccctgggcagcactgagtgctctcagtctcttcagaagaagaaagtcgctgaggg

SEQ ID NO: 3433 - DNA, 647 bp, Homo sapiens
ggcatctggaagactgctccccacagcaagaagtggtggctcttctgtacagtggagaaagaagggggaccccaccagggctatggagagacagtagaggcaggactgaaccgtcagcaaagattaaaaggatgacctgaggctggcaaccacaaaaccaagaagccagcgggggctgccccttccaagtctcaccaatgacccagagcaggttccagagcccaaaggcccaaaagtgcaattcccaaaagccaaggtctgggagccatcaaggagctcccagagatccagcgacgctcagagggcaagggtgtctttgatgagcctgcgcatggtggtggtgactgaggtgcccagggcatcagtgatctggaaggagatcttgtacaggtagggctgcacgtcccgcaagcctgtgtcaaacacgttatccacctccgactgtgtgggcatcttgggcaagtactcatgccgattcatcacctccacgatgttgatgatcttctcgcagagtttctcacccaccttctcccggcagatctgccgctcctgctccgtggccagggctaccacatgcaccttgaccgtccacacttcccatgggatgcactcgtctgagaatggccagcgagacttcttcttctggt

SEQ ID NO: 3434 - DNA, 2558 bp, Homo sapiens
atgtcctcctcttcgtccttcttgtccttcgtgtcgccctctttctgctcgggcttggcgttgttctgcatggctttggcaaacgcttccacatctagaacacgttaaagacacaaggtggtgtctaacccttgcccagaactggggatcaaagcgatgggatcaagggcagaagggctgtgacctttaccccctcagccccacttctgcagatccagggggacaggaatggaccctgcccctggctctggcctggaggtgcaggcgcagccacttaccgcccttgttggcggcctccacagcctctgcaggcagaccgaactggcacatgagggggcccagctgccccgaggccaaggctgcgctgaacatgcccagggcctgcaagaagagccaggcgagggctgagctccaacccgggctgcaccccagagccacactgctcagctgccagctctgcgggtcaggcacatgaagcactggccatggtgaaggtggggcagggcctcctcctcccccctgcccactccctgagcacacagtggaggacaccctgggcccggcctctacctgctggaactggggcgaggtcagggtattctggatctcatccgcggtctgcggcagcgactccccagatggcaagtagggaagcaggcgctcctggacatccgcgttggcgaggatgggagccattatctccggcgtcagcacactggccaggtccactggggcacaagaacacggccatcagctcgatgacagcctaagtgcccacatggaaggcatgcaagcagggactcagcccatggccccagcaccccaggcgcgcacactaggcagatgccttggaagattagaagattcagtccagatcccacccaaagggacaagcatttctgaagggccaagcacacgggtctgcactccatgagctggcagcaggcaggcagccatgtagggccaggggacccagggcgcaggaaccccagctccctccagtcctccagccccaccgctcggccagccaccctcctctgaagtacccagctggggtcctcaccaggggcccagaagccctcgcctacccagctctagccacaggcaaacaagcgcattcccaaaggggaaccagcttgcggacacacaggctccccgacactacgcagacagagccagcagaagtttaaaggaaacagagaccgggcctcaaagcattcccagcagaagctgcccgagagcccgggtggcgcacgttacccagtcctccaaggccggctggtccgatgagctgcatgagctggctgtggctcatgtttcccagcaggctctgcaggccaccctcacctggaaaacactgcagctcaggcgggcctgccccagccagatccacgcgggccccaccgcactgcctgcgcctctgctgagcaccgcactcggctgcccctgaaccctacagggggcaccacttgaagtgaggcgacggtgggatgcagacccgtcctaccccgtgaaggtgggagtggggagtgacccagggagctcacagggtctctaacttttagaatcttctatttccacttccaaacaacctgtgctgagggggcgagtcatccacagtagactctggcctcccaggaaaccctgagctcacgtgacacatgtgacagttaccgcctagcgcagagagttcgtggccgctgcttccgctggcccccagcgccccaggcatcggggggttgttcagatactcgttgactttccggcaatgctcctcatcctggtctgtcttgggttcctgcaagaggaagggcatgtaagggcaggagctggcgccagctcacccagggccaccacagccatcctctgacctggcttccaggtgagggacctgagacgcagaggcgcgtgtgcctggccacacaatgctgaggagacaggacccggcccagcaggtgaggggacggcagtggcgcctcctgagcacgatgctctgcgccctgtccccatccgccgcaatcccgggtgtgccctgtccccctccgcccatttcacaaatggggagcctagagctccgaaggcacttagctgctgccagaccaagccctctcaccctcctgccctctggggtgcggttctttacacacccgtctccttccttcaaccagtggaaggcagcgaactggcccgctcagcacaccgcggcccagggccacggcaggcgctcacaatcgagcacacgcgtgtgcacacacatgtgcacagatcagtgtcagaagcatcgacctgcgagctcacagagctgggagcagagcacccacgcacaccccgaatggctatggaagctgcagggcgccagggacactgggagtccctgctctcatggcaaagcagggacgggggacttaaaagccaccaacaggaaaatcggggaaaaaagggagatggtggtaacagttggacactatttcttggcaaaaccgtggaaaaacacgttctacaccagcaggtggcaaattgtggccgccatctgtgtttgcaaataaagtttaactgga

SEQ ID NO: 3435 - DNA, 1320 bp, Homo sapiens
aaaaaatcagtcacttgataaaggacacaaccggatgtgattcttgtcacttctattttaaacatgcatactgggaaaaacagaaacacaagagtgctatgggtacacgcgacgtgtgagaagaaaggaaccccctggagacacggacgcggtgtgcggtgacagccaggcctcactgacaacagggcagcgaatcgcagccgggacgcctctgaggcggaagcagtcttgggatttcctgtcacgctctcgatgcttctgcccactctggtttgtcacggggatgcttcattttggacagtataaaaccggtgattaatgcatatcttgctcttcagcaaaatactattcaagtagttttaacttaaatattttaaaagtaatctttacattattgaagattgttaaaaaatacagaatctgacaacttttcactcaatctgatgctctgaaactcttcacttctgttttatcataatttagaaggcaatccctggcctctataaaactctctgcaggattagcttcaagatccatctttcccccactggttcgagtttaaaaggctttcagaaccttttgccactgcattataaagagaacatgaaccccttcccattacttcctttagctacacatgctatgactgagagtgtgctggaagctaaacaagccccagctgatttctgccacataaaagggcgccgtgaagaatttccctgttgaaaccttaatgaagacgatgatcccaagtgaagctttatgaagagacggcacagcagagtgaaatgtttggcaatcaacagttaattagaattacatccttgatcagggatgatgctatctccgcgaactcagtcgttagaaaagttggtttctgctgtgacgaggctcacagtggccactcgaggaagtccagcctcgtcagcctccggtcccgggccccaggcccctccaggccctcagtagatatctgggcagtcggagaaattccgctcaaagtaatcccctgcatacaaccagtcgggggtcccagtgtaggggttattgcctgggtagaaccacctgccggatacaagggaggggggtcagaagatgctcagcccaaaaggaaaacgcagccctgttctgggtgcaggagtgtgttcccccaactcagcaccatcacggtaacgtgggttttaaaatgcagcccagcgtaacaacttcaacggagaattattgatcacgtggtcatgtgaatgctggaacctaaagatatccagccacccgtgtcaatttcacttcccaacaaaatcttgagggtttaactcaacacaa

SEQ ID NO: 3436 - DNA, 3292 bp, Homo sapiens
gccatgggcagccttcccccgtcccccggcgtctccacagctctgtgatgtctgctagccccattttatcgattcagaccccgaggcttggaggggacagaagggtccagtctaggtctctctgcgcccagagctaatgctcctgtgagcaggggggacctgccagttcaccacacccaacagaaaccacacagctggcaccaggcacttgggtattgaaccaggaagctttatttacacagtacaagtaacaagcaaattcctgagagactagagcggctggagtgcaagccacagcctgtgcggggaggccaggctgcaggggcgggcagaccctgggccccgggtctacgctttctggtcgccacacttcctgaagcacggcaacacccacaacatccagctcagggaagcccctgcagccccagaaacagcctatgtgctatctgtcgccccagcccccaggacagcttccccacacactgaaaacacaaatcatttgccaaaaagactatgctagaaggtcagactatcctatctaggctacaagatctccacttcggtctgccattaaaaaaaaaaaaaatctttctcttcttttctctttaaagaggcatgacagaggggtttgaccaacagcgtggacatggcaaggtgtggcatcattgccagtgtggggccagagggtgcccgagccccggtgcgcggccagcctgctgcatccctgccggctgacgtctggagtgaccgtcattccagtgaccacccccatagccacagacggcacgtcagtggaaacgggggtgcagcaggcatgacaccaaggcagagcccgcagcagggggcccggggttccacagctagggaagcttgctcagacaggcagcacacccagggcacggccactcacgcccccgcaccaggagacccatttggaagttagttagggtttgttttgttttctttttaatgtggacttcccctttatttaaattttctttcagtgtacaaattcacaaaactggctacaaaaatttggttgaaaagtaaggctttctgagaatgaaaatctgtacgtctggtcagaacaagctccccacgggcccaggtgcacgtctgcccgtgcaaatccggcctccaccgcgagtaaggcaagagggaaggcctgctatagaggctgtgtgccctcggccacaccgggcatgtggtgccaggaccccccacgcccagtggtactccgggggcaagacatggccatgtgctctccacattcacccaacaactgccctggccgcctccacatttgctctaagaagacatggtctccatgacccccaggcagggacaggccaagatgtctctgtctgctcagagccaccagctcttgggttcggctgtccgggatcacaagtagacatgcctccggcaggagctacagcaaccagaggtgagctggttccccggctctgggacctgcccagtgcccggcataccccatgtgtcagccacctgagctagcaacaccatctctcagggctgtggggctgggggctttctgccagctccttaaagctgatttttaagaagtgccacccacatattgggaacttgaaccaccatccttttgatgtagtaaaaaaataagatttaaacaacgtttcccaaaaagcatctttcttgaggagaaagaaggtgagaagcatctggactcaacctgcagaagcgaggcgttcactcgtccatgaagacgagcaaaagcaaagtgactacaaaagtgctttgaacgcgcgtgtcagccaacacaagggagcgcaccagttatttttagccttatgggaaaatgagccacttgctcctaagccagcccaattgctattgtttgcagaagacgccacattcgctaaaagccagattcccatagagcagagcccatgtggtggtgtctgcaaggcagccggagaggagctacaaaccttgagaggagagcaaaccctcagggggctaggctcctcggatgccccagggtgaggagccagggtggggtaggggcagggagcatgaatccagctttgtgccggtggctgggcctacaacagagatgcagccctcaggactgggctccccctaagctgacaagggcgtgggcttgtcttgaggtgggtgatgtgccctggttacagccagcagtcctcaaggacaaacgggaggtgcctggaatcctgcaggggcccctgcagagtggccagcggacgcccttcacccctgagtgcgcatagggccctcatctgcccacctgctcgcagctcccgtctcccgaggccgttttcaagaggctgccctggtatcgtgccatccctacactcaccggaaccaaccatgcttatcactcagtgacctgtcagccacagagaagggctgccatctgctaaccctgccccaacggtggcagagccatggggtcagcctctccatgctgtaggagaggcaagcaagtccgtcttttcagccaacagatccaccaaatttctacccaacacgggaggccctaacaagcaccctccaaatcgttccttgggcccgagactccggacatggcttaccctctggagggccagtccagcaccccagggattctgtctctcacattggaattaaggccaaatggttctggtgttacagaaggaagcatctcccgaaccttcccaagcctgaagcagggagacctgggagagaaggcacggagtaaaactgagtgaaagaagctgcggggccgactccccagaagtgaacctgagtgaggccaagaagggccctgacatagcagatggcccctggcccccaccccaggccctccctgacagcccccaccaccagggggatacagagcggtgcccagctctgccggggacaacagagactgcccaacatcccacagggaaagaggcagaaaagacgcaaacttcaaagctgtcctctgggctgcagtagttctgtggacctggtggctgccacgctcggggagccggtgagaggctgacacacccgctgtatgacgcggccaggccaggctctcccccaggcagcaggtgggctccctctctgggacccgacaccactcaggaagctttcatcaggcccacgagttgggctccccttcaagggcccacctagtgcccagagtgggggctgtcgatgccagcacaccccagccctgcctgggcccacaccccctcagttcttctctatctgctcaatgtccaactcgccgtccagggagcagaggctgttccca

SEQ ID NO: 3437 - DNA, 3387 bp, Homo sapiens
ggtggtgaggtgggggcagttaggaccctgtatgttatgtaaaatagatttacaaaaaggacaagcatgataaaagggaatgaatggagacgatgtattattcagtttgaaagagatagttcacatttttataagaaaaatttaataaaacatatattttagttatcatttaacaaagatatattaaagctattcaggcaatgccacaggattctcatgaagggaaatcactgaacccttgtcatgagaaaatggtcatttcaacacatttcaatacattgtataaatttggagcttaaggtgagtgagtatgttttcacttagtcataaatgtttggtcaaaattaaagttatcatatggtttcacatcaatacaaatattgtcacagtgttacagaaacaactatcaaatggtaagatagtttacatttgtgttttctagaaacctttgtatttatgcttcatttggttaatgttaagtgctgataaaggcataccagattgtttgtcaaagtaaagaagcaatccatcacacctaggacatctaaggatggattatacgtcagagtggtctcatatacaaatgaccattttccttcagtaaaatcttgttggttgaaatgtaagtcttttcctaaagttttaatcagaggtagccatcactaagacttaagccacctgtggttctcttaagtttcactgaagccagaagaaggaaattaccacaacttgtattatactaattatcttcattattaacgatcatattagagccactgacatgtcccaaattatattaaaataaaaacctgcattgctctgacatgaagctcaattcaatgtaataaacaaattaggtattaaacgttataatttaaaaaacttctacgatatcaccagaaatcctggtgaaatttaattttttcccttttttaggtcagtggccggtgggatagatttttctaaactttttcctgctatgattttgaaggcaaatacatagagcacagttcagtaaaagagtttccaagccttttcactggagcatttacattttgattctgttgtcatttgaaatagaacatctgcagggagataatgagcttaagttacaattgactttggaaagaataacagacttttgtgtttcctcaatcatgtagtcaatagggaattctccagttatgtgaacaatcacagtcttttaagacaatacttagatctaaatgcaaaatctagcatgcagaggctttttaaggattttagactgtctccaaagaacttggctcgagatggattacacagatttacaaatgcagttttcaactgtgacatcaaactgatcttatctcatttcatgttactcaactgtgcccgtaggaccccaagaggtggaatattttgtctacattattttaaacatctatagatatgtgtggatgtgtgaataatgcctaaatttctcatcttttaactagtttgtttttatcatacagacacagcctgttcataagaccagctttagacaacttagaactcaatgctctgaagattcagggaggccaacatagaaaaagatcttccaaaatatggggtggtccaacccatctcatccctctctagctggaaaactatagagaaagggctgtgactgccttgaccactgcctggcacaatgtaggcactcggtatttgttggatgaataagtggctgaatcagtgaatagacaaaaaacatggattttgccttctgaaaatctcacaaattttaccagcttatattatactgattgtcactatgatttctaagtttcatggttagaaccatattttgagtctatataaaaactttttagatgtatgaatttgaaatttcattaattactttaaaggcttcaaagatttgaggacatttgaacagtggataaggaacaatgtttggggatacagagtttttatgctgagttgaactcaacctttctagttctttatacaagcttcctgaattatctggcaggaatgattcaaacataaaaccccatttttaaattttataaaagatattttcatttttatataaaaagatcatcaggcatattatcccctttgatatttattaacaaccattctctaagaaattcataataattggagacaccatccctaaatctcttcctattttcaaaagatcatttatcctttcatatttgattcctggaatacactaagctgaagtttaatcacatacttactcagatgtttccatgtgtttattcatttaacaaatacttattgtgtacctagtgcatgctaggttctggaaatgcaacagcaaacaagacagacacaatccctcttggaggttactgtgagaaactctccaacatttactctagcaataactagagagtttactgtccattgggtcctcttcacacctgatagaaaaaataaaattcctcaccccatggaagtcatgaaatactccctgcacagatttgtgtgagcttgcttttctaaaaccactgctcaaaaatgctgcttagtttatctataaaccacggttataccccagtgaggtaggtaagtaatttattcataactaacatttatgcagctctattttctagccactgtgctgagtgcttttatggactatctcaccaaatcccttcaacaactctattcagtaggttccattttatagatacaaaaactgaagcacagatatattatgtgacttgtccaaggtcacacagctagcaggtggaactgggatttgaacccatgcaatctgacacaagagttcatgtgtctaatcattatctgtggtttgggggacaccattacattaaaatgaatgagtcactaagtgagtcactgtatataaaatacttggaaattgtaaagtaatatacaaaagatattaacaaagtattattcatggtaaacaaatcacatcagtagcaaacacagggtgggaactcaatcttatgttatagcttactcttaagaagaatatgtgaagccaggaacatggttaaaggtacagaccagaaaatttctgacatgtgataaatatttcagtgacttttcagatttatttcttgttagccgctgtgtctatttggtgctacaaaaactgaaagaaacaaaatccctgatgtaagggcttataataaatacacagtttggagatgaactaaggatattttacatttacgggaaaggattggacaatagtatcattttctcaccatttgcatgtacatcatgtctttccaattgttttcattatttttctgaaagagctgcaaaattgtgcagtggttcaacctgaccaaagtggtattatgctgctgggaagtaaaagtattagacaccaaa

SEQ ID NO: 3438 - DNA, 3581 bp, Homo sapiens
agccagagaacacaagaaacaaccagtaactccaaagaaaggtcagggtttcaagaacattgtgcccccccggttgactgtgcagagcaagtacctctttggatggaggtcattctagctgaacagttgtcctactccctgccatccttctttccaccttccaagattggacactgcttctcatggggctccttggccctgggctggatcaagaccacaatttattatgtaagacatggggtgaagaatggtcaaggaaagttatggccgtgagtgacatggaattagatgaaaaggctcaagtttgctgaagagagtttaaatttggcttttgctcttggaaacgtcaaaataatcataagaagcacttgtgccttacagagcaaataatccacagagtgtcatattcattttgcaaacagggtcacaacagcagtcaaatagaagcctgaacacccagagagttaacatacagattccataaggataacaagggattgagcatgctggtgggtttttaagtcagatccacattgaaccctgtgacctaccggaggttataagtggaacccggggaaagcagcttttccatacaaaacaacaacaacacaacgacaacaaagaaaaccagactctgctggatgtctataatactcatttgcagtaaggctttcaagatacaggaatttttatagcatttgtattttaaggatttagggcaaatacatttttttttctacttgataaaaagaaaattagtacttaaaaggttcaaaaatatattgattgagttatttttcttacataaataaattatattgatttttaggatttaacagctgaaaaaaccctttctgcttccactggaggcaaaactgaacaaaatgttagttaaatagagagagcagcatttctaagaaatctgtggtcagcattatagaccatctatgctacaaggatgtcattaaataggatttgttcaattactggattcttcttctatgatcagttatagaatttctggtttatatctctgattcataaaactgggactccactttttgaagatacatctgattgatttttttcagtcatgatttaacagacttctttgagatgctcattttaacatttacataatttataatcccaaatgtataaaagacaatgaaaaaagcatcataaataaataatgcaaaatgaaatagttatgtcagacttttggaccttctgataaattagcaaaactgtaacagaaaaagtaaaaaatacagtaaattgtgacaacaaaaagtgaaactggtactagtaacacttgcaacatttccaagggtcctgcgcagccctgcgcccccagagtactgaaccatgagcttacttcaagtctcagagtgtgaactacctgtgaagagtgagaccatcagaagggacgttaacatgaaggtgaaaggacatggggaagtgctgcttaggcagtttctttctcagttcctaaacatggagaagctgaggaagaagagaaaataatgttgacttgcaatgtagtttcgattaactgataatttggaatttgggtccaactgtaagatataaacagaatggagaaattaatggagaagtaacttttcatagctgtattataaagggtggcacacatttgacagcctcagacactcttgatcaaaggacctactagcaagtgtcaaagtgttgggcaactgtcttcttgcaggctccagaaagaaccttattcttggtgaaggaaagcctgaagtgaaaatccattcggtcctggtgctctttaaacacagagaggcaaattaatggctagagaaatctgtaagcgaaccaggtgagagcagagcgctagccgtgtgcttgtgaagcagcgtgtagctctacggagcgcgggtccttgccccacccccgtcgacagcaataactcatggtgggtaaagctttctcgcagcaagaggaatcttttcactggtgagagggatgtatagaaaataatgcctagtcagtcagtatttcttcttgctgcaggtgtctgaaaaaccaccaagggggaaattatattactaccggtaaggtttttgttttttataaagaaatgaatatatgtattttcaaccattagttatatacttctgtctatactactcacttagtaatcatgataaaatagggaaatattttaactcaaaaatatgcaccagcacttcctttttctgtgctttttggttccctgtgacattcttcctgtgcaacccagctcacagaaaaagagctcctctttgtctctgttcttccacccttcaatggtaaaaccctagacagctttcttttgccatttttcctcctcaagtgagtgggaaacttggaagagaagggggtagggcgtgtcaccaagtactgtattaactatgattgctggaatgaactggataacagaatgagaattctgtgcctcctagactaggtagacaacacttatctaatgaagtggtgagaccctgcaactattaacatctgttaccatagttctcagacaggaaatcaggtacgtaatcttacttatggaaacacaggttcttatggaggtgaagtgagggaagtaacaaacctttatgggataagaaacttacaagtcacaataatttcttaaatgaaaaaagttctaattggtgtcgttgttggagtctttgagtgccccctccccagcctgtgccccatgttctctctctgcgggcaaaggggcactgggttcggcacagttctcatcaccgctgggctccctttcacagctgggagcaggctctgggtgggagttggggttgtccccctttgtcttcttcttcttcctcttctggctctccagacctactatttccgagtgtctggcctgctgcatggctggcagagccatgcccataccaggggagaggaacatggatgggtaaatgagtccaggagatactcctgggatgagaaatgggttaaaagccacaggactactagtagttattgcaggttcagactgatcagaaaatggacctggaccaggcttgtcctcagctaaagtgtctgttttcacatcatggctactcggcttgtcttccgcagtcttttcagtcactgccgtaccacttttcgttgtgcttgatagagacgccggagcagtggaagtgcaggtggttgccatgggtggactgaggagtcccccaacaccaaacatctggggcacagcagccatgcctggcagcatcatgggcagcatgctcagggtacttttgacctcttcacctgttggcatcgtggcaaagccagctggaaaccccaccagcccggtgagggggatgcctggcatatttctcatgttctgaagtcctaccaggtccatcccagcaatcagtccattcatgaacagtggccccattccagagggagagtctgccacaatggaaggagccttcaggagttcgctccgaggccgcctccccctcctgcgggggcccgtatctcgaagaataggctcagccagagtgtgattgaacttgttttctggaagaaacccctgg

SEQ ID NO: 3439 - DNA, 401 bp, Homo sapiens
gaattggcgtttgccgaggctggcatagatttggctgtctccgctcatagctgcttttggcgcgaaagatgccgggtctggttgactcaaaccctgccctgcctgagtctcaggagaagaggccgctgaagccctgctgcacttgcccggagaccaagaaggcacgcgatgcgtgtatcatcgagaaaggagaagaacactgtggacatctaattgaggcccacaaggaatgcatgagagccctaggatttaaaatatgaaatggtggtctgctgtgtgaataaataattcctgaaggatgaagaagattaattttgggagttctttgatgaactttgatatgtggaaaaagtatttataatttattgtaagaagaaagtaaaatattactagtggaaaaa

SEQ ID NO: 3440 - DNA, 1029 bp, Homo sapiens
atggagggccatgatccaaaggaaccagagaagttgagaaaactgtttattggtggtctgagctttgaaactacagatgatagtttaagagaacattttgagaaatggggcacactcacagattgtgtggtaatgagagacccccaaacaaaacgttccaggggctttggttttgtgacttattcttgtgttgaagaggtggatgcagcaatgtgtgcttgaccacacaaggttgatgggcgtgtagtggaaccaaagacagctgtttctagagaggattctgtaaagcctggtgcccatctaacagtgaagaaaatttttgttggtggtattaaagaagatacagaagaatataatttgagagacttctttgaaaagtatggcaaaattgaaaccatagaagttacggaagacaggcagagtgggaaaaagaggatttgcttttgtaacttttgatgagcatgatacagttgataaaattgttgttcagaaataccacactattaatgggcataattgtgaagtgaaaaaggccctttctaaacaagagatgcagtctgctggatcacagagaggtcgtggaggtggatctggcaattttatgggtcgcggaggaaactttggaggtggtggaggagctatggtggtggaggtggtggcagcagaggtagttatggaggaggtgatggtggatataatggatttggaggtgatggtggcaactatggtgtggtcctggttatagtagtagagggggctatggtggtggtggaccaggatatggaaaccaaggtggtggatatggtggaggtggtggaggatatgatggttacaatgaaggaggaaattttggcggtggtaactatggtggtggtgggaactataatgattttggaaattatagtggacaacagcaatcaaattatggacccgtgaaaggggacagttctggtggaagaagctcgggcagtccctatggtggtggttatggatctggtggtggaagtggtggatatggtagcagaaggt

SEQ ID NO: 3441 - DNA, 429 bp, Homo sapiens
attagccgggcgtggtggcgggcgcccgtaatcccagctactcgggaggctgaggcaggagaatggcgtgaacccgggaggtggaggttgcagtgagccgagattgcgccactgcactccagcctgggcgacagagcgagactgtaaattttcaccagtattagttctatttgcaaactgaaaaatgttgtaggcttaatgtaaaataaccacattagtgaacattatatctcttagaagaaaggccatattttgctcctgcttctgtaaaaatattatttgtttgaaggggaaataatggtagtgtgacctttcacttaattcctactcccttaatgtgagagagacaaaatgagctgaagaaggaaaattctggagttacactccacaaccttgaacatactgacggacatctctgttttgacaacg

SEQ ID NO: 3442 - DNA, 2670 bp, Homo sapiens
actggttatagtgctatacaggaaacctggcagcgccggagccgcgcggtcgaggagggagcgcgggacgccgagcccacgcgcgcctgccgggacaagtggagacgaggccggcgagcggacgccccgaggttggcgaaggagctgtggccgggtccccttcttatccagcccgagacactgcgctccggtgggcgtccctgcgctgggaatccctctcggagtttttccaggcccggccgggttgctccgggaaaggccctgttgggggaggtgggcccggagctggcaggtctacaatccggttggaagggctcgcagtgggtgattcagggtgccaatgacctccccgcgaacgggaacgcccgcactagacaaccagccccagaccggcattcccagagccgcaggcgggagggacgcagggactccgggacagcaaatccccgggggagaagggaagggggaaggcgggacaggggaggcccaccctccttgggctccgctagcgaccagccagcgccccttcagacgcagccttcctggctccggaccccggctttctgctccggtcctcgtcccaatgccccccaaggtccccagcagaggcattcaggttcctcctcgccccgcccagacgcagcttctttgggtatgggtgacagcactcctgagcgtcgctgtccctattcgctgccgttgccagctccgattccgcgaaacctctccggcaccacctcggaagccccgcccagggcgatggtccgggcctaacctgccggccccgcccacccggcccttgggctccctgaggcccgcccagcagacaccggagagcaatggtgtgatctccgcacactgcaacctctgcctccagggttcaagtggttctcctgcctcagcctcccaagcagatgggactacaggtactggtagttaactctcaaggagaaatttcacggttgagcaccgaaaagaaagtggtcatgaaaggaagtatcaacaattatcttaaattgggtcaagaagggaagtatcgcgtctaccacaatcaatactccactaattcatttgctttgaataagcaccagcacagagaagaccatgataagagaaggcatcttgcacataagttctgtctgactccagcaggagagttcaaatggaacggttctgtccatgggtccaaagttcttaccatatctactctgagactgactatcacccaattagaaaacaacatcccttcatcctttcttcatcccaaccgggcatcacatagggcaaactggatcaaggcagttcagatgtgtagcaaactcagagaatttgcattggctttagccattttggagtgtgcagttaaaccagttgtgatgctaccaatatggcgagaatctttaggacataccagctttctccctttgtctcataaccatgtccaccaatgagaatgctaatacacaagctgcccatcttcacagatctaagaacaagggaaaggacagtacagaaacgaggcgtcacagaatagaggtcaatgtggagctgaggaaagctaagaaggatgaccagatgctgaagaggagaaatgtaagctcatttcctgatgatgctacttctccgctgcaggaaaactgcaacaaccagactcctgccctaagagccatagggaatatcgtcactggtacagatgaacagactcaggttgtgattgatgcaggagcactcgccgtctttcccagcctgctcaccaaccccaaaactaacattcagaaggaagctacgtggacaatgtcaaacatcacagccagccgccaggaccagatacagcaagttgtgaatcatggattagtcccattccttgtcagcgatctctctaagattttgagacacaaaaggaagctgtatgggccgtggaacagttgaacagattgtgtaccttgttcactgtggcataatagaaccgttgatgaacctcttacctgcaaaagataccaagattattctggttatcctggatgccatttcaaatatctttcaggctgctgagaaactaggtgaaactgagaaacttagtataatgattgaagaatgtggaggcgtagacaaaattgaagctctacaaaaccatgaaaatgagtctgtatataaggcttcattaagcttaactgagaagtatttctctgtagagctgccagagcagagctgagccacccattgctggagaggacatccacgcaggcctggacgagccggactgccttactaaggatttcctccgtatctgactgcaactcagcactcagctgcatgcgggacaggaagaggaagatcaaaacgttgtgccagaaactacctctgaaggctacactttccaagttcaggatggggctcctgggacctttaacttttagatcatgtagctgaggcataaatttgttgtgtactatgtttggtattttgtcttattgtttctctactaagaactctttcttaaatgtggtttgttattgtagcactttttacactgaaactatacttgaacagttccaactgtacatactgtatgaagcttgtcctctgactaggtttctaatttctatgtggaatttcctatcttgcagcatcctgtaaataaacattcaagtccacccttttcttgacttc

SEQ ID NO: 3443 - DNA, 1720 bp, Homo sapiens
tgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgttt

SEQ ID NO: 3444 - DNA, 2545 bp, Homo sapiens
aatagcctcatgtggctagtggctcattggacattgtagttgtagacgtttgagactgttggttttaagttggacttaatcactttcctacccaaattctaccactcctttaagaactcctttagaactcttttagttcacataatacgccatattttttttactgtgcctgtagttcttcaaggagtggtacaatttgggtaggaaaaccaggcaggaattccagggtagtgttcaatattgacattagtaatagtctatcaataataaaatagacatctcaatcactatacaaaatctcagaaatgtaaagctcttacagagcatgcttgtgcttgtgtaacagctggtgtaatgcctgcattttcagtaccatgtagccgcactgttaatagttttctatcactttttagttactcatgtctcattaatgatagtgccattaattgtgatgagtgttttcgattcatgtggtcaataaaaagagactacacaagctggaactttgttgccattagtcaagctagtgagatagtatatctatctatctccccagaagaaagtaagataattgatggggtgtggattcagaagagggattacttttctttgagcctcagacttctagacagtatacttcagtcagtaatggaccacatatagaacagtgtttccttagtagaccatatttttactgtaccttttctatatttagatacacaaatattgtgttacaattgtctgcagtattcagcacagtaacatgctgtgtaggtttgggacaaaataggctctaccatctgggtttgtgtaaatacaagctgattttcacacaagattccctaactatgcatttcttagaacgtatccccattgataagtgatacgtgactaatttacgtgaaatttatacattctttatctttcctgtttttggtttattgatggtgaggaaaattactcgtttcagctttttcatttttttactccccaaatgattttcacctttttcttaaaatgtacaataaatgcactgaaaactttgatcactgtcactacagttgtacttaagtgtttttcttcggtttttgcttgcacagttttcatgtcattgaaggaaaaatttataaatgcttgaggagaatgagatacatcttgtataggggaaagtacaaaaggtatggtggcaagagagaaatccttaaaggggcactataatatgtaagtgttaacctaattgccagctttctctatgccatcctggacacagcgatcatattttgtttcaaataatttataaacattcattaaaacttgagtcatttgtgataaaatggtgtgtgtaaaagtaatgaaactaaaattggtgtggggtgttaaaagttgtaaaattttcttcatctaaatcataaaaagatacacattctagaggaattatctgccaaaaaaataacaattatcaaagatatttaaatgtatgggatgtacttaaaatcacttattccccatttcatgtttactaataaacatataaactaaagtgggtcaactaaatagggaagatacagcaggcaagacaaataggctgggcttttatttttatctgcttgggctttaagctttccttcattcaagtgacagattctgcctttgacgggatgcttaaaatcactatattagatctaagatcatttctaaaacctgtttttttaatgaacctaaagacttttcacagcagatgagtacataaaaatgttactggaataaggaataccattaaagctctaatatccaatgtcaagttttatattaaaatctttcccaagttatctctgccagggcattttgttgatgtcttagtgcaagattaccaaaaacttagtcaaattgaacaggatattcattttcttctccaactaccaaaacacagtcttcattataaggtgattggggtgcggttgaaaaaactgtggtgaaacgagaatcagaatgttttttgtacaggaaccaaatgattgctcccaaaactgtcaaaattaccgtgctagcaatcaccaatgctgatattaaaatgtggttatctgaaaaggaaaagacaaaagagtatttgggaaattagggtacacaagttgcaagtatattttgatgagcacaactgtagttttgtgtaaacatttctctgtgttgagaatttcccacactgatgagaaaaccaaaaatttcgcatttgttactaacaagatttatatttcttagcctgaagaatagtactcaaattttctaggaagttgtgcacttctccactctactgaagaccccatagtggaaatcacgcaagtatataccatgctccagtttgtcttccttcgctttactttctgatctaagactacaaattcagacctactgttccctttaggaattctagtatttagataatgtgttacattattgaggtttaatggttcacctggctttggggatttaagatttgtttaactgaaaaaaacaccaagacctgcagtaaagtacctggttttgtgtg

SEQ ID NO: 3445 - DNA, 1191 bp, Homo sapiens
cactgccatgaagaagaataaccccaggaagtaccttcgcagtgtaggagatggagagactgtggagtttgatgttgttgaaggagaaaagggtgcgaaggcagcaaatgttacaggtcctggtggtgttccagttcaaggcagtaaatatgcagcagaccgtaaccattatagacgctatccacgtcctaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcagaggccctcctctccaaagacagcctagagaggacggcaatgaagaagataaagaaaatcaaggagatgagacccaaggtcagcagccacctcaacgtcggtaccgccgcaacttcaattaccgacgccgacgcccagaaaaccctaaaccacaagatggcaaagagacaaaagcagccaatccaccagctgagaattcgtccgctcccgaggctgagcagggcggggcttgagtaaatgccggcttaccatctctaccatcatccggtttagtcatccaacaagaagaaataatgaaattccagcaataagaaatgaacaaaagattggagctgaagaccttaaatgcttgcattttgcccgttgaccagataaatagatctgcattatctatgcagcatggggtttttattatttttacctaaagacgtctctttttggtaataacaaacgtgttttttaaaaaagcctggtttttctgaatacgcctttaaaggtttttaaattgtttcatatctggtcaagttgagatttttaagaacttcctttttaatttgtaataaaagtttacaacttgattttttcaaaaaagtcaacaaactgcaagcacctgttaataaaggtcttaaaaacaaaacaaaacaaaacaaaaaaaaaactttaagcattcagaacccagatacaaacttctgcaattgcctcagcaatagtctag

SEQ ID NO: 3446 - DNA, 1702 bp, Homo sapiens
atgtttctggtagatatttttaagtaacttgatataatagattaaaatgtatatatttcaaaagagaaaaggaagcagtaagaaataagatagaggagggcctttgacaagatggcggcaggaggcagtggcgttggtgggaagcacagctcgaaaagcgataacgattctggtttcctggggctgcggcccatttcggcggacccagcgctgaggcggcggcggcggcgaggcccaagaaataagaagtgggactggcggaggcttgcgcaggagccgctggggctggaggttgaccagttcctggaagacgtgcggctacaggggcgcatgagcggtggcttgttgagagaggccccaaatgaaaaactcttcttcgtggacaccggctccaaggaaaaagggctaagaagagaaccaaagtccagaagaagtcactgcttctcaagaaaccccttcgggttgacctcatcctcgagacacatccaaagtccctgcccccaaagacgtcctcgcccaccaggtcccgaacgccaagaagctcaggcggaaggagcagctatgggagaatctggccaagcagggcgagctgccccgggaggtgcgcagggcccaggcccggctcctcaaccctcccacagccggggccaagcccgggccccaggacaccgtggagcggcccttctacgaactctgggcatcagacaaccccctggactggccattgtttggccaggatgagtttttcctggagcagaccaagaagaaaggagtgaagcggccaccacgcctgcacaccaagccgtcccaggcacccgccgtggaggtggcgcctgccggagcttcctacaacccgtactttgaagaccaccagaccctgctctcagcggcccacgaggtggagttgcagcggcagaaggaggcggagaagctggagcggcagctggccctgcccgccacagagcaggccgccacccaggagtccacgttccaggtagccgtgcgaggggctgctggaggagtcagagggtccgggggagccaggccagggcgaggggccggaggctggggatgccgaggtctgtcccacgcccacccgcctggccgccacagagaaggagacggagcagcagcggcggcgggagaaggctgcgcgcaggctgcgggtacagcaggccgcgttgcggactgccaggctccggccccggcaccgggaggtgttcctgctgcgcgggatcaaggcccaggtggccctgaggctggcggagctggcgcggcggcggaggcagcggcaggcacggcggaaggccgaggctgacaagccccgaaggctggggcggctcaagtaccaggcacctgacatcgacgtgcagctgagctcggagctggcagactcgctcaggaccctgaagcccgagggcgacatccttcgaggccggttcaagagcttccagaggaggaatatgatccagcctcgacagagagccaagttcaaacccaggtacaaggtgaagctgggggagaagcgggcgttccgcgagatccagttgtagctcccatcagaggccggagcctcgcctttcaataaaaagtcccttctagctaaaaaaaaaaaaaaaaaaaaagaggaggaagaattgcaaataaaatggcaggcatagttctaagtgctttacatatgtattcacagtaaaccttcgaa

SEQ ID NO: 3447 - DNA, 857 bp, Homo sapiens
gctctcctctcctgctaagctttgtttcctaattaaaatcttctgccactgacacagctactgctgctgctggaaccgccatagccaccttggtttcgtggttttgcaaagtactggcctccaccgccataggggccagagtttctgcctccaaaatttcctcccttcatgggtccaaaatttgaagactgattgttgtaattgccaaaatcattgtagcttccaccacctccaaaattgcttccatcattaccaaatccattagagccatccccactgccaccatatctaccaccagcacggctgccaccaaagccaccacgaccactgaagtttcctccatgaccgaagttgtcattcccaccgaaaccacctccacgaccaccaccaaagtttccagaaccacttcgacctctttggctggatgaagcactagccatctcttgctttgacagggcttttctaacttcacagttgtggccattcacagttaagtgggcacctggtctttgagaatcttctctggagacagctctctttggttccacaactcttccatccaccttgtgtggccttgcattcatagctgcatccacctcctccacagtggcatatgtgacaaacccaaagcccctggagcgcttggtgtttggatctctcattaccacacagtccgtgagcgttccccattgctcaaaatggctcctcaggctctcatcagttgtttcaaagctcaaccctccaatgaagagcttcctcagctgttcgggctctttaggagactctgacttagacatgacggcagggtgaagagagactttaacgatgcttcttcggcggcgtccacgggcagaaag

SEQ ID NO: 3448 - DNA, 1761 bp, Homo sapiens
tacagtgtacacaggagtgggaccttctgttcttgaacttaggctgtggtgtgatcacccttttctctgcatccacctgacaggctgggacttgggctatgctctggacaaggctggctggtgcaatgatgccctctagaggatggatcaggcccagtcaccacctcagattcagtgcctgctgctcttcctctttccacttggccctggtgacagacagatagaggcccagctgacgtgtctatcggaacgactttatttcagtacactgggccccaccaggcaatgtggtttgtgcgaggctgtgcgagggacaggcttgggctaagagaagggaggtgagttggttaagcgcactgcagtccgcggggcgctacgttgctttcacacatacctgctgctgtggcccacacctggcaggggcctttggtcataggacggcgtgggggagaatactgtgtgaagtctgggattggggtgggtcttggtgtcacaggtgagggtgccggtgaagacaggctggccccagctttgcaccatctaggctgaaggcctttggaccactcctaggagtcaggcctggctccattagctcctggcactctggtctggcccactccctccttaaccaagcaggtccaaggtcaagaatggcacaagatcagcccagagggggccttcccacctctacaacctagtcccctggtcagctacagtggcaaaaggcaacttggtaaattgcagctttctccagtcttaagggcactggctctccaacacccctcccttgcttaggggcctctgccaaagaaaaattttacctcctgtttcagaaaatctaaccagcaaccagcctgttgattccagggcagtgagcaagaggaaaagggagaaagagcctggtgggagtgtctttgagtgtagcttccaatctcaaatggtcctggaacctgtggacactgtcagctcaccatcagctgggagaggtggggccctggaggctaagcttaggtgctgtaaacattagtgtagcaaggcaggaggcagcaagctccctctctccagcccctaactgaacaaacacttcaataaataaaacggtttgaagatggcattgcaacaagaacagatggaaagcgaggtcctggaaccagcaggtgccttaaactctcccaaggcccccgaaaggggactgggctgggaacattaactctgcagccattcagagtgaggactgctcctgccctcctccagtggccggtgtggtcctgttccctggtgaacatgagggcctcctgctctctcctgactccagtctctgtaatagctcttggggtgcttttccagcctcccaaaccaaaatggcaacaaaaccagacagaactcaaccccagtcccagtcctcagtgtgcagtcaggaggcatcgatagtggaggcagcagctgcctggggcctcaggccatcaccactgcaggtagttcatcgtcctttctgggcccagggtcccagggccacacggcactcgcatgtgcacacacactcatatccacacacgcactcacacacaggcagttcctcgcaaacactccgactcaagaaagcgagttttaaagtggagttaacttcagagagaggtgaagatgatgtcccgacattagaaggtttttctgtggatggatcgggcaccgtcttcctcatattcctttttggagacccacatcttcttaaaggtgtccagggaggcaaggatggagcccctg

SEQ ID NO: 3449 - DNA, 6116 bp, Homo sapiens
aaaaaaactcagtttcctcatccataaaataggaattagatttcaatgttctcttaggtcccttctagctttaattcatatgtgattatgcagtaaccacaaggtattttttaaacctcctaatgtatggatattaagcagaagagtatttatatgaatacatgtttcacattcctttggtatgaaaatggtgtgttaagtttttcctttaaccactgagttgtgaatgtgaagaaggtggtggagaggaacaaaaaacagaaaggtattttgatcttgccacaaagcatacacacaaattggcacatgcagctgtttgccaaagccttctttttttttttactttttaagaaattatgttagggaaaataaattctgcttccagggacaacttcatggagcctatttacaaattaagagtcagcttaatttgtaacatttctaccagagccaagaatcccaaattcctggtagattagtgttttatttctaaggggcttatgcattcggctccaactcaactcgtctatgtgctgccagtaattaaaatgttccacctcagactgcacaaatggcttatccttctttgtggcatggcgtctgtctcaggaaaaaaggttttatgaaattccatggcaacagtcccaacatgtttgagacttcagctaaaggaatggatgtattttggtgtgtagtcttcagtatatcactgtatttccgtaatactagactccaagctatgccagattgcttattccctttgtgaaagaggagttgctcattacgttcttgaaatatcgcacatcctgttggttcttcaagggacaagagaaagagaatttggaagcagggattagtagaagagaaaacgagggaaaggaagcctttccaccagattagtgttcaagtctttgcagaggagaccaactttttttgttttcttttgttttgagacagtctctcgctctgttgcccaggctggagtgcagtggcgcgatctcggctcacggcaacctccgcctcccgggttcaagcaattctcctgcctcagcctcccaagtagctgggattacaggtgctcaccaccaagcccggctaatttttgtatttttagtagagacaaggtttcaccatgttggccaggccagtctcaaactcctgacctcaggtgatctgcccgccttggcctcccacagtgctgggattacaggcatgagctaccgcacccagcctgagaccaccttttgcatctcaagattgtgaaaccaaggcccattccaccagcctggggactctttttatagatatgatcctcctttttcctgtgactaatgaatttgctgcatgatttctattcttctgaggttagttttctgagtaaggtgaccactcacaaaggcactttctttgtggcattctgagcctagattggggcccatcaattccagaaaaaatttatgtgtggaaactctgcatccttaagtcttgaagttgaaccagatatgcagtggttaccatcacacagataaacgctgccttctgtacataccccttatgctgtactaattaacaaaccccttgccagggctggggaggtgagggtgaaggagaatcttagcagaagggcagagtcaggacttgcatctgccactgctgggcactgaagccctggagcagcttcagatagtacctgtactttctcatgcagactccctctgaacaagagccttgtaggcccctctccttcatttcccaccagcctcttatcaggcgggctttccaccatacacccaggaggccacggtctgaggaacaaccaaacccatgcaaagggccgggcgcgatagctcacgcctgtaatgccagcactttgggaggctggggcaggcagatcacctgaggttgggagttcgagacctgcctgaccaacatggagaaacccccatctctactaaaaatacaaaattagccgggcgtgatggcacatgcctgtaatcccagctactcaggaggctgaggcaggagaatcgcttgaacccgggaggcggaggttgcggtgagccgagatggcaccactgcactccagcctcggcaacaagagcgaaactctgtctaaaacaaaaacaaacaaacaaacaaaaaaacccaggcaaagtttccttgcagccaaggtgacagaactgggctgagggtggaaaagaaacagaaccagtgctccaggtgttttttaattttttaatttatttttattttttttgtatatgtatatatatgtatgtatattttagaggaccagggtctcactatgttgcctaggccagactcaaactcctgtgctcaagcaatcctgcctcagcctcccaagtagctgggattacaggcatgcacaaacaatgcccagctctccaaatgttttctgtcactacctgaagtgttgcatcggtacttcctacggaaagaaaactaaatagaagtgtctctcccgtgagcccccaccactaccaccagaaaaaaaaaagagagaaaatgaactcatcagtctttagtttcctcaagttattctcccaaaaagacattcgccttggcacagataagccagctaatcttatgctttatgacccactgtgagctgttcctgacacagcttctgactttgtcagtgacaaaatttctcaccttttaaatgcagtgcttaacattttgttaggcccatactcaaaatcggccagatataaaatgacctcagattttgatctcctaggctcaaacaatcctcctacctcagcctcccaagtagctgggactataggcacaccaccatgcacagctaattttttttgtatttttctgcagagatggcgtttcgccatactgcccaggctagtctcaaaatcctgggctcaagcaatctgcccacctcagcctcccaaagtgctggaactacaggcaagagccactgcgcccagccacaacctcagatttctttggcaaacagaaatgtttaaaaacacaaaattttgctcaggtgaaacactgtgttactatcaaatctcacatccacataaagtttttcttttcggctttgtttcgtgaggaacagacagaacaaagtttttccaggtagcatctgtatcactattattctcctatttcctgtaccacccccacctccccaagccctactgaatgtgaggtttagaatgttttaaggagggtcaggtgcggtggctcacgcctgtaatcccagcactttgggaggccaaggcgggcggatcacctgagtttgggagttcgagaccagcctgaccaacatggagaaaccctgtctctactaaaaatacaaaattagccaggcgtggtggcacatgcctgtaatcccagctacttaggaggctgaggcaggagaatcgcttgaacccaggaggaggaggttgtggtgagccgagatcgtgccattgcactccagcctgggtgacagagtgagactccatctcgaaaaaaaaaatacaaaaattagctgggtgtggtggtgcacacctgtaatcccagctactcgggaggctgacgcaggagaattgcttgaacctgggaggtggaggttgcagtgagccgagatcgcgccattgcaatccagcctggacaacagagtgagactccatctcaaaaaaaaaaaaaaaaagaatgttttaaggaaaaaaatagtactgttacatataatcccaggtgataagaccacaatggaaatgtttaagtcctcactttaaagagtaccccactgagaagaggtatgttggactctagcagagatttggaaactctgggacactcaagatgtgaaagagcctggctatctgaggactcaaagagtcagcatcgggacttgtgagctcaagaagagaaaagggagtggtgaaactttgtcctaaaagttagcaccaggaacagaagaaaaaaacccgatatatagtgatacctcatcttttagagaatgggaagctatttttgtgttcacacagaaagtatagttcaaaaaacctctatatccagagttcagacaaggagaatgatttgagatataagtgccgatgaaggaggtcaattttgatctgaaaccagcagctggacctgggccacctcaggaaaaggactctgttctccaaggcagcacgactgaatggttctgagaataagccagggttcaggactcctgaccctttaggaccatggactcagaagagcctgaaggacaattgtgggctttaaacttctgagagcttgtaaagtaacacaagactgtgcctctcccttgccccagctgtagatagtctttgccccaccattgttatgaagatacacagggttttgcagtttgaataaattggatacaagtttcctctttttttttttctttttgagacaaagtctcgctctgtttccccaggctgagtgcagtggcacaatcaaggcttacttgccgcctcaacctcctgggctcaagcaacgagccatcctcccgtcttagcctcccaactagctgagactacaggcgtgggtcaccacacccagctaatttttgtactttttgtagagacagggtctcaccatgttgcccaggctggtcctgaactcctgggctcaagtaatctgcccacctcagcctcccaaagtgttggggttacaggcgtgaggcaccgcggctggcctgagtttcttcttaatactgtatcacaattgtgggctgtcttatgtgttgatatcgattgagctatttgaaataggaatgttaatgggtgtattaaatttttgtaaggatataacaatatctaccttccaaggatgttgtgaggttttccatgattttgtatatgagctaatgttacctttgaggggtggtgtgcattatgttggatgattgtaaattttcagtggaaaatgtaccgtgtcctaaatttaaagacatgaaaaatatcccaagatcatactagatcataatagcaattcctttacaaatgaattatggaggtaactgatctctaacagtttccttcatgttgttttaatgcacaagggcagaggatctgctgacccttggaaccagcgtgagctaaccacgtgctatagacacttcatggtgtcgcacccagggaagtcaaagcgctttgctccctcactgtctgtgagtcctcagccattagtaccccaccccccgctgctccaaaacttgagttatttcaaatgtttctcactgttcatctctccactgaccccactccagaaagcctggagagagtcccaagatgccacccaccttccccaatccctcgccacagatctgtgtctatctcacactctgtaagtgccgctttgcttcttcctctcttgaaaagactgagaacacacattttaacatgttaggaaaatggggcagcctaaaaaatgactgatcccaccgccagtgactcatgtatactccaggctagcagacaaggccctttttggtgggcctgcttctgtgggttcacagaaaccaaattactgtgggttgcaaagaattagcaggtcatttacaaagcagacatcccttcacccagactgtggttttgcatgctcaggttctcagtctatgagctttggtgcaggatcattttggctactggaaaaaccatagcttattttaaatttctggttgccaaagccaccacacgtgtggtctgtggatgaccattgtctgcagaatgacgaggaaggaacagaatgtggtttggggctcagggtggccttcccactgggagggaaggcgggagggagcccttgccctgggttttgacacagcctgtgctcacagcctctcctctcatctgcatttctcagaaatgccctccctgcccagtggtgactttccctcgtcactcctatggagttctacctggagcccagccatgtgtggaactgtgaagtttactcctctgtaaagatggtttaaagaaagtcagcttctgaaatgtaacaatgctaacccttgctggaaccctgtaagaaatagccctgctgatagttttctaggtttatcatgtttgatttttacactgaaaaataaaaaaatcctggtatgtttg

SEQ ID NO: 3450 - DNA, 2103 bp, Homo sapiens
gtgcactgtctggtcaagagcagtgtccatgtgcgtttctgtggcagcagtgcacgtggggtgggtggggggtgcgtacggtggggcttgtaggttaagatgtctctgcggtggtgtggggctggaggccgagccaggcacggcagctggccctctccaggcgcatggaggaattctccctttgccgttccaaggatgccgccgcctcctaccggggctcccgggggggtcagccaacactacaaagggcagcgagtcctcagggcgcccgggagccaccagtctgctctcgggctctactcagactagcgccaacagtctccgcggacagactcgcatcagccgccctggggctcggcctcctcccataggctcctcttcctctctttcattcaagtcttcaaactttgaaaaaaatatgagcttttgccaaataagacgggatagtttatggagttttctgaggcgcattgaactctggtcagcccctcgagcgtgggctcggccatcagcaggcccggtgggttggccgggctggccctcccaggctgcctttctctctggtcgcggcctggcccgccccggcctccaccgccgcaattcatgctggtgccgcgcccgcagccccactcctggtatgcctgagattctccaggggccaagccggtcctccttcccggcccactcttccagggccaggacgctcccgcggagccagcccatcgtggctgggggtcccaggggctggaggcctgcctggttagcctctgtttcccagacattgactcgaggcgcctccagtcctctcaaccccctgactttcaagtcctttcaagtccttgtgccctgaccaagttatgaggaaaagagggctgagggcctggaggtgggctcgcaccccctcgaacccacctagatgtctcctcctccccagcctatgagttcagacttggggggctccatctgtccctccctgaggtccctcatcttgtccctgctctgattctgtcagcagatcctgaacactccttggtggggacccatgcctccaaggctgcccccaatgccagctgtcctggggaaactccccagaactctcggggaaaggcccgagaaccttcggaggaagcctccgggactcctcgccacctgctctgtttctctcccggccccactgccttcaggtatcaggaagagggcaggcccctgtgccccctctccccttcccagggcggccaacaatactccaccatggggcgcttcctttcttctctggaaactaagacattggactgaaggaactggcctgaggggggctgaccgggggcccgtgctgctgggagctctacgcacaagaggccgccggggtcacggacaggaacctcagcccagggtgctggcctttctccttcgcaggagtcccccaaaatccacacagcgactcgagcagccttccactcagccagaggagggtcgggctcccccgcctgctctcggtggtggcgtctggcccttcctgccgtttccaaggcctccggaagcaccaacccagttctcagttacctcctctggccggaaggcctcacgttgtcctccagagctgctctgggcccagggctggctccgtgaccacctgatggacgtgctgggcagcatgggctcccaaggcagcatccccagctgctctcccaccccaccccagctgcccggcggctgggcccacgagggctctggggacacttccataggaaaggggcctggcactttgtgattgccacgtgtttcctgttaagccgcctgcccccagtgcaaatctctgtgttttgctctctcctgaacaaaaatgtaaaccgacgccggaaagcaaatggtatcgaatacctttcttgcccataagggtttttacaaagaacgtgtctcactaggaactaggacactcatcggcccgagaccaactcctggataaaaggaataaggagaatcgtgtttgtaacgagttacaggattgtttctttcctggattttaaacttttgttaaattgtgaaattatggaggagttttatagaaaaaaaaagtgaaataaagtcagatgggaaagcaga

SEQ ID NO: 3451 - DNA, 1164 bp, Homo sapiens
gttctcatacaagatttattccccagcacacccctcccctcctcagttcacagtggagactatggagattcagggcaggatccctcaggtacaagaaacaccttccgaagattttgctctccttccttccctccctcttgccaactcccaaggcctgaagcgcacactcatgcaaacacacgaaatccccctccttccccacacctcctgtctttccacatcagagctctgaacttgagaggtgtcaaaagtctgtttgagaagcctaaagtggggagatgccattacccctgaccaccccactatgagtgactatgagacacctaactcttccctcttctgtcaaccattttcactccctggcctctgtaccttctccatcaaccaagagcaaacatgtcagcacacccccacctgcagtacatgaaaacaggctctgtccaacatccctcacccaagtacaggggtgttgggggagtggcccctgaggatcagcaaagggttaatgcagaaggaaagaggacagaagcgtttggcttgagctctgcttggggaggcagaggctatagactggcacaggtttagaatcaagtaccatgtttaggtttctgtctcacatcacatgatttcactaggggctgcagaacagatacccctcagaggggtctctgctgattacagccacattcttactattggctcatccttaaaggaggccccaccaagttgggaagcagttgaaaataaaagctgtaaaggagctgaacaggaagtaagaataggtggtgcaagagattatggcccctgggatgaatgacatggagccatttgtaaagtgctactgtatcatcccccatgaattattgcttctccaaaggaggagcagaggaaggaacaggaacatagaaatgagtatggtattgctttgctcactgctgaggctgatggccagatggacccaggggttatcagaaaccgaagattaactacacagctccagaagactcagacctcaaaatacagaggtgctcactaatcctcccagccagctgatccccctgggccaaggtaatgtagaagaggcccatccccacatcatattcacattttttaaatttcacaagcaatactttggaccactggggttcaggccccaagaaatga

SEQ ID NO: 3452 - DNA, 795 bp, Homo sapiens
ccccctgttcctcttctgtatcctcgtcgtcgtcctcgctctgcgcttctgcttcctgcgccttcttttccttttctacgtctccctcctcctcctcctcactttcgtcctgggagtcactctctaagtcactttcggggagtgtctgtccggcatcttcctcctcctcaccactgctgtcgtacaagccgctatttttcccagactccagggctcccagaatatagtcaagaccgtcgcgtgcaaagctcagcggcacggagctgctgccgtccttctttttgcgcttgttcaaaccgaggcaacgctccagctttcggatctctcggtcctcctcctcgttcgccgctaaaagcgcccgtttccgggcagcggcggtggcggctgcggagggtctggtctttgcggtggcggccgtggccttggccttgacccgggacggccgcggcttcctgggaggcgaggggtcccgactaggggctgggcgggcgcgctcctccgtgtcctgccggtgaccgctggcttcttcggctccgcttcggcctcccaggccgggaccctgttcggggcccgccgtcctctgcagccggcgtgctttccgcaggtgccgcttctccttcctcagttccttacggctttttctccctcccgggcgaaagctcaccggggcgccgcgcccctcgcaacccccgggagcctcgccttccgaagtcgcgtgcacgaactcctccaccgctagcttcagcctcttcagggccttctccccaccgccagcaggaccgcggcgcggcccgc

SEQ ID NO: 3453 - DNA, 1469 bp, Homo sapiens
ctcttcccgccagcccgcctggagcaccagcctcgcgcgtccggaggaaccttggcttggcgccccatcctggtagcctcaaacttcatagcactttgtggtttttcttaaaactctgagcctgtgcccgggcggatcacctgaggtcgggagttcaagaccagactgaccaacatggtgaaaccccgtctctactaaaaatacaaaattagcccggcgtggtggcgcatgcctgtgatcccagctacctgggaggctgaggcaagagaatcgcttgaacctgggaggtgtaggttgcagtgagccgagatcatgccattgtactccagcctgggcgacagagtgagactccgtctcaaaaacaaacaagcaaacaaacaactttgggcctgtgccgaagggtctgggcagatcttccaaagatgtacaaaatgtagaaattgccctcaagcaaatgcaaagatgctcaacacccttagtcatcaaggaaatgcaaatggaatccacagagagatactgcacactgacaaagatggtcgtattactaaaggtgaataaccagcgcggggggcacgtggagtcactggaacatttgtgcaatgctggtgggaatgtcaacccgtgcggccctctggaataagcctggcagctcctccaagagttaccgtgtgacccagcaattccactcctagctccacccacaggaattgaaagcaaagacgcaaacagatgcctgtgcaccaaagttcacggcagcatccttcgccatagtggcagcatccgtcgtcacagcggcatcatccttcatcatagcggcagcatccgtcgtcacagcggcagcatccttcgccacagcggcagcagctgtcgtcacagcggcatcatccttcgccatagcggcagcatccttcgccaaagcggcagcatccttcaccatagcggcagcatccttcgccatagcggcagcatccttcgccatagcggcaaggtggaaaccctgtccatccactgaggcgtgcatagactaaacatggccagtccaggcactggaatccaggccgtagaacggcgcccacggtcaaaaggaatgagaccctgatgcactgggcgacacagacgggcgacacagacttggagacatcatgctaagtgaaaagccaggcacacggagcggacggcgtgatcctgctcacgtgatgtgtcccgaatgggcacgtccagagggaagaagggagatggcgctgccggtgcccgggacgggggttgggagcgacggttgctggtttggggtttctttctggggtgaggaagtgttttgatattggccgttggtgatgtttgcatacctctgaatatgctaagacccacagaattgcacactttaaatggatgaattgtatggtatgggaattacacaattatgtctcattaaagcagttattttaaaaatctagtgcccagtagcaaca

SEQ ID NO: 3454 - DNA, 985 bp, Homo sapiens
ggccttgctgtgctacaaccggagctgcggtcagcgcttcgatcctgagaccaattccgacgatgcttgcacatatcacccaggcgttccagtctttcacgatgcattaaagggttggtcttgctgtaagagaagaacaactgatttttctgatttcttaagcattgtaggctgtacaaaaggtagacataatagtgagaagccacctgagccagtcaaacctgaggtcaagactactgaggagaaggaactatctgaattaaaaccaaaatttcaggaacacattcaagcccctaagacagtagacgcgataaaaagaccaagcccagatgaaccaatgacaaatttggaattaaaaatatctgcctccctaaaacaagcacttgataaacttaaactgtcatcagggaatgaagaaaataagaaaagaagacaatgatgaaattaagattgggacctcatgtaagaatggagggtgttcaaagacatatcggggtctagagagtctagaagaagtctgtgtatatcattctggagtacctattttccatgaggggacgaaatactggagctgttgtagaagaaaaacttctgattttaatacattcttagaccaagagggctgtacaaaagagaaacatgtggactaaaaaagatgctgggaaaaaagttgttccatgtagacatgactggcatcagactggaggtgaagttaccatttcagtataggctaaaaattcacttccagaacttagtcgagtagaagcaaatagcacattgttagatgcgcatattgtatttgaaggagagaaggaatttgatcaaaatgtgaaattatggggtgtgattgatgtaaagcgaagttattaactatgactgcaacaaagattgaaatcactatgagaaaagctgaaccgatgcagtgggcaagccttgaactgcctgcagctaaaaagcaggaaaaacaaaaagacgacacagcaga

SEQ ID NO: 3455 - DNA, 2183 bp, Homo sapiens
cagttttacaaacataatgaaaattagttgatttttagttgatttttttgtcccaacattttttttaacctttttgccactcattatatgtttgcagttctaggtctttgacagctgaagaccacaggaatcaaacaggcgagacacacagaatactgacccttctttacgcttttatagtgtttataccatatggcccagtgtggaattcttgattatccaagtgcctttggtcatttgtggcaggaaaacttaatagtttttagccagcagtgccacagccagcttttactgcaatacctaaagggtcaagtagtgtttttgtaccactattatttcaaatttaagtattctgccatgaaacgatccatactgggctggaacttgacatgtgaaatctttaatactaaagcttatctctgcttggcagctttttaggagaataatgagagttacaattttgactcttgcgttcctagaattcaaatggcatagctttctgaaatgagtatttcaagtttagtagtccgtataggagtgttgtgacttcaatttcagtgttcttgttaaaagaaataatatgatatatatatacacacatatatataacttgatgccagttttctagtaagcctcagtcttttattcactactcaatgataatgcattgtacaaacactgtcacatgagtaaataaaaatgaataattccttagaagatggagagtgttaaattatatttgtgataggaagcttagacatatcttttggttattagcttccattgccaattgtatttcagatgcatagggttttcttcccaaaaatatattgttaacttttatagctaactagcacctggaaaaaatgtatttgtacaactttactattgtatatagttttataataatgaaaaataaacccaatggccatattagaatgcaatttcgacatacagcttatctagatagttttccagaggattttgaaatttggcttaactgggaggataactgctcagcacaccactgaaacataaccactgacaccattcatttattttaactgagattcttgacatttttctctcctatgccttgttactttagcatacttgaactcacataaatgcttctttggattacatgggctatctgattccattttggatctgattgtccatcttgaattcaatatggtattcatctggactattcaaaaattatgccatttctagtctgtgaaataagatgtaaaaaatctttatttttgccctttggtaaaaacctatgtgacaacttttaaaatgtgaagcaacatctaatatagttgactggtatactaataggaaagtgaaagtatttcatgggtactttgtcacagaatgtgaaaagaaacttggcatagtggcctttataatgaggcatccacttactcctctgaagtgaagtctgtagcttagcttgtgtatagtttttgaaagaaatctcatgatcttcgttcattctcttgccttctcttttatctcatatggcacaagtagagggggaagccaggaggaaattcatcacctcgctatgcttttatttgatttttaattcctgagtgcctaaatgtggtgaccggcacctcacataactttttgagattcttgatgtcatttttatccttcctgtcaaccagcaatgtatttttatgttactaaaaccagtaacgtcataattgttgagggcaagcttcattgttgatagtgcaaagtgtcgctgttgtgatgtgtgtttattttattcaagtttgaatattgacaagtgtaacttaagctggtgactgacacctattgatctgctgtgtgcaaatgatagtactattttttagaaaactcttaagtaaattttaaaaatatttgaatacaaaatatctgagcaattttgaactcaaaagtttttcattgttttaaggattgccacaggactctttaatggtttacatacatgcctaatatttattggtgtgtttaaaatattttttgatagagtgttatgtcttaagcgcattagaaaacaattgtttgtaatggaatcaaagtgtttccctggacagtttgatgtgcttatggttgagatttataatctgcttgtactttgctttttaacttattaactgtaaataaattttagagaatac

SEQ ID NO: 3456 - DNA, 3645 bp, Homo sapiens
aaattgtaacttggccaggagaatcagaagctagaggaaaatggaggaggaaagaagaaccacatctgtttctaccgcgccatggcacccgggggggtctcgaattacacttccatcccaccttccccctccctcccggccagggtttggctcaggaatagttgaaactgtgattcactgctacagttctctgtgctgtcctggttgctacaagctgaagtctgctcagttctggggacgaaagaggtatgggctacgagggattaaaaaatgagatatttgcagcaaatggggaagagccactggcaaaagtttggtgtctggatgtggaggagggaggctccctatggctgggggagggatgctgagggtctcagagggagccacagtcccagtaggagaggccacagaagagccatgtccttgggcagccagagccctcctggcactgccctgggcttgaggcaaatggcaagggaggctctgcggctgggctggcaggggccaggctcaccaggaagaggtggcggtcctggggggtgccgttcttggctgacagtttctggatttggccctccttgatcagttcattggccgggttgacaatgtcttcttccccacccagctgctcgtacacctccaagagcttgtgcattttctcctgcaagagacatgggactcaggcaccaaaggtctgtgagagtggctggtgacctagagatgcacggagtccttccctgcaaccgtggcccagaatccagagagggcaatgagctactgacaagggtgggagggaaaacagagtgatgtttgagttgggtattgaaggatgaataggagttcaccatgcagagcataaaaacaacgataaacaggaacagagctaaccattgctgtgagccatgtgctgttctacatgatacatgttttaactcacctagtgaggtgagtgccattgttatcttcattttacagacaaggaaactgaggcacagagcggtcagttgagtatctgagacccagactcggacaatccatatgtcaccttcccctgaccatggtgactggtggggtggtcacatgggtaaccagcacccagaagtgcgatgggacagcgtcaaagctcatgcttcagctctgagccagacgccagtgtagcagaacgcagaggtgagcctgcggcaacctcgacaacagccacatgtctgagtctgtacctgctgtgccttggaagccccgtccttggacctgagtgatctcagcctgtacatcctggaggcggctgggtttggctgacccttccgtctctggcaccaatgcagagttcttggcaggtgcccctgcaccctcctgggagcccttggccccagctcactctccgcatccttccggtctggggcgtcctgcgggagcctcttcagatagtccttgagcagcagctcgtaccgggggaccctctgcacgggctccagcatgtggtgctgcagcgtcaggttcccgcatacctcctgcttctgtggggacagagggagcattgggcactccaaggacacgtgtgtggatgccagccccaccggcttctggccaccacagccccaggaagctgcccggaactggctgcccagaactgactgtccttcaagacatggctgacacagaccacactttacaacgagggaaactgaggctcagagagactgaccaatggagcaagaactggaaccccaggcaggctggcccttggcccagagctggctctcttatacgcatcctcggtggagaaaataaatgcctggacaggactgtctcctcctgtcaagagtggcttttccccactctcacccacccgtgggcctaagcagggctccttcgacccctctgctgagaaatcaggcagagcttcgcccaaccatccccactgggtatcgggccagggcttgtccttatgcctagaagcagctcggggagtccttctgcagatcgctctcgatataaacgcaccagtattccaatcaggtgctgagaccctcgcgctccacgtgtacccagctctgctcaccggctccctgtgcctcccctcgcaccctgcagcacctccttgctgccatgtctccatctggcatctgaaccccagacacgtgtgctgaatgctgcccacctgtcgcctctgtgctccccaatcgggtcctcctgcccaggccactttgcctctgcctcccctgatgatgcccactgggcagcctgtgagggcctgctgactttgtcgtcctgtccaccagcttccccacccacctgccagcaactcaagggcctcaaccaccctcacctggctcagggcccagaacagaacggcttccagctcagatgagctcaaaaatgcctgggatacaacagggtgagagaaacccaagtcgacaatcttcataaaaacaactgtttctgtcaagatattcacataatctccaagtatctccctacaagaaacttttttttttttgagacggagtctcgctctgttgcctgggctggagtgcaatggcgcgatctcggctcactgcaacctccgcctcccaggttcaagcaattctcctgcctcagcctcctaagtaactgggattacaggtgcacaccaccacacctggctaatttttgtatttttagtagagatggggtttcactatattggtcaggctggtctcgaactcctgaccttgtgatctgcctacctcggtctcccaaagtgctaggattacaagcgtgagccatcgcgcctggccaaaactttttttttttttttgatggagtcttgctctgttgcccagcctggagtgtagtggagtgatcttggctcactacagcctccgcctccccggctcaagcaattctgtctcagcctcccaagtagctgggattacaggtatgagtgtgccaccacacccagctaatttttgtatttttagtagagatagggtttcactatgttgcccagactggtctcgcacttctgacctcaggtgatccgcccacctgggcctcccaaagtgctgggattagaggcgtgagctaccacaagcggccaagaaacttaataggggaaaaaacccaacttcacctgaagagtcctgacagacacgccctttatcaagtgaatatccccaggaatgggatgcagagactgcgtcaccgggcaggacgcagggagaagagcacagcctcactccaggaaaaggcacagcctcaatcaaactgtggacaaacagcagaaaaacccaagcaggcagtctacaagtaactaggctgcacccctcaaaaagacaaggacagaggcctgttccagacccaagaggacaaatacaataatgagcgcaatgtgtggccctgggttgggttatggatcagaaaacaagaatgttattgggacaatcggtgacatctgagtgtgggctgcggagtagatagcaccaggacatcagtgtaaaatccccgattttgatcactgtgctgggagtacgcaagagaatatccttgttcacatgtttagtgataaagggttacggtgtctgcaacttagtttcaaaacgctcaaaagtcatcatcatctgtatgagtttagagggaataataaagtaagccagacaaaatgtt

SEQ ID NO: 3457 - DNA, 5682 bp, Homo sapiens
gttttgagacggggcgctgggccgggcgcggtggctcagggctgtaatgccagcattttaggaggcagaggtgggaaaggattgcttgaggccagcccgggcaagatagcgctactctatctctattttaaaaaaataggagaggcgccaccccattcttacttaggcgaatcacttgcttttcctcgagagcatgttaacccttcgggaatgataggacgaccggggtcttctggtgtcagacccgcgtgcagtgtgcccttttgttctgttttgcctgctcaaagtacctccccgcaccccactcctacctggattcttcccagtcggagctatttcacgtccacacacccttcccgatttctgtagcctgggattcaggaatccaaggcttcccccacctcagcagggctcatctgtattgtggttatgggtttccaggtcacagctccagctctgattccatcctcggccctgggagagtttaacttttctggatccgcttcttcccccgggaaatggacagtgtgacagtacctgcctcaaggggcacatgagacagctctgcctgagagtgagcaaggtggggctgggtcccccctaacgcccagacccccatggagaaccccttcccagcccacctcagtacctggaagctgagtacccctatgccttgcagtgcctctcttctggagtgacaggatgagggtgggggcttcacaggaaccagggcctggcatgcagccttcatgttttcccacaccttaggtcatctgcaccttggttacaccagtgggcctgatgtccttgaaaaatatcatagacgggtaggtgcggtggctcacacctgtaatcccagcacttagggaggctgaggcagatggatcacctgaggtcaggagtttgagaccagcctggccaacatggtgaaaccccgtctctactaaaaatacaaaaattagccgggcgtgatggtgggtgcctgtaatcccagctacttgggagactgaggcaggagaatcgcttgaacccaggaggtggatgttgcagtgagccgagattgtgccactgcactccagcttgggcaacaaagcaagactccgtctcaaaaaaaaaaaaaaaaaaagaaaataccatggagggccaggtgcggtggctcacgcctgtaatcccagcactttgggagggtgaggtggatggatcactggaggtcaggagtttggagagcagcctggccaacatggtgaaaccctgtctctatcaaaaaacacaaaaattagctgggcttggttgtgcgtgcctgtaatcccagctactcgggaggctgaggcaggagaatcgcttgaacccgagaggtggaggctgcagtgggccgagatcgcgccactgcactccagcctgggtgacagagcgagaccgtgtttcaagaaaaaaacccacaacaaacaatggagaccaaacccagggcccatcaaaggggcctctagaggctggcagggcagagtctaaatcccagccatgcccctcccaactgtgtggccttggagaagcccctcaacctctggcatgtgctgtctgaacttgggttcttcacggtgccccaaccaataccagccagccagttcccacgactcccatccgatggcagcctgggagcccatctgttcctgtcctgctgggcccaccaggaactggccacctctgctggatgggtggctgctgcagctgacatttaggctccagaggctgggcactgaatcagggaggccagagagggctgccaggacagcaggcgctcctggccaagtgaggctctgctgggagctccctgtttggtggaggatcaagacagaactttgaggacagtgttccacccatattctgcacccttcttggctgaggccacagggcagacccccacccaccggccctgttcttccaagcccgatcccatatgagcaggcgtcccatgcacacacttctcaggcactttttatttcatgctgtgcgggggccccttgtcccagatttgtggccacgtgtccaggtgtctgggggagtgggccaagcctgagagaggagggccctgctccagagatccccaggttgtccctgttgacctatagggaggtctgacttcaggcgttgccctcctgacccgtgagcagtcctgagtcgctggctcctattctgtcacacggggtgggtagtgccaaaagcagcctcctgcagcccttggcgtccggaagagtgacagccacattcaagtctccctggcacgtgaggtccatggtgcccctgactcatgtcctggctccagccaatagcccagacccccatggaaggttccagcatgtgcaaaaatgcacattggccaggtggctgccccccggagacatgtgtcagagaggcacgggtcaggtgacccaagtgtccaaaactctcatggagggtcccagcccattggccaccccaagccaaccacagcagggtctgagcctcagacgcgcagtggcctagtggcttctgctctgacagctcacgtccaggttataagggagacgggcagcgttaatagaaaactttgtacatacacatataaaaaaccatttggtcttccattaaggctgttacagtttaaagttacgtaaaccacgtacaaagaaacagttaaacgtacaaaaaggggagtggggagatgtgaggccgcaggtggagatgtggtgctccccacaggtgcgtccatgatttgggggctgcgtgcgagggggcctggctccagccggcctctccctgccttgactctgcacttggggccggtgcccacctcacgtcactcttgagcttttgattctggatccttctctgagggccgaacactagctctgcagctctggcgcccagctccagtgcaggggccgtcctcggacatgcagactttgtcagctgtggctctcagccattggtctggcccgaggcggggggcaggcagtacgttgggggatccgagtacctccgcttggccccaggtggctggccatcctcttctaggggctccagggcgccctgcactggcaggtctgccccgggcgtgatgtacacggaatgtatctggtccgggcggcgggcaggtggctcccggcgccgcactggggcagccgcctcccgggcacccggtgcccagcgaggcaggtgggagggcaggcctggtgggagcttgatgttggccgtgggcatgatgggggtccgccggggggtcttcactctgaccgttacgaaggacgacggccttcgtcgtggaggggcggccacggtggggagggggctcggggtgggcgcgccggggcaagggagagcaggcgcagggggcccttttgagagacagatggcagggttactgcagcttcagggccggcagccggaggaccctcgccctggggcctgctgggatggacgggaaggagaaaagcagacgctaccttaatactgaccttccgaggccccccgcccggcccgctcctccagcaggctctcggtgctggccgacgtctccgagtccaggttctcctcgtccgagccccttgggtccagctccggcagccggtaggtgatgtcctccctggaggaaaaagggtagtggtgtccaaggccaccccaccggaagtgctgggccagtgtggaacagagcaggctgtcctgctcctagatgtaactctgtgtccccaacctccccccaccccaagcaggaggattgcttgagcccaggagtttgaacccagcctgggcaacataggcggaccctgttctgcaaaaagtaaaaaaaattagccaggcgtggtggtgtgcaccacctgtggttccggctactggggaggctgaggtgggaggaccccgtgagcctaggggattgtggctgcagtgaaccgtgatcgcaccactgcaatccagcctgggtgacagagaaagaccctgtctcagaaataaaggccgagtgcggtggctcacgcctgtaatcccaacactttgggaggccaaggtgggtggatcacttgaggtcaggagttcaagaccagcctggccaatgtggtgaaaccctgtctctattaaaaacacaaaattagcagggcatggtggtgggcacctgtaatcccagctactcggaggctgaggcagagaatcgcttgaacccgggagatggaggttgcagtgagccgagatagcaccactgcactccagctgggcgacagagcgagacgccgtctcaaaaaaaaaaaaaaaaaaaaaaaaagtgttgtttgcccagtgttagggatgacaggaccaaacctggcgaggtcaagcggaccaccagggatggaacctgcactccagcttgccctaaacatgaaggactgagggaggggactgagccacttgcttctcctccttgatggactggatccgttcaatgagaatctccttttcccggtcctcatcgccgccggctgcctcctcctccagcagcacctccagctcctcctcctggatgtcccgggtcttggggctcttgttctgaaacaaagaagcaaggggtcccactgacatctctgagtgggcgaggttactgccggaggtgtgagcagatcccaggaggttagttgtgatgtgagtgtgctgggctcttagtgagacttctctaggaatcccatgggacagagtggtggtcatgtggccgattagtcgtcctgagcacagaaggtcagcaggcaaggggcctccccagcatgcacttccggaaggttaggacaggctctgtctatcctacgaggggcccagggccccagggaaccccagcatgcactgcaccgggagacatgcaccgcgggcccaccgaacgcgtacataccaggaccccctcatagggagacgaaaaccccagtttgagaggccatggctgggagagagatgaacacagggtgaccacacgggccaagacagacacaggcatgagctggggatacatccaatgaccggtaccaagatagggggtccctggttcccacaggagcccagagcccgttccccactaacacacccctgcactgtggggctgattcttctgctatgggaacatttccccgtgggtagggcccaggtcagaagggacaaggctggacgcatgacctgaaccaccagcaagcaggaagctggtccccctacctgccccacctagaggaacataattggagtgaggctgagcgaggaccatcgtctttcgttcaaggcagtaagtctgcccctacctgcagggcctggtggccccagccaggctggttgtggccaagggtgtggtaggagtgggcggggaactgggaagggaggccccgccctgctacccgagaccacacccactacccggtcccatcctcggcatgggaggtcctgcccacccaaggccccgcccaccaagaccccactcaccagccttcccagcaacaaagccacgcccaaggccctgcccagcaccaggctccgccccaccaaagaggtcccgcccccacgatcaccggtactcacagcattttgtcgcaggagcgaaagcctgcggaaggcgatactctctgcagcctccagttggctgatctcctccatcttcactttgtatttcctcatctgctccttgatcagcatctccacgcacct

SEQ ID NO: 3458 - DNA, 2563 bp, Homo sapiens
agatggagaggacgctctgccatttagaggtcctactgagtgggcacaccttttcccctcgagaaaaccttgtttctaccagagaaatgggcagaggcctctctctggaacttgaacctctctgtccctggaaacatcccaaagcaggcccagcctgccatgttcctttgttggggcacagagggaatggaatcttaccgataaggtgagaagagcttgagagaataccaaggacgggcccacccttctccctcctccctccaaacacctcaggctaaaaggggagggaaaaaaaaggcaccaacaaagagtttaagacagcaattcccagctttttcaaatatgaagcattttttaaccaatccgttttttaattcttaaattcttgacattacagaactaaactgaaatttattaacattccactcttacatttcttatcgacaaacagaaataaaattcatgagccaaaaaacccaaaacaaaactaaaaacagggaaaagcttataaaactaaatatggatcccagcattaacagctgaacagagaatgtgatttttaaattcttagcggatgataaagttgtgtagaaactgaacacttacaaattatttaaaacctggaatcactgaccagaaattacacagttggatcatgggagaacagcagaaaggggttattgagggaacctacactgttctagctgcaccccatgcccttctcagaggaaagcctggcattgattagatactgggccagactaatactggcagcagagccagtgatagtaacctgcctaccagaggagccttccactgggttggcaattttgatctgggccccggacatctggcggatctcattaatgttggcgccttggcgcccgattatgcagccaattaagttatttggaatggtgagttcatgggtggtttgagtagatgcatccaaacttgcccaatagcctttcacctctggagagctggagtcaattccggcgaatccggtcccgccgtgcatcatggcaaagtgagactgttgtcttgccacctggttcagcttggccagatcgagcggagaaatggtgtgttgtccttgaatcgagtaggcatctagaggtggtccctccaggtcatgggtggcatgggggtagcccgcagcgtcgctgcaccgatcttggccgcccgcgcagatgactggggagctggccggcatgggctggtacggaatggtcatgactctcccttgcggagactgggagagcgtctccagcatgaccaggcaaatctgcttgacacactcggtgacagactgcggcacgccagcgatggtgatggcccgctcggtggagttgggcagcatatcccccgccacctggacctgcgcccccgtactctcgcggatctctttgatcttacacccgcctttcccaatcagggagccgcactgggtggccggcaccaccagcctcagggtgaccgggggcctgctggccgcggtactgttggtcatggagctgttgatatcttcctccagcttgtcgatgatcatagcgaaagccttaaagatggcattggtggggccggtcagagtgatgattctctccggacaattcccctccgagatgttgatccgcgcgccactctcctcgcggatcctcttaaccgactcccctttcttcccaatgatgcttcctacttcctttccgtgcataagaagccgaatggtgagagtcacatttagtccactttcagtcacaccggcatccatggcgagcggcgggcggcgttcgggggagttgggctcgttacgtggtcaagtctttggcggctggcggggggaggggaggtgtaggcccaaaactgccggcgcgaggcgagcgagggccgcgggagcgagcgggagcgggcgggaggccgcagcgtagtcgcaggggcgggcggcggcggcggagggggcgagcggggccgggagcggcgggcgggcgggtgggcgagggcgcggcggtggcgactccggcggcagcctcggcggtctgggcggggcgggaagcccgctttcaaccccgcgtaccctctgaccccggaagtgcttgctgcgcaggaccccttgaaaaaaaatgaggacccgtcttttttaggtcacaagattgcgccaacccttacatggtccttaaaaaaaaaaccttctgacactgcagtagtgaaaatgaagcgcacgatgggcggaagctaggaagacaaacataaagatgaagtgcttaattcaaggtcacacaatgtcggggatggacctccagatttccttactggtgagacgtggtcttgtaacacagtggttaagaatgtgactttggagccagcctgctaggggctgaattctgactcagccatttactaactgtgtgaccttaggattgctgataaccaccagaaactagaagagacaaggaaggattcttccctagagccttcagagggagcatggccctactgacacctggatttcaaacttgtagcttcctaaactgcaagagaataaatttctgttgttttaagccat

SEQ ID NO: 3459 - DNA, 3279 bp, Homo sapiens
ataatatggtgcattcagtttactccacaagtggttaacattttaagtcctagattttttatgtcttgcctttgtataagcatcgctttggggaataccaagatgattcattattcagtgattattttcttgaaagataactatgatgattggctgtaaaatcttcaccctaataaaggagtgagatctctgtgtaaacagctttctgaaggactgataatagaatagaacttgcagccaaaggctttttcccttttgagaagacggtatttgtgtaaggagtgctaaggtagacttcattgtacatagagtgccatattctgttgaaacgatcataacaaaatcaaaacctcatgcttcagcaaaaaggaaaaaagatttttaaattactttgtctattacttactgctcatagagaagtgactatataaaatggtccaattttctcatttctggtggtgcctgtgagtcttaaagccatatctgcttatcttactgttgatagaatactttttttctttttagcccatgataagtaatatgggcaggtagaagcaaactggagactgtcctgttaatgctgcatggggcacaatgtctttcaaattattggtggaagaatctcttttatccatggcgagaggtaagaatattaaagagtcaggatattgttgctcctggtatttaacaactgtcattagaaatgctgaaatttaattgtagagaagtcaagaaagaaagagtaaactgagaaaatcttactactacagagtcacttttacaatgagacctgcactttatgccagcactgtttgtgaggagcagtactgccttaaattagtttgactctgactgatgtcagtgtacgttacttcctttatgtgactgacagtcagctttccattgagatataacattcacagatgatccccaagtatccttgtcatcagaagctttggaccttttctgccactgacttgtggctgatctgtaacacaataaatacataattttatttcatgttgtctgtccacctctgaataagcagtggcatgaccaaaaagactggtagaaggagagaatttcttggccaaatccttcataccaggtaccacttcttgagtaactgagagttgactgtcttctatggtgactacatagaagatatttccaaaggttctgttatgcagtgaagacattcagattatttgtaagaatttcaccaacacccttgtgtattgaaatgcttaaccattaacagggaaaaaaaaggagaaaaccgaacaaaacagagacatttacttgaaatgggaggtttgctaatgtgaagagtgtttctgttttattacttataagagaaaagcaggaaaacttttgctttgataagaaagacaccagagtggtgattctgtttgatgccacaggctaacacaatcgtgtaatcatgttgagttgtagaaatatatggccctaaaaaccattctctttcccttatatatataaatatgtgaacactgcctagtaacattttaatagatttaagatgcatttgtacattctcagcaaactagaagaaaatgttttttctctttttgagttaacttcatagcatagagaaccagcactgtgcaggtttcagcatttcagataagggcataattaattgtgtaacttaatgccctgttattcattgctgaggttcatataaagaatagaaaaattgaaagatgggtttgggcgacattttcttcccaaaagatcaagtaaggagtaagaacaagtaagggaagacagctaagagaacatactatgacatatcatagaattgggatacatttttgttgcactggatttcaggctatactgctaaaataatttctacctgttaaattttgtgagagggtttttgacatcagaatttttgtatttctggtcaaattggtcttggaaatccctatggtctctaatttcagctcttgctgtaaactgcaagccaaatgctctttctcagaaagagctatatttttctcttcttacaggcaacccaatatttatttcataaagtgttataaatattgagaagatacactggggagatagcatataaaaatgatgctccaaaatgagaattctatatggggctttccctaagaagaatccatcccagcacatattttgaaaaggtgctgaattaaaaagtacaagagtttgctcatataaatcaagttgcccaggaaacctgaggtgatgctatcatttgtctcataatttagaaacgtgatctcttgagagagagactacgcattgcctgggcactttcagattccttaggaagtgcccctttgatatttggaatgtggatatatttataaaacaaatggattgttattccaaatccacatggatttataaccaagccccagaagaataggcagctttgaaatagctagttcgtggaattgaacagaaccttgatggaatgcagttgcctgtgtgaggacagaaaacaaagaggctgcctcagaccacatgcctatctagagattaagtgaatttgtgagggacattttgtggatgccttaaagatgaccagtggtgggttctgatgggaatatatacactcatctggactaggccaatggaagcagtctctttcagttcacctccgtacagcacaagttgttcctgctcatgacctcattgaggaaaatgagaattgtggtgctggtgactttcatgtgtcttgggaggttgaggtgttcaacatcgttaaggcactcccaaaacgcaaacctccttttttaaatgccaattgtacatctacattaattcatctatgcaaacttgtgttttcatggtttgttttttacactatatttctcattaggttctttaaacatcaggtttaatattgatattatgaataatttttaaaccaaagtattctataagtctgtgtgctttgttttcctggatggtttgaccaaggtaaacatcagtcttgtccttctctcttaataaagtcatccatttgttaagtcagtggtctctgtctcatgtttttgttttgtttctttacagcattcaaggacagggaaacttacgagagtcttattataattattattatttacaaaatgaccctaataggtctgtttagtaacagtgaaattttttcttactccatttccatacactttctgtaaatatgtataacatgataatgatgcctggtgtattgaaatcctcaataaatactgccaagtgtggatcagttgg

SEQ ID NO: 3460 - DNA, 304 bp, Homo sapiens
ctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagatttcaggtactcagactccacctttacttttacctatgttggcggccccagaagg

SEQ ID NO: 3461 - DNA, 11572 bp, Homo sapiens
tttcatcatgttacccaggctggtctcaaactcttgggctcaagtgattcacccgccttggcctcccaaagtgctgggattacaagcgtgagtcaccatagctggcctggcctcctcttttcttaaatccttttttttttaattgacaaaactgtatatattaatatttatcttgttcaacatgatgttttgaaatatgcatacgttgtggaatggctaaactgagctaatgaacatgtattacttcacttagttattttgtaagaacacttaagatctactcttagcaactttgaagaatatatttgttattaactatagtcaccatgttgtacagtagatctcttaaacttattcctatcaagctgaaattttaaatcctttgaccaacatctccccaactccgcaacccctatcccactctcacctccgcagttctagtaacaaccattctaccctacttctatgagttcaactattttagattccacatataggtgagatcatgcagtagttgtctttctgtgcctgacttatttcacttaacataatgttcttcaggttcatccacgttgtttcaaatgacagaatttcctttcttatgggtgaataatatttcattgtacatatacaccacattttcttcatttatctattgattgattgatgcataggttgatgccatatcttggctattatgaataatgctgcagagaccatgggagtcagatatctcttcaacatactgattttatttccttgggatacatatacctaaatagtaggattgctggatcatgtggtagttctattttaaattttgttttctgtttatattcccaccaacagtgtgccagaagttctctttactccgtatccttgccaacacttgttgtctttcatcttttttggtaatagccattctaatagttttgaggcggtgcctcactgtggttttaaatttgcattttcctggtaagtgatggtaagcatttgcatgtcttaaacctgttggccatttgtatgtcttcttttgagaaatgtctactcaggtcctttccccatcttttaatcaggctgttttcttggtattgagttgttggagttcgttgtatattttggatattaacccctcattagatgtatggcttataaatattttattccattccataagttgtctcttcactctgttgatagtttcctttgcagtgcagaagcttttgtttgatatagtcccatttgatttgtcttttttttgttgttgttacctgtgcttttagggtcatattcaaataattgcccagaccagtgtcatggagctttttctctacgttttcttctaatagtttacagttttgggtcttagatttaggtcactgtcagttgagtttttaatatggtgtgagataagggtctaacttcattattctgtatgtggatatccagttgtcccagcacaatttattaaagggactgtcttttcccattaagtttcttcacacgtttgtaaaaaatcagctggctgtaaatatatggatttattcctgggctctctttcctattcttttggtttaagtgtctgtttttatgccagtacaaaaatgttttgattactatggctttgtagtaattttgaaatcaggtattgtgatatctctagctttgttctttttgctcaagattgctttggctattcagggtctttagtggttccatatgaattttaggattgttttttcgatttctgtggaaaatatcattggaattttgacagggattgcactgaatctttagatcactttggttagtatggacattttagcaatattaagtcttccaatctatgaatgtgggatatttttgcatttatttgtgactttaatttcttatgtcaatgttttacagttttcagtgtagagatattttaccttcttggttaaatttattcctaagtattttatattttgtgacactactgcttgttgtatattgatatgcctgcaactttactgaatttgtttattagttctaacagtctttttggtggattctttcagcttttctatatataaaatcatcacttgcaaacagggacagtctccttcctttccaatttggatgccttttacttctttctcttgcctaatcgctctggctaggacttccagttccagtactatgttaaacagaaatgaaagtggaagtccttggattattcctgatcttagaggaaaagctttcagtttttcactgttgagtatggtgttagctgtgggtttgtcacatatggcctttacttttgaagtacactccttctactcctaattcattgagagcttttatcatgaaaggatgttaaattttgtcaaatacttgatcgtgtggtttttgtccttcattctgttaatgtggtgtattatatttatagattggcatatgttgaaccatctgtgaatccctgacataaatctcacttggtcatggtgattaatcttttcagagtgctgttgaatttgtttattagtattttgttgaaaatttttgcatcttgaccaggcaccgtggctcacgcttgtaatcccagcacttcaggaggtcaaggcctgaggatggtttgacccaggagttcgagaccagcctgggcaacataatgggaccctgcctatataaatatgtatatttttttaattagctgggcatgatggtgtgcacctgaagtcccaggggtggaaggatcacctgagtctgaaaggtcaaggtgcagtgagccatgattgtaccactgcactccatcctgggtaacagagggagaccctgtctcaaaaaaaaaaaaagaaaaaagaatttttgcatctatggtcatcagaaatattggcctgtagctttctttttgctttttcttttctttcttttttttttttttccatatctgccacagtctaattgacaagttttcttctttaatagtgtctttgtctggctttggtgtcagggtaatgctggccttgtaaaatgagtttggaagcattccttcctcttcaattttttggaagtgtttgagaagggctggtactagtttttcttctttttttgagatgggggtcttgccctgttgcccaggctggagtgcagtggcactatcacggctcactgcagccttcaccgcctgggctgaattaattctgccaccttagcctcccgagtagtttggactgccgacatgcatcaccacacccagctaattttttattttttgtagagacaggttatccctatgttgcccaggctggtctcgaactcctgcacttaagcaatcctcccacctaaacctcccaaagtgctgggattacagatgtgagccaccgtgtctggccgtagttctttaaatgttcgatagcattcagcagtgaagccgtctggttctggtcttttctttgatgagggaatttttttttttttttttttttgagactgagtctcgctctctcaccaggctggagtgcagtggcgcgatctctgctcactgcaacctctgtcttctgggttcaagtgattctcttgcctcagcctcccaagtagctgggactacaggcacgtgccacaatgcccagctaatttttgtatttttagtagagacggggtttcaacatgttggacaggatggttttgatctcttgacctcgtgatctgcctgcctcggcctcccaatgtgctgggattactgatgtgatctcctttttttttcaaggcttaacatgtaatttaacaagttgatgctgcattgctgctccatttctcagaaaaacttcaaatttaaagtatcagcaacaaatcaaacatagtacatcaattaaatatgcacagcataactactatctaagataggcaaggctaagagctactctcagaccttcagcatacagcaactctgtttccaagattgtactaggcctatcaagaaaagttgtgaacagcaacatcatagacacaaaacggccattcctggttgtccttatccaagaaaaagattgaggcaagttaacacaagatttttaaaaaagatacactgaaatgaaagtctctaagagaaaatgtcttccttaggacaagaagggataatatatcggatataaaagaactatacgtacattgtttgtgacctctgtggacatttgcctgaattctcacctgggagtgaatggagcagtggggcgaaggtcattggaggaggttgtgttttgtggtgtatgtggcagtgtctctggggttggggagtgtatggataagaaagcaaatgaaacaggatggagaaaaaaagaacgatcaagattaatgggtctctaactggattcatttcactgtagttcccccaggtcttcaacagtcacatttgagacctcagtaatgcaccacagagaactcatcagttaaacaatataccacacagaactggtttgttaaataccactcctcccttgccctcttcctccaaaatactccctacagtagtataggtagggtagacctaactattgggaggaatctcttaacatttttctagggtagaattctggctagtccaaaaagggcccttttaaaggttttgagaaactagacactgcagctttattagtatcagcaacgtgtgtttggagtaaattcagctccaggagttgcacaattcaatgcaggaggagttccgccaattgccccaattccttccgttgcagcagcttggccaaagcattccgttgttggtggggtcaatctagcatcataggttcaggttctggaggagctgggctgccagctggcacagaagcagggggcatggtgcctccgttatgcctatagcacctcccacagccatctggcccatctgtatctcctgctgtctcatatcagagaaggttccagtgaatctttcctgccattaccagtgcattgcttcctcctagtgcctgcactcctctcgcatgggctccagttgccgtcgtttttgcatctcttggttgttcagcttttccatcctccacagctcttcttgacacctcatcaaatcctgcctcattagcatgacctggcattgatgaaggcgagcaacctccatctccatctccagcttctcatgagcctccttgatattgcagtccacttcgtcctgctgctgcttctccatctcaatgagtaccctctagtgcatggcatacttatattcaaaagccatgctgtgcacactggggtggctgttctcactccttgtgaaattgctggttctttacaaccagcttctctggaagtccttctttgtcacctaattagcctatgggctacacagtaacaggatgaggaaacgtggttaacaggaagaagccctcactgcatctgtcctgagctttctgagcaacttgctgtcctgagaactcaacaatgcctttccctaagggccttccttgatcatccacaatgactacagccctctccacctggccaaagaaaagtcttcttccaaaagtttgttagaaggtttcagactgtaagggatgcactatggcaggcagggtgcgcacagctgcatactgtccagacccactttggcaatctccactagggttcgtgcttccaagtgcataaagccaaagccttcatccttatgaagacctcacctgccttcccatatttcttttttgttgtcgtttttaattttttcatttttcctttttgttaatttatttaaactctctttctgtgaaattgccttcccatatttctcacagtttcctcatttcctcctcagtgatgtcagaaggaacactgcccacaaagaaatatttggcctcgtttggtgaagggcttctttcctgggctgcagtgtggagcctgaggagaatgtctgagggcagcagggaggggactgtgaattgaggcagcaatagattggttatttttgaggttattttttctttcttttgtgtgtgtgtgtgtgtgtgtgtgtgtgccaaagatttacttgttcatttcttgcatttgaagtactcttcaatgacatccttggcctgagactccttgccatagttcgtaactactatacaacttcaaccaaccactttacacggtttcccctctctgtcagttttacagaggcctaccgattcccctagtttctggtcatcaaccttaattaggttgatttggtgttcagcacaaagggcctccaccaacttgacatacataggctcatcacagttggatgcaagcacacacagcacacaaagatgggcttggcacttgtctgaggctttggcagctttgcaaatttcatatgctaggccatcatggatgagggcggtcttcagcacctcctgtaaaacagtattaatgtccattacacctccagcagcactgccttcctcggccatggcagtgggttacgagtgaagccggatcttgaatgcacccgagactccgcctctatacaattcagtggcagcagggaaagagcaggagccagatttcttatagtcagagaattacaaatttggaaagggtgaaaactagaataaggttggaattggaagtactggtataaactcctacagctttcggtatgtgtagatacagagatgtataggtgtgtgtgtatgagtggggtgtgtgtgtgtgtgcatgcacatgcattcatgtttgttccctagctctgttccatgagagggcttgggaacagcaatggcaccaaacaatgagcatacctactgcccagatcttggtttctaaataccattttctgctaaaagagaccagatcttagagaaaaagcaccttgcagagttagtgcagaggaaatacaaagatgagcatggaatgtctttttgtattagaaagtaagaacatgctccaagaatgatggggacataccaaaggacacagaagccagcttgaaggggtcgccactggccaaacgaacaaattacaacttctcaaataaaataagccacaagtccacatgatataaatcaatgaataaattggagagaagggaaagctctaccttttagggtaatgccaaccaacaaatgtaaaaggaatgatggaattagaaaatctgtatttggcaatcattgtggtactgattgattcaggtgaacatcttcaatggatgctaaaactagtgagtgaaagttggatgatctctctacaagatacttattaactacaaggggcaaaaagaataaccataaaagtggagaagcctcgtgataatacctaatcaattgaccaaagccccagccagcaactggacaaatcaaaactgtgtgacacctgataagatgcaagaagacaatctctcttttgtggtgttcttgccaaaaaggtacaatctgaatctaataaaaaggaaacatcaggcaaacccaaattgaggaacagtctacaaaataactgacctgaagtgttcaaaaatgttaaagtaattaaagtcaagaaagacaaacttcttttaagagtggtggagactaaagagacgtaacaaaatgcaatgtgagcacttgactatgaaggacactgatgggacaactggcaacttgaacggggtctgtgggttagatggtaatataccagtgttaatttcctggttttgatcactgtgttgtggttaagtaaaagaatgtccttgtttgtagaaattacacactgaagcctttaagatcatgagacagcactggctccatggttcagggaaaaaggttctttgtactttaacttttcctgtaagtttggaattatttcaaaatttaaaaattcaaaatagaatcataaaagtaatatttttcataataaacaagggtagcctttgttaaaaaatcagaaaagctgatatcaaagttcattctcttatgtggacttaaaaatcaaagaataattagctccaaaagaaaagatttgccaagtaagatgtttttctcttacaaaatggaaatttaacttctaaatttacttcacataacttgcaaatgtaaccggttttcttacttggacatttttcattttaccaactttattttcttttgacttttccaggtattcagagttgatgtttttcctaaaataaaccacagactatatttgggactatataagagatactaagaagtacaaagggctctttctcttaagtgttatgaaaaagactttgaatttaaataaagcttacaaagaaatcataaaactaattttaaaatgcttttatgtaggcaaaagggaaactatagtactctcactacttaatatttccagttctgcctaaaacaaagacatacattaatttttaacaatctttgtctcaaaattctaggaacatttggaagaagtatttaaagctaatgcttactctttgcgtgaaattttatataatctcaggaatagaaatttaagaaatagaaatcttctcatttcagtttgctaagcacattcttcattcttacatattacaggtccactagattcaaaggtaagccaaaaataccatgcaaaagactgcctcctaaattatttaaatctcttttgtagcaaaattttcccagaaactgaggaacatccacacagaaattcttacctttttatcaaaagtttgttatccttttctcattttctgggcctttcaatgcattggcattgacaagagtgaaaaaattatttgctgttatttgcatatcaaacacatggtttcaacgtggtatgaaactatgttggttccaacgtggctgactcctttgtgtccattaaaaccattttcctcatatctaaagtgaatcttggtatctgtgatttatgtttaatatagagatgggaaatggttagtaatctaatactagtcaagtcacatgtattcttaaaaaaagctcaaatagttgaattagggtgatggaaattatactcaaatctgaaattgtaatgaggctcctttctgaaacttaaatgacccattcattttttttaggtttagcttaatgtttttcctcttcataataccaactgaggtttaacttaataacaaatggtaactatataagattgtattaaatagtcttgggctattttttggtaagctctttgatttggtaactacattccaaaagttaattatcagttacatgagtttaaatggcatccatagctgccccttcacacaaacaggtgctcagtaatagggcttattagaaagaccctagaaaccaagaaacttcagttctagtcctcaatatagaagtagctaacaattttggataagtcatttaacttctagtctttggtttccatatttataaaatggagacaatatcctatctactttaataaggtattattaaaatgtttataattggataatatattgaagcattctgaaataataccagttcgtctttgtttagcaatctcaatttttcaaattcttaaccctgggattgaagttattaaaggcacttgtttctccttatttaaaagatttatgaaaggctcctaccatggcatgccttggctcctacggttttactttccctccacaggaaacctatattgacaattttagattgtcaaaattctttcttaatgaaagtattaatgagaattatttcattattcatagtttggttaagatttatgacaaatcacagccaaaagaacttcattggtaatagcttgtttgaggcttcctggggaaaataatgatgtcagatttgcatttgcaatcttagactattataggatattatgctgcataaatctagatataacttttattcagataatttacaaaaattagaacatgattttaaaggtggtatatctcttgtggagggaaatcttgctgaaattacagcttcttaggttaacagagaatgtgtcctgtttgtgcacctctctaaatgaaagaattaaggagaattatttcattattcatagtttggtttgtgggggtgaaagagggaatgagaaaaatcctaagacatccttggaacaatttaacacaaaatatacacatatatagatcctgagatgttacaacaaattaacaattatatagatcaacatgatccaaatagttttcaagacaccgttatggtgggtaaacagccattttacggcatgtgctccatggatgtccacatcatgccaggaaaaccatactctttgtctccaaatttgaaagctagtcatccagagcaggtggccagtcaacatctacagactagaagggagaaaagaagtcattaaaacagatattactgttgtggtaagcatttgctggtaatgctgtataaatttaatagttttaatatagtgcaacagaagaaactgcatttgaagaaaagagctattgaataccataaattaaccctcaagtctgttctaggtattcttgggcctgaggtcttctgaattaattgagtagcagtatttggctactcagttggttattaactgtgctttttgactgataagagaatacatttaaattttttaaatggtatttatggggccaggtgtggtggctcacacctttaatcccagcactttgggaggccgatcaattatatagatcaacatgatcaaggtgggcagaccactcaaagtcaagagttcaagaccagcctggccaacatggcaaaaccccgtctccactaaaaatgcaaaatttagccaagcatggtggcacacgcctgtagtcctagctactcaggaagctgaggcaggagaacagcttgagcccaggaggcagaggttgcagtgagccgaaatcacgccacagcactccagcctgggtgacagaatgagaccctatctatctcagaaaaaaaaaaaaaaaaaaaagtatttatgggtaaaagtagcaaacaaattcaagtgaccaccaattttccctcagaagtctcagaaacttttattcttctgatcatttttattctctcatcttgcatttaacaaatattcaagtagtctataagcctatagtcttgttgtaacacagcaacaaaatgtgaaataaatgattatgaaagatgacctggaaccagaaaaggattaaggatctttgtgcttcagttctgtagaatttctgtttctttaaaatccagttcatctatctctacttacctttattttgttcttctaggacaaaaccttgatctttgagtcagaatgaaattacagtaaacagactatttgtctccacataaacacataccaggtctatcaaaggctaggggatctactttaagagaaagttaaaaaaaaaaaaaaacccaccgtatctatctgtggcttttattgacatttaaagtttaaaacataaaattatttactgaaaattttttcattaatccatgagtcacttcacgtactggcttcaaaaaaaatttattagaaaagcctaaatagctatgtgtgtgtgtgtcttttacaaatctcaagaagatatttttgttctgtttcagaatatagccatataccaaacacccaaatgtaaattaatgagtgttttctcaagctgaaaataaaacatgactga

SEQ ID NO: 3462 - DNA, 394 bp, Homo sapiens
cgaaagctgtcgaagctttgcagcggctgtggcactgggtgcgagccgatgagcgcttccaccgcgtcctcgggcgtcaggttgagcgcctcggggttcatctgctggtagttgctcgccatccagtacagatcctcgaggtgtgtcttctgttcggtcgggctgaagctgggcgacgagggcacggagctacacggagtgctgagcggtgtggaggacaccgagccggctggctgcaggcgtgtgcagggcctgcccggacgctccgcgcgccccagtggctccttcttcacgtcgaacttgagcaggtcgaagtcgttgacatactccatggccagcgggctggtgggcagctctggccccatgctcagctccgcggccatcgctgaagcga

SEQ ID NO: 3463 - DNA, 1782 bp, Homo sapiens
attagccacgcgtggtggtgcacacctgtggtcccaattactggggagactgaggcggaagaatcgcttgagcccaggagatggaggttgtcgtgagctaggatctgccactgcactctagcctgggtgacagtaagacccttgtctcaaaaaaaaaaaaaagaaaaactgcagattggtgactcttacgaagatagatggaaatgttctaaataaaacacacttaggatctggcaatatatatatttaatgtactattctgaccaaatggagcttaatcagatagcttgagaatgatttaatgttacgaaatctgttaattgcattatctcaataatagatcggtgaataactttattattctctcaacaaatcctgtatttgatttacaaaatggatgggaggtttcagggagagcagttggaagcctgtgtgctcacctgttaggaacgagagtggcaacagcagtggggaggagtgctcggctcctgcacctgtctcgatggcagagcccacaggcttggctgacagacgtgggatgaaggaaagagaagcctctcactcttcccacagcattgtagtgcgatttcatgcagaagtccaagcaggttccaggacaattgtgtaagaagctatggacaagaacgtctaagaaaacggaaaatgacatagaggatttgcactgtagctaagacttcacgcaaggctgtggcagctgaaagcatgttctggtgctggggctgcgtggcagagccaggagcccaggatccagcgcactgggcaccgacctgggacctggtcatctttgcgtgtggaaaagatggcatttccagttattgacaggtgaatgctggccttttagggaaaaaaaaatattagaattccatacagaataaagaatgaagatgagaggttaaaggtttttctaaggcatgaagagctgtgggggcagcctgcccttgttctttttgtcgtgtgtccttcacatgcagtaactctgttcacgcctcacaaaaaccctatgaggtggagacctgccatcaacccttcctgcacgggtgccactgaggccccaaggttaaatcatttcccagagtgtatcagcagaggcacagccacagagacacgtccgcacagagagctttccagatcaccagtaacagcgtgagatcatggtgcagaaggtcatgaggaggatggcaacgagcgagacacagccggttggtgctcacaaggacattggtagatctgactgagggccaggtcggctaggccttcccaggtgacaggagcccagtgccggccttggtgcacacagcgcgtccttgtgctttctcaggagagcttcactggggacactctgtgatgtttttggagggtcatttggtaatgtgttcaggagccaaaaaatatgcataatattcagtcttacaattacattttttgaatttatctcaaggaaatcccagggatctgtgtgaagctgcacatgctgctgctgctcagtgcgggactgtttataatatttgtaactcaaatgtccagaagaactgtacactctgtgcatgttttcagtaagttcatatttgtaagaaaaagtgggtgtgttgagagacaaatttttgtgtacatttacctggaaacaagcagtagtacacatatgcatgcatgaagtggtgttttcctgagtgttaagattgtgaatgttttattatgatcatttctactttttctattggaaaatactttgtgtaattaaaacatgaagatggagctaccatc

SEQ ID NO: 3464 - DNA, 2275 bp, Homo sapiens
actcaccagggcgcggttgaacctctcctccagctctccggccgcgggcatcggctgcttgggaggcgcgggctgcttggggggcggcgcggcggggcccgcgggctgctcggcgctgccggccgcgttgcccatggtggtccccacccagccggccaggcgcctccagcctcggaaatccagctttccgggggacggggacgaggctcccggcccgggcgggggcgagggggcagcggctggcggtggcggcgggggtctcggcagcggggggcgctcggctcagcggcgcgcaggggccggagcgcggcgtcccatcggggcggccccgtccgtgggaccgggcggcgagctgcagggttgggggaggaagtcaggctgcaggccgccggggccagagggctgggccgggggcaggaagctgcggcgctggctcccccctcggcgattttcgaacttctgctgtcgctccccgtgcgcgcaaaccgcagttcgccgccgccgccgccgggcacccagccccaggggggcgggctggagggagggggcgggcgctggccgggggacccccgcaaccatggcgggcggggagtgggctgccgagccgcttcacctgccgcagagggggcggccggcgccgcttcacctgccggagcgggaggccaccgaggcgaggccgaggcggcggcgcgctcggcggcgcctccgggtcctagaaccgcatcctcccgctcgcctcgggcgagggattggccgggtctgggtgaaggggatcacggcctggggattggaggggcacatcttctccgcaccgaggatctcagcgactgcgagcacggctcggagacccacggtggtgcagcgttggggcgccagggctgcgttcccgtctcgcgtcccggactgagaaggtgggaacccccttccaggccccccaccttttatttctctcctcccctgcttagcccagagacgagctgaggacgagggggagccatctccaaacaggaactcctaaacagggtggggggcgcggacgcaggccagtggagacccccgccacctgtcccacctcgaccaaccgtgcgcctgtgcagggcacccctacaggttttagaatgggggcacctatggaatatggcaggctgcgagaagctgggcccgccaaggtggtcccaaggaggagtggggggttgcggaaaggaggatgagagccagccacaaggctggaaaaggagtgggcaccgcagaggagggaaaaagaatcttgacactgtcaccgccagggatctaggggggcctcttaccttggagaataacaatctctgatgtctgctaattacagaaatactttcagagctctttcattcatcctgacaatggccagagaaggtaggtattggtagccttattttagagatggggaaactgaggctgagagtaggtaagtaagctgtccaagggcactcagctaacaaaggacagaagcaagcctcctcactgtctacctccaaaacctacactggcttggagttgctgtcctggccctccactgcccatctcatgtaggacgggagagtatggggggctggggtcccatctatagcctgaatttgagactttcagttgctcctctcattccccatttaatttgtggggatccccaactgacccctccctacacttccagggcactgaggagggagggcccgctgaaggagccccgaattatctctaggccaggtcaggagccattagtgtcccctcccctgacagcatcctcctccttctgccctcacattcagagccactgacaagactttaagcaagagacggagagttaacatctaatctggaggaagaccctggaaggagccagccccttcccccaggctgacctggtttaagcctttcttctgccaaggtcaccagcaccccagatgggtgagagatgtgatcactggtttcgtggcctgaccaaggacctccaagattctgtggcagatgagaaatgccttggtccttgggctgcttgcagcctagcgagggacagacttttaacctctctaggagagtggctgcttcaagtcatcctatgggaccagctgttcatgcttcctcttgcccagaactacttctgtgagaggaaaagagaagggtaggagcgtgccctgcagctggaaacccaagccaggcggggagccacgaatgcagtagttatcagactgtatcttcaatcctgggggcttctcaagccattgccagccactcttca

SEQ ID NO: 3465 - DNA, 10346 bp, Homo sapiens
cggagcccgccgcgtgcccggaagcgctcgattccccccgctgccttgatgtggcgcgtgcggagggctaggagcgcgcggctcaggggtgtctcgttggtcgctgggtccttttccccacccagagcctccccggccgccgccgcgagctgcgcgaggcagaacgagagcgagtccgtgagggttggcttcgcagccgccatcttggctcgggcctcagactccgccccgcttctcgccgctgatcccagggagcggaactggaagacagggaaatcgtcgggcaccgcctcgctgacgctgtttagcgccaccgcagtgatgcaagtcggaagttgtagttctcgaccccggaagtctgtccttgcacacgaggcgcggcagtaccttaatcgcagcgcatcctgggacgtgcgggcggtgcatgagggagatgtggtccgcgtcgagcttctcacgcctacctcgggaagcgctggaaactcttccagggccctccaggtgggccagggcctccgaacagcccagaagtccgaccacggagccttcgtgccgtgccccgcccccggcgtgcactcggcggggaccgccttttctcctctaggctcgcttcgctgccccccagcggtggtgcggcccggccttgggacggactccgagaaccccgagccgggccgaaagtgcggggtcctgaccgcgccgcagacggggagccctcgctcggtcagaggaagaagagggttaaacctaccgagaacgttcgctgccgcttcctagagtgacgggcttgtggaattttccgtttccggagctggaccccggtgtcccgagtgtcctccgctctggacgtgctcgtgagctcaggagctggcatctaggaaacggggagttcttcactcgcagcgcagtcggccgcgccagaagaggcgagggagaatccggacggggcggggcggcgggggagcgggacattcgcgtcccggggagcccccaggtcacccctggattgcgaggtggctccgcctgagcagcccttcctggtgtggtcggggcagctgcccgcccggaaaatggtcaggctctagccctggggaggaagaagcctttgccaagagcaaccgtctacaagccccaaaacctgcgagtgccggaaatgtggactgaccacagcctgcctccccggcttcattcaccaccaaggcagcccctctggtgacaagccttaccgttgtccgggttatggcagaagcttccgatgtggctctgatctggttaagcaccactgggtacacaccggtgaaaagccgtactcctgccccgagtgtgaccatcgcttcggccctatgcctgtgcctagtgtggtaagactttcagcgtcagctccaacctgatccagcaccagcgcgctcacaccgctaaaagccttaccgctgaggggactgcggcaagagtctcagccttggctccaccctgttgcagcacctgcgctccacatgggtgagaaggcctctaagtgccttgtttgtagtaagagttttgtgcacagttggaatctgctgcggcaccagcacagtcacaaagtccggaaacctgatgcttggtggtgagtgtggccagaccttcggccacagctcccacctgcccatccactaggcggcccacagcagcacccctgcgtctgcctgcagtgtggcagggccctagcgcaaagctccaacctgggccagcaccagcggacgcactagggcggcagcctctgcaaatagccctggcttcaattttagctgaaacttcagctctgactttggttcggacttcaaggaaatggaaggaaccaggatctctaagcagacccccttctgctcccttagggctgttgattttagagctaatgatgggattcggttggggcgagggggtctccacatctttttgcccaaccctttgctaagtcaaggaaccccagtctgggctgggcatggtggctcatgcctgtaatcccagcactttgggaggccaaggttagcggatcactggaggccaggagttcgagaccagcctggccaacatattgaaaccctgtctctactaaaaaaaaaatgctaggcgtgttggctctcgcctgtaatcccagctactcgggaggctgaggcaggagactcacttgaaccccgggaggcggaggctgcagtgagcgaagatcgtgccactgcactccagcctgggcgacagagagtgtctcaaaaaaataacaaatttaaaaattgtttttaacaaaggagccccagtctggaagaatcagaacactagatctgtgatcactgccttcaaagagcccagtcagctgagagggcttaggtttgttctttgaagttacaaagacagaacgtcgaccagctgaagggagagttttggaatggcgggagctatccagcgtggacccagctgcctgcagatctggcagtagctgacacagtcccttcacaggcctagggagtgatggggttaatcacacctagaacaacagctacctcttcccagaggaatgggaccagaaatcaggcaagcccctgtgaggagttccatggcagcgcgcaggcggggcattcctaacctccagagggaaccatgagggatcctgtgttctggcagatgggccagagaatttgaacttgggaccattgtgtgagccctgggtgtgtgagcccttcaaaagtcctctcagcacgtgagaactatcattatggatgatgctagggtggtgggggccccagaacagacctgtatgttgagttcaggggttgctttgttgcatttctgggcaggggcaagaggcccagggtttgtcatctgccccttcccctgccttatccccttcccttccaagttccccaggctccttttctgccagtctgtcaagagagggaagagtggcgaagagtcctttgtgcctggacattggggactgaacatggcccttttgcctgggcattgcccaaacatatatttctactggcataactttgtgtatgtgagagccaggggtaggcttcccaaagcacctgcctgtgctcagagtagacaccaagctctgaggcccttcccttccctgctgggggagggagttgtctgtttcaaggacctaatgtccaccccttgtgggacagtcctaccatcagtccaggcatctggtctgctgcccccaaattttaccatcttttttttttttttttttttttttttttgagacggagtctcactctgttgcccaggctggagtgcagtggcacgatctcagctcactgcaacctccgcctcctgggttaaagtgattctcctgcctcagcctcccgagtagctgggaccacaggcttgcgccacgatgccagccagtgtttgtatttttagtagagggtttcaccaaccctctactaaagaccagcctctagttggtcaggctggtctcgaactcctgacctcaagtgatccatccgcctcagccccccaaagtgctaggattacaggcatgagccaccacgcccggtaattttgccatcttttatcaggctttctgtgtcgaggacgctacccacatagagtagaacctaaagggaagggatgtgaagtgacctcaccctcagcttctagctcatggtgtcaaggcttgtgtgatcttagacacgtctgcctcttctgagcctgtttcttcatctgtaaaacagggatgggaggttgtggtaaagattccacagcaacactgcacacgcatgaagtacctgggccagggatgactcggcagacctcagtttccctctgcctcctgcctagagctgttagcaagcatccatcatgcggctcacacaagagctccccccggaggttacagaaatgaaggcagcagccccagtccttgggtagcctgtttccccttgaaggaaacagactcaatatcagcaacacagagtgaatgacgccagggtggcgaacgggcctttcctggagcaaatgcgggaggcttcatggagatgacgtgtaatgaacagcactcatctcaggctgggagcagcacatgcccccggcagggagtcagtgatgaggtatggggttcttgacatcttcctcacccaggacccttcagagagtacgagccagggtttgagtgaagggcctgagcccagcacatgcatggtaggcactcaaagaataattgtcatgatcaggtcctttttacactgcttactagtggcctttaagcctcagtttcctcacagttgccttgagtgagtgtcaagtgttgtagacctctgcaaaattcataactgcttaagaatattaggtatgggtagagtaggcttggaaggaggattggtttgcagaatccctttcagagacctgtaatctaatttctcacattagggctaatactcctgggacccctctcctctccaattgcataaaacaggttctgaccagaacagcgaggcaggccagacctcagaagcagagggacgggcttaatctaacaggagtttatcccatgtcctgcatccactgtaccctgtgctgggtttagaagtagcttcactgtccaagcttgtgacccagtgcccaagcccgagatgggaaacacatttgttttggctgtgtgtgtgtgtgtgtgtgtgtgtgtgtgtgtgtgtgtgtgttttcaaacaagccaagatttttactttttgagttccattttgttgcccaggctggtctctgaaacttccaggctcaagcaatccccctgcctcagcctcccaaaatgctggaattacaggtgtgagctaccatgcccatttatttatttatttatttatttatttatttttgagacagaatctcactctgtcatccaggctggagtgcagtggtgcaattgtggctcactgtagcctcaacctcctgggctcaagtgatcctcccaccttaacctcccaaggagctgggactacaggcatacaccaccacacctggctaattttttgatttttaaaaaatgttttgtagagacggggtctcactgtgttgcccaggctggtcttgaactcctgagttcaagtgttcctctggtctcagcctcccaaaatgctgggattacagatgtgagccacctaacctggtctttttatttttttaaagagccaacatttaaataaggagatttcacatcacagtcgatttctggggcttggtttgttgttgttttttttgtttttttttttttttaattgagacaggatcttgccaggttgcagactggtcttgaactcctaggctcaaatgatcccctcctggccgggcacggtggctcacgcctgtaatcccagcactttgggaggcctaggtgggcggatcacgaggtcaggagatcgagaccttcctggctaacaaggtgaaatcctgtctctactaaaaatacaaaaaattagctggaaatggtggcaggcgcctatagttccagctactcaagaggctgaggcaagagaatggcatgaacccaggaggcagagcttgcagtgggcggagatcctgtcactgcaatccagcctgggtgacagagcaagactccgtttcaaaaaaaaaaagaaaagatcccctgccccggcccttccctcccccacccacctcggcttccgaaagtggtaggattacaggcgtcagtcaccacacccggcctgctttattatttatatcagaagatgctgcaacattggatttttatggcagcagttcgttgagtagtggctgtcctggacataggaacagggacactccctcttgcatccctgactcagcacgtttcatatgtgttacttgcctgtcccctgcagaaaagtacttgaggttacagtctccatcccaccccactgtgggtgagaaggacctttccatgcagtgaaggcacttttcccctttccttcaccccttcctgttcccttctctgccgttttccttcttctcccccagaactcctctgtgaaatacctggcctccttccctgagcctccctgtctccctgccaccccatctccactccgtgctatgacatcaccccgtaatttgaagctcctttccctatctgaagggaggcagagacagagtgcacaggctcaactaggcaaggcagacccttgcatgcctgggtcagaggtcagggtctctggcacacattcctcccagagcaactgtaggaagcaagccagtacagaggtactctaagcgctagacaggacggggtgggagtcggtaacatcgtctcctctgggctggccctgcttctgcttagctctgggcataagactgactccagtacagtcacagttatgtctctgagctcacccagtcctgggttccaggttcccagctctgagcctggcgagacacacacaggctggtgctgtgggatgtcttggtacggtggctcacgcctgtattcccagcgctttgggaggccgaggtgggcagatcacctgaggtcaggagttcgagaccaggctgcccaacgtggtgaaaccctgtctctaccaaaaatataaaaattagccaggcatggtggcacgtgcctgtaatcccagctacttgggaggttgaggcaggaaaattgcttgaacccaggaggtggaggtttcagtgagccaagatcgtgccactgcaccccagtttggatgaaagagtgagactccgtttcaaaaaaaaaacaaaaaaaacaaaaccaaaaaataaaaaaacacatcagcttgacattttggaggcattcccagactcagggttagtcagcagattagcatttaaaagaaagtcttgtccctacagattccctgacctcagctacccatgaagggtgggaagaggagtccttagcaagaagtccaggaagttgacaacctcctcagacctgataggacactcctctctccaccctgcctcctgactgatttaatctcaggggtgtgaggacctctgagataggccccaggagtctcacccgcaccacttatgtctcagggctaaccagagactccctgaaacagatcctagaggattcccaagtgataggataaatagagaggtactgagacttcctggcgtgggtgacctctcccaggctggccaacctcccccattcagaaatttgctgagcaccaggagtgaatgaagtaaaggaagcccctaggagttcaagaagcagagatttccaggtccatgcaccaaagctcatgtgctcaattctcaggaaaggcctcactcagttaaaaaattttgtatcatgaaagggtaaatgaattaattagtgaatctggtttctaagccaatggcttactagaaatattatagtaaatcagaaaaaaaaaaaaaggcggtggctcacacctataatcccagcactttgagaggctgaggtgagaggatgctttgagcccaggagttcgagactagcctgggcaacatagcaaaccccatctctagaaaaaattaaaaaaccagccaggtgtggtgatgttcactgtagtcccagctattcaggaggctgaggcaggaggaccgcttgagcccaggaatttgagactgcagtgagctaggattgtgccactgcaccccagcctgggcaacagagtgagaccctgtctctaaaaaaataattttttttaaagataattcttcaaaggagatccgctcttcctttcctacacccattccctttcctccctttcctgaacaatgctgtcttacagcctctaggggcaggcagagccaaagaggcctctgccgggtgtggggagtgagacgcagcaggccagagcatgtatcagagctccagcaggtgggggagggtgtccacacgagaaggtggcctggcttggcatggcagaacctgataggattaggaaggcatcagccacgggaaggagatggcgagagagataagaaactgcttccaccagctattggtcaaataagtacacatttgaaagataacagccaggtttctcagtgtcagagaaaaccgagacacagctcgggaaagggagaaaatgtgggtggggagacccttgtggtgtcgaattggaactggaggtataggagtagactcaggattttcagaaagtgtttagatagacatagaaattagtatgggtgtgtatatgtgtatgtgcacgcagatgtgtgtaaatgtccatatattccctagctctggaaagccctggagcagtgccatcccaataacaaaaagctttttatggttttttgagatagggtctctccctcacccaggctggggtgcagtggtgcgaccacagcccactgcagcctcgacttcctgggctcaggtgatcctcctgtgtcagcctcccaagtagctgggactacaggcatatgccaccacacccagctaatttttaattttttttttttgtagggacgggtcttgctacgttgcccaggatggtcctgaactcctgggctcaagcaatcctcccacctcagtctcccaaagtgctgggactacaggtgtaacagttttaaggtaatcagaatcaagaaatgattgaggtgatgctctggaataatggggactagagagtcgtgacaactaaatgcaatgtgtggtgtggtagcatttttctgggctgtagtccctagatgggtagagaagaaagccccggagagggtgaagaggtggggatgtggaagacgtcagagagagcacagggcagagcgcagagaactgcatccacaggcctcgccatgcccccagcatggctgcaccacaccagcagatgccttcgcttcccagcagtggacacaggtcactggatcctcacaaatgagcagccaggagaatgtttgcagcctggagattcggggctttgtcagcaccttgggaaggttttgttcttgggttttgggtttttggtttttggatttttttggtaacaatatcgctatatttattctcctgcagtacacttttaaattgcttcaacattttccccttaaaataaaaaagaacaacaacaaaaaaattccaaaccttagaattgaaatatttggccttttctctctctcttttttttttttttttttttttttgagatggaatctcgctctgtcgcctaggctggagagcagtggcgcgatctcagctcactgcaacttctacctcctgggatcaagcgattctcctgccttaccctcctgagtagctgggaccacaggcgcatgccaccataccaggctagtttttttttgttttgttttgttttgttttgttttgttggtatttttagtagagacggggtttcaccgtgttagccaggatggtctcgatctcctgacctcgtgatccgcctgcctcggcctcccaaagtgctgggattacaggtgtgagccagtgcacctggccttggccctttctctttttatttcctcgcagttctctcccttttttaaaaaaaataataataaattgaatttataaatagaggcaaggtcttgttatgttgcccaggctggtctcgaactcctaggctcgagggatcctcccaccttggcctctcaaagtgctggattacatgtgtgagccaccccacctggccccagctctcttaattgccagcactcctcttggaagtccctcatcttgattaccttatttaaggtcacctcctcacaggccctatcttttttttttttttttttttttgagagggagtttcgttgcttttgcccaggctgcagtgcaatggcgtggtctcggctcactgcaacatccatctcctgggttcaagccattcgcctgcctcagcctcccaagtagctgagattacagacatctgccaccacacctggctaattttttggaatttttagtagagacggtgtttcaccttgttggccaggctggtcttgaactcctgacctcaggtgatctgcttgccttgacctcccaaagttcagggattacaggcgtgaggcaccatgcccagccagtccctgtcttcaaatacagtcacactgggggttaaacaatgtataaatttgggggcgatacaaacattcagtccataacaccccctataccccaaccctaggcaaccactaatctacatcttatctctacagatgacctattctggacatgtcatataaatggaatcatacaatgtgtggtcattcgtgtctggcttctttcatatagcataatgttatcaaggttcatccacactgtagtatctcatttctttttattaggaataatacagtttcactttatggattgctgtggtttgaacctgtcccctaaagttcatgtgttg

SEQ ID NO: 3466 - DNA, 1423 bp, Homo sapiens
gaggaactgcgttccaggcagaggaagtccagatgcgcaagagcagagatgggagggacagcacagtggcttctcagaattgaatatggtgttagacttctaaaagagctgtggtagagggagaaaactgtcaaaggaaatcagtaactgttaaaggaaaataccttaaacgtcctgttttcaggctgactaatgccttaggggagcaaatgagcaacagaaacgatatgagcaactgctgttctttcaaaatacccaggcagaggaaccggcagacgatgggcaggcaaatagcatcgaacaaacaactgagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagttgttgaaatggatgaaaacaacggacttttgcttttagaactgaatcctcctaacccttgggacttacagcccagatctcctgaagagttggcttttggagaagtacagtaacagataacatatctcactcatgcctgcatggacctcaagttaggagacaagagaatggtgtttgacccttggttaatcggtcctgcttttgcccgtggatggtggttgctccatgagcctccatctgattggctggagaggctgtgccaggcagacctcatttacatcagtcatctgcactcagaccacctgagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtcagaaatctgctttctttccatgctttccagttatgctttctgtgatgaatgttaggtgagatagtcaccgtaagctcaaatactgaattaaaaaccaaactgaaattcacagttgttggttttgttgttaaattccaggtggacaaaaatcttcgattcatgatcttgatggacggtgttcatcctgagatggacacttgcattattgtggagtacaaaggtcataaaatactcaatatagtagactgcaccagacccaatgggggaaggctgcctatgaaggttgctctaatgatgagtgattttgctggaggagcatcaggctttccaatgactttcagtggtggaaaatttacggaatgaacactccatgagagcagggacctgctttgccttgttcaccactttattcccagtggctagaaccacgtctgacacagagtaggtgcacaataaatattggttac

SEQ ID NO: 3467 - DNA, 8810 bp, Homo sapiens
ccagcgccctggcgcccctgctcctccgcgcccgccgcggcgcccgcagccgctcgggccattgttccgcggctgccagggctggagcgggctgcccctgggcttctgcgcctccgtcgttcctctctgaagacctggcctccgcctcggagtgggagtgggtctgggagctgagcgcagagctcagagcgccctctgtccccgcccgggcgtcgaggtcacccagcaagcgcagatcggggtgaggctcttgggttggtaggcagggagggacaggtgggccggatgcagaggccggcagctcgcgggtgaggcggcgccccgctcttcctatgggctccttggcccggtccgcgcctcctcgcaggcggaccacctttccttcccggtccgtggggcgccatcgcgcggggacttgaggcacttgcgtcctctggcggctgcatggcgccccgcaactctccacctccgcgtcctgcctgtgctaggcagggccgcctttactggtgtgagggttgcttgaacccttgaggcgccaggaatccctagtacactgacgcatgtgcttcccatgagcccgacaaggtctggcaggggagaggcagtggttcctgatctctgtcactctctgggtgaacgcagaggacacagtagtaattcccctcacccacaagctccaagctaccctagaaaacaaattgtttagcctcaggccatcgtttgagatcagggaccagggaattaagtggactctgagatccattgccatgacaaaaggggtaagagtctcattgcttgaggaaagaatacgccttaagttcactttatgtcttctgcccattgcatggcagttaggggagctgaaggaagaaagtgaaagaaaaagagacctctcataaccaagagtgtttgccgccactggcttctcctttaaaccaaactccaaattaatctgctccaggaaattttctgagcccaggctgagagggttgaaggctcatgcatcctactgagaccaaggagctgcactgggatgtttttgtatataacacagaggtcccaacacaaatacatcatttccacattttatttttgtatagatagggtctcgctatattgcccaggctggtctcgaactcctagcctcaagtgagcctcccacctcggccttccaaactgttgggactacaggtagtgagccgccatgtacaacccaaaccttttttttttaagcagatgatttcagctttctcaccagaaccgagaaagtacaactgcatgtattagtctcccttgccttgcctttggggagaagtttgtgtgtgtgtgtgtgtgtgtgtgtgtgtgtgtgtgtgtgtgtgtgtttgtcttttgttgttgttgttttgggacggagtcgcgctcttgctctgttgcccaggctggagtgcaatggcgtgatctcagctcgctgcaacctccgtctcccggctccaagcaattctcctgcctcagcctcctgagtagctaggattataggcgggcaccaccacacccggctaatttttgtatttttagtagagacggggtttcatcatattggttaggctggtctcgaactcctcacctcatgatccactcgcctcagcctcccaaagtgctgggattacaggcgtgagccaccgcacctggcggttttttttttttctttttgagatggagtttcacttttgttgcacaggctggagtgcaatggcacaatctcggttcactgtatcctccgcctcccgggtcaagcgattctcctgcctcagccacctgagcagctgggattacaggtgcctgccaccatgcctggctaattttttttttttttttttttgtatttttagtagagatggggtttcaccatgttggccaggctggtttcgaactcatgacctcaggtgatccacttgcctctgccaaagtgctgggattacaggcgtgagccaccacgcccagcctagaaggaggtttaaggactaagataatgttcataaggtgggagacagggaaagatgagagtgtagggaagtttaaatttttcccttgaatgtttgataatttgagtctataaaacaaactgattacatagattaaagggaaaagaggcctacgcatttttttttttttttttttttttgagacggagtctcgctctgtcgctcaggctggagtgcagtggcacgatctcagctcactgcaacctccacttcccgggtcacgcgattctcctgcctcagcctcctgagtagctgggactgcaggtgcacgtcgccatgcctggctaattttttttttttttttttggtatttctagtagagacagagtttcgccatgttaggcaggctggtcttgaactcctgacctcaggtgatccgcccgcctcggcctcccaaagtgctgggattacaggtgtgagccactgggtccggtctcctacaaattttatttgatgcacgcatgtgtgtgggagtcatacaaaatataaaaactcaaagaaatgcccaatggttgcttttataccaccttgaggttacagaaagaatgagagcttgcatctgggcaaaacaggttatggtggcaagacaggttatgggagggggagaagaagaggcctggccagcaaagacggtcttggtgaacaaatgaaatctcacagacagtagcctttagaaggaataggtggtaaaggtttctgttagaccttttaagatgtcagactctcagttaatctttcctaaatctggacaagggagagcaccagagaaagcctttctgcatcgatgcagattctctgcagatgcagatctcccccacaaaagacagctttgcaggctttctgaacagtcatctcaaaatacatcaaattcagaatgaaaatttttggtgctcttcaagagcaataaatactatgaaaacccaactacaggggtagagttttgataatcaaatatttgccggtgtcagtcatccaggatgaactaagaagttcatttctatgaatgagtcatgaaagcatccacatttcccctttttctagcccctcaccaaactattatgatggcctttctgcaggcagtctgagaaggggcaacccagttgtaaagaataacgttgagaaattgatcatctctggtagcatctgtcactcccttgaaaatatccaccaggctagacaggtttctcctccacctgacccctgtatctgtatcagtcaccattacctgggagtactggagacaatgacatatcaatggaattctggattattggataccattaatcttctgttggaagggggaaccagacagaagccagaagttacttctgtctagactccctcccaacctcccatgttttatagcctcaaagaaggcagtcagcattctcagcattcttttcttctttttcttcttctcttcctccttcacctcctcctccccttcttcctcctcctttcccttctcctcctccccttccccctccctcttcttccttcttccttctttcttctcctcctcctcttcatcccctccctcctcctttccccctcctccttttcctcctcttctcctcatcctccctctcctcccctcctctccttcctcacttcccttctcctcctccccctccccctccctcctcttcttccttcttccgtcttttcttcttctcctcctcctcctctccgtcccctctctcctttctctcctcctccttttcctcctcttctcctcctcatcctccctctcctcccctcctcctcttcctcctcctcatcctccctctcctcccctcctcccctcctcctcttcctcttctccccttcccttcctcctccttctcttcccccacttcctacctctcctactcctcttcccccatctcctcttccttctccttctccccctctcctccccctcccatctccttctcctccccccacctccttctcctcctccttcttcttttaaatagaggcagggtcttgctttgttcgtcttaaactcctgggctcaagcaatcattctgcctcagcctcccaaagtgctgggattacaggtgtgagccactactggtggcccgtcctttttaaatttttaattttattaatcttattttcatttctttttaatagagatagggtctcactatgttgaccagactggtctggaactcctggtctcaagcagtccttctgcctcagcctcccaaagtgctaggattacaggtgtgagccaccacactaggacaagatttatttctgttatgaactgaatgtttgtgtctctcttcccccagttcatatgttgaagccctagaccccaatgtgatggctatttgaaggtggagtctttgggagataattgggtctagattagatcatgagggtaggacccttatgatgggattagtgcccttaaaagaagagagagagggagagggagagagggagagagggagggagggagagagagagagagagagagaaagaaagaaagaaagagatctttctttccatgagtacatatggaggaaacgacatgtgagcacacagtgagaagacagctgtctacatatcagaaagttggctctcaccagacaacgaatctgcaggcatcttgatcttggacttcccagcccctagaactgtgataaataaatttctgttgtttaagccacccagttgatggcatcttattacagcagcctgagaagattaagacaatttcttaaaggttcttagagacgattccatagctttcttttatctcttatttaaaggagggcaggtttctgtacatcttgtgttttccaagatagttccaataattttataatttcattttttttcaattaaggcaattcatacatgcatagttacacataattttacttttatgactttaatattgtatttttttaatgtgcacttttattgaactggtctcaagtcagtgtacaggtaaccccttgctactttcacacctccatccaatcccagggagaccaaaagccttcatacacctcaagtttagggacaaaaagtgtggccacaatggctcattcaaaataaaacaaaataggccagacgcagtggctcatgcctgtaatcccagcactttgggaggccaaggcaggctgatcacttgagctcaggaatttgagaccagcataggcaatatggtgaaaacccatctttaccaaaaatacaaaaaactagccaagcagggtggtgcacttctgtggtctcagctactcgggaggctaaggtgggaggattacttgagctggggagctggaggttgcagtgagctgagatcgcctcactgcattccagcctgggtgacagagtgagaccctgtctcaaaaaagagtaaaaacaaaacaaaaacaaaatacaaagttattaaggctaagatttaaaacattttgcattatgtaatttgcatgaaagcaatgctatcacctcccctgtgtggacttaggagaggactgggccattttccttagatagaagtggagtggcttttgggagggcaaaggaacttcctgtaacaatacatttcatgatatttgcaatgactattaaaaaaaaaagaacaggcctggcgtcgtggctcatgcctgtaatcctagcattttgtaaggctgaggcagacacatcacctgagcccaggagtttcagaccagcctgggcaacatagtgagaccccttttctacaaaagatagaaaaattagcaaggcacggtggtgtgcactgtagtcccagttatttgggaagctgaggtgggaggatcacctgagccctggaggttgaggttgcagcgagctgtgattgggccactgcactacagccttggtgacagagtgagaccctcagagtgaggccctgtctcaaaataaataaataaaataaaaattaaaaataactatgtacaatccaagttcttggccacattgtagaactttgggggatgctcattccaacagactgttgtcactttcactgttccagtttgtaaatcctgaatcatcaagccaaaaaaaaaaaaaccaaaaaaaaaagaaaccccaaaccaaaacagaacccgaaaccaatcaaacaaacaaacactccccaaaaaacaaataaagccatgccaatctcatcttgttttctatgcaagttaggtttttgttaagaaagggtataacacaactaagtaacagtctgcttagaagcatttgcagtagaagatgggggcgagagaagtgggactcgtattcctgcctgctgatccacatctgctggaaggtggacagcgaggccaggatggagccaatgatacacatggagtatttgcactcagcaggagcaataatcttgatcttcatcatgctgggagccagggcagtgatctccttttgcatcctgttgggcgatgccagggtacatggtggtgccgctggacagcactgcattggcgtacaggcctttatggatgtccacgtcacacttcatgatggagttgaaggtagtttcatggatgtcacgggttccatgcccaggaaggaaggctggaggagaggccagggcagtggaactacttgttgcagatgtcgatgacctggctctggagcagcttgtagctcttctccagggagaagctggaggacatggtggccatctcctacttgaagtccagggcaatgtagcgcagcttcttcttgatgtcacgcatgatttcctgctgggccgtggtggtgaagctgtagccacgctcggtgaggatcttcgtgaagtagtcagtcaggtcccagccagccaggtccagacataggatggcactggggagggtgtaccccttgtagtttggtagtgtgggtgaccccatcactggagtccatcgcaatgccagtggtacaaccagaggcatacagcaacagcacagcatggatggcacatatatggcaggggtgttgaaggtctcaaacatgatctgggtcatcttctcgcagttggccttggggttcagaagagcctcagtcagcagcatgggatgttcctcaggagccatgtgcagcttgttgtagaaggtgtggttccagatctccatgtcgtcctagttggtgatgatgctgtgctggatgtggtatttcaggatcaggatgcctttcttgctctgggccttgtcacccacataagagtccttctgagccatgcctgctgtcatgtactggttccgtgggcaccccgtgatggaaggcaagataccctggggggcattgtcactgcaagtgtgaagatatcatcattcatggggagctggcaccaagtttggactggtggaggagtgtcgagcgtgagggtctgtgcttggggcagatacagtcttggtctaatattttaacataaattaaccatatcagaaagagttattaaacttaggactcaaacctatggagtaataatttaatactataattaaattaaacacaatcacatacacctaaccctcaacgatatacagagaaagttttgatactaattttcaattctttatctctatgaagctgatgaaaaattcttaggcagtgtgcctggtgtgggattttgtaaaccaaaaataatattctaggcttcccaatcaactgaatagacctatcctctcagccaagggcattccaaaattaacctgaaaaactagttcagaccatgatgagatgcaggagatggggcatgacttatttacactctcctgtctttggaatgcaggcatgggtgaccagcattaacattaaaatagagatcttaagaataaaacagacttcctgtagcaataagacaccaaattccagcctgactaaaataaatcgaatatatatatatatacatatatgtaaaacactttgatttcttacatatatattattattatatatattttgttatttttttgagatgaagtctcactctgttgccagttcggagtgcagtggtgcgatctcagctcactgcaacctctgactccatggttcaagctattttcctgcctcagccgaccaagtagctgggattacaagcacacaccaccacgcccagctaatttttgtatttttagtagagatggggtttcaccatgttggccaggatggccttgatctcctgacctcatgatctgcccactttggcctcccaaagtactgggattacaggcataagccaccgtgcccagccccaaaatatatttctttcagagatatatatatatatatatatatatatatattatatattatataatgtgtgtgtgtgtgtgtgtgtgtgtgtgtgtatattttttgatacagagtctgttacccaggctggagtgcagtgatgtgatcttggctcattgccacctctgcctcctgagttcaagcaattctagtactttagtttcccaagtagctgggattacaggcgtgtatcaccatgcccaactaatttttgtatttttagtagagatgaggttttgccctgtttgcgaggctggtcttgaactcctggcctcaagtgatccacccaccttggcctcccaaaatgctgggattacagacaagagctaccatgcccagccttctttgatatattttgaaatggtcctgcaaagctttctctcattgggaaaatgtatattctatagagaatccttgattctttcctgatccaggaaggaattaactgagtctgacacctttttgggtctgataaatgtcaggcctgtgagcccaagctaagccatcatatccccagtgacc

SEQ ID NO: 3468 - DNA, 1637 bp, Homo sapiens
agaggcttccggcgccgagaccgagatccccgtcggctcggtgtatcctcgctggtggagtaccctctgcttgagcgcatctcatgcgccagtagtggcgcccgccccgaacggtgtcgacggggcgttctctgagcggttcagggtcactggaagggaccagaggtgattggaatattcattgagcttggaaaggggttggaatgagagaaccgtttggaagcactggaatacagctttattcctacacgattagacccgttaccccgtgggtctggccgaccgtcctgactcggagatccctgagctgcgccgccgcttccttcgtcaacatccagcagctacttgatgagcgccctccagtgggccttaggtccctatgccggcgcggggttacagcagtggacagacaggccagtccctgtcctcgaggagcccatgatccgcggggagacaggcatttaacgacgactcacacgatcacttaaatacaactgtggtgaaccgcacaagagggacgcgcggcggtctgcggggaatgacgaggccgacctcgtctgcgacccagggagggcaagggtggaccaggcaaagggaacagaggactgggacctggaggtgggcgggaggcgtttggttcattggaggaaaggaatagccctgtgtgtgatgagcattgagaggaggtctggcgagcaccatctagggctgaagaactaggcagtggctccagcgcggggcggtgggggggacaagtgagccagggcaagaagaatggatttggccctagagtacgggttctccaaatgtaacctcggccctacagatctctgagactatgtcagggggtttgtgagattttataacaaaattaagatgttagtacaatatcgtgtttcgccgccgggcgcggtggctcacgcctgtaatcccagcactttgggaggccgaggcgggcagatcacaaggtcaggagatcgagaccatcctggctaacacggtgaaaccccgtctctactaaaaacacaaaaagttagccgggcgtggtggcgggcccctgtagtcccagctactcgggaagctgaggcaggagaatggcgtgaacccgggaggcggagcgtgccgtgagccgagatcgtgccactgcactccagcctgggcaacagagcgagactctgtctcagaaaaaaagaaagattatttgcagccgggcgcggtggctcacgcgggtaatcccaatactttgggaggccgaggcgggcggatcaccaggttaggagatcgagaccatcctggctaacacggtgaaaccccgtctctactaaaaaatacaaaatattagccaggcatggtggaggacgcctgtagtccgagctacttgggaggctgaggcaggagaatggcgtgaacccgagaggcggagcttgcagtgagccgagatcgcgccactgcactccagcctgggcgacagagcgagactccgtctcaaaaaaaaaaaaaaaaaagttttttgccttcttcattctataagtgtacagtggagtttttcagaagctacatgatatgtattgacaccatggttcccacgatgaatagaatgtgtgcctatgtattctcgtgttttaaatttttctcac

SEQ ID NO: 3469 - DNA, 594 bp, Homo sapiens
atggctccttccgaaagatcatacttgccagcatacaacccaatctccacatatccaaactataatcgtacatctgatagtctacaagtagctcaggacctttgaagtatcgggaagcaactcggacattatattcttggccaggatgataaaactcagccaaaccccagtctattagtcgtagctttctgtgctcatgatcaatcatgacattatggggcttgacatctctgtgcataattcccatgctgtgacaataatccagggccttcagaatctcatacatgtaaaatcgaatatcatagtctgttaacgtctggtacaattgcttgaagtctgtgttgtttacgtgttcaaaaaccaaggcgggggttcgtgacacagggtcttttacaatgtctgccagtgtgatgatgttggcggacaaagctggacttgatgtttggagatctggcagtcactgtgttcagaagcagcttgggggtaagaccttgtttcagacctgttttcttcacactgtggtggaagcggcagcggctgtggccgctctcccttctgctcacacagacaatatggcggcgatggagtggggag

SEQ ID NO: 3470 - DNA, 756 bp, Homo sapiens
cacaacacccaagcctcccttctcccagtccagaaggagagcgaaaggttcacgtcccagtccactaagacagcacctgtgggcgcaggtctctgcggaaggcgcccgcgcccccggctcagactcctcggtgccgtccctgcacactgaaggcgatggctccccggggacagagtccctctccgggcctctcagcagcccgggcggcggcttctctccacggttttcgcgggcgcttcccccaggatggaggggggtggcctcgcctcaggtctgcgccctcgggccgacggttcgacgcgcgctctgggctccggcagcgccgctcggggtcctcagaaggccaccacggcccgcacgagcacgttgagcatgctgtccgccgggcggcaagcgggctttgcctcgcacgcgggcggcgccgtcggaggggccgcggggctgcagttcaggaggccggagaagcgcctctgcaggacgcgggccaggttgggaaaggcgccctccgcttgcgccggagggggctgcaggcgatcggcgacttcggatgacgctccctcctcttcttccttttcttccagacgggctttcttgctcgggaccagtccagcgtccccgccgtcgctcagggtcatgatgcgctgtgcctctttctgcacttccatggcgactcgacggcgacagcggcgggggctcccgggagggacagaacaggcagcaggtgcactccggacaacgggctcgctcacgcctctc

SEQ ID NO: 3471 - DNA, 4374 bp, Homo sapiens
gagtccttctagcggcgccggtgagtccgcgtgtggaagtctgtgaggcgcagaggtggggcaggccgtctggctagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatggctatgcagactctaaaacacatgcctggacatacaagtcgagaagtactaatcatctttagcagccttacaacttgcgatccatctaatatttatgatctaatcaagaccctaaaggcagctaaaattagagtatctgttactggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatctttatgatttatgttaattcattaatttagtgtaagaagaaagttaagtctgaatgtaaattcagtgtaagatgaaaatttatcaatacttatgaaattaggctgggcgctgtggctcacacctgtaatcccaacactttgggaggctgaggtgggcagatcacttgaggtcaggagttcgagaccagcctggccaacatggtgaaaccccgtcactactaaaaatacaaaaaataattagccgggcatggtggttcacgcctggagtcccagctacttgggaggctgaggcaggagaatcgcttgaacccaggaggcggaggttgcagggagccgagattgtgccactgcactccaccctagagtgagactccctctcaaaaaaaaaaaaagttatgaaattaatacatatgaaatgatgtactgctacatccaccagagaggtctttttaggtttaaccaaacatctggaatatgtttatcaagttagtacatctgaaattatttgtggctatgaccaacagaagtcactttacattaaacattcaaactcacaagactgccatggccatacttggtacccgcttactcagaaggatattaaacagaaacaacagcctgccagcacagcatcaagcagtcctcattagcagtggaagtccttgtagcagtccactagtacaatttgggtgcaaggagataagatcctccacaggcatcaaggaaccaatatctcttaacaattccataaacacagcttccaggtatccacaagggatgtgtcaatttcaagagtcactacactcaggaaagcctaaagcttgaagactccatttatttatagtgcatcccaatccagatacgtaacaattaacgagttatttttactataagcaaagttgcctaaaatcatagttgatactaaccatggttaacagagctctaaagtttgacagaaagtgagattcaaatcctttcactctcatatgctaaaccttttgccttactctgggtcatcagagaaatttaggtgagaatgtatgatgaagtctgtgttttagattcaatgcagatatatcattgtgggcagaactctttctggttatatccagttaagagtaaatcaggctttcagccgggcgcggtggctcacgcctgtaatcctagcactttgggaggccgaggcgggcagatcacgaggtcaggagatcgagaccatcctggctaacacggtgaaaccccgtctctactaaacatacaaaaaattagctgggcctggtggcgggcgcctgtagtcccagctattcggaaggctggggcaggagaatggtgtgaacccaggaggcggagcttgcagtgaaccgagatcgctccactgcactccagcctgggcgacagagctagactctgtctcaagaaaaaaaaaaaaaaaaaagagtaaatcaggctttcatagcaaaggtatgtctattttatgtatataaacttcaggtactctaacttgagtttcactatgaaatttgtgattttttttttttttttttgagatggagtcttgctccatcgcccaggctggagtgcagtggcctgctgttggctcactgcaacctccgcctcccaggctcaagccattctcctgtctcagcctcctgagtagctgggactacaggcgcctgccaccacgcctggctaatttttgcatttttggtagagacggggtttcaccttgttgatcaggctgatctccaactcctgacctcaggtcatccacccacctccgccaccgtgcccggccgaaatttgtgattttataactaagaatttttagttaagaacattatcagtaaagacaacgtaatcccaccctggagagtttattgggagcccaggaatattcatttttaatacacacacacacacacacacacacacacactgatcagagtaacgggagtttctctcaggagtcatactccatgagcctggacccagtggttctttatgtggaaacaaatttcacctataggtaacctggtaactgctattttcttctgtgtgctctgtcaacaaaggtatcagtggcttgcaggagatgcctttaatactcagagcattctatctccccctatctggtttagaaggaaggccttcattagttaccttttgagaagttactagaactctctattagagacttaccctcctgacctgataaaaagggatacccatgtctctattaacagctttatctctttctacagttttgggtatttgataaggttaaggcaaaattttagttatgcttaaggaggagttcttttttcacaattacagagaaaattttggtttgttgaagattgcagaaacagcaatggtaatgtaagacagttttggcctttaatttttttcttgaaactctacagtatactacaatagtgaaggaaactattatcatgagagatccttctgaataggatgtctttctgagttccactattcagttacaaaactccttaatgcttaaaattcattatgaaaattagatttattttaaatactttcaagtgtatacatttttatttcataatttttattgtcttttaactaaagcatttagttcatttatatttactgtgtaccttttatatttaataaatatatttacttattaaaagattaccactga

SEQ ID NO: 3472 - DNA, 2131 bp, Homo sapiens
agggattgtcctgacaacttgtggggatagaagggctcacagggcaggggtctcagctgcccccatccttagggcaggggagttagtgtggagccgagagcaggtcccagctccccctgccagccgcactgtcccaggcccagggacctctgccgggtcctcccagcccttgccacacagcctagacgtagtagcctgggcttccagcaggtggcgagctggttcgtgctggaaatttctcctgggtttcttggggtcaaacatgccaacctccaagaccccatcctcacgtctcccacttttctggcgctggagtgtgcagggcgtaggacctgcatgtgtgggtgtgagaatgggggcggtggacaccagggggcgagtgtgtgactaggtgtgtgtgcacatgtgtagggtgcagacgcatgggtgccatcctttgcgttcagtgactgtgcgtccagacccctcaccagcggcccccccaccacaccctggtcctcccaggcagctgtcccagggcgcccaggcctgccttgcaccacagccctcaggaaatccggcaaggaggcccctgcaggttggttcaggcccccaggtagcaaaacagagacaacagcagccccgcctgaccccctgcccctctctgtggaggcccgggacccccgcaataagcaccacatgggtgaggctgtccctgtcagggtcccctgccagggtccctcctggggttctgggccatttgaggggctctttgatgggccaggccggccagagtgaactccgagcactttctggctggtgccccaacctctccactccccactcattcccaccttgaaaaagggctataggtcccctgccctgcccgggtccagtttacaaacagtgtggggtggccccagggcctggccccactctccctgctgtgcccactcctctccagactccacctccccagtgggtatgggccctccacatgccaggtaagtagcaaacccccactccctccaaggaccaggtctcagagaaggccctggtcactgcccccggcccacctggagcccatcggggctgcctctcccagccgcgacttctccttttgccttaggcctcgcgacatcctgatctctcctgcaataactaggaatcgagattccacagtagacgtcccttgccgtgctcgctctctctctcgcgcgcgctctctctctccctctctctctctctctctctctctctctctctctctctctctctctctcctctctttctctctctccctctctctgttaagatcctgttcgggagtttccccagccgttgtagtatctagtatgttagagttgggaggggaccatagttatgtagcccagccccctcattcccagaggcacccagagggccagcctccagcctgaccccagagcagaaccggaacaccaggttggggccctggtgctgccacctcctctgctggtcgggctgggaccctttgccccttaggagaggtgttggtcacagatgtttacctcagtttatgtcactgtcgaagaaacaaaaaataatagcaaaaaataacactgtagacatgaagacttagaagacaaaaaaaaaaaaatcacacaaaaaatctcccttgttgcgattcttctgtgaaggtacagtgtgtatgtgtgtatgtgtgtatgtgtgtgcgtgtctctgtcccagaccctgtgtcccccacactgccccctgtccttcggtgcttcccagagacccctctgagctggcctgtggggcacgggaagccccctggatgggaggcggggccacaggtcggctagagggtctccaccaggcccactgaacagaaccccacggctgccagaatgttccctgagcccacactgtggccagtgggacagtcctggtggctgacatcagcgtccatgcttggctcagggcctggggcggggtcctgggtagagtcctagccccagagccccagcccctcatgtcttgccgcccttcctccatgtgtttgtaaatactctggcatcctttggccctgagaaggtttttaaatgtgttatttacttctctaaacatgacgattgctataaaaataaacaaaagtttagaaaaatga

SEQ ID NO: 3473 - DNA, 646 bp, Homo sapiens
ctcttttccgcctcaccctttgggagtaggggtgtgcggctggcttgtcccgcccctgcccctgagtgacagaaccgtggacagcaacatttcccacaggacacgaagtttgtcggcccttgccttggcagagctgagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaaggtagtgaatgaataaagtattgacttctgaagtgttatctctgctgggatgttggcttaaatgactagaaaggaattgggggaagcataatgagtaaccattttggcagatagcctcagtgatttgctttaagaaaaaattaagcatagtctgtaaaggcaaaaaacaaaactaaattgaaaagggaataatatcttgagtgtttattcatttaatccaacttctctcctaaaatggagtggtatcttccctagccacacacaattaagattaaaataacttgattcctatttacaattaataaatgcaaaatactatgcaaataggattgctatatgaataaattata

SEQ ID NO: 3474 - DNA, 993 bp, Homo sapiens
atgaggggtcctgacctgcgcccccggccggggtcactcaccggcctcgctctggttgtagtagccgcgcagggtccccaggtccactcggtcagtctgtgactgggccttcacattccgtgtctcctggtcccaatactccggcccctcctgctctatccacggcgcccgcggctccatcctctggctcgcggcgtcgctgtcgaaccgcacgaactgcgtgtcgtccacgtagcccacggcgatgaagcggggctccccgcggccgggccgggacacggatgtgaagaaatacctcatggagtgggagcctgggggcgagcagtggctgagacctgcccgaccctcgtcccggcgcggctcccccggtcctgcgcccccgccaggagggccccttgcttctccccgcagaggcggtttccctcccgaccccgcactcacccgcccaggtctgggtcagggccagggcccccgagagtagcaggaggagggttcggggcgccatgacggccatcctcggcgtctggggagaatctgagtcccggtgggtgcgtgcgggctttagaacagcgaccgcgacgacactgattggcttctctggaaacccgacacccaatgggagtgagaactgggtccgcgtcgtgagtatccaggatgaaggaccctacgtaggttgggagagggagaaaagaaactgcggagttggggaatccccaaggctgggactccccaatccatacaccgccttcggggcctgagactctgagagccacgcctggggccctgggacttcgccctgacccctctgctcctgtgcgaagcgctctgtctcaatgtctccctgagtcttggcccaggagctgtctgagaaacaagggagaaaccctcggcatgggccccgtccctctcctttcacttttcatcccattatctctgtccctgaactggactccctgactcccactccttacctgtccacctggactcttctag

SEQ ID NO: 3475 - DNA, 487 bp, Homo sapiens
agaagaggcgcccggaaaaccttagctcttggctatctcttccctgagcacaccctggccctggggcctgagatctctccatgcaggggcagccatgagctccgggggcagcagcaaggctggccacaccacccatcagccacctccagccccgccgctcaaccagccatcagtcccttaactgccagtgttcgtggaccatgcaaaacaaccaagcaagggactcattaagcccaaagcaattttagggtgcccagtggagagactcacagaggctgctagtgccgatgctgctggtgctgctgctgaggagtgcccaggaccaggtgccaggggagttggagtcaataaccaccactgtcagatctactgacccccaagccagtttctccagtcagatctacacagctaaatgagaagcggaactgggaatcttttttgcaaacaaaactctggcccattaagaactctctgctgccttgtgaag

SEQ ID NO: 3476 - DNA, 1643 bp, Homo sapiens
gatttgagtcttgctctgtcgcccaggctctgtatcaaaaaataaataaataaataaataaataaaagccaagggtctagccagagctgtggaaccgccgccaggtcgctgttggtccacaccgcccgtcgcgctacccgcccacccagcatcggccgccgccatgggagtgcaggtggaaaccatctccccaggagaggagtgcaccttcccgaggcacggccagacctgcgtggtgcactacaccgggatgcttgaagatggaaagaaatttgattcctcccgggacagaaacaagccccttaatttttagcaggaggtgatccgaggctgggaagaaagggttgcttagatgagtgtgggtcagacagcccaactgactatatctccagattctgcctacggtgccactgggcacccaggcatcatcccaccacacgccactctcgtcttcgatgtggagctcctaaaactggaatgaagggaatggccttctccctcagctccctgttcttggatctgccatggagggatctggtgcctccagacgcgtgcgcatgaatccatatgaagcttttcctgaggttccactacactctgtatagacatctgccctgactgaatgtgttctgtcactcagctttgcttccgacaccttccatttcctcttcccccttctccttgtgtgtgtgtttacctaaactatatgccataaacctcaagttactcattttattttgttttcattttggggtgaagattcagtttcagtcttttgcatctaggtttccaattaagtacatggtcaagtatcaacagcacaagtgatagattcactttagaataggaattggtgttgggggggtgttgcaagaatattttaattttttcgatgaaatttttatctattagatactaaacattctttctgctgcgctgcaaagtcatagcagatatgaggtgctgttgagggattaattattgtccaagttgagagatgtccttcagttaaattaaaatccctacctaaaaccaaggtggtgatggggagagcctttgcttccaccagttcccccccttccctcgctttaagcccctgcctttgaaagtagatcatgttcactgagatgctggacactgcaggtatctctccctgggccagcagggacctctgaagctttgttgcctggcttatttttttttccatcctgtggtttttctaatggactttccggaattttgtaatctcataactttccaagctccatcatttcctaaatcttaagaactttaactgacagtttaaattgaagatgctgtttgtagacttcacacccaatgaaagcccagccattgccgggcacggtggctcacgcctgtaatctcagcactttgggaagccaaggtgggtggatcacctgaggttgggcgttcgtgactagcctgatcaacatggagaaacctggtctctactaaaaatacaaaattagccgggcatgattgtgcatgcctgtaatcccagctactcgggaggctgaggcagaattgcttgaactgggaggcagaggttgtggtgggccgagatcgtgccattgattgcactccagcctgggcaacaggagcgaaactccatctcaaattaa

SEQ ID NO: 3477 - DNA, 6559 bp, Homo sapiens
ggcactgggaggaggggagaggcaagagttaggggaataccgaggaaagtggcagggattggaggctcctggagaaagggcaaggctgaaggttgtcccatgtattttggccagatttgattatgtaatcgagaatcatgagataattaagtgtgttcatgtctctggagccttcaaccagctcttttaacatcttgctcttcccagcattccttagggtctttggctgggctctgggatggatgccatgggagtacctttacttaagctctaaagttaccaatggagagactgggactcaaagaggaacttgattggaccccagagaggtgaggggtaagggctagaacctcacacatgctggttttgctgctgcctggcaggcccatgggaagaactttagaggttccaaggaattggaaaagggtcacaagatgggtggccaaactcccagctcaggcttgattcctactctcaatgtggggatagtggagaagggggctgcaggaagggctgagaaaagctgagaatgagaagttatacaggaggtagcttggtgggagtgaaacaaaaatgagtggttcatgggccagccaggcatcctgatttccagctcacagcagcaggagcttcagagaggaagaaggagaggaggagaaagccaggttgatgttagtaaaggtcaaacaatttcaggagcacctctgacctccctccacacaggttttcttaccttgactatgcagagggtggtccatcttggcactgaagatggaaccccctcttccatggtctggggtgaccccatgcctgtaactgaatgtgctcagatccttggggtgcggggactgtagggggaggatttgaaggtgtgggactgtcctggctggagaccactgggtcaggagaactccagtagagggtttgggtgctgggaaccaggaagagtgggggaaggggcagagccaactccagaggcggatctcctggctgaggacagagggtgtattgtccaagctggaggttgctgtagctgggcggggagcagctcagctcgtctcttccaaatttcttttgggggagggtaagggaaggcaagcccccctttacttgtggccctgggggctacaatggttgctgagaaacaaggcttatttgacaaataatgcttcccaggagcagatgtgtagctctctcacttcctgagaaaccagatgctgtgagctcgcttagcacttgaggcgacgccctcagcacgaactgggaccctagtgccttgggatccggagtatagtgcttgattctattgagaagaaacgaggctaatgtggactgggagacacacgggacctaatcagcctcaagttagcccttttgaagtaggttgctgcacctgcactttccccctactcgtccactagttcaagatttacaagacgttgacaatgagggctgaccagtcctgggtccactcctgcagctggggggcttctcggtggacccacactttttttttgagacagggtcttgctctgttgcccaggctggagtgtagtggtgtgatcacagctcactgcagccttgacctcctgggttcaagtgatccttcctcccaagtagctgcaactatgggcatacaccaccatacctggataatttttctatttttttgtagagacagggtcttgccatgttgccctgactagtctcaaacttctaggctcaagcgattctcctgcctcatcctcccaaagtgctgggattacaggtgtgagcaaccattgagacaagagtctcgctctgtcacccaggccggagtgcagtggtgcgatcccggtccactgcaacctccacttcccgggttcaagcgattcttctgcctcagcctcctgagtagctgggactacaggtgtacaccaccatgcctagctaatttttgtatttttagtagagacggggtttcaccctattagccaggctggtctagaactcctgaccacatgatgtgcccgccttggcctcccaaagtgctgggattacagctgtgagccatggcacctggccacacacgtctttttaaatttaaatgaggatgtggccatattacagcccaggttttctctgactttagagtaccttttgggacatagggccttcctctctaccctttctgtacacagccatcataaacctctttcaacaagcctttcctatttttatgttccttctttccatcatttacctagacctcattattgcacagctgagagtggcttgaaacaaaggcttggagaatgtgagtgaaactgattcctgtggtggagaggcagtgaaaaagcattaccttgtaggtttccaggcagcctggacaataggggcacctaaacccacattgaaaagccttcacatcatcacagctgagtctcatagccttcaactttaccagttttggagaacagagataaatgcactggccagaaactagaagagcagctgctccaattggctgggaaatcatttaactggctcctcatcttggctcttaaatccccaaaattgttgactgaggtttcccgggctcctttctatgctccacctccttgtgaccttaaggattctctgccactgtcctaacccctttcccgccttgcaacaatgaccagtctgtccctagctgtttggaaaattcccactgagtctgtgagcctctgttctggtaacctcgaccagcctgtcaccagtatctctggtccaccagtgcggtgtaactcaagggagcagcatctctccagattgctgaagtgagggagggagattatgagggaactgccccaaggacacaaggattcattcttagagttcccacatcttgattaaaataaacagtacaggaaatagactgcaggcacatccaggtgattaaaaaatttaacaccaggcaaaaaaaaaaaaaaaaaaaaaaaaaaaagccagaggggagctaggatgcaaactctattattgggcctcaataaacactgaaatagattcccttgtaaccccaccctctaatcttggacaatatggtatccaatactgaatgaaaacttcagagatggtaggaggaggaggagcaggtggtcaatgactacagtaaaaaccactgggagtgcagagtatttgtcaaagaacttcagcattacaatgaactttaaagatcagatttatttggagaaaacaaaaaacccacaacccaaaggatgggattttacatcaagacatctcccaggtaataagtctacagattacaaatcattttcatagaagatatttttgtacaaattttacatgtattcaggagcgggacattaatcaatccctgtttctattttaataggggggacaaggtaggggagagggaaaaacagttttggatataactatttggaaggagagtagacatgaagagggcaaaccctagcttttcattatctacaatcaatagtttgtttttcttttttaaaaaagaaagaaaaaccctttcaatcttcaatactctttaaaagcccacttcttagctactggccaatccacaccaattatttaaattcacttggtacacacctttgtccactgggtaaattatattcattatgcccactgctgcagcacgcataaaccaacacccctgcatggctgaacagggcctaatctaggactgatgggagaagggcttgcaaaccaagatcaaggtgtttctccgctaatactgtctaccaagctgatccctacaaaaatgcatataaaagcaggcaagtttagctactgtgttgcaagagaaaccaggaccttgttaaatagttctctccattaccatttattctctcaagggaagcttaaaaaaacaacaacaaaacaacacattggtctggccacctcatgaatccaacaagcattagtgtggcatttcagtggagaaggaaacttggggggaaaaatcccatcaaggttgtaagaaaggctcccaatttaactgtccctgtccctatttatccatcatccaagaccatccattattctagagcactctgatcaataaaaggggtccaagcatcaggagcaggcaaggagaaccaaaagacatcaagaaaccgatttgcttgagaaaagcagcgattcttcctttcagagttctccatggctgagaaaatgcccaagacatcatgtatgtgacttagatactgctttttgggaggttaagagtagcatgaagaacttaagatgatgataagagtctaaatttttagtttcaaggtttcaatagaatgtggatatattcaaaactttcaaaaaggacagtgtttagaaagggtaaaactaggacacagaaaacactgggaattaccacgacccccaagtgcttccggctccaggaaataaccattcatgtgtttgctggaggtcacacaattttcccctattacctggtgcaaaatgactcatcacttcccaaaagcttcttttcaaaccacgattttcccatttattttggtccaatgcagtcccattctttatggcctatagtctcactcccaactacccccctggggggttaaaaaaaaaaaaggaattccctctaggctggcccccaaaactcagaattaaataagaggaggggctggcagcctcctggagactagaacaacttgaggctaaatctacctttccaagagtggaaaatttattcagataatgtttgagaattcatatatgccacaataggataaaaactaaaaggtagaaatctcacacttttccttctacctccctcccctactgcccaaccaggttccaggcattatatcactgtcattaccatttctgctaaatggagacccctaggcactaatcacactggcaactgcatggtgacataacgcaccacaacttttcctctaaaaagctgtagtccctttctctctggctgtattggcaattctccagttacttcaatactttaaaggctgcagcagcatgcaaaataatttcattttttgtttttaaaaaaaggtaagaaaggtcttcaggagatggtgagttttattttgtcttgtctggatagaggttttgatttgctctcgaatgttccagggtggagagaaactaggagaaaagcacaggatgtagaggtctattcggcataatcttctccctcattttcatcttcaccatcaacagagagagcagcatacttgcttgcagaactgaacttctgtaacacaacgagagtgacaggataatgaaggccctgaattatcacatcaaaacccaagacacaggatactgatcctttggcaatgggggatgacagtcagatgacacccacttgcttgctcatcagcattgtccattggagaggagctagggaagagggtcagaggcacatgcgatcttactatagtctcataccacctctacaccttgcagaagggatgagaacaaaggaagacagaaaccaggaaaaagctaaacttctttcgctatttcagtaaagaccaatgtcttatttccaaacactttgtattccaaatggaaagaagtccaacggcaaaaagtttagaatactaagaatttttaattcttagtaagaatacttagaattctaagaatttttcttagaatgaaaaattgggagcagccttcaacacttacggaagctggattttcctcaggtttctttggctcaggtgcagatctggagtcttgatcctttttgccatctttcctgcagagacgtaagcataaaaccatgtctttaggaaaggactcgcctaatacaaacatgtgtatgcatgcagtttcaaggcactgaacaggcacctctagtcaacagtccttgttgtctggatgatgtattacttctagattttcagaatcttaactgtctacgttggctgactttagtttgctcacaatgagcgatctggcagtgctctgagaaccaagaacttaatttcttaattacacaaacatgtggatcagaggaaagatgagaaagagaacaagcatacctatctgactccttccagtggtctctgttccctccgtcgcctggaccacggctagagttcccagtttggccttttggggcattcatcccatctactttattttcatctgcttgggcagtaatgtaaacaaattaaaggcaagtaaaagtatcaatgtccctctcctaagatttcccttaagctgaagaaaattgtgcccacatgtactgagggaaactaacctcaccccaacccagacttccttcctgaagcccttctttccacatcctctacagcacacaaaaatacaaaaaacaaacaaaatccactaaaaagttccatgtagggatatgccatcatgaaaagcaagctggaaataaagattatgacgctctgtagtgaccttggttaatttccttccgatttttttctccccgtcaaagaaatgttctaccaggaaagggcagggtttcatactttctccaaagaggccactcctccctctactggcaagaaaaggtagataaccc

SEQ ID NO: 3478 - DNA, 11792 bp, Homo sapiens
cagctttatttgccttgtacagcatcaattttcttacattctcagttaattggccattaaagtgctggaaattttcttaatcatgataacatttgttaaaaagaaatcagaactaatatcaggaacatggcggcatgaaggaaacagttcccttacaaaacacagaaaatggaagcccctcatgttgagggggtgggttggacaatttgcaaacagattctaatttcctctcaccgtcagcaccaaactggctgggaccaccacccctgggtgaaagaaacaacactaaagaaccctaaaaacacccacacaccctgactaccaccacctctgggccatctgtgggcgtttgctgtttgaacagatccagtctcaggaaagaggaagacctgacctccgtctgcaacccatcaccccacccacccttactaacaaaagcccccaaagtcattacaatgaaaaagtgggtttccattaccccaaaactaacaatgttcagtaaaaatgaggataataaacacaaaagcttgcttagtaaacaggagctctcagcagtcaatgcaaaaaaatatatatatatgaaatcttaaggcaaatactgttgactttgcacatgggctggacgaacttggaactctttacctatctgtatagttccaggagcctacaggcggtcggtttttcagcgcttgccaccgggccaggcaaggtctttgcatgattgctgaggcagtcggtgtgtttccctttggagtttatataggaacacaccacccaaggctgatgttttgttatatatatatatatgtacacacatacaaaggcctgctactctttctttgtggaaactgacagctccacctcgggaagctggatgccaaccttattcccactgtcattgctagaagaggaggacagtcgggacttcttagaggccagggacaccccactcccctgtaacttgcctgtctcatcatcgctcccagtcacctcataatgacctttgctctttgaccccaatccaccaaaggtaccgaatttcagcttcccgtgtttccctttaactttcccaccttccagagacacttccccaccttcaaactccagcgtccccgtcggggtggaaggtccagagaactctctttcatcactgaatgaatttgagcggtgccgtggcttcttacttttaaataaggagaatttgcctttcggtgaagaggcttcggcctctgcctctccttccagagagcccaggctggcctttgaacttttcaggtcacctttggacccagaaattgatgcttctggtgagccagtgacaccacctttccctttaggtttggaaaaattaaacttgggcattttgatcttggactttttcagtttgacttcagactcttcccactcgccgtctccagcaccagcttggatgctggcctctgctttagggaagtgaacatccacccccatttctctgccaaccagctcacggccagagaaggtaaatttggggatcttcattttagggaatgttacttttccagatccactttccaagtgaccttgaggcccagacacactcagcccaggagcctggagtccaatctgacctcctttcacacctccttccacctttggtcctgagaaatgaaggcccccagcaaacttagatgtgtccaagttgagagcagaggagacttggggtcccttccactcacccccggaacctttaacactcaaatgcccttcaccaaggctgatgtctggggcactgacaccccctgaaacatccgcacctcctttgatttttgggcccttcaagttgatgccaaaatctgactcaggagatgccatattaaaggcaggccccttcacactgatatcaggagcagccccatggaaacctacttctgaacctttcagaccacctttgatttcaggcccagaaatctgcccagttgggagtttcacattcacgcctggcaggttcacatcacatccagaggacttaattccaggcatctggaggtttccttctaggccttgaacaccaatgcctggaagacctcctccgacagtggggcctttgatctcaccagtggccccaaggctccctttcacttttggtccttccaagttaaagtccacattcggtgctgaaatccgaggccctttcaggttcacatccacacctggccccttcagttcgccagaaacctgtggccccttggcattgacgtgcaagtcggaccccggagtagagatgccaaattggggcagcttcattttgggaagtttaatgctgccttcggatgcctccaagcttagatcaggagctcctacggatactttagggcatttgatgtcaccagagacagccagatctccctgcaggcttggtcccctcagtgtcacatctggtgccccaacgttaagctttgttgtggcatcgatccctggcactttcacaccgtctcctcccacctgcattttgccaccgacaccactgaggttgagccctggagcatgcaccttcatgctgggaacagatgcatccaggtctcccttcaaacttggtcctttcaagttcagatcaaggtcaggcccagagacttttggcatagagaggttcactgaaggcaagtctactcctggcccctttagagaaacatcgggcccttcgagcttaacatctggtcctctcaagtctccttcaagagagggtagctgggcatggacctcggctcccccaccctccattttcacacctgggatgccgatcttgggcatggaaaacttggggaacttaatttttgcttctggaccttgcagatctacatctggtccttccagtcccacgctggggacatcaccctttatctttggtcctttcaagtttacattcacatcagggatggagacttgaggggcagaaatgccgaaggacggtgttttgactttagcatctaggccttcgatgttgatgtcaggtgcacccaagtttgcctgcactttggggcctttcaggtcaccctctatttttggcactgagatgtccacatctggcatcttgaccttgggagccttcgccttgatgtcaagaccttcgacgtgaatcgctggcaaagaaagttccagatcaggtgcctggagttcaccctccagtttggggctagggagaggggcctcagctttaaatttaggtgatttaatgtcaaactctacatctgggaagtacatttttccaaacatcgttttcttggttttgggcgatttcacgtcgactttgagtgcagcatccggccctgcgatgttgacatctacatccggagccttgaggctggcatcaatttcacccccaggaacattcaggtcaaatccctgttttttggccttaatcttaggaccactcatatgaattttaggcattttaaacttacttttcttgcccttgccaccaacactaatttcaggagtctcaaggttcagctctgcctcaggaacagtgacatccagtgaaggtgacttgatgtcagctttggggctttttgccccaaatccaaacttgggtttcttaaatttggggattttaacatctggcccttcgatgttaatatctgggctgtccatgtgtacatctaagcttggagcttcaactttgggtcccttgaggtccacttcaccaccttctaacttcggacctgaaaatccaatttttggtgccttgagatgcaaatcaacatcaggagcagttactttaggagcagatatctccagcgatggcatcttcaaagatgggccactgagtttggcatcagggccttcgaaatccagacgtggacctttaagatctacttctgggcctttcaaagtcccttcaaccttagggacagacacatcaaaatctccttttactttgggtcctttcaaatccaggtcaacatcaggtatggagatcttgggagctttgatatttatttcaggcatcttgaacttggggcccttcagttttgcgtctggaccttcgatattcacatctggaatatcaacgtccaccttgggtcccgagacatcgatgtcggccttgggcaggctcacatccacatctggaccttctcctttgaagccaggcatgctgaatttgggcattttcaccttgggcatcttcaggtgccagtctgggccatgaacatccacatcaggggtgttgatgtccacttttgggcccttgatgtcagcttctgggcccttgaggtcaccttccactttaggaagggtaacatccacatcgcccttcactttgggtcctttcaggtttaagtcaatatcaggcatggagatcttgggggctttgatgctcatctcaggcatcttgaacttggggccctttagtttcgcatctggaccttcgatattcacatcaggaacatcaacgtccactttgggtcctgagacatcaatgtcagccttgggcaggttcacatccacatctgggccctctcctttgaagccaggcatgctgaacttgggcattttcactttgggcatttttaggtgccagtctgggccttgaacgtccacatctgggacatcaatgtccactttggggtccctgatgtcaacttcggggcccttgaggtcgccttccactttgggcagagaaatgtccatgtcgcccttcacctttggacctttcagattcaggtcaacttcaggcatagagatcttcggtgccttgaggtgtaagtcaggcattttaaatttggggcccttcagtttcccttctggaccatgaatgtcaatatcaggagtgtcaatgcccactttagggcctttgacatccactttgggacctttcagatctccctccagtttaggaacggaaatgtccatatctccttttatcttaggtcctttcaaattcaaatcaatgtcactcatggagatttgtgggcttttgaaatgtacatcaggcatcttaaacttgggacctttgagcttcccttcaggaccttcaatgtctacctctggccctttcagatcactttccaccttaggtagtgaaacatccacatcacccttcaccttgggacctttcaggtgcaaatcaaagtcaggcatagagattttgggagctttgatgttcatctcaggcatcttaaatttgggccccttcaattttccttccggaccttcaatattgacatcaggtgtgtcaatgtccaaactggggccttttatgtcaatttcagggcccttgagatcaccttccactttgggcagagagacatccacatcacctttcactttgggacccttcaagttaaagtcaatgtcaggcatggagattttgggggccttgatgttcatctctggcatcttgaactttggacccttgagttttgcatctggaccttcgatactgacatcaggggcatcaatgtccactttggggccagaaatctcaatgtcagccttaggaagggtaacatccacatctgggccctctcctttgaatcctggcatgctgaatttgggcattttcaccttgggcatcttcaggtgccagtctgggccatgaacatctacatcaggggcatcgatgtccactttggggcccttgatgtcaacttctgggcccttgaggtcaccttccactttaggaagggaaacatccacatcacccttcaccttgggacctttcagatgcaaatcaaagtcaggcatggagatcttgggggctttgatgttcatctcaggcatcttgaatttagggccctttagtttcgcatctggaccttcgatattcacatcaggaacatcaatgtccaccttgggtcctgagacgtcaaggtcagccttgggcaggttcacatccacatctggaacatcaatgtccaccttgggtcctgagacatcaaggtcagccttgggcaggttcacatccacatctgggccctctcctttgaagccaggcatgctgaatttgggcattttcactttgggcatttttaggtgccagtctgggccttgaacgcccacatccgggacatcaatgtccacttggggacccctgatgtcaacttcagggcccttgaggtcaccttccactttgggcagagaaatatccacatcgcccttcaccttgggacctttcagatgcaaatcaaagtcaggcatggggatcttgggggctttgatattcatctctggcatcttgaacttgggccctttcaactttccctctggtccttcaatgttaacatcagggccttcaacgtccactttggggcctgagacatcaacgtcagccttgggcaggttcacatccacttcagggccctctgctttgaagccaggcatgctgaacttgggcattttcatcttgggcatcttcaggtgccagtctggaccctgaacattaacatctgggacatcaatgtccactttggggcctttgaggtcaacttcaggacctttcagatctccctctaccttagggcctgtaacatccacatctccttttatttttggacctgtgagattcaggtcaatatctggcatggatatctttggagtcttaaaatgcatctctggcatcttaaactttggacttttccactttccttcaggtccttcgatattcacatcgggacattcaacatccactttcggtcctgagacatcaatgtcagccttgggcaggttcacgtccacatctggaccttctcctttgaagccaggcatgctgatcttgggcatttttatcttgggcatctttaggtgccagtctgggccatgaacatcaacatcaggtgcgtcaatgtccacttttgggcccttgatgtcaacttctgggcccttgaggtcaccttccactttaggaagggaaacatccacatcacccttcactttgggtcctttcaggtttaagtcaatatcaggcatggagatcttgggggctttgatattcatctctggcatcttgaacttaggccctttcaactttccctctggtccttcaatgttaacatcagggccttcaatgtccactttgggtcctgagacatcaatgtcagccttgggcagcttcacatccccatctgggccctctcctttgaagccaggcatgctgaactttggcattttcaccttgggcatcttcaggtgccagtctgggccttgaacacccacatctggggcattaatatccactttgggccccttgatgtcaacttcggggcccttgaggtcaccttccactttgggcagagaaacatccacatcgcccttcaccttgggacctttcagatgcaaatcaaagtcaggcatggagatcttgggggctttgatgttcatctctggcatctttaacttaggccctttcaactttccctctggtccttcaatattaacatcagggccttcaatgtccaccttgggtcctgagatgtcaacgtcagccttaggcaagttgacgtctacttcagggccctctgctttgaagccaggcatgctgaacttgggcattttcatcttgggcatcttcaggtgccagtctggagcttggacatcgggggcatttacatcaactttggggcccctgatgttcatatctggtacttcaagtttaccttctacctcaggcacagacacatccacatcccccttgattttgggtcctttgagatttagatcaacatcaggcatagaaatattgggggctttgaaatgcatatcaggcatcttgaacttagggcctttcaatttgccctctggtccctcaatgtcaatgtctggcccactgacatccacatgtggccctttaaggtccccttccaatttgggaacatctacatccacctctccttttgccttggggctcttcaagtgtagatcgaggtctggcatagagattttgggagctttaaagtgcatatctggcatcttgaacttaggagttttccacttgccatttgggccttccacagctacttctggcatgtcagcatctaatttgggacctttgacatccaattctggaccttttaactctccctccagctttggggcagaaacatcaacatctcctttgattttgggtccctttaaattgaaatcaacatcaggcatggagatcttgggggtcttgaagtgcatctcaggcatcttaaacttggggcccttcagcttcccttctggaccttcaaggctcacatctgggacttcaacatccaccttgggtcctgagacatcaacgtcagccttgggcaagttcacatccacttctgggccctctcctttgaagccaggcatgctgaacttgggcattttcatcttaggcatcttcaggtgccagtctgggccatgaacatccacatctggggcatcaatgtccactttgggccctctgatgtcaacatctggcactttcatttcaccttctaccttgggaacagacacatccatatcccctttgactttggggcctttcaagtttaagttcacatcaggcatggagatcttgggggtcttgaagtgcatctcaggcatcttaaacttgggccctttcaactttgcatcaggacactccagctcaacatcaggcacctccacatccacactggggcctgttaaatctccctccaattttggcaaagacacatccacatcccctttgactttggggcctttcaagtgtaagtccacatcaggcatggagatcttgggggccttgaagtgcatctcaggcatcttaagcttggggcccttcagcttcccttctggaccttcaaggctcacatctgggacttcaacatccaccttgggtcctgagacaacaacatcagccttgggcaagttcacatccacttctgggccctctgctttgaagccaggcatgctgaacttgggcattttcatcttgggcatcttcaggtgccagtctgggccatgaacatccacatctggggcatcaatgtccattttgggtcctttgatgtcaacatctggcactttcatttcaccttctaccttgggcacagacacatccatatcccctttgactttggggcctttcaggtgtaagtccacatcaggcatggagatcttgggggtcttgaagtgcatctcaggcatcttaaacttgggccctttcaactttgcatcaggacactccagctcaacatcaggcacctccacacccacactgggacctgttaaatctccctccaattttggcaccgacacatccacatcccctttgactttggggcctttcaagtgtaagtccacatcaggcatggagatcttgggggccttgaagtgcatgtctggcatcttaaatttagggcctttcaactttgcatcaggacactccagctcaacatcaggcacctccacacccacactggggcctgttaaatctccctccaattttggcaccgacacatccgcatcccctttgactttggggcctttcaggtgtaagtccacatcaggcatggagatcttgggggccttgaagtgcatctcaggcatcttaaacttgggccctttcaactttgcatcaggacactccagatcaacatcgggcacctccgcttccacaaaaggacctttgacatcaacttgcggccctctgagatcaccttccagttctggcacagaagcatctatctctcccttcagtttgggtcccttcaaattcaagtccacatctggcatggagaccttgggagcttttatattcaacttgggcatcttaaatttggagcctttcaactttccttctggtccctcaatatccaaatcaggagcatcagtgtccacactgggtccagacacatcaatgtcagcctttggcagattcacatccacttcagggccctctgctttgaagccaggcatactgaacttgggcattttcatcttgggcattttcaggtgccaatctgggtcgtgaacctccacatctggggcatcaatgtccactttgggccctttaatgtcaacatctggcactttcatttcaccttctaccttgggcacagacacatccatatcccctttgactttggggcctttcaagtgtaagtccacatcgggcatggagatcttgggggccttgaaatgcatctcaggcatcttaaacttggggcccttcaacttcccttctggaccttcaatatcaatatcaccaacattcacatccatcttaggggctttcacatcaatttcaggacccttcaagtctccttccactttgggaagggaaacatctacatcagttttcagtttaggggctttcaaattaagtccaacatcaggcatagagattttgtgcgtctgtatattcatgcttggcatcttgaacttagggccttttagtttcccctctggagcttcaagattcacatctggaacatcaatgtccaccttgggtcctgaaacaccaaggtcagccttgggcaggttcatatccacctctgggccctctcctttaaagccaggcatgctgaacttgggcatttttaccttgggcatcttcaggtgccagtctgggccatgaacctccacatctggtgcattaatatcaactttggggcctttgatgtcaacatcaggagcttttatctctccttctacttttggaactgttacatcataatctcctttcattttaggacctttcaaatgcaaaccaacatctggtatggatatcttctgaggctttatactcatttctggcatcttgaatttgggaccttttagttttgcgtctggaccttcaatattcacatctggaacttcagcatccattttgggtcctgagacatcaacgtcagctttgggcagcttcacatccacttcagggccctctcctttgaagccgggcatgctgaacttgggcattttcaccttgggcatcttcaggtgccaatctgggccatgaacatccacatctggagcactaatgtcaactttgggccctttaatgtcaacatctggcactttcatttcaccttctacctcaggcaaggacacatccacatctcccttcaattttggccccttaagattcaggtccacatcaggcatggagatcttgggggccttgaagtgcatctcaggcatcttaaacttggggcccttcagctttccttccgggccctcaaggctcacatctgggacttcaacatccaccttgggtcctgagacatcaatgtcagccttgggcaggttcacatccacttctcggccctctcctttgaagccaggcatgctaaacttgggcattttcatcttgggcatcttcaggtgccagtctgggccttgaacctccacatctggggcatcaatgtccattttgggtcctttgatttcaacatctggcactttcatttcaccttctaccttgggcacagacacatccacatcccctttgactttggggcctttcaagtgtaagtccacatcaggcatggagatcttgggggtcttgaaatgcatctcaggcatcttaaacttgggacccttcagcttcccttctggaccttcgaggctcacatctggggcttcgatgtccaccttgggtcctgagacaacaacgtcagccttaggcaagttcacatccacttctgggccctcgcctttgaggctgggcatgctgaacttgggcattttcatcttgggtattttcaggctccagtccaggccttggccttccacatctggtgctttaatatctaccttgggacctctgatgtccacatctggaacctgcatttcac

SEQ ID NO: 3479 - DNA, 267 bp, Homo sapiens
tttaaataagtaactccattgtttttctcttttccaagatggccgatgttatggttttctacgaagtcagtgcttacttagctcactaacagcgctgctgttggcggctgcggctgctgctgtggcaggattttcaatgtggtgtgttttcaagcctcactcactcatcctctcattcccaaacattcagcatccgtgcacactcctcacttccaggtttttcaaaagatgggagatttccagtgggggtcctcaggttatcatccc

SEQ ID NO: 3480 - DNA, 2288 bp, Homo sapiens
ggcttaaacaacagaaatttatttgctcataatttttgaggctggaagtccaggatcaaagtgtagataaggatgatttcctctataatgagccttaaaagaaggatctcctccaggaatctctctttgccttgaaggtaaccatttccggtcacttcacataaaattctgtgcctgctaccctggtatctctttcacttcttataaggaaaccagtcatattgaatgagggccccattctaactgcctcattttaaaatcacctctttaaaaaaccacatctctaaataccaccattatcttgaggtcccagggatgaaagccttaatgttaatgagtggatgggacatgtgacataatctaaatcagtggtcccctaactttttggcaccagggaccagtttcgtggaagacatttttcccacggactggagttggggattaaactgttccagttcagatcatcaggcattagattctcataaggagtgtgcaacctagatcccttgcatgtgcagttcacaataaagttcatgctcctatgagaatctaatgccactgctgatctgacagaaagttgagctcaggcagtaatgtttgctcatcctacattcacctcctgctgtgcaccctggatcctagcaggccacagaccagtaccagtccatggcccaggggtttggggatccctgacctaggccattccacttattatagtcatcaagttattctccagcatacattgcatatgaatattaaagcttgtggaacataaaagggttttcccacaatccttgaattcatagtttctctccagtttgtgttctaaaatgtttatcaaggactaagtggcaggcaagggctttcccacattccttacatcaatatggcttctctccactgggaatcctgacatacactttaaggcttgagaaataagtgaagattttcccacattccgtataaacataggttttctcctagtgggagttttgtggtatcagtcctatggattaaatgaagcctttcccatattttccatttacatagggtttcctgccactgtgaattcttacaagttcattatgacctgagataataaagaagtggttccagattcccaactctcacagcatttttctacaatgtgactgttcacatctttcatgtaaatgggaacaacagagagctttaccacaattctaacattgataagatttctctccagtgtgagttctttaatgacatggaaagggactgtaagaattgaagaactggctgggcgtgatggctcatgcctgtaatctcagcactttgggaggtcaaaccaggcagatcactggaggtcaggagttcgagaccagcctgatcaacatggagaatccctgccttcactaaaaatacaaaattagctgggattacagggttgagccactgcgcctagccttttatttatttatttatttttttgagacagtgtctcactgtttcccaggctggagtgcagtatcacaatctcggctcactgtgacctccacctcctggattcaagcaattcaggctggtcatgaactcccaacctcaggtgatccacctgccttggcctcccaaagtgctggtattacaggcataagccaccacacctggagttttagtcagagcttcagtgacctggaggaagggaaatatccaactccagccaactctatacatcctgacccaactaaagggtgggaaaaactgaagttcacagtgcagaagcacagactcactgcaagactgacatctaatccctggacaatagaatgctgcccctctccccacagcttatcatgattactagaggcctgcttacagcatttcctcttatccagtatgccatgtccagctaaggaaaaattacaagcatactaaaaggcaaaagttagtttaaagagaaagagtaagaaccagaaccagatatagcaggattgctgaaattatcagactgggaatttaaaacaattatgattgatatgccatgggttctactggataaagcagacagcatccaagaacagacaggcagtgtaaacacagagatggaaattctaagaaccacaaagaaatgctagaaattgaagacagtgtaacagaaatgaagaatgtctttggtaggcttattattggccaagaaacagccaactaaagagcttgagaatatatcagcagaaacatccacacctgaaaagcaaagagaagaataaaaaaacaagatataagaactgtgggataactacaaaagatgt

SEQ ID NO: 3481 - DNA, 2301 bp, Homo sapiens
ttttaccaacaaatttagaattatttcaagttgctttatgttaaaatatataacaagttacattttcttgctgcattaataagtttttgatttttaaaatctgatatttcagcaactaaaggaatacttttctttataggtctgttctgtttttaacctcattgactgtatatgttttatttacccgtgccaggagtctagaatcgtgcttaggtgccattcttaggtatgaaaacaagtttggagaccaatgcaggtctctgtgcagaaatctggggctctaaatgaattaccaaaccaataggaaagttaaaatactactcatgatgtagtgtgtcatctgaagctatgatagaatatattatttctaaaatagtattgagaagttaattgttcagtccatagtagtgtaagtgaagtgtggaggtcagccatagttgtctttcttcagcaggtactctaaccagagactgggttctgtggaaaatagaattatattcttggtttgggatcaacaaatgttttgttattgttttaatgttgctggcattgcctgaaacaaagtgccctgttattcctcttatgtcatcagaactctgcttactgaagttgaagtttaatcttaggatctagaattcttgtggttggtcgtgtattaagaaaagaaggtggtttgattttatttcttgtacttggtggaacctgttactatacaagtcatgttttgacctgtaagccgagcaaatctgaaaggtgaatcgttaatggtagtataattgtttcatttgaaactgtcagtttcttcaagtcacttctctgaaaaaaattatgatagattgatagcctgccagaaaatagcaatttctaaggtgctgccatccacacttacttattgtgaaatatgaaaatccagagtggtttgtatgagaggggaaatactggctctaagctttctacagaaaacaggaaattcatgctgttgttgacataattttaaaggaaacttttaacaagaaaattcatgagggatacaatcaaacatagttaatctcttgagtgctaatcatttgagtatagtccacatcaggaagttttatgaggttgaaaactttactttgaaatatttaattgggagactagaccatttctttttccaagtcattctgatttattgtcctagtaaatgtatgtgtatgcatatatactgatgtattgactgaatgtgtgtgtgtgtgtgtgtgcgcgtgtaaatctgttttcatagggaacatacattgatggctcctagtctattttatactaaaacttaaaaaaatttgctgcactttgcagttgccactttttaaaagattaatgctttgcacatttcagtaggccttaaagatgaattgctcaccaacattttagaaatacactgcttacatgtgacatactctaaacaaagtcatagtaaactgttctcttaggttcatgtattattgagcaaataaggatgtcctttcttaaaatttctacatttatgtttgcttttgtgtaaaatctttattagtttgtaagtttctcaaagaggaggtttatactggaagcagtatttctaaagtacagagattcgaccatggattgaatacagtagtggaggaatgctggtattgtggcctaatttatccttttaaactgtatgtcattagtattagccaaaacctcagagtggagtgtcttgggctgaatgatcttctcaactttgccttgtttcccatctcataaaggctccttctggttcttttcccttccaaggattgtgagtcatgctcacataggcctgggatcttctggatggggtcggggaggaggtgggggtttcctgtggctggcccagagttctagccaatggaatcattcaagaatgcctaaagttcaggggtgggaatgccatatattggtgttaatcacttggcactttcttgggcaccaatattagcactgtttcatttttaataactggaagcacttaatgattattttgtttgtttaatttcaacttaaggatattgagggtcagagaagtaaggtttatttcttgtttatgttttctggaatttatagggtgtttgtagaagggataaatgggttacctaatgagccattcttctaggctctgtaaggtatgcccttttggctaggatattttaaaataatttgcaagcttttaatattgtgctttgtagaaatttacgatttttaaaaataatttgcaattgatagattacacttaaatttataaagtatccaattttaagtttc

SEQ ID NO: 3482 - DNA, 2288 bp, Homo sapiens
caatcatgtagttttggcggaaatttccccatcattctaggatgatacagaaagaaaaactgtgcctggaccctccctcttggtgggtctgtggaaacataagcggtttttttaatgggcccctgcatcaataccaaacatgggggtttggtaatgagaaaccaggacaggccatctgcagtgacccagcccaggacgaagtttacaaacacctcctggaacgaagctcccgcctgcatgtcaccttgatgggggctgtgagtggggcagtgtgatacccagtgactagacgcactctgcgttttcccgtgtttggggctgaggcctgctggacagatggctggccaagtgggagcagaccctagggagtttgcacctcggctgggccggattcggaccggctctgtgttcactacactcagaatagcctggctgcttctctgtctccgagaccggaggtagtgggaaccaacagctgggctggagagttggtgctggcaaaacagtccttgccctggggccggttcttacccaggtccagagaaaccaacgcgggatgtcagacttcaccaaaaggactttctggttgcccctggctggcttcctggaggcgttcgcctctagtttctcagggatggagcgagagcccagccagagaacagtaagaggagctgctctcctatctgcactcacccaggccttcacccagactttaccacggaggcggctgagtgcagctacagctaggtccgcgtccctcactcttttcatcttctgcacgttcttcgtgaaactggaaggatcccgggtctcagctagaacacggtggaagagaactttcctaggaaacggttcatgtgtcacttttcaggatgtggaaacactgagccatacaccctccattgcttggtgctggggttgtgtggcctccactgggcacttgccgacctgagtctggggccaggggagcccaggctgccctgcactcctgcctcccagcccacagccaggtgctttcatcacagctaaacctggttccctccaaacctcccagccactcgggcttgtaactgtctgagccccggatccggtggggtgaaagcagccagctcatcccagtgactcacaggacacagccatccagcggcatctttccttgtcgaatgatactgtaatgaccttccaaagtgaagagtagcacattaaagtgattttattgtttcctgtttctcattccgatttctttttcctcctatgttcccagattctggaatggaaccccagcccttccaggtctgagagccactctttctttactctggatttctgtcacatcgggggcccctccctctgcggagttgcatgttgctgttcctgatgcacagactcctcccccgctgcttttctgcccactgggtcaggatctgccattctttacaagtttccttaacgtattgcgtcaaagcgagacaaccgagtcttactcaaacttgttttaaccggagatggagggttgctgctgtgtcaccgcctgcacagggctgccctcaggccagcttcctggggcttactccaagggcatcggcttgccccgcactgtggtgggatgtaaagtgataacagctaaacgacgcatgcacaacatgtcctggtgccttctgcgtgaccccagagcagcaggttctgcacatggcagcctggagtgcaatggcacgatctcagctcgctgcaacctccgcctccccggttcaagcaattctactgcctcagcctcccgagtagctgagattacaggcccctgccaccatgcccaggagatacttgagagggaccatgcccggctgaagccccgtctcgtgtggaagaatgtcatctccagtgtctgctgcctcctccctgcaaagtctcccacaagcacaggacaaggggtgcttccaccatctcctaggagctgatgacatgtccagaccaggtctcatgcttggtgcctggtgccagggaactgtggaacacgtcgcagagagctcaagcgccacgtttggatccctgagcagctgtcacaagcctgcacccaggactggggggcctgctgcgagagcccaaagggaaagggagaatttccaaggctgcatccagctccatcaggcccagtgaatttccacacagcccgggtcaccacgctgttatgaaatcaaattccttctgtgacccctagtatgtaccggtaaatccagctggagggcgggaattccctagctgctgctgtgcttttgacaatttttcaagag

SEQ ID NO: 3483 - DNA, 1588 bp, Homo sapiens
gaggggcgggagcccgcgggggccgcgcccttctctcgcttcggactgcgcaacgctgcgctctgggctgacaggcggataaaacggtcccatcaagactgagaaaaagcacaccagctattggcacagcgtgggcagtggggcctacaggatgactgacttagtctacagagatcccggcgtacttaagcaggtagtaatgatggacaggtgaggctttaggcggccgccctgggatctgaattgccccttggcccttatcgaagctgcagctgcttccgcatagctgctgtggtcaaaaaggagcccagagtgacagttttccttgacggtcgccgttctgtttgttgtaactgatctgcaacattttgggaaaatacagttccattgtacctgccacctttcagctgtagccagagacctttatcaaaatgggcttgtttccacagaacagcagaacggttgggggtttgcatgtacagttaaccagcataagactcgtactgggaaaatccagctgggatgtgacacagcttaactgatagcttaaggcatcagtattgggaccaaaggctggtcagatttgtatcattctgaggaccaaatgatgggaacaataaaattgttcatgacagttgttctcattttgctgtccagatgaagactcttaagatgacagaaggtgatttttctggtgatcgaggacttccggggtaatgacagtgatgaaatgcaggggacctggtaggtttcttttggagactaactgggggctgcctggtgggacagaacagcatgtttccaagggctgtggctggtcatagccatgggatctccaactgcatgcaagagcaacctggaaagactttgacagcgcaggtcagtacaatacctgcaagctgccactcagctttcctataatgtttcaggaccagggctggaagccttccatgtgtcaacttcaatgtagatgggtttttttttttttttttttttgagacggagtcttgctctgtcacccaggctgctggagtgcagtggcatgatctcggctcatggcaacctctgcctcctgggttcaagcgactctcctacctcatcctcccgagtagctgggattacaggtgcccaccatcacacccagctaattttcttgtatttttagtagagatggttttcaccatgttggctagatgggtctcgaacttctgacctcgggtgatccgcccgactcggcctccccttccaaagtgctgggattacaggcatgagccaccgctcctggccagtttagttttcacgctaagctttttgttctgcaggttgcccccaagtttcctggcagtgtgtgatactgaggaggtgagcttgtttctggagctgtgctttaagattcatgttacatgtaaagctgtcctcatttgtgactatggacctatggagttgggacaatctctatgggaagcagaaggcaaggaccccggtcattttaggtagaaacaacagcatgctaatgcaaaaaattatgcagtgtgctactgaacttcagaggtgatcaataaaagaagaataaaaagactaataaaag

SEQ ID NO: 3484 - DNA, 1813 bp, Homo sapiens
acacctcccaaaatgcagagaaggcagggtggctaggaatggctctagtagaattctccccttatcttgtctggaaacaaggggcaaagagctatctatttcctcctgccagcctcctgcccccaacaggattcctcacatcccaggaccagctggaaaaggtggtgagagttggaaagagactgctcagtgaggactgccctgcgaaccagcttggattcatcccgttcacctccacgttctgcactcggggccgagggaagggaggcagcccaggcagctagagaacttgatgaaacacactcaatctgaatctcgcttgatcgtcatgctgacccagtgagtctactcagggtcaggcatcctttccgactactcactcagcagcggatccccacccgcctctgactcccagtgtctttcggctccaacgtaagttcaccgaacgtctaagagctgaggattcaaaggcatgtaagaccgcccctgccctcagctgcaagacctgtccgcgatcctacgagccccattccgccctctttccccgaccttggtcccccatgggccctacaaccaggtccccgactgacaccttgaccagcgaacacagcaaacaggcccgcagatgccgcaggtccttcggcaccgtctccagggccatcttcgccgatgggaagaacaacagggagatagacgaccacagcctgtgcacccgcaggaagtaaatagctcgttacccagaatgcccaccacttccggcgcttagacttcctcttccggtgtgggcggacgccagctccgcccctacccccgccagaggagatggtttctcccgccagcaggcggggaggctgggcggccggccgccacctgggccggagcgcgtcgcagccacctgagcccgccgagggcgcggcggaggctgtgtggggtagtcagcgggcccccggggcgggggggcggctgcgcttgcgcgggagtgtgtcgggctgagccgcagcgccgagacgcgggctgtttgatctgggctggtggccctgggcgtcggtcctgttccccgatggtaacccgaagtttgtttttttttgttttgtctccccgttttagaagcattgggggcagtgaatccactgtctccctctggattgtctctgcagagaccgagaagaaatccagggacagccccacccctccttcctaactgcgagagcgctatagggtttccacttgcttcccacaggaatgctggcctgggagctacggcggaaaaaaatgcgtatttatcttttaaaactccgtctgtttgctcgttccggctgataatttatactttgcgcagttcttagcgcttagacacggttcctttactaaagaccatttgtaggagattaggtgtcctttttttccctttcatttcaccgtctaggaagcgaaatgccttgttctataggcactaaaccaccacccctaccaaacctttctcggggaagcagaaggggaacttgtgccttgtgaggaagcgacaaaggccccttctggccctggagacttcacgccaatggagcaccagctctctgtcctcgcaatagcccgagtgcaggcagaacgcagtcatttgtgtttatctgagaggagctttgggatataaatagtttcaggccccgctgcgctgtcattccagcccagcctcctgattgagctgcttccgggcgggctttcttcttgttggcggtcccatgctgtgttcagatgggctctgtgacaggtttggatgttttctatcactgaataaaactttccactttggaacata

SEQ ID NO: 3485 - DNA, 2483 bp, Homo sapiens
aggtttaaaaccaggacaatactgcttttcctttatttaaaaaaaactacaacctagtgactgtattggtcataagcatgattgttgttgcaatgtgctacttacaatgaatgactgacagaaaacaagctagggatcctgtctgcagcttccagcctttcctctttttatttcagtaggcatcaatgataaatcaatcttatgtacaatttcttacaactagcccctttacctttggcaagattacttacaactcatacaacttcttaatatctgagaactatttaaaatattctaaatgcataaaaataaagattttggcttttgatatatataatatttattctgttactcaaaatggaagctcaacttctcccccaaaatatagctctgctgggcagttgctgatatgccctcctgggaattctggcagcatagcgtgcctctctgttccccagcctgagcacaaaccactcttcttgatctctaatacaggccactactgacaggaggcaggtgaatggcctgaaaaacaaagggagattgctttgcttcctgttgtgttttacatttcagtaaatgtgcttggaatatagattcttgttcagatactttgcctctctgttgccagagatttgtaagggggtaagggaagagggagtacagaaagcaacatttccttgacttctttagcctaattgcaaggcagcttttctctaggaatgctttttcccatgtctttcaaaatcacccctcacagtactctgggcctggacttgttccttgggacctttgggattagtgaaaagagtactaatcaggagacaaagtctgttttgctcctttgaccgctaccccctgctccctgtctggtatggacaagatacatagccataatgattgcttaaagttcaatttcaaacgtcttctgtaagtcactggagaaagggttggtaggggagggattagtacgctgcttggacttattttctaatgcagcccactgggcttcaaaaggatccactgggcaggtgcctgtaggaacctctgtatgcctgtctgctgaggccaacctgccatcatctacaccattgaaagctgcagaaccgttgaggtgctgagcaggaggcttaaagaagggactggtggtagcactgcttgcctcgtagtgagggaatgtctgctgcctgaccaggctgggtgactgatggggctggatagggcattccattggccacaggataggactgggcagggacaaaggctggttgcagggctgggaccacacccactggcacaggctgagaggtgaggaatgcattcccttggaaaggtgatgctggctgggagatggcagtgggtggaggaggctggagaactggctgcagaggagcagctgaggcctggggctgctgagcccggacgctcttagacacctcttctaaccatcggtcggcctcagagggagtacgtctatgaccggcctggaagagacctggagaggcagcaccagaagattgaccccactcggtccctggaaccaacaagatgagagacaaaagaatcagttaggggcatctttcctcaccttataatcttggttatttgaatgatcctaacatgtacaacatgtccccccctaatgggacattttgtggttttgataggtaggagtaaagtctctattaccaactgggattttgtggtaggatgaagaaaacttgtcaagaccatgctgctgtgtcagccacactgaagcactgtctagatatggctcaaatgcattaaaccacggcagctgactgatgtcagaaacccctcgctgttgctatggctcatccacaatacagaaactagctggttgtggtagctcacacctgtaatcccagctacttgtgaggctgaggcaggaggactacttgagcccaagagctggaggctgcagtgagctatgactgtgccactgcactctggcctgggcaacacagtgagaattctgtcttaaaaaaaaaaaaaggccacgtgcagtggcttatgcctgtaatcccagcactttgggaggccgaggtgggcagatcacctgaggtcaagagatcgagactatcctggccaacatggtgaaaccccgtctctactaaaaatacaaaaattagctgggcgtggttcatttgaataaaagcatgcagtagtaaaattttgaactggattaaatttgagtaaatgtaagactgtgggtaccagttgagtcccattctgattgtgacaaatctcaaccaccaactctcacaatcctttgtagatcttgggactcaatctctttgcagttgttgtgcataacaatgaatattatttggtggtattaaagaacatgcttaattagtgaatagtctgaagaccactaaagcatattagataacagtaatacaggttaaattttctagtacagatagcatgatttttcccccctttggcttcctggtgca

SEQ ID NO: 3486 - DNA, 6080 bp, Homo sapiens
actccccgaaggcttctcagctctagcaggaagcctccaggccgcaactccttcccattctcccttctgtctccaaagatctccccacgtaggcaccaaatggaaggacccccgcccaaggcctttgtctccagctgatagattctgctccatttctggcatcagtgaaacgcctgaacattccacagcccaaagccgaacactatgcatgagataaacttacctcaagctccactgcctctgctttggacagatttaggaccacagccgggaaaaatgttggagaccccggaaccgccatgaacagcccccaccaaggagcggcacttccggccccgcccgctacgtaatcagtcggcgccccaggcgcctgagtccccgccccggccacgtgggcctccgaaccacgagtcatgcggcaggccgcacccagacccgcccctcccacacgggacgtttcaataatgaaagcgctaggtgctagtgtctcaaaaatcagtaaaactttattcgcttccattctttcgccattaacagaaaactggagaaagcaaaaatgtttcgtgtttacaaagataaacggcctctttacccagagatcaaaacctcaaacgacaagggggaagataaaaccgccctcccccacatcccctgagctgacccttgtcatcttagacaaagccttcagtccactggccagggaccctgtatatggccaattcaagaagagggccaagaaatcagacccatccattcccgtgatataaagttgaacagaagctacaccaagggtcaagtgtctgtattttacaggacacagtaaccaggcggctacttataaaaaaaaacaagattcatttcaggcacaacttttttatttttttttgttttgtttttaaatcagtaaaagaaaccgggtcctagaagctgcagtgatctaagcagcagcaagtttgtgcattcattttttttgtttttgtttaaatatgtttaaattatcacactgctggcactcctcatttgcatgaaattctgcaccatacttactaattgtagtaaagttaccccccaacccacgaaaaaaaacctactctggaagaaaattttcactgaaatataaccaaacttctttaagtggattgtgacaagattataaatgatatgaaaaataacattttaaaatttggccatcaactttaagaaatggtttgcctatacaaatttttgtaatttttaaaagataatatattctaccctcatatggtcctcagaattaaagcataatgaacaggaagaaaaaggaaaagaatgcaactgagtgctaaggcagaacatcttgccagaagtaattaatgaaggtagagtatataatgaaaagtgcagaatttcatagggccaacaagataacagtctatatttttcacttacacaggcaaagtggattctgcaattaccagttgcgttaaatgcaccaaataaagctcctaaaattgatactataaggcgccaccttaagtttttccaggctgcaactgtgcattatttaaaatggttttcttaaatttatttatttttttaaacataacacgaggaaggtgttaaaactggtgtaatagctcaatagaataagtattccagatttcgggagggatgaagagggagatattcagaacccttcaccagattccccccaacttgatcatagtggattaatggtgtgctttgtggatgtggttagtcaatgacaccagcttgacggatctttctttctgcaccaaacccctgtgggggggagaaaaaaaaaaccctgcagttaatgatttgagcgcacaacaatcatagtacattcactattccgaaatgaaactacaaaagcattatttttaatcatcttatgcagtactaattctttcctagaggagaaaatccacagtaagcactcctgacccattcattacctaaactgtcttcaaagcatcaagaaaagaaatgtgcttcttactgtaagcaaccattaggttagggggctgaaccaatgtgtagaaagtcctaactagttataagcaatatggaagtctccctgcttcattaagtttcctgacctattgtttaaataggaccacatattttatgttggtctatcagttggcctcccccaagccttgtatgccctcataccattgagttatctggtccccttggctgacgaagaaccattaggcgaggagcactggcatcatccagagtgatattcttcaagcgattgaccaaccgatcaggtcgaggagctgcaacagccttggggccctcactgtaattaagtcaaaagatgagaagaaaccacacttggtgggcagacagcaagcacttgcaaaggagtgtgttttccacctaactgcccaaatgactcactttttatgatgggactcttgcctcatatacctagctagaaagacaggacagacaagtttgtttatgtattattatccccaactcaaggtcccaacttaataggaatggaaggaatcatttgcagaccctagacttgaatgcaatcaagagtgaccagttccacagatgcataaaaaaacaaggtagcagatgtggtagctaacacctgtaatcccagcgctttgagaggacagggcaggaggaacacttgagcccagaagttcgagatcagcctgggcaaaacagtgggaccatgtctctacaaaaaataaaattggctgcatgtggtggcgcatgcttgtagtcccagctactggggaagctgacgtgggagaattgcttaggcccagggggttgagtctgcagtgagtcgtgatagcgcctgggtaaccgaatcagactgtgagactgtctctggggaagcaaagcggcattatgaatcagcatggctaaactattagaattttaagtagcatataacctagaaatgacttaatggaagaagaagaatttggcaaaaattttaaaaaacatgtactaaacaatctttttgtattcaactagaagtaggaagtatcaagaaataataagtggcagaagacaaggcacagaaaagtgatgtgacaaaacagagactataaagttgagacactccagggtagttactaatcaaaccacaacaacaaaactcaccagactcgccaaacattacaggcgctgcacttgccagtgcgctgattaagaatcactgagaactccacctcatctcctgcctgtagctcaatgccatcctgaacttctttcacatggaaaaagagcttcttgctatctcctacttcatagttaatgaagccaaactgaaaaaaaaaagtaggtaaaaaagagagggcatgccacacctcactctgaatgaagcacaatgcctgcccctatctaaaaggatgtataaaacatggtattaatgttgatactccagtccagctgcctgtggcaaaacctgtcagggaagaaatgtatctctgaaagtgccattcactatatcacaaacttgaaccaaacaaataaaacttgccttgttccttcgtatattatgaactaagctttttgaattaagcaaactcatcaggaagctgttacttcaacatatatattgtttggatcccctctagaattaagctgggttatagtagcagccatacaaaatgttattattctctgtactgatgaaaaacattctgaggactcagatttccctgagatctcaggagtaagactaagtttgtttgccctaagcttattttttaagtacttttgaacgtggtttctgtgtttgtgtgatatgcaaaagaagctctaagcaaaagtgtacaaaaccatatagtccttctattctggaaatctcacccctaacttattttccccattgcataatattagttactaataccaatcttactttctcattgctaatatagtcactttttgtgtagttttctgtttttattaagctacctcaaatgactgaaaaaaggtgaagtagaaataaaaaaacgaatgaatgttgatgatttccccttggctgaaaatatttgaaggttttggttaccaactcatagaaggatcaaattcagatacagagatgctggcacttacctgatctttcacacattccactgtggccctgcgcaggggtgtgatgttgtaagccatagtttgtgcattttggcccaggacacacaattggaacttgacgctctcccctttctgcaggcaatcccctttgttggccatcccaacgatgccaaatggatagacctcacctttcatatcgcctgtaaaacaggtacaaagtctaaaagctagtatttcacaacagtcctctgctgatgaccctaggaagtttatataactgctaaaaatgtgttatgttacttaaaatatatttacattttcagtactcagaagtttcaccttaaagcttaaatgaaatcctaaatgttaaatactaccatggaaccaaatgagaatgtcacagctcccatcagtactttattagctgatgaacaattttaaactgcatttataaattaaaacaaaaaatactgtcatttacaatcccattgcctaaattttaagcactatgggttgccaatattcacaggactatcttcttcccaagttcacaatatgagccaaccaaaaatacttttgtcccatactcaatgagccagtaaacaactaggcgggcacaggcaaaaacaatttagataaatttgacaccccacctcctttttttttgttcgaattctggctccctcacataggttcctttttccagatcagagaccaaaaaccattttcctaaagggccggagagtattattttaggtttgcaagtcatcctgtctaaccaactctgctgttgtagtgagaaagcaacgaaaaacaatatgtaaacaaatggttgtggctgtgatcacaagaaaaggccaccatatatgctgagccctgccctacagtatgaagttgcctggagcccggtgcaggctacagataaaaactatgccaaagaattcagctgcctaacaattttcagcatccaggcaaatgtactcagtcaacaatagtggaaaacatgagaaaaacaggtgggaagcagaagcttctaaccatcctcttgatgattacagggtaagtgaagaatttttgtcattgttattgttgagacagggtctcgctctgctacccaggctggagtgcagtggcgatcaacggctcactgcagccttgatttcctgggctcgggtgatcctcccacctcagctcctgagtcgctgggactacaggcacacaccatgactggctaatttttgcattttttgtagagacagggttttgccatgttgcccaggctggtctcaaactcctgggctcaagtgatctgcccaccttggcctcccgaagtgttgggtttacaggtgtgagccaccacacctgacttttttttttttttttgagacggagtcatgctctgttaaccaggctggagttcagtggcatgattcagctcactgcaacttccgcctcccaggttcaagtgattctcctgcctcagcctctgaagtagctgggattataggcacccaccatgatacctggctaatttttgtatttttaggagagacagggtttcgccatgttggccaggctggtctcgaactcctgaccttcaggtgatctgcctgccttggcttcccaaagtgctgggattacaggtgtgagcccctactctcgaccccagctgacttttaattttaaatacaggaaccaaaaaactttgaggagataatccaaagagatcaagtcatgggaagagtgattagaggaagctggtctgacctcatgcaatatcaataattaccatttatgatgcacatactgattcatactttatagaaccatctaaggctgaaggtattaccattttaaagatgaagaaactgagctagcaaagatttaagttatttgtccaagattatatgctagaacggtgtccagatctaggtctgcccaacttcaaagtcttagtataagttacagttgtgttcctgaataaaagagctagttct

SEQ ID NO: 3487 - DNA, 760 bp, Homo sapiens
gatggtcaagctgacggcggagctgatcgagcaggcggcgcagtacaccagcgcggtgcgcgaccgggagctggacctccgggggtataaaattcccgtcattgaaaatctaggtgctacgttagaccagtttgatgctattgatttttctgacaatgagatcaggaaactggatggttttcctttgttgagaagactgaaaacgttgttagtgaacaaaacagaatatgccgtataggtgagggacttgatcaggctctgccctgtctgacagaactcattctcaccaataataggctcgtggaactgggtgatctggaccctctggcatctctcaaatcgctgacttacctaagtatcctaagaaatccagtaaccaataagaagcattacagattgtatgtgatttataaagttccgcaaatcagagtactggatttccagaaagtgaaactaaagagcgtcaggaagcagagaaaatgttcaagggcaaacggggtgcacagcttgcaaaggatattgccaggagaagcaaaacttttaatccaggtgctggtttgccaactgacaaaaagaaaggtgggccatctccaggggatgtagaagcaatcaagaatgctatagcaaatgcttcaactctggctgaagtggagaggctgaaggggttgctgcagtctggtcagatccctggcagagaacgcagattggggcccactgatgatggtgaagaagagatggaagaagacacagtcacaaacgg

SEQ ID NO: 3488 - DNA, 5517 bp, Homo sapiens
gagacagggtctcactctgtcgcccagggtgctggagtgcagtggcgtgatcttggctcactgcagccccgacctccctcatcctcccatctcagcctcaagtagctggactacaggcgggtgccaccatgcccagctaatttttgtattttttgtagaaatggggttttgccatgttgcccaggctggccttgaactcctgagcttaagtgatccactcgcctcgatttcctaaagtgctagggttacaggcgtgagccaccatgcccagcccagacttccttctcatccaggaaattccaaaatgtctttacatacatattcttatattgtgtaataaaagattctgaagtccattactggctagaataataactagaaattgcttaatattactatacattgcatttgaacttaatctccacagtaacaattaggtagtattacttggatttcatggatgaagaaaaccaagatacaaaaagttcacacagccagtaagcagatgagcctgacttcatagtcatacatagcctgaattgagtcccagcaggagcacatgggcatggacatctaccagatttgggaactggcgtagccaagcaagaaataggagacggaatcaggagttaggattccatgcttaggaccatcccagatggatggctgcctccctctgggagctgcactcttctgaggttgcaggcatccagggccagggtgcttctgtgaggtgtgccagcacgtgccactctgctggatacaagctatcatgttctgagggctgcttccctcagcataagaaggggcttctattgggatgtgtaggcttcattgtagggtccacttgagtcttttttttttagagacagtctcgctctgtcagccaggctggagtgcaatggcgcgatcccagctcactgcaacctccacctcctgggttcaggcaattcttgtgcctcagcttcccaagaagctgggattacaggcacatgctaacacgcctgtatattttttgtagagacagagtttcgccgttggccaggattgtcttgaactcttgggctcggtgatctgcctacctcgacctcccaaagtgctggaattacaggtgtgagccatcacgcccggcccacttgaatatatatatatagccaagaatagttggctatactttcatctttgcctagttctaagtaattgattggtttcaggatccaataaactctacaggtaaatccactaaggtaatggtctataccggtggttcctgaacttgagtgtgcagcagaattacctggaaggcttcttaaaacacagatttctgtccccacctcccaggatttgattcaggcggcctgctgtggagcctgagaatgtacatttctaacaagttaccaggtactacagatgcttctgttctggagactgtgctgagaaccactatgctatatctttccagggacagtaaggatcccactaaaaagacaagaattcgatttttatcagtttactaaatcaacatcttatatttctatactaaacactagccactacttgaggtttattactgttgtgattatgtttataaaacagggacatcttgcatacccctaatggtgtgaataaaatcaactgtgtcagtacctttgagcacttcataacttaaaattctaaaaaattgagatttggacctacagtttgctatttaacagaccaggtctggtcttgacagtaaagccaccatcaaaagctgcattaagaacctcatccaggcagcttgctgtgacaaaacttaaatcctgtcgtacgttgcctgggattccctcaaggtctttttcatttctccgaggaataatgacttgcttcagtcccgctctgtgtgccgccagcactttgtctttaattccacccacctgtaaggagagaaaaaagtttttagggttaatgatcaccctcaagctgaaagaaaccctgacccagctttctttcactgaatttaaccactactattttaaaacatccaaatcatcttccgttttgttatagcatgagctaggaaagccaggaaaaaggataagtagtaacctttttttaatgtttcaattggtgttatattaaagactctgatgagggggattctaaattgttgataggtatgagttcctcttctgtcaatgattgtttttataaatgctgtcaaagtaaattggcattcaggtgtaatcacaaccgtctagtctttaggttgatctgaaaaagcagcacgtgattctgaccatgagcgccgctcctgcagagcttagctgtgtgctggggttacttccctctctacaggtttaaagccagaacctccatgctggttaatgaagaaaatgtatccctaaactaggctcctatggtggctttcaaacatgtctacaatggtccccctgcttgaatgtgggccaggctttgtgactcggtaagaaacagagtgtggtgggagtgatgctgtatgatctccacggctgagtcacaaaaaacgagagctgctgcctgaatctctcttgatcacctgccctggaggtggccagtcataatgtctgaggtcactcaagcagcctatgggcaagtccatcaggtgaggaactggggcctcctgccactagatgggaccaatttgccagtcacatgagtcaaccaccatggaagcagtttctccagcctgtcagccttcatgtgactgcagcctggctggaacctagactgtaaggccagagaccctgggccacaagaacccagctcagcctctcctgaattcctggcccacaggaacttgaagagtatggagtattcttgctttggggtaatgtgttgcatctgctccaattaagactggctggctgctccaggccttcccgccccactggcatcttctttcaaggttttgttcatgctgctgaagtactccttcaaagtaccttcttcaaaagagtgtaagatgaactgattccttgcatgtttgaaaatattttactttcacacttgattgatactaaggccatgtatacaagactagatgtaaaacattttccctcacagctttcattactattttttttttttttgagacagtcttactctgtcacccaagctagagtgcagtggcacaatcttgatagaaaaaagaaaaaaagactatttctttttttttttcctcatcttgctatgaacctgccaaaatcttgttgtggactaaaattgtagtctagtctgttgtagactaatactcaactaacaactttaaatactctcaagttctgtacattttatcacactatttttataagcagtttaggatctggagcctcaagaccccacatgtatagaaccttttcaaaatgtagtcattagatatggttaatctttattagagtttccattctatactagcaaagttttctgcagggggacaggaggtctcaaagaaacttcaaatttaagaaatgggcttaaagcttaaaaacaactactatcccattttgcacatgtgctatatctttaacaatttgtcaagtagaacaaggcctcaaattttcatgtaactgccaatatttctgatgaccacactaatatttttttcccttagcaaatcttagaatgggaaacgtgggctgaatgtggtggctcacgcctgtaatcccagcactttgggaggtggagatgagaggactgcatgagacctggagtttgagacaagcctggacaacacagagagaccctgtctctacgcaaaataaaataaattagctgagcatggtggcgtgctcctatagtcccagctattcgggagatagacaggaggatcgcttgagcccaggacttggtggctatagtgagctacagtcacaccactgcactccagcctgggcaacagagtgagacctgtctatttcaaaaaaaaaaaaaaaaaaaaaaggaaaatgtgaaaaattgtcagtttttcttttatttgatcaaaattttaaaatatgaattagttacaggcataaaaatataatatatacttaaaaccaaggttttcatagaaagaaggcaaacccgtatttaaaaataatattaattttcaaaaattaaataaaaaataaccatataaattgttttttcatacttactggaagaacaagacctctcagtgtaatttctccagtcatggctacatctgaacgtaccagccgcccactaaaaagtgaggcgagacaggttactatggtaactccagcagatggtccatcttttgtgacagctccagctgggaagtgcagatggatgtctgtgttgtcaagaagatcaaaacttccaaaagctttaaaaaggaaaaagggactttaatgtagaaaaattaaacctgttttctttttctcctaaaaaaaaagtcacaaacaaaaatgaatgttttgggtaaatgaattcttcaaaatattggtggacagtacaatttgggtgagggtgtggaagaacagttccattctactctaagtcgtattaaaacaaaataaaccttttgaattagtttctagttcaggcactagtcaaatagtcctgaaatgggaactaggatttccacaggggttcaaaacggtgtgtactttgctagatgtgtaactggcagtctcgagctcatgccagtctccgccatggaaggtaccgcctcctgggtcacgcctgcctggccgggtgcaggctcctaccattggtcagctggtacttctttgcgttgctgcggagccagctgatagcgaggtgggcggactccttcatcacgtccccgagctggccggtcagagttaactggccctcgccatccattcgactcgcctccacgaacatgatttctccacctaagggagtccaagccaaacctattgctactcctggctgactcaaacgctgagataccttgaaagaagaagaatgatcagagttgggttggcaaatgctaaaggtgactgataccacacaatcctgcaagagtcggctgactccacagaagacttcagccacttacctcaaagtccttgttacctaacatgattctgcgtcacattcagcacttactctctggctttctgccagaagaaagacctaaacttcctctttgacatttatcagaggcaattttaccttaaaatatatgtaaataactttgctttttatgagccagatctagctacacatgccctagttttcaaggaataaacccaatagttttatctaagtatctttattgggctgcaaatatatatatattttgagacagtctcactccattgcccaggcttgaagtacagtgacacaatttcagctcactgaaaactctgcctcctggcttcaagtgattctcctgcctctgcctcccaagtggctggtactatgggcgcacacaggccaccacacccgctaatttttgtattttttgtagagatgtggtctcaccatgttggccagactggtctcaaactcctgacctcaagt

SEQ ID NO: 3489 - DNA, 1509 bp, Homo sapiens
tttttttttttttttttttttttttagagacagtgtctcactctgtctcccaggctagagtacagtgtgcaatcatagctcactgcagccttgaactcctggcctcaagcaatcctcccaccttggcttcccaatgtgctaggtttacaggcgtgaaaacattgtgttgtgtgtgtgtgtgtttttttttttttttttagacagagtttcgctcttgttgtccaggctggagtacaatggcttgatcttggctcactgcaatctctgcctcgcaggttcaagcgattctcctgcctcagcctctggagtggctgggattacaggcgcccaccatcacgcccggccaattttttgtatttttagtagagacagggtttcaccatgttggccaggctggcctcgaactcttgacctcaggtgatccacctgccttggcctcccaatgtactgagattacaggcatgagccaccacgcccggccaaaaacatttaaaaaatgactgtccctgctcaaatactgcagtaggaaatgtaatttgacatatatcacttccagaaaaaaactttaaatctttctataaaatgaatttgatacatcatcagcatgaagtgaagttaaaatctcttacaaagtaaattcaggtatatcaacaatgagatccaaaagtatcggttcaagatcaaagactcatatgaggtaaaggcaaataaagcccctcatgctttcagacatttacttgttatccttaaaatgattattgttctaaggtgcaaatcttatcattcagtgacctatttgctatttggctgtttatctcctttaaataaaataccatacaggttataatgtacattttaaaatcaaatatgaaagtacacatatgtgaacaagacattaatttaaatatcaattatattcataatacagaagtctaagaatgctatttggtcatttcaattagatgctgatatatttggtcaagaaaacccacattcctatcagcctaaggcaaatagtaaatgcctctatttttattaagtggactataaacagtagacattattgtttgatactactggaatgctctcaattagaacgtacactgataacaaatatgtctttctaatctgggtgataacctcaatgattacatggaaatctacaagtaacagtctataacttaaagcagtagagcacctggtaattgtcatacagtgcctctctatgaatttagaacattctacttacattggcagtggagagaaaagaccccttcacactgagacttcctgtgcaccgcgcctgccgcctgcctcagcttaggacatggtacagtcttctttgcttttgcccttctcattccctcctctggtatcttctctgctttctggattgaagtgccctggctctcttcctggtgccgacaagtcatcgttctctaggctattgctgtctaaagctttcctgacggtctgacttggatgttctgacatctcacacctctctgt

SEQ ID NO: 3490 - DNA, 4520 bp, Homo sapiens
gcgacaggtgggcggacacagaaggcgacgcctagggctgtgttgtcccggaagtgccttctctcctcccgggtctgcgcggacgcggcctccttacctcatttgtcctcgcccctccccgtccctctacgcgttttggtccctgtttggtgctttctgtttgcagctacggcagtgagtatgtatgtgacggaccccgagtcacccgcggcctgggacccctgcctaccctccgtctcgccagccgagctgtggaactagcgcgtgccccctcgccgacctcggcgtctccggtccgcccctcacttgtggtggggcgcagctcctggtccctcagctgcgcgccgccccacgcggccgggctgcgggtctagggggtccgcatctccctggctttccaagggctaaggtcgtgattctagggcggctgggcgtccagggcctcggtgggggtggcgtgtctgccctttttatctccccgcaaggcccccagtcttctagggaagccagtcagtgaagcgcggaggtccgggcgcgccgagagagagtccagtctttgaggaccgagtagtcctgggccacctcccgcctctgctgtcagaagcagcagctgccgccgtggaatccaaaatttcgggagctgtgaccctttcctcatgtaaaacgagtagtcttggacgatctgggcataggaaccaatcagaaacaatcgcttcagcaatcaagaccattgttcatcatggaggaacccatggatacctctgagcctctatctgcattaccattcactgggcagcagtcttttgagccaagtggcaaatttggacagtatccatcgatgcagatgaaccacatccaggcactggggaagtggaggacatagaacagctcaatcagtgtttgatccaacacttccatctcattaagacaagtttgatttttctttgctttttatttcatggaatacatgagaatctcttaactgttggagtttccaaggaggcatacctcatgacttcagttaatggaaagaacaaaactaaaatgctgtatggccaaagccacaaagggaaggatccacaatttacattcttggagctatcatctgtactgtactgttgtgatctactgattggcattggcatagtagtaggggtcaagtgacagaatccgtgccagcagtctccaggttcagaagcaattcaagaccctgatgatagctctccagcaaccaacacatggtgattgtgccaacttgttgctcagttataatgcagggccagtgattggtttaagtgaagaccatggttgagatcatttgtctttggtctaatagaatttgagtctagtagaatttgagtctccagggaaagagctacttgaccaaattaaactagtagcaggtagagcatgaatgacagcatattataccatcaagatgttcttagagcagtgtatggatggatcgattgtactgccatcagttgtgactgacgttgtattcaaggagaaagagaaacttgtttagaaagcactttgaaagttttttgagtacgggggtgccctgtatcaccccgttatggttgaactttctccttcaaaattaccagacttggcagcagtggcaaattattgggctaaaagacttaatcagacatattctgggttcaaggctcctaatataatacctggtgcaaacattatacttccactcattcagatggttgcatcctgccaggcatccagtgggactgggaatatggacacttgaacattaaacatcctgaagaattttggaatgacaggttacaagtgaacataatcagttctctatattaaaaaaaaaaaaagatttgggcatagattgggctcacataatctttagagagattttttcatttttgtgaaagtacagaaattcttaactgcttatgaaatgctgattgttaaacagcatccacagctattttgtgttgtttccctgaccccaccctgaagaaaagaaaaattatggcatattgaaaacagcagtatgatgtaagagaaaagatcacaaattccttgagggtgggtcttttccatactcataagcctatttataatattcagagtaatttattgacacatattaatattccctcctatcccattaattgccaaatcatcaaacatttattgagcacctactctgtgtagggtgtaagcagtactggggacttacagtgataaaagacatagttttagccttaagtgatgtactgtttcactgaagagatggaatataagaagccaagtaatttatggaattctcttctttgtttttcttttttttttttggcagtggagtcttgctctttaaatagagcaaggctagtctggaactcctgggctcatgtggtcctcccgccttagctttcagtgtagctgggactacaggtgtgaacacagcttggaaatctcttaaccatgggagttaagtctcaaaattctggtgatacaagtggttgaaacttaaaactgtatttaaaaaataggattcgtgaatttgagatagttcataagtctgcaaaaggctgtataaatacatattttacatttactattattaattttgtagtaaatttgagtacagcactctctttatctgtggaaacttcagactctcccctattactttaatttcagtgagacattattaaatataagtgggcttacacatttgttttgctttactgacaaataatacacaacttggaggcttttttttcctttctattcttcctctaaatgttcaacacttttctgattttgtgatttgaggttgtttaatagcttcctgaggctccattgagaccgtatatacgtgacacttaacagtctagccttcctcggtacatatagatatatgatggtggctttgcctgtagtaaattcatgccaaaacataggctttcagtgcctattacatatggctttcagctctctctactgagggatgtaggagtttatttctgaggtctgagcctcttttcctttacttcctttactctttcctaagccttctttataaaaactatgcatgttctattgttttcctttttgattccctttcttttattatccccagtaggagtgacttgtaattctcatatgttagaaaggcagatctcctggttgaagaaaagatccacccaagcaagtcagcatgtttaataatttttgagggggatctcaaatgtgggaaggattgttatataagacaaccaaatgatgacatgagacaataaatgctataggaattatggaggaataattagctatttattttcttggttagggaagagatattattagttgtagaagtaattactaacttctacattttttattgtggaaatcaaaaatatatatatgaaaataaaatgttataattgacttcagtgtcccataaaccagcttcaacaattaccaaattgtgaccaatctttacacacatgcacaggtgtccctcagtatctgtggggcattggttctaggaccacttatggataccaacatctatggatgctcaagtccctgatataaaatggtggactatttgcatataacctgtgtacatcccgtattatttaaatcatccctagatcacttataatacgtaatacaatgtaaatgccatgtaaataactgttatactgtattaaggaataacaacaagaaaaatgtacatgttcagtacagacgcaattttttttgtgtgtggaatattttcattccaaggtcagttgaacccatggacataggaggctgactgtgtgtgtgtgtgtgtgtgtgtgtgtgtgtgtgtgcatacagacacacatatttctgaaatgtaaatattctcttcttaaaaaaattattatcacagctaaacaaattaccagtaattcttttatcctcatatacccggtgttcagattttctagattggctcctaatttttttacagattatttgaatctgattcaattcatgtactgtaatgtttgataacttaagtaccctttataggttctcttttacctcttctttattaaattccttgtaatttgttgtactaaatagattgtcttctagaatttcctgtagtctgaattatgtagtattgtttcacatgttccagtgtcctcttatttcctgtgagttggtagttagatctagaagcttgattaaattcagattttctctctttagatcatcaactttagatcatcaacttggatcatttgtttcattttgcttttgatatgttgttttttagaattacctcttaaaattttgatttaattttataatcatgtaaaatgtttataaatttccaaattcagatcagcaaaacacaataaaatctattcagagaaggcaaaccttctgtccagtctccatcctgttcctgctcttccccttatgggtaaccattaagagaaaattggtggttggtccttacatttaaaaatatatataatcaaaaaactgta

SEQ ID NO: 3491 - DNA, 708 bp, Homo sapiens
gcccgggggcgcccccagcgcgcggacggcgggaccctgcggcctcctccaggtctggacgcagggaggggtgagactgttctggccaaagagactggagatccagtatcagcaagctactttcttggtaaacctccatttcccaatgctcatctttgtcctctacccccacccatcccaaggcaaatgatgaaaacatctattggatccagcctttgctatcttctccatgctgctcatagtgggtctagcaatgtcccattctcggtaatgtttggtaggtctaaaacatcctcacgaaatgttccccaaatgttctgctccagctgagcaactaataacaatgggaagatgcagaaaaaaaatgcatggagcataatgttagttttgggactcgtcagtggcaacgttttagagatgccatgaagaattcctggtaataatccttcttcctacagcatttagcaatgaatactatgggattatggctaaaagatggtcaagactgcctcagccattaggatcagaattctaagttccaaagaagagcaaactcaagaggatttcctcaggcctctgactatagatgctgcctggggagaacaggtgctacactcaaaacattctcattttatttatatcctccctgaactagtacccaactccataaccccagactcaaataacagaaataaaagccatctcact

SEQ ID NO: 3492 - DNA, 3286 bp, Homo sapiens
aaacctgcagttgcctggtcagtggatcccatgtgcagagggcgagacggggccctggccaggcgttgggaggcgggaggctcggccggcgctccgggtgaggatggcacgcccccgcccttgcttctgcgcacagggaagacattcggccccgaacttggggctcaaaacggttcagttcgctgcctttcccatcctgacccagccccgggttttttccgaagccgccgctggataggttgcattactaggcttcccccagccactctccctgcccaaagccttcagaagccgcccctctccccttcacctggcccttatccactgtcccagcctcatttctttccccctccctgaatgtcttctgctcccctttccttgggcactgcccttatcctggggtcctggctgctgccattcctggccctggaaaaccagtgcggaacccaaagaaaggtggaagagcagcttttagagaggtgtttttattctttggggacaaagccgggttctgtgggtgtaggattctccaggttctccaggctgtagggcccagaggcttaatcagaattttcagacaaaactggaacctttcttttttcccgttggtttatttgtagtccttgggcaaaccaatgtctttgttcgaaagagggaaaataatccaaacgtttttcttttaactttttttttaggttcaggggcacatgtgtaggcttgctatataggtaaattgcatgtcaccagggtttgttgtacagattatttcatcatccagataaaaagcatagtaccagataggtagttttttgatcctcaccctccttccatgctccgacctcaggtaggccccagtgtctgcggttcccttctttgtatccatgtgtactcaatgtttagcttctacttataagtgagaacatgtggtatttggttttctgtttctgagtgagttcatttaggataatggcttccagctccatccacgttgctgcacaggacatgatcccattcttttttatggctgcatagtattccatggtgtatatgtgccacattttcttttttttttttttaaggcagagtctcgcttggttgcccaggctggagtgcagtggcaggatctcggctcactgcaaccaccaccttccaggttcaagcgattctcacgcctaggcctcccaagtagctgggatgacaggtgctcgccaccacgcctggctaattttcgtatttttagcggagacggagtttctccatgttggccaggctggtctcaaactcctgacctcaggtgaaccacccgcctcagcctcccaaagtgctgggattacagacatgagccaccactccctgccaccacattttctttatcctttctaccactgatggacatttagtttgattccctgactttgcgattgtgtatagtgctgccgtgaacatttgtgtatatatgtctttatgacagaatgatttagattcctttgggtatataaccaataatgggattgctgagtcaaatggtaattctgtttaatcatgtcccatttgtcaatttttgctttcgttacaattatttttgggatctttgtcatgaaatctttttccgttcctatgtccagaatggtattgcctaggttatcttccagagtttttatagtttggggttttacatttaagtctttaatccatcttgagttgatttttgcatatggtgtaaggaagtggttcagtttcaatcctctgcatatggctagctagttatcccagtaccacttactgaatggggaattctttccccattgcgtatttttgtcaactttgtcaaagattagatggttgtaggtgtgtagctttatttctgggccctctattctgttccattgatctatgtgtctgcttttgtaccagcaccatgcttttgtaccagtatcatgcagttttggttactgtagccctgtagtatagtttgaagttgggtaatgcgatgcctccagctttgttctttttgcttaggattgctttggctttttgggctcttttttggtttcaaataaattttaatgctttttttttctgattctgtgaagaatgttattggtagtttgataggaatagcattgaatctataaattgctttgggtagtatggccattttaacaatattgattcttcctatccataagtatggaatgtttttccatttgtgtcatctctgatttctttcagcagtgttttgtaatttttgttgtagagatctttcatctccctggttagctgtattcctaggtattttattctttttgtggcaattgtgaataggattgcattcttgatttggctctcagcttggatgtcgttggtgtataaaaatgctaccatattttgtatattgattttgtctcctgaaagttagctgaagttgtttatcagatctaggagcttttgggccaagatcatggggttttctagatatagaatcatatcgtctgcaaacagagatacttcgacttcctttctttttggttgccttttatttctttctcttgcctgattgctgtggcgaggacttccagtactatgttgaataggactgaagtgccttgttctacttctcaagagtaatgctccagcttttgctcattcagtatgatgttggctgtggttttgtcatagatggctcttattattttgaggtatgttccttcgacgcctggtttgttgagggtttttaacatgaagtcaagttgaattttatcaaaagccttttctgtatctattgagatgatacgtgagttttgtttttagttctgccaaaccttttcttttaaagcccaacgaataaaacccatcacctttcacaagaccaccacagcaagtaggcaggaatgccagtgttaaaagtgaaatcttttgaatttgtagtacctttccttttccaaatctagctgaaatttctcacttgttttccttttgatgaagctaaccaccggcatttctcctaagaaatggatataaaaaaagtttgatatggttaaagtaagaagtgctagctcctagaatatctctggatattgctgtcccttgttacagagcatgagccctgcccaaagactggagtgtaatggcatagaaaaggtcaggagcccactgagccagaagtataggaggcttgcgacaaagtttaacaggggcctgttgctatcactgggtggagggacagatgggagaacactcacaccatggaatcttaggcagccattaataaaaataagccacactg

SEQ ID NO: 3493 - DNA, 566 bp, Homo sapiens
gagcttcccaggcgcgcgggccgcgaggttattagaggtggagcgcggggagggcgcgcggcgggaggcggccgccgttacggcgcgagcgtggtcacgtggccgctggtcaccgccgccaccccctcccgccctgttctctttcaggtcgggccgggcccggccgcttccgcgagcgccctgcagactgagggagagagagagaaagaggaggggaggaggaggaggattcagggaataggagctggggagcccttctgcgccacagtgatatcagtatcaagataaaagtttggaatgggagaaaaattctcaaagcctgaaagaaaatctgagatgcttggagtgtaaagatcccatggtcacataaatccggaaagcactgaatactttgtttcccataagagaatcccattatatgttgatgtattaaaagacctgagaacctggtacttgtgtttggagaactctattgtactgagcctaagtcatttttgatctataacaagaacatgcattttcacatgtcaaccggatttgtggaccagtaaagttctcccacaagg

SEQ ID NO: 3494 - DNA, 1951 bp, Homo sapiens
caagatgtggagggcaatatgcctctctctgggttcgccacgggatcaagttgcaggggctgtcactggcaacacgcttctgcctgaacggttctgtgggatgagccccagggaggcgctggcagcctcacaccctcccctcccagtcccgccccttgtgttggctgcctttgtttctccaagacggttttctgatcaattaaaatcgtgtagggtcttaaatggtaattctgccttttcaaataaacaaaggcggagaacaaatgggagggtaagttttaataaaccttaggcatcatttcctcctgctgtgacactaaatttacttggataaaaacaacctcttagatttacattttgattctgttactgctttcatgtgtgcggggctgtcccacttcagatgaaatttatccacttctttaaatatttagtagtctagcgtggatgttaatgaaagtctggcggtgctattttgagaattgcaacaatgatagtaattttcagtgtcagattcctgcttcgcaaagggaaagagggatgggagaagggggagggaaaaatggtttcagttctaatagagtttgccatccgctgggccgtgccagacagatgggtcatgaatactgtctagacgctctctgcctgagcgaagccctggtctctaaggacacgcaatgagacgccggcttaagtaactggggaaagtcagggcaagctctcctgtaaccagatagaaatcaacgtgatcctgcttcctgggggaggccaaggggtggccgggagggtgtagggagagggggtgctaagagaaaaggcccgctgttactgatcaattttagtgcaaacttgacaattattaggcattagggagagcgtgaaaggacagttgtaggatgataacactattgatttaagccgtactgcccagaatgcagaatgatatatttcagacccaggcttcaaaggccggagaggagctggggtgaaaaggaggatgttgtcgtgtgtgcttaagacgggaatgcagcccgcggggtgacctgcgttaattgtgtatattaacacactcagcactgctcttgtggaaaccgttggtcttgactgttcatttagcctcttaatttgcaagggttttagaggcttaccaggcttgctttctctttttatgaatttctgcgaatttcttcatgctgggtctcttccgggcagctccacaactggcagagctgtaggaaagcgggtaaaaaaatccccagcgcctgcctggctgcgcttgggtgcctgcgtagtcgtgatgcttgtcttcctaattattttctgagtggcggggatggagtttatgtgatgtcagaagtgagtttctgctcatgaagactcccagtgtaagtgtggtgggagtcgggaaggagatattgaggtaaagatgagattggggggcggaggctgggggaccaccgataaggcgggaggtgacgcagcagcttgccgttcggctgggaggtgctttgtcgcttggtttgatggccgctaatcacgtcttggtcttgaaaaaaattatccaaaagggtactacggtgaaacttggaagggaccatctttgagtaactgaagaaataaagctgaagtctaaagctgccatgagatacgtcgtggactgcagaggtgggtgaccctccgagggctggacttctggattcatcctctgggctggtgcctctttcagtcatggcagctttaacatgggaaagaaaccccaacaacctaaactttgcagtaatcattttttcactccttcatccattcttgttctgtcccaagagctaataacagagggaaaagaagatattttttgcttccttcccagaaagaaaacagagatcaaagataaaaaatattttcaaagtagacaatcactggagagggaagaaagaaatcttgtttcaggagt

SEQ ID NO: 3495 - DNA, 2893 bp, Homo sapiens
ggtagagacgggatttcactatgttggccaggctggtctcgaactcccgaccgcaagtgatccacccgccttggcctcccaaagtgctgggattacaagcttgagccactgcacccagcctggaaagtatatttatgaaaggtttgcactccacaaaagcatctttgctagggtgtcaaggaagagatcactaaaccaaccccaacacatccatacaattccagcaatctagagagggctggtccttttccttttctggattattttctgttctcagtaaaacaagtatttactgtgatactgaaacactgggaaattaacactgattaagatattttaaacactgagtcttaattataacagaaccagttttcatcagaatgcttttacgtcacattcagtgaagtgttacgctaatatattctacagccctgaagatagaaaaaaggtttctctccaggtatgagatatggtacaaaaatacatttttccacatacaaaagagagaaaaaaacaaagacatgtggcgggtggcgaggggaggcccaatcccaacaccctacaaggttccatggaatggagaaggaacaaaaaaatccccaattattttggggtaagatgtgccccagaaaaggtgaaatctatgcaataaaacccaggttttcttcaaatctagcatctaggatttctatcagagtttcaaataatcagaatttctatcagaatttctaccctgaggtgacacctactaactgtaggttctttcattaaaaatgaagacatctttcaccagaatgtatcaagctataaaactggcttcagagcctacacttagccagagtggaaaaaaaaaatagtgcatattttcgacagcaattttgaattgatgcttgaggtctcaatccaccagcacccagatatcatgttacctccctcagttgaatacaagttaaaatgatgatcttatcgagatctcaatagagcacagtgcccttcatgtttcgggtaagagggtgggaggaggaatgaagcgggtattacacccagcccagtgacagcttaagccttaacatgcgggcatcttacaatgaccataaacaagggaggggccaaggcagggctggcgatcattagctttgcgcacagaatgccatgttttcccctggccaacataagcaaagctgttttagtacctaaacgtggtatagccaaatgcacaaaaggaaagaagatagagatgacctcccgagttatttataccttgtgctaaaatagattcatctacaagtatctaaatgacaaaactagaatgatttcaacccagtaatcctgtgttccaatgtgcatggataaagatttgatctaggcccagcgcggtggctcacgcctgtaatcccagcactttgggattataggggtgagccaccctgcccagcctgctccagcaaatcttaaatatccatgcacactgaataaacatgcacctgaaacaggtgcacgtttcaggaagtgaatggaactctccaggagagtttgggtcccatcatgtgtaccttagaaacagaagtctcaaaagtctcaacaacatccacaaaaacatctgcatctgttttccagatacttgcaaccaaaaataaaacttcacaggaacactacacaagaagtggtagacagctaaatcttctccaaactgagacctggaccataaggtcttggttgtagcaggtctggcaggggttatctataaacctgcacgcagggcactgtgagcgggttgccagggtacatctgtggccaggtaagggccacagagacagtcgtgatccccagcagcttcaaagctgcaaaatgctgggcttttttttttttttttaagatgaagtcttgctctgttgcctaggctggagtgcagtggcgtgatctcggctcaccgcaacctccacctcccaggttcaagcaattctcctgcctcagcctcctgagtagctggactacaggcacccaccaccatgcctgactaatttttgtatttttagtagagacgggggtttcaccatgttggccaggctggtcttgaactcctgacctcaggtgatccatactcctcggcctcccaaagcgctgggattacaggcatcagccactgcgcctggcctagggctttcttttttaaaaaacaagtcctaacaaaagggggtttctaccagcccctgagccacaccttctgaaactcccttgcccaggatccccacagctgtccacctcgcaagtcccactctctgcccacagagactgcctaaaaggaggacacaacagatttcagataaaaagcacctgtgtatcgtaaatatttcaggaaaaagaattcagatcttttcaaaggcttgcttattgctgctaattgttcctgaggatctttctaagcagcaatatacttgagaatattagctgctactgtttgttttccctctaaggtcctgaggaaatcaaaagaaaaaaaaaaaaaccctcaagggtatagcttttgtatatagccctagtgagcaaactgcaaattgggacatgcagtagattctggagcaatctccaatccttaccaggtacttcctggcatcaaatccccaggacatttcttggcccctccttgcattttccgtttcaaaatgttgaggttaaaatacatcgaagcacagagggaagaaaatctcaggtcttctagaaatggcgatgtcttcatttaaaaataggactgatgggggcttggcaggggtctctaggatccaaaagaggttgagttgcatcctgcagcccaactgtccacatttagaagtgacaacattcatgaactaagtcaacatccaccaaaaataacatgaaataaagctcacagttt

SEQ ID NO: 3496 - DNA, 570 bp, Homo sapiens
gagagaaagaacagaccagcgcccttcccgactacatccgaaacttcacacagggtgtttctgagcaccagcacttccagcgcttcacttaacggcataaagcaaaacaggaccttggcacaccgtcagctcgaactcaacactggcagccaccgtctcacccctgcggaggagcgctcccgtctcccacaggtgccttaccgcgttccctcccgctgctttcatttttctgacctaataattacgggaaatggaaagtctgggccagcatcaataaaatgacaccaaaaataagtagatgaaatcaaatgaatatgagaacatcttgttcttcaatatcacgggtttttgttaatgtttcataagtaattctccccacttgatttttcttctataaaatcccatagaacaatgtttatgctatagccatttaatatatgtacaaattgtaaagaatatgtataaatgttttacacgaatgtaagagcatgtagaagccaacatataaataaattgtttaaaaaaactgtacagtaaattctcaaagcactttttcaaaacactttttgg

SEQ ID NO: 3497 - DNA, 846 bp, Homo sapiens
aaccggatgatggcagaaaccaagggagggcaggcagagcggaaacgagccaggaaaagcgacaagtcaggaagaccctcggctcctatcccgccccaccgcagggccccacacagcctgagcccgggccccgaaaggaacgaggcctcctgcgcctcgcggagacactcacttttcacctgaggccaccagctctttgccctcgctgttgccaaacgcgtccgtctccccggggccgtccttggggccgggcgccgccggggcagcgggtggcgacaccccgggctgcggatgcgtgctccccttgcccagctcctgcaagatctccgaaggagagctggacaggccccgcgcgaggggctccgccggccagccgcccccgccccaccacgggtggagtcgcgcggcggcagccgggcccgcggccggccgtcccccgcctcggggacgccggcacagggtgaccaagggctgtgcccgccgcagagtcgcgctcacgccggcgggcgaccgcaggagcaggtcccgcagcatccccgagcctcgcagccgcatcatgccgccgggtccgtcagcgcccgctcaacaggggaggatgctccgggcgtgggcggccggtttcctcggggaacgcggtctgtggtggggcggtgagatgacagaagaggaaagggcagctacttgggtgtggttccggctcggactcccgcagcggatgcgggtgctgctgctgctgctgctgctgctgctgctgctgctgctgctgctgcgcgctaggattgccgcgaccggttctcttcgctccgcctaaggctccgcactgaggctaaagcgcaggggagggct

SEQ ID NO: 3498 - DNA, 12072 bp, Homo sapiens
gtacagcccagagaggtatcagctcgtagcccctcgagtcctgccacggactccgcagaggtggacgcgccgcggagttgggggacggctcccccaagcagcccgctcttcaccgcgcggaagcaaacttagcggcgcggccagccccacagccattttcccgggaacccgaggaagcggacgaggaggcggctgcaactgcggcggcggttcctgcagttgctgccgctggtcaatggctggccccttcccttgcgctcgccgtgccacttgcctagcatccctctccccacctccaaagcttccaactgcaccgggacctcgggcagcagcagctgctgctactgccacttcgtccattcagtatccccggattcccctctccccacctaccaactgcgggtgaagtgcgcgctgtcagctccagagtcctcctcccctctgacctccgtgggcccccgtccgggcagcaccactcccagccgcggctgcagttcctgcgccgggttccccactcgccccgatttactgccacaatccaccaaataacaagctgttgagcagactcgcttctacacgaactcctattggctgctcatgacgccgaagagcttcggataggacctcgctacctgccgtcctcattggatgtagctgtgaaacttcatggattggtgagaaaaacagcaggtaggacatcttccacttatgattggctttttccgaaaaccaactttattggagagttggttattgagtaagcaagtcctgagaaatgattggtagagacgactccggatgtgcttgactgggcactgattggtgaattgaggggtcaggaagagcagttcgacacgaggattggcggcggagtgtcccatggaaacggaacccagaattgcagccaggggcttgcacgggggcggggcagggtctgtccaaggcgcttgcgctaaaccagcttgtcggcgccattttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaagaataagactgattttatgggaaaattaagcagatgctccagtttgagaaacctggatctgcgatctgtttgtggcacagcactttgggaggctgaggcgggcgtgagattgggagtttgagaccagcctgaccaacatggagaaaccgcatctctactaaaaatacaaaattagcctggcgtggtggcgcatgcctgtaatcccagctactctggaggctgaggcaggagaaccgcttgaatccgggaggcgaaggtcacgagtggtattcagttaagagaacaattatttcgtataagccacatcagagacgactgaagatgaaaaaactaccatccccgtatataactaatttgtgctgtgcaccaacaagaacctgctttaaatttccatggcaatttacaacccccatactgtaccaggtaccagcatcaagatgatttatggtaataagatataaaaccaaggaaaataacctaaagtctgaaaaagaccagaatcgaagtttcctgattcatattttaatgttttgaaatttatactccaggctgggtgcagtggcttgtgcctgtaatcccagcactttgggaggccgaggcggccggattgcctgaagtcagaagttcgagaccagcctgaccaacatggtgaaaccctgtctctacttaaaaatacaaaagagctgggcatggaggtggtgcgcgcctgtaaccctagctactcgggaggctgaggcctaagaatctcttgaacccaggaggcagaggttgtagtgagccgggatcacgccactgcactctagcctgggcgacagagagagagactgtctaaaaaaggaaaagaaaaaaatttatacgccaaaaaagatattctgagataacctgtagttaccactaactttgtgacaaaattataaaaatccacagccatctatgaatctgtaggcagacctgaagtttgaacgactggtgaagacatctgattttctttatagccaagttaggataacaaaatgcaaacaagtcattaatatttactatatgcaagatacagaaagatgaaggaaggagtaagaagttatccttcgtggaactattcaaagcaaaaatgcaaaataccagggaaagctttgaagaaccaagatttgagcaggttcttagaatatagattggattggatttgatttcaagaaagatgaacgtgtaaagcagaagtgggaagccaaaaacttttttccaaattagaattaagcattctttcaatgaacatttggaaatcaaggtagaaaaatatccctagggcctagctgaggagtctgtatgttgttgggttttgatagtaaccagtccaagattttgttattagacgtgggtttctgaatagacaggcatttctgaacagacatgacaggatcaaaacaatgtttgagcaaactgcccttcatctactgtggatatgttgggggatgatggaatatagtgaaagataatgggtgctcatacagcagtctagacttaaggtgattcaactactatatattaaactagattatcttttattttttaattttgaaatctggatgctcaagctctgcctgcacaaccacatgaggaagaaggaacaatgacaacaaaaataacactaaatttaaatttaagagtactacttttaggaaatagacaaaccattatttgggtacaactaaaggcaactggcatggactcaaatattttggggaagaaaaagactaaaagttctaaggaagaaaatgcgaaccttgatagtttgaaatagttaaaaagacagtgtagaaactgcttaggcagtttgattatggactattagatgatacttgggtctgataatggtataaggagaataaagtatttagggatccaatattacgcctgcagctttttccaaatagttcatgggggagggggatgtgtaagtggttaactgaagtctaactagataggtttgttgtaagcttaggatgtttacagttcttcatgttaagttgagcgtgatgggaagggaaagaatgctgatctttaaatttttgtccttagttaagttctgtatttagtgaattaattgcatcctaaaaagtcaaacttgaaaagcacattttaaatggcaaatctattttttacatgtttgtgaagtttttattttttagtaaacagaccatcagaagagaacaatggtacagagcaggggtcagcagatggattttgtaaagcatcaacttgtaaatattttcaagtttattagctgtatggctctggtttctgttccctgttccaaatgttaaagtctactgttgtattctaaaagcagccatggactgaatgtagctgtgttccaataaaacttacacaaaagcaggcagtgggccataatttgcaacacctgattcacagcataattttgtcacaaactgaaagtgttcctcaattaaagtgatttttttttcttgatttttctctgggatttattgtttttcccattccttgctaggatttaactacagaaagacagatagtaactgctctaaatattctaatttcctttatttttttgagataaggtgtcgctctgttgccctggctggagtgcagtggcgtgatcatagctcactgtagcccccaactcctggctggggctcaaacagtcctcctgcctcagcctcccaagtagctgggactacaggcacgcaccacctcacctcgctaacattttgttttgggagatagggtcttactcttttgcccagcctggtcttggaactactgggctcaagcagtcctcccaacttggcctaccaaactggtaggattacaggggtaatccccctcaactgacataaatattctaattttcaaatttccatataatagtatggagagatgaaaacaaaaggaaaagagtagaagataggaacctagcatcatactagtaagtgtgcaatggaaaagaacataggtctaagactcataaggtctggatactgttcagaaccagctgattctgtggtcctatgcagtgtgtttaatctgcagttgagcttgggctaaatgacctctaagatccttttgtcagctttactaaaatacgaaacaaattaggttttatagggggttctagaacttagcattgtataaatgccaagcactaataagtattttctagaagctggtcttaaataagttgaatgagtaattagttgagcagggttctagtacagcattaacattaaatgtatgtgaaattgtatctcacttcagtttaccaaaacactgataaatggtatgcctgctttttaggcaagtttctgacaggtaatcaataatattgaaacagtatccatgaagtctttaagttgatcaacgcatggctaaaaggaaaaccaagtttttaagaaaactttttcacactaatagctgaattttgtgaaagaaaaagtgggtagtcgtaagagtgtaggctttatgccttacctggctaggagcaaagctaagagaaccggtggagcacagccagacataaaagctgtgttccaaagaaagaatataggaaaaatataactttttattaactcaaaattttaaacaaaattttcaaactagagctcacagagattcataaataggtttcaaggattttgtgaaatcatatcaaaagttgtgtttttctagattgaggctttatagcagttattcagaatctataaagggatgtataacacaactctacagataatatgttaccagctttcccattcagtgacttagcagcttcataaactctcaacatcaaaccacactatatccttacaccgagcttccccagccacaggccacatggggccaaacacaaattcgtaaactttcttaacacatgatgagatttttttttaagctcatcagctatcattagtgttggtgtattttatgtgtggcccagggaagccaaatgattggacatccctgccttagactgaaatgtctgtggtgataaaatttcactgcattaggatgacgacatagtaaaaattcaagcattaattattacctgaagcttctctatttccgtctttgcagcttgcctggctttgccgatggcacagccccaataaccctatttagaaaaaaatatatataatcactgaattagtacactatcatatgtaattaatgactactaatgtttctataacctagtgaaaggatgctaaatgacttttaaaagcaagtatagaaaaatatagtcaaacacattctgatgaatgccaaagggctcaaaaatactaaaataccaaacaattccaaaacaacctgtatttttaataaaggtatatccaaaaatatgtaaattatgtaatcatatacactttaagacattttggggaacaggaacggaaaagattttagcactatgacaatgaaaaatgaaattatatattcctgagagacagaaataaagttaattcctatgagttcagtactctaaacccccaattttattattttgtaaatttttttaaagataaggatgcacagctgggtgtggtgggtcatgcctgtaatcccagcactatggaaggccaaggtgggcagatcacctcaggtcaggagttggagaccggcctggccaacattgtaaaaccctgtctctactaaaaatacaaaaaaattagctaggtgtggtggcaggtgcctgtaatgccagctactccagaggctgaggcaggagaatcgcttgaatctgggaggcagaggttgcagtgagctgagaccgcgccactgcactccagcctgggcaacagagtgagactccatcaaaaaaaaaaaaaaaaaggatgtacacatatatacttctgttacagcaaaatatatttaagaatcttcattttcttcaattagtaaaaacgacaaaaatgtaaggataagaaaacagttaagaaacggtaacaggccgggtgcagtggctcacacaaagtgcttgtaatcccagcactttgggaatctgaggcacgtggatcacttgaggccaggagttccagaccagcctgggcaacatggtgaaagtctgtctctactaaaaatacaaaaattagccaggtgtgatggtacaggcctgtaatcccagctacttgagaggctgaggcacaagaatcccttgaatccgggaggcagaggttacagtgagccaagattgcaccactgcagtccagcctgggcaactgagcaagactctgtctcaaaaaaaaaaaaaaatggtaataatttagggaaagctcttagaaatcacatttaaaccttctctttaaaagggaaggcagggcaaggtggctcacacctataatcccagcattttgggagaccaaggtgggcggattacttgagatcaggagttcgagaccagcctggctaacatggtgaaacctcgtctctactgaaaatacaaaaattagccgggtgtggtgatgcatgcttctaatcccagcctactcgggaggctgaggcagaattgcttgaactggggaggtggaggtttggcgccactgcactccagtctgggtgacagagcgagacgctgtctgaaacaaaattaggtccggcactgtggctcacgcctgtaatccttgcactttggcaggccggggtgggcagaccacctgaggtcaggagttggagaccagctggccaacatggcaaaaccccatctgtactaaaaatacaaaaattaaccaggcatggtagtacatgcctgtaatcccagctaatcaggaggctgagacaggagaattgcttgaacctaggaggcggaagaggttgcagtgaaccaagatcgagccactgcactccagcctgggagacagagtgacactccatcttataaataaataaaataaaagggatgacatggctggacatcgatgctcacgcctgtagtcccagcattttgggagtccaaggcaggaggactgcttaaggccaggagtttgagaccagccctgggaacgtggaaagaccttgtctctatagacaccaaaaaaatacaaaaattagctaggcatggtggcatgagcctgtagtcccagctacttgggaggcttaggtaggaggatcgcctgagcccaggagttgagaggctgaagtgagctatgattgtgtcactgcactccagcctgggcaagaatgaggaaaaaagacattaaatacagttttaagacagtgtttatagtaataaaggaaaatcacatattcaaaatactatatgcactatacagtttctataaataacatactgaaaaaaaatctttcctctgcctcgtatcagttattaatgataagaaaacatggctgggcctggtggctcacacctgtaatactcgcactttgggagacccaggtgggtagatctcttgaggactggaattcaagaccagtctggccaacatggcaaaggcctgtttctactaaaaataaaaaaaattagccaggtggtgcacacctgtaatcccagctacccgggaggctgaggcagaagaactgtttgaacctgggaggcagaggttgcagtgagctgtgatcacaccactgtgctccagcctgggccacagtgagaccctgttcccccaaaaaggaaaaaaaaaaaaattctgttggacaagaggttgttgtaaaaaaaaaaaaaagaaaaattactttccttgaatgagtttttttttaatttcatataatcttataatgagacttaaatgctaatgaaataccattaaactaaaatagaatttcaaatgattcaaaattactcacgtatgaaacacctgatgggtcaatcatgtagagttgcgcaccgtcattcacactgtaagaccctaacatgaaactgcatgaaagtatacaaacagcttaaaccatggcaataacataaaagtatttgtgaaaaaattattttaaaatgcagttatattttctttctgagataaattactaatacacatataactcagtaagtactttgaaacagtggtttcaattaattaaaactattacatgagattattcaaaattcatgtagcttttgtttgtttagtattaatctttctgatgaaggtctcctggaaagtctagcagtacagggaaaggagtaacgatagatgaaaaccacaactatgagagggcccaataaataaggcataaacacaaaaagatcaagggaacaaaattcctgacggagagtatactgaatccatgtgaaattctttccacccttcattctatttcccaatatcctgccaatcatttctctgcaataatcagaattggttcagtgtatttttctgtgctcaacaaattaggctattagctgattgtatgaaatactgattttctgaaattgtgacatacagtgggcactgtttccatgagttctgcatctgtggattcaacaaaccacagatagaaaactttcaaaaaacattgcttctgtactgaacaactgtgattttcttgtcattattccctaaacaatacagtgtaacagctatttacactgtgttaggtattgcaagtaatctagagatgacaacatacaggaggatatgcacaggttatatgcaaatacttaaccattttatatcagggacttcagcaaccttggattttggtattcatgggaggtcctaaaaccaatcccccacaaataccaagggacaactatatttgccttagagtagaaaagaaatcagcagcatcttacacatcatcttatatgcggaatattttaactattcaattcccatccctaccgtcatttccttccattttctaccgatatgagacttatccttcaggatatatagctcattgtcactattttaaagcctttcaacatttctttgaagaaaatcagcatggagcacagacttttatatgactggaccccttcctacatcagtatcatctctaaacctcatactctacacaccaagcatacttaactctctctggcgcacgtattttcataccagttcctgtgcttgcaactaccaagtctccctacatctcacactcttccttgcctcctgtccagaaagagtccgttccctaattgttgtccctttatcatatcactaatattttatcaatgtgacttcacacctgtgtctccacatttatgactaactcagtgcccaatagatgtttactaaaaaagttctctctggcccagtgcggtggctcacgcctgtaatcccagcactttgggaggctgaggtggatcacttgaggtcaggagtttgagaccagcctggccaacatggcgaaaccctgactgtactaaaaataaaaaaattagccgggcgtggtggcaggtgcttgtaatccctgctactcaggaggttgaggcaggagaatagcttgaacccgggaggcagaggttgcagtgacctgagatcgtgccactgcattccagcctgggcgacagagcgagactccatctcaaaacaaaacaaaacaaacaaaaaaaaagttatgaaaaaaagttatctctactattcttactcccttaaaaagagtagagaagttaactgatgaactcagagctcagttgaaaggtattttacatggtctgaaaacaaagtgtttcataatgtaatttaactgagaagcttaagaatgactaatgtcagcctgggcagcatggtgagaccccgtctctacaaaaaaaaattttgttaattagccaggcatggtggcccatgcctgtggtcccagctacttgggaggctgaggtaggagcatcgcttgagccaggtcaaagctgcagtcagccatgatggcaccactgcactccagctcaggtgacagtaactgtctcaaaaagtaaaaacaaaaccctaatgtaatattaccaatagaataaaactcaagttttctttaatatcttagtaattaaatatgactgatgataaacaactcaaaggtaggactacagctgagcactcagatgttagtatatgtattattttgaccaaacatgtttgactgttttaagtcataagccaaacatgtcttttcattttagaaaaatctagtcacaagtcttctctgtgaagccaaatttgaatatttatacctattccaggtctttatgcagctgaatctccactttaccccacaataaaatatcagcacttcaacagaaagagaaaccgtgcctaatgggaattgtgagacgtaatttttaaaattacctaagaatatcagggactaacaccgagagcttattataatcagattaaagtcattgttatcagttccttgttttataatcacttcagatctatatagtccttttcactattgaaaccttttttttttttttttttttttttttaaagaggcagagtctctattgcgccagctagagtacagtggtatggccacagctcattccagccttcaactcctgggctcaaatgatcctctcaagcagctcctaagtagctgtgactacaggcatgtgatactgcacctggctaaattttaaattttttttgtagagataggttctcactgcgttggccaggctggtctcatactcctgggcgcgagggatcctcccacctcaacctcccaaagtactgggattacaggcttgagccatggcacccagcctcaagtagtttctatgtacactgttttatttaatcattgccctaatacttatcgacgagtttctatttttaagtatgtaaaaggctaagatgctggggaacataataaatatctatagtacagatctgccttttgaataattcacaaaatttcttacctgcagccaaaaggtctaacagcactgtagagtgtatatgcatgcacatacatggccactctgtctgcaagatgctatggagggaagcagaagagcttattaataaacttctattactgtccaaaaggttcctcaatatgttatcaacttacttttagtggaatgttgtagccaaagttagatctgaagttggaagcttcttctcttgctatgtctgctaaagaacgagcatctgccaacaaacctgctactgcctgaaaaaaaagcaccaatttactagaggaacacattcctatcacaaatcaaagtctgcaattaataaagacttattaaacatttttttaacaagtattaccattcaaaataaacttttttggcttaaaggtctctctacaaggcattttgatgcttgagtatgaaattataatttagaaatttagtaagtataacttcattgctttgtccaatgttcatattcaggacatttccttttttttttttgatacggggtctcgctctgtcaccagggctggagtacagtggcatgatctccgctcacttcacactctgcctcctgggttcatgccattctcctgcctcagcctcctgagtagctgggactacaggcgcctgccaccacgcccggctaatttttttgtatttttagtagagatggggtttcaccatgtcagccaggacggtcttgatctcctgacctcgtgatctgcctgcctcagcctcctaaagtgctgggattacaggcgtgagccaccgtgcccggccaatattcaggactacttctatcataaatcctcttcccctgatttactaccactacctcattataacgaataaaaaccatgggtcttggtcagatttttttttttttttttttttgagacagagtctcactgtgtcacctaggctggagcacaatggcaccatctgggctcacttcaacctttgcctctcaggttcaagggattctcctgcctcagcctccccagtagctgggattggctaatttttatatttttagtagagacagggtttggttttgtcatgttggccaggctggtcttga

SEQ ID NO: 3499 - DNA, 753 bp, Homo sapiens
gaggattgggatattccgactccttaagggcctggcgcacataaggtgtgaccttttcattcccgttgttatggagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttttgagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaag

SEQ ID NO: 3500 - DNA, 270 bp, Homo sapiens
tattttaccaaaaacgcaggggatttatttgaggtttgggtgaaaaataatcttgtgggtggtggtaggccgacagatggggacaggaagctgtggacgaaagccccaggtcccgtgggagaggtgacagcacagggaagtgcccagcgcacgtgacgggggcggggcgggactttggggagggcggggcctaacggtatcgagcgagccggttgtagacgtggtccaggtttctgcacaggaatatcgagagcgtcatgaacccgagct

SEQ ID NO: 3501 - DNA, 1287 bp, Homo sapiens
gaagcagaaggaatggaaagcctggagaaagaggatgaaatgacggatgaagcagttggagactctgctgagaagcctccttctacttttgcctcacctgagactgctccagaagtggagaccagcagaactccaccagcctgtgaaaccacgaacccttcaatcaagaaaagacctttgatcaggagaagacttctcgtctcatttctggggacacattcaggatttctccaaagcaggtgaaggtacgctcgagcgtggtcattgaggacaagtcgacgagagatcccgagtacatctacagtcagccttacgtctgcaggtgtacccaacagctccgaagagacagcgaccatcgagaacgggccatgatgacgatggcggttttgtcgaaaagaaaagggggaaatgtggggaaaagcaagagagatcagattgttactgtgtctgtgtagaaagaagtagacatgggagactccattttgttatgtgttaagaaaaattcttctgccttgagattctgttaatctatgaccttacccccaaccccgtgctctctgaaacgtgtgctgtgtcaactcagggttgaatggattaagggcggtgcaggatgtgctttgttaaacagatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtataagaggaaggaatgcctcttgcagttgagacaagaggaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcactgagatgtttatgtgtatgcatatccaaaagcacagcacttaatcctttacattgtctatgatgccaagacctttgttcacgtgtttgtctgctgaccctctccccacaattgtcttgtgaccctgacacatccccctctttgagaaacacccacagatgatcaataaatactaagggaactcagaggctggcgggatcctccatatgctgaacgctggttccccgggtccccttatttctttctctat

SEQ ID NO: 3502 - DNA, 1338 bp, Homo sapiens
ctgttttctcatctgtgaaatgacgggttggacggccttgtctctgaggcctcatccagttccacgtacaggaagatataaatgcaaatgtgcaaaaaaaggaagaaggaaagatggaccaagttcacctgtttggtacgtacagggtccacagctctgcagaaaggggagaaacctggtagacagagggcctgacgcaccatagcattgagcacattttccactgcttaattatgtgtgagattttcccttttaaaataaatctatggtctgtgaaatagtctgtataaaaatatgaagccttgaataggccagtcatagcagttccgtcttgaatagaactcaattttacaagcacggagtgagagtatcattccactgcaaactcttttatttccacaacatattagatctcattctgctttagtagagttacctcttaagtacgactattagtcatttcattaatatgaaaatctgggaaggcccacataaaataccaacataattgctggctaccaagataaaattatttaggcagattccagccccaatggttcaatgataacaaaactacaaaacatgggacatcaaattcattaataaaattattaagtcacctcttccatcgaatgatgagatttttcttattcactgtttcccatcagggaaaaaagaatcctcccacctcatgcctttttttttttctgatgccaggaattagtattcattgcctctttaagaggccaatgcaaaaaaaggtagaaaaagccctagcccaggagttgggattgccagttgtagtccctgggttgccttgctgggggtgcctaagtcagtgccataacctcagtttttctaatctgtgtaacatggggatagagtatatgatttccaaggtcactttcacctctgtgattgagcctctaagaaagccaaatcttttcactttgtaatcatgacatttttaaaagatggagttaatatgaatgggaaacttttttttttttgagccagggacttgctatgttgcccaggctggtcttgaactcctgaactcaagtgatcctctcacctcagcctctcaaatagctgagactacaggcacacaccactgcacctggctaaagactatattcttaaagaataaaagtactgcacttcacctctatctcctggtatctcttcaattcaaacacaccattaatgactacaatattttatttaaggccgggcgcagtggctcacgcctggttaatcccagcactttgggaggccaaggcaggcggatcactaggtcaggagatcgagaccatcctggctaacgtggtgaaaccc

SEQ ID NO: 3503 - DNA, 503 bp, Homo sapiens
agagtttcatatgctggaccacattttagcttttattgttttttttttcccattgtccaaaaagttaagcaacaagtggccacacttttacgtgactacaacctggagttctgcaaagaaggaataatccaatactcaaggttgtgttgtgtgaggaagcaaagaaacacttacaatttattgaccacttctttcaagtcatttgtctgcacctctcgggtcatgatttccatcatcttcttccggatttggcggacctgttggtgctgagcataagaggtcttccgtatctgattgttgcgttttttagtaaaaccaacacagaacagacgaagcaagtaaccatcggtagtcttgacatcaacgtgagcttcaatcattgtctggagaaaaaagataccgtcagatttaacaggttttacgttatccatttatccctcaagttctaattttaaaaagctggattgtcaaacactcattattaaatataaagtatcctaaca

SEQ ID NO: 3504 - DNA, 4285 bp, Homo sapiens
atttcctccttcatattctgaatctcatcctgcaggcggccaatagtgtcttggtagttagcagcttcaacggcaaagttctcttccatttcacgcatctggcgttccagggactcattctgcagggggtgagaaagatgtctggtgttatttctcagaaaaacccagctgttcccagaaccatttacagaccttctgcaataatttccattagcggcaaatggcgaccactctaattttaggtggagaatgcgagtaccaagtccttcatattagaagcaatgatataggcaagctaaaaccttcaagagttccatgaagtcccttttgagtctgtcttgataactcattttctttgcattatgatatacatttttactcactcaacattttgttcaggtatcatcatgagcctagtcagcagaatgggtcattattttccctcttttactgcagggttggtactcacggttcctttaagggcatccacttcacaggtgagggactgcacctgtctccggtactcagtggactcctgctttgcctggcgcagggcgtcattgttccggttggcagcctcagagaggtcagcaaactgttgggaagaaaacagaaatgtagattgctcacattcaagtcttttgactctcttagaaaaaaaaaatcatatttctcactgaatgtcttccagtataggtttaaatttctgttttgaaagccagggaaagagcagtggagtactgacattagtattttcagagttcactctacagtgctcatttcaacacagtggaggtcaaaggtatggcattggggtttacttggaggcaaggttagggggaagagagtctgctattctgaaggaggtgatgtggccaggcgtggtggcgcatgcctgtaatcccaacattttgggaggctgaggagggtggatcacctgaggtcaggagtttgagagaagcctggtcaacatggtgaaaccccatctctactaaaaatacaaaaattagccgggcatggtggtgcttgcctgtggttccagctcttagggggctgaggcaggagaatcacttgaacctgggaggcggaggttgcagtgtgccaagatgttgccactgcactccagcctgggcagtagagcaagactctgtctcataaataaataagaaaataaataaataaataaaggaggtgatgtgagtggtggggaggctgtggtggcaaacacaatatgagcaagaagtcaaagccagctttgcattggagctagaggatatttaggaatcacacacaggtatggggttttgagaacacaatgcttttctttggttgaagccgcactgatttgtttcctaccttggatttgtaccattcttctgcctcctgcaggttcttggcagccacactttcatattgctgacgtacgtcacgcagggcagccgtgaggtcaggcttggaaacatccacatcgatttggacatgctgttcctgaatctgagcctgcagctcctggatttcctgcaaaaagaacagacagacggtcagctctgccaaccgtgggggctgccttaccctcattcattccccgaaagtcactccactaacctcttcgtggagtttcttcaaaaaggcaatctcttcttgcaaagattccactttgcgttcaaggtcaagacgtgccagagacgcattgtcaacatcctattttgaacagagaaaagacaggacatggaggatgtaaaagtgtatggcttatctcatttatttgtcttagattaaccatctgaacctagtctccttactatagaaaagccgttgacacattttatgaccctggaataggtttataaatcattcagtgctataatatgctgtgctttctcctgctcactaatatattttaattgtgactgcttgtgttttactcaaggtggtgatcagacaattttaaaataaataaatgtccacacacatggtaaactgcactcaatcatgactgaatccacattttaccagtgatattttaaaattactttttaaggctggtcatggtggcttatgcctgtaatcccagcactttgggaggctgagacgggtggatcacttgaggtcaggagttcgagaccagcctagccaacatggcgaaaccccgtctctaccaaaaatacaaaaattagctgggtgtggtggcacatgcctgtagtcccagctacttgggaggttgaggcaggagaatttcttcaacccaggaggcagaggttgcagtgagccaacatagtgccactgcactccagcctgggcaacagagtgacactctgtctcaaaaaataaagtaattcatttaatttaattactttttaaatctagaaaatctatgccacaacatttttaagatttgttttgtaatttcatggaataacatgatgatagaggtggacaaattttcacaacttcatgtacacttgagtacatggagaacagaaacttgtgcttcaagagttttagcttttcttctccactcaaatcttttgaaacttatccttaggctccaaagcaaatatgtagtcatctggcatccattgtacaaggctagatttatattcaataacccaattcaggatatgcatgccaaagattcagttcaggaaaaaatggaaaagaaatgtaactctgaactgtatttgcttggctttctctggtggatttttcttctaaaactcctttgactcatcctgtaaaggcatgtctttttcacttgccactgtatcagttcagttagcctgtttcagaatgactggtcaagcttgcaaagaatgaaactacataaaggatttttgctgattcagccgtccttctatatttccatttaaaaagctcagcattccaaatcagaatatgtaatcttgcaactaagattttatttcctctcaaaaggatgcgtgaggattgcttatcttgtcagcaattatatttggagttcatagccttacggtcttaaactgttgagacttttctatcaccttagtggaaaaatgaatgaagagtgggtgacaaaaagatcagacttgatgaaaacattgatttttacttgttaagccctgaaaaatacataaaagatattttactaacctccaaagaaagatcaatgtggtattctatcacattgaagagaatgaggaattttgcttaatctcgaaacagaggatcttttgtattgatgttgttttatgttaactcactacactgcagaaaacatgacaggtatgataatcaaaaatgctcaaggactaaaatgaaccacacacattgctgtggttaaattaatttggtaaatgtatttcagtttcaaaatgttatactacactattcatctgagagtgctttgcagttaatcccagtaaatattccagggaatacaactataaactataatggggatcttctggcttttggattccaattttaagttaaaaattctgtaagtccatctaattttggtgaaaaaaaaaaaaaacacgcacaaaaaccctttagttaaaattcagtttttcagccttgggtttattactgttattattttttatggcaagagtgctaaagaacacaagaacccaatcaagaaaggacttttaaaatgtgaggtatgcttgtagctttaaaaactttttacattacctacttctcaagtctgggccagatattagataacggatgttagcaaatacttgtgtccaattagaaccgtgcttacatcattacatattcagtaagaatgtagcctgttgcaaagcttccctgggaatacaaagactcctattatttctgtccagagccaccacatttgccagaatgtctgtatctacattccatagtgaagcccatagaaaccattaataccccttagccaaggggacagatggctccttttcacccttattagatcacaaaatagttgtgcatagtgatacttccatcgaactttaatgacacaatagaatttgcaaagaagaaaagaaacttgctggctccattccagttggaaactaagttttcttatcttccaacacgttttccattttaaactgcagggcataattgcgctttttgtggccttgtaaaaattaagcaacttgactttggcaaaccacaatctaaaattgtaaccgttcgaaaccagaaggtcaatgtgttgcaaaactgtgcaacatttgggaaacaaagtaaaaagttaaaagatttttctttatgtcccaaggaactgcttagaaatcattcaaggatcgct

SEQ ID NO: 3505 - DNA, 5892 bp, Homo sapiens
ggctgttgagtttgaactagctctgcccaggtcgccctctccgctgtctcttcctcctcaccagcctaggccccagaaacttgtacccaccaccgccagaccgccccaactcacactcacaatttgtgctcgcaatctcctatgtccccagccggacaccctctccgaactccctcaagggtcaagcatacctcaagggcatccagctgccacctctctggatgaaccgcccatcgaaagtcctctatgacctccctctccaccacccccgatcttgagggccgaaatgaccccgtacgactctcgctgtcccccaaagctgcaaatatctgcacctgcacagctgccgcctcattccctgccctcttcggggacccagttcccaaatccaccagcccactcccttcgacatcgccccagcaggagacgagaaagggacaccaagaggcacggtgcttcttccccacctaagcctgcggcctgcggacaccccaatgcaccctgcgcccgggacaccgccgaccccgccccgctttgctctttgacaggtctctctcccggcgagggccgtggtcttcaggaaaggcccgagcccctttcccagctgcgccctaggcgcgcgccccggctgcccgcacccgccagtgccgtcgcgctcacctgggccgggaggctgacagccttgggctgtgccctgagggccgcgagaggacgtcgcgctggcagacccgggcttgggccccgcggcgctgcgcctccaacccggaagaacagccccaactccgcggcggcgggcggccacgtgactgcagctccgctcccacctcggcccgcgccccttccccgccccagctttcttcccgccaggccccctccacccgatcgccgcgcgctctccgaaccaaaaggcgacctcacgaaatgcccctttgagctcaaaggctagttacccccaggggcccttccactctcggggacaggcgaaacctctttgtctctgcctcggcctgcggcccccagcccagcctccgcgctttccctccgccagtccttgtcaatcaaacctggtgccaaacgcggcagctgaagttttcagggacacatttgcttctccccttgaagaaccagttacaaagcgtgatgtcctctctggggtcccatcagaacaaagaaacaggtctaaagaccctcattccagagagcatcctgccccatatccagaatgaaatccatgctcagagatgccaagaagaatctagacagacaggcctttctaggctgtacaagaagcatgatgccagcatctgcttctggtgacaacctcaagaagtttacaattggccgcgtgcggtggctcatgcctgtaatgccagcacttcgggaggcggagacagatggatcatttgaggtcaggagttcgagaccaggctggccaacatggtgaaaccccatctctactaaaaatacaaaaattagctgggcatggtggcatgtgtctggaatccctgctactcaggaggctgaggcaagaggatcacttggaacttgggaggcagaggttgctgtgagctgagatcacaccactgtactccagcctgggcaacagagtgatactctatctcaaaaaaaaaagaaagaaagaaagaaaagaaaaagaagcttacaatcatggtggaaggcgaagaggaggagcaggcatatcacatggccaaaaagggagcaagagaaaggtgagaaagacactagactctttttaaaaccagctctcacatgagctaatggaataagaactcactcattaccacaaggacagaacccagccattcatgagggacctgccaccatgacccaaaaacctcctacttgacccaacctccaacactggggataacatttcaacatgagatttgaagaggacaaatactcaaactatatcacttgttgtccatttttaatctttctctaacataccctaacttcttcttgaaaatgcttaattttctctgttttgagatgtaaatttgctatcctgtttttcttaaaacttggtaagatcttcagccatgaaggacagacaaactgtaacctttccatttacaaagctgcatttgaattcaactgtccttttaaactaaggagttttactggtctcgtggctaaaattttaaagatgtaggccaggtgcagtggctcatgcctgtaatcctatcacttttggagaccaaggcggggatggatcacctgaggtcaggagttcaagaccagcctggccaacatgatgaaactccatctctactaaaaatacaaaaattagtcaggcatggtggcacacacctgtaatcccagctactcgggaggctgaggcaagagaatggcttgaacccgggcgacggaagttgcagtgaggcgagattgcaccattgcactccagcctgggcaataagagtgaaactctgtctcaaaaaaagaaaaaatgatataaagtatttatttgtgtttatattttatggatacgtgtctatgtttatagattgcctgtatggtaccaacttgacataaataaattagtactcataaattaagtaaataagcccaaacgcttttcaagttcacagggcattagtaatctgtggtaaatgaagatagtttaaaatttggggtaaaataaaatagaaacattttctgaatttaatttagatatttttctgggtctatttgttagacaggtttacactatctctgctatttttttaaggacctaaaactgaatggacatagaaaattgaggaaagaaataaaaccgtaacaattataagaggttataaaaggttcatggaacctttttatgttttttcttgtgcagtcaaaaccaattgcaggctggatgcagtagctcacacttgtaatcccagcactttgggaggctgagatgggcagatcacttgagctcaggagtttgagaccatcctgggcaacatagtgaaactctctcactaccaaagtacaaaaggaattagctgggcatgatggtacacacttgtagtcccagctacttgggggactgagatgggaaaattgcttgagcccgggagtcaaaggttgcagtaagccaagattgcaccactacactccagcctgggtgacaaagtgagaccctgtctcaaaaaaaaacaaaaaaaggaaaagaaaacaattgcaattggattgatctgtttataaggctttattaaaattagctttagcatttataatacactggcacaaagttagaatttggatttctcttttgaacaagatttttgtatacattaataagaaatagtaaaagatttttgtttaccttttgagtaaactgcaaaaaatattagtaataagaggagagaatttccctaatgctgtttttattatgtcttttgattgtttggaaaactgaatctcccctctgtcaaagagtaaaatttttgctttttgaaatttttgaattatcagtttggctaaatgaataactattatcttacagtgacctgtaatcttattttgatcaagtgttttaaacctttgatatttgacaaacttcccaaaatcaaatgtaaaattctaacttaaatgttttcgacctcaagctaacttttgggcattaaagcccttggaagtccaaatagggcccctggaagtccaaaagaaacatattaggctaatttggtatattaaaatcatacaggaagctgatcaaataaaaaatgttgtttaattttctttgagttgtatttgtataaatctgttattaatatgcatcccaaaattgtatcatattgctaaaatgttgatagatcttgttatatgttattggtaataattgttatcctgttaaattattgtataccacagaaataatgaaatttctttgtcaattgcatcagtaatcatggctcttctaagtcttttgtcattcacagatgattattgttttacttggattcttttcaaaagtggtttgtaattggctacagcctaaaatctgcttgttcaaaaaaaaaaaaaaaaaatccatggaaagggccctgacagcacacacacttaaacacagttttctgataactttggaattcacaccgttggactagttaaaaacttctaaaataattttttaaaatctaataaattaatgaagattgctaatccaacatcaagcagaataagttaattacatggggctgaactgataaaatgccaaaataatattttcataacctttttttggtttgagacattgctgatactttttatgttttgttttccagagtcaagaaaattgtttttttcttttgagctgtacatagcttacagtaattagataaattacacttttgtgagaacaattgaaacactaacctttctctctacctgatgtctccagaatttggaaagtatttgtgagtattcttcacttttggcaatatagttatttgtacaaattcgataggaatctgttttcttttgtaacagaacacagttggatacactgattattttgccaaggctttcattggaatggcataattttttaatgaccagactgctttgaggatttgaagttgactttatagagcctataaaaagcctgttggaaaaattagcctgataccttgtctacacagtttccttacaaggttcctgaccttgcggtagtaaagaatgtcactctctggcaggcccaggagcctcaggatattttgggaaccttgacaagagaggagtgtatccaatttatacaggaattacaagtgcagtctgattgtgaatccttgtcttggcttcttagccttgagagtttttaaaagttgaatgtgaaattccttatgaaaaagttccaacaaagccaaactttaaaagagcctatatgtggtcaatcactatttttgctgtactttatgcaaataatcaggccaaatataataaaactaaaacttattttgcaaataaattggtcctgttatgatttgcctttaatagaaaagggggactggagagagaagaattatgtttcagaagaaaatgatagcatacctgttgttagattctagctttgtccattgtttttaagttgtaattatttgcctacatttgaactaaatcttgaattctttcctggctacaagtctccaagctaacatttaaatttttttctcctatgtttctgacttggaataagtagaagttaaaactatgcttttcttgaagccctgcagactggagcaagacaacttgaataaactatgggaaaaatcactacagcaacttatatataaacagcttttatgctttgttgatgtatggaatactcagaaagttcactgcaacacctgatttaaactacaaccaggagactctgtcagattaacactacaatctgaagaactacagagactctcaaaaaactagtgtatagtctacagtagatattaacctttgtttttcttctgttttcatagaaacaccttttattaaaaatctgtttgccgcttcatatatagagtcctagtccatctgtaatgccaccccctggaatgagacatagctgtttaactgaactgatctattctcgggactaagagactgataaaaaaagatataaaatgatatattcaaatttgctcctttctgcttatcccttttgtttttccactcctttgtctatctgtttctgtaaccaaaaaggcgtcctgatccagaccccaagagagggttcttggatcttgcgcaagaaaaaattcgagacgagtccacagtgcaaagtgaaagtaagtttattaagaaagtgaaggagtgaaatagtccatagacagagtagggcattcccaaaagtaagaggaggaatgcacccaccctaag

SEQ ID NO: 3506 - DNA, 3011 bp, Homo sapiens
ggcgtgaacccaggaggcggagcttgcagtgagccgagattgtgccactgcactccagcctgggcaacagagctagactctgtgtcaaaaataaatgactagataaaaaaaaaaattgtttgagtacattttccctgcattttagagattaggacagtggtcactttctagttgccgtcttcacagacaaacttgaaaggtattaaggaaaaaattccacatagctctgggccttttttgtattctgattgccacgttaatctgtaatcgttaagtacccatgaaagaatgtgtttcagtatcagtgcttttttggtactttaacaagtattgtaggcacggtggatttttttgaaatacccatgtgtccaatagcaagttaaggaacctagcgcatcaaattttgttttcttcattcatttggaaccttattttcgcaaaaaacctagctggaataataatgccatattgtattttgcacactgctttattttctagaggctctgggagcaaattacattcatcacattacctctgctctctcaagattaaagtctttcagcaacattctttattgtcatcataaggaaaaacttttatcgcaatgatagtcagttcacattagtttagcactatagatagtattcagaaattgctttctctttggtaaagaagataaataggtgaattttattgcctgtgttttcaggcttcagaggtacctggcaccttactcaagcaaaaacaaaaaacagctttacttcaaaagcatgtgcctctggtaaattatccatcacttttgttttaaagtggtccctccaagaataatgtggcatacacagtgggtttggttgtaaggcagatgtaatagatgacttcaaaagcctgctccttactgcactctggacaaggccctggtctgtatagtttggcttcctctgttaagtcattctacaaggtgacttgccatttgaactttcgtaagagacctcagcagttagactgagaaaagttagagtgctgtagttatgaagtcatacatttttgataaaatacctgtggaaaaccagggatcctctcctgtttctctctcttgcctccccctttccctccattcctctgtcgcctccccctctcctccactttctttaagaatcagggggtacagaataacctacaaacaacctcttcaaagtacccttggaaattgaagttcaatcttaagttttttgctgtctttaatttactagaattgcctaatttttagttgatttctctacagagcttagcttgtgtagttatttctcttttactgttgctttggtgtgtcttgaagtttgattgattatttttggtcattgagttcttagtgtagtttgctagatgattattaagattcttttgtgtctgacacttgtggtgagttgcttttgaaatctgttgagatttccatgtgagaactgataatcaggctcttgatctgcttccctaaattacttttttagagcccaaaccccaggtttagggtgagggtttgtaatacaaagaaacacttccatcacttctgcccttaacccttgcctctattacctaagcttagtaagtagttttcttaatattgtccaatgtttggtgttatctgcattgttttttgtttttttaattgtggttgttctgacgtgtgaaatttaaggaaagagccattttttaaaaatgccgagcagggcaatgcaagtacagccaaatattagacttgatgtgcaatcttcggtcctttttaatctggggtattataggcagtactttaaattgcaaagtcttccgggcctattttcctctacatttttgtaattaactctgggggcttacttgttttggcagtactgaaatcaaaggagctggttcttcttttctcccaattattttcatatgaaagcacctacaattagcctgttagtcctattcagatacatcaaatatcagtgaatgctttactattcgcacatttaagcatctttgttttacataaaattagagtatgaaaaccagtgttcaattttttatcttgttgagcttgtaaaatgccagcaatttaaaactaggacttttccccccataagccaaggaggtagaattactaatacaagggttaaagaaggtagattttgttttcaatatttgggtaatattagaaagattcttcccacagggaagaactagcaagtgtcccaattttttccaaacgttggggaggggaaaattcactgtatcatgaaaccctaagggtttgttgcacttcctgctttttaggcctggataacagtatcaccatccttatttacagaagggtaaaactgactcttaatgagaaaagctttataagttcaagggctgtaaaatatgaactacttagggtcgtttgccttccatgggaacttggctagacttagaaaaagctgtttgttgtgctaatgtaaaagtgtcatacaatttagaagatttttgaagatggtaaacttagaagaattctatgttctgaaatgcacacttttagaatgtttttctttgaaaacaggctaatagttttttctttttttgacaaagtttcagctcctctttaaagttattgtgtcatttttctggtttaaatttcccttatatttccacctgtaatgtcagtggcaacaacatcatacttcacttacttgttaatttactttttacccttattctaagagcaagttgagttgaactgaatcttccttgtcttagtaacaatgtataaatagtggcttttctgtacaaaaggttgtaatgcctcctgatggatataattttgtgattgtatttaaaagttgaataaatcacaccagcttcctgaaaatgttcataatgcatcttttggaaaacaaatacatgcctactttgtgcatatttgcattaacatggcaaagattgtatgaaatacctgtttttcagaaaataaaggttcagtctcaaaagatacagca

SEQ ID NO: 3507 - DNA, 2366 bp, Homo sapiens
acatttgtcaaagatgtatattctgaggtctagtgagttcagacacctcggggaagcctctagcacatacatttatacgatttctttccaatataaactctcaagtagtgactgaactctggtgaagcttctgccaccctcatttcatttgtaaagcatatctgcactttgagttatagatccacaagttttgacctttaagtagtattcttgccacatatactacacttctgtgatttctctccaggatgtatattcttatgcctagtgaacacttgcttaaaacttagctatattctggccgggcgcagtggctcacgcctgtaatcccagcactttgggaggtgccattcactttcgtgcgtgcgtgtgcgtgatggagtctcactctgtcacccaggctagagtgcagtggcgcgatctcggctcactgcaacctccgcctccagggttcaagcaattctcctgactcagcctctcgagtagctggtactaccagtacccgccacgaagcccagctaatttttgtatttttggcagaaacagggtttcaccatgttggccaggctgctcttgaactcctgacctcaagtgatccgcccacctcagcctcccaaagtgctgggattacaggcatgagccagacctcatgagaactatcacaaggacagcaacaaggggatggtactaaaactttcttgagaaagccacccccatcatccaatcacctcccactaggctccacctccaatactggagattactacaattccacatgagacttcaaagggaaaggacaaatatacaagctatatgagtaagtataaattatttggggatcccagaggttaggacaacatctaacggcctttccacattgagtttagttgtaaggttctctccagcatgttttatctgatgtttagtgaggcctgagcgactaatgtaagatttgccacactcattacatttataaggtttttcactagaatgaattcgttggtgtttagtgaggcaagaccgccgcccaaacgccttgccacattccatacatttgtatggcttctctccagtatggtttctctgatggtaaaccaagtttgacctttcgataaaagctttaccacattcattacatttataaggtttctctccagtatgcatcatctgatgattaagcagaattgaacgtactctaaaggctttgccacactcattacatttgtaaggtttctctccagtatgaatactccaatgacgtgcgaggcctgagcgataacggaagaccttgccacattcattacatttgtaaggtgtctctccagtatgaattatctggtgccttacaagttgtgaattctgataaaagaccttgccacatacatcacatgtatatggtttctttcctgcatggattatatgatgtgcagtgaggcttgagttccgtttaaaggttttgccacattcattacatttgtagggtttgtctccagtatgaactgtctgatgagttgcaagagaggaactttgactaaagcacttcccacatcgattacatttgtaaggtttctctccagtatgaattctctgatgaactgcaaggtgggaacttttactaaaggacttgccacattcattacatatgtagggtttgtctccagtgtgacttctccggtgatttacaagatctgaattttgtctgaagatcctgccacatacatcacattggtatggtttccctcttgtatggactatctgatgtactgttagtagtgagccccgatgaaaggctttaccagactcattgcatctgtaaggtttctctgtagtatgtatcatctgatgattaataagacttgaagacactctgaaggctttgccacactcattacctatgtaaggtttttccctaatatgtgttttctcgtcttgtgtaggtaacgaaagttgcaaaaaatcattcccatatttcctagaaatgttggtttggacaccaggaaaaattctttgaagtggtgaagctaaaaaacaattattaactgtcctctcaatttgattacatccataaattttctctgcagtttgaaatttctgcaattcacccagaccggactgaaaccttaatataagctgattttccatatgcttgttttctacgtccccttgactatgtcgaactctttgaccagtaagattgtttttatgggtcatcggcccttctttataatttatttcaccatctttccattgaaagtcaacttcctgtagatttttccggatttccctgaagtaaaaattttcagtgtcatagctttcatgtccttccaacatcactgcttggaatttttctcctgtgttactgttct

SEQ ID NO: 3508 - DNA, 1471 bp, Homo sapiens
tgactcttcgtatgttgaataagggatgcatgccaagtgaaaactttaccacattcatcacattcatagagcttttctccagcatgaattctctgatgtttaataaggaatgagtgacaacggaaagctttcctacattcattacattcatacggggttttggttgtatggatgctctgatgtcgagtaaggtgtgagaaacggcgaaatgccttcccacattcaatgcattcataaggtttctctccagtatgtgtaatctggtggcgaatgagttctgagccactgctaaatgctttaccacatttcctacatatatattgtttctttcctatgtgaattctttgatgtcgagtgaggttggaggcacggctaaaggcctttccacactcagtacattcataaggtttctccccagtgtgcgttctctggtgttcaataagaaatgaaaggtaactgaatgttttattacagtccttacactcatggggtttctttccagtatgtatcatttggtgtttcacaaggtttgaaatctggctaaaggttttgccacattccttacatgcatatggtttctctccagtatgagtcctctggtgtaacaccagggaaaagcgtcgaccaaaagtttttccacattcatggcatccatagggcctctccacagtactgatattcatatgttgagccagggcttcttgatgagagactgttactttcctaatacatccctgattttcttgcagcatctcagtatgatccttgcatttccagcctcctttaaaactggaatacacagggccttgacttagaattctttccatgatcaaatactgggatgagtcatcataaatgacattttttggtgaaaagtctttgatctcaccacttgactctgaaactgaaagataccaaaaaaaaagtgaatgtttctttttcctgtattgaataaaataaggccatttctcccttctttagcaacagaatgaagtttcaaaaaatcttatcaatagcagctttcacagctgtgactgaaatctgagtagtatgcccagaacttcagaaaagatcaaacagagatagacatataggtaaataaagagaaagtgtaaacgtaagtaattgaaagagcagggaaaatagagctatcaggaaatatttgtgaaggataggttgctagtcttcttcaccaccatttaaacggtatttactgccagaattatctaaaaatggcaatttcataatgctgctactaaacactaagtgttcgtcagattgcacaaagacattagattctgttcacttagtgcctctggaacatcttataataatctaaatgaaaaaaaaagcggtttctctgaaaacttgcctatgatcctccaactctaccttctgaactagtatgaagctcatatttggtataattatgtcttttctgggacctatttgagggtggaatgtgggagga

SEQ ID NO: 3509 - DNA, 2261 bp, Homo sapiens
aaacctgtccgtggctggcagccctgtgatacctcgccacattctgcaacagaatccgagatagaggtagaagtgggggagtacgtcgtggctgtcagggcagctttctgtaaaatgctgcctggaggagcatgtgattccagaccctcctctctgcaacgaaagtgaggttgacacctgcaggtatgattgtaacacgacttttagttcaggcctggggcctcctggcccactgagcagaacacacagaagctgggcccacccctgccctccccacaaagggtcacgggagccaccgcctgactttgaagcccactgacttgcggctgacaagagaaaagaatgtgcccctgtgatcatgtgaaagcatcagccaggggtccaagaacttccctctggagcctcacactcccagcgtggcacccagcagggaacagattctctccaaacctttgtgaatgaatgaaggatgacgtcactagaatccatccctgttttattttttatttttattttttgagacagagtctcgctctgttgttgcccaggctggagtgcggtggcacaatctcagctcactacaacctccgcctccccggttcaagtgattctcctgcctcaacctcctgagtagctgggattacaggcacccatcaccacgcctggctaatttttgtgtgtgtttagtacagacggggtttcaccacgttggccagactggtcttgaactcctgacctcaggtgatccgcctgcctcggcctcccaaagtgttgggattacaggcgtgagccaccacgcccatgcccatccccattttatagacaaggataccaaggctcagagaggggaagccacttgccaaggacgcacaggaggacaccagtgagcaggacctctggtctgtctgggaggccactgggcctcttcccagagtctctgcttggtgagccaggattttacacccgccttgggcccagtgggctgagaggacatgggctggggtgtcggaagctgcagagctgatccctcctgcttggctggaggcttgcagacccggcaggcaggctcgggaggcagcgggcgacttgaaaatgcactccctaccacaggctcaagagtgacggcgcctgtcagggaccgggaggcagggcctgtcttttcctgctgttttattgccttcaaagtctggaccaagtggtttctggatggagtcacggtaacctcacgtctattcaagcaattcgttcattgtttcatttagtaaaatacccacaaaacaaggaagaacaccttggcggtgcctctgatccccccatttgtctgcaaatcggaaaagcatgattccatcgatctcctgtttattgagcgcctactacatgctaggtcggatggtctagttcaacccctcgcaacgccacagctgctgtctgtttcgtatcttgtatttttcgcttgacagtttatcatgtgcattttctcgggtaccaaaggcccttgtaagagatggtgtctggagaatgggtatctcaggggcctaccacctggcttacctcctcccaaatcagggttcctctgcaccacctcctctctgtccagctcctccttcagggcctggctcaattctacctcctccacaaagccctccattccctcccctcctggtcagtgttgtctcttttgcagccactagctctctgccttgcctcacccgggtctcctatccctctccttctctctcatggagtgatgccttttttcttcctctacacacatcaggtctgagctcaaagtcaccttgtcaaaggccctcccaggaccaccctgtgtgattatcctgtgggcttgttcctgtgtttgtccctgagcccacagggtctggtggttcagtagaaggactcctgcagaaggtgctggataaacactggaagatctagaaataaaaataaaagaaagactgggcgcggtggctcaggcctgtaatcccaacactttgggaggccgaggtgggcggatcccctgaggtcaggagttcgagactaacctggccaacatggcgaaaccccatctctactaaaaatacaaaaattagccaggcatggtggcatgtgcctgtaatcccagctactcaggaggctgaggcaggagaatcgcttgaacccgggaggcagaggttgtagtgagctgagatcgcgccaccgcactctagcctgggcgaaagagtgagactgtatcccaaaaataataaaataaaataaaataa

SEQ ID NO: 3510 - DNA, 6129 bp, Homo sapiens
agttacaagttgctggagggcagctggtattaactcatcaccagggagagagcacagacaggcaggggcatgtagtgctcactggtcctgttccttctcatccttccagcaactccaagaaaacaatctgaacctaagacaacagacgcagctgcacctgggacagcagacacagctgggcctgggacaatggacacagctgtacctagaaaagcagaaacagctgtgcctgggaaaaggaacacagctgtgcctggaacagcagacccagcttcacctgggacagcagacacagcagaacctatgagaacaaccactccaacagttctggcctcctggccttctctcacccagagcaccaacagcacccagcccacggctcttaccagccccctcaccaggatcctgctctgcaacatccacttcctgctcccgatctccctgaaggggctgctgctcgtgggcctgctctgcactgtgctgcaagtgagcagtgctaagggggcctccagggggaaataaagtcacagcctgagccggggaaccgcagctcccacaccatcaacaccctcggagggggcaagcagaacctctggcctcctatcaggagcagataaaagaaaggacatcccccttgcacactgattccttggaggcatctgcatctcaccttcatggatcctccctcaggcctcctttccttgtggctccaggatgaccctgtcagagatactggactatcgttcagttgcagaggccccagggcctgtctggacttttccatcccaagaggggctcggctctatcccctttgtgcctgtgaccctctccatcccccacccggctcagaactggcacagccaccaccaaccactcctgattcaacccaagcttcgccctttccacctctcgagctgtgcaacaacaaatgcaggatgctcagccctcatgtgtcagtcccctcaattcacttgtaattaaataacaacacacctctttttctaattttcaaaggtgtatatatttcccctcaataaagttgttaggattatttttctcttccacttacattcttcctgaactctgcctgctcttttttcttccatattttactttaaatacttttttttgaattactatatttcttttcttagctcctttttttggagagatcttgttgtcttaacttctctaagaaggaggggaattttccatctgaactcttcctctattgccttgagcacttcctctcctgagacgggttcttcaactgccatttgctagtgttcatttcttctccttgatctcatcagctgtgaacaggtgctggtgtgctttataacttttctctgaatgaggttgaagattggccaagagtagtgtcaggagccatggaggcagagccatggagggcagagcatggagggcagagtgtggaaggcagagccatggagggcagagggtggagggcaatgtggagggcagaccgtggaaggcagagccatggagggcagagcatggagggctattgacacagtggaaagtttgttttcgggaacactcaccacttgccacatcttgactacctgtgtccatatggttcatgtgttgagaaagggcaagacctcaggctccagcagcctgcatgctgctaagcataagagaacagcctgtgttgttgcaatgtgaaccatggtcacacaggctggttgctattgtcatctggaggcttcttcacccacgagtctggagcatgggctggggtgatccaagacagctctgctgggactgttgcccagagaccctacatgtggcctctctgtgacagctgggttctaaaagggaatatctgcagaccttccagagggcaagcgtttcaatagactgaagagggagctgcagggtttcttctgacttagccttggaagccatacggaggccctcttgcattccccatgggggcaaatattggttcttgcagggtggaaaaatatttttactctttctagatacaaaacagagatatagatggatggatggatagatagatagataggtagatagatagataggtaggtaggtagatagatagatagatagatagatagatagatagatagatagacaggtgaatggatggatgtacaatacatctttggtattaacatttcatgaggggagatatttagggatattctttttttagggatattcattgttatcttaggataacaatgaaaaaatgttgagaaacactgttctagtccacaagttgaaacagtcacaacccagccagacccaaggggaggggacctaagccacaactcttcatggaaggagtatcaagaaatttgcagccatgtttttaaactgccttgtggaagaatcataatgtagcgccttcatgtcacatataagaatagcgggacgtgaaggggtgaagccacctggtccccagtcacaaggccagagagcagagttgattctgcctctgaatggcagcctggagctggcccacacagcatccctgcaggcccatctgtgcactttagaaggtcacttcccaagcctgctgggggcaccatatggtcccaagaataaaaatgaggccctgaaacacctatcctttactcagaggtcacagtccagcagccattacttgcacagacatgtcttgtttgggttcagtgggtgaatggttaaacaaattattttacacccatgcaatgaaatcctgctgagcaataggaaggaatcagctattggttgtggtaagtgcaaccacttgtatggatctcaaggctcagtgaattaaaaagtcaatctcaaaatattacatactgcataatttcatttgtcctcaaaaggatgacactgtagagatggagaacagattagtggtttccaggggacaggaatgggataagggtgcaaatacaagggacagcatgagggagatccttgtgatgatggattggttctgtattttgacgggggtggtagttacctggatctgtaaaattgcatggaactctacacaaacatatccataaaccaatgtatgttaaaaacggtgaaaactgaacaaagtctgcagtctagctaacagtattgtaacaatgctggtttcctggtttgggtcttgtcctacagttatataatacatcaccattgaaagacactagatgaaggattcacaggactctatgttatatttgcaatgttaagcctataatcatttcaaaataaaagtttcaaaaattaaaacctccaggggctccctatggcctccagaacacaattcaaacttcttggtctgccatgaagccctttcagactgaggctccagccccatatctcactcctccctcacatgcactctgcacacatggtaatggtaacgtagctcctgaaggtcctggtatccaccatgctctatgactcttccctaccattgtctgggacaatcatcccccagtcttctgccctatttttataactcaagccctcaattttccttctccgcttggccctcatgggagtgcctcccttctgtgcccccacagagcactgtgcagaaccctgacacaaattctaacacaccgcatcgctattgttagtctacatcttagacttcccttctaaaggagtagggactctgcatagtttaagtccttatctgtaatgcccagaacaatgcaccatagacacacaataaaagtttattgaatgaatgagtaaataaagggaaaaaagaaaggaagaataggggaaaaaaagggagtaagggagaagggaaaattcaaagcatggagaagccactgtttgtttctcctgcacctgctgtctgccatctgtctactctttcttaactcttctcttctggcttctgctgtcattgctctgttgatctgctcttctgaacttcattagtgaccttgtgaatgataagttcaatagcctcctctcaatcccggtcctcctccacctctctagctctgctctcctccttgaaacattcatggctcttgacttctcatcttccacctgtttgattctgctccagcaccttgatcaatgtcttcctcctaccctttgtctttaaatgcaggtgccccgagggctctgtccttggttctgaactcttccctccatgttttcacttcttgctgggttccagttaatctctctacacacattcctctccagccctcaacactctgctaacccacatctctagctatctgctagacctctctgcctgatgattccaaacacacagaaaactaagctctgcatcatccaagcctgctcttgactttcctacttctgtcaatgatgcccgattcctctggttttccaggcttaagactccggactcccagattcttcctttcagactttgctacatctgctaggcaagtcctcctaaagcacatctgcaatcccatcttgttctgctcaaatccatcccaccatagctaatcaaagtttaagtaagagttgagtcctaagcctcctgaacctgccaccacctgagttcttctagattagttccatctggcctgccacaggaaaatttcactccattggaatcttagacacatcctaccatgagcatctgtatgtgaacagtacagtccatttgctgataggtcttctataagtgactattgttatgaagattatttcccgcctctctgctttcacttatgctgtttctctgtcctctctctctccctgttgctccatccctgctccgctgaaatcctatacctccttcaacatcaacatgaatgtcaccttctttccctgacctggccagcttggcatgatattctcctcaccaaccccctgacatcaggaagcatctcttgtggctctagagttcttcctatgctgtaatgacttgggagcttatccttctcataaaatgaatcataagctcctttcttgctcatcatcatatttcccgggttaatataattaatatgggccttgttagattgaatttctctttcagcatgagtcctgggccagccccatctttcccctagtcaccatgcatgatggagctgggagccccaccagagctcaagttcagagcacggcagctctgcctaagcactcggcactcagagggtcactccatgtgctctggacactggcatcactagctcaggatgagctcaggcctgggggcagagggggagcactggtccagatgtaggtagcaagtggagatggtgatgcttgcttgtggcagactgtgggagtcctccccacaaactttagggaaacagagtaattgacaaacattcagaaaaccaactgagctcattcccgagccaggggtcaccagtagtggtgatagcactgtgcacttcaagtgtggacaagtatccttcacctctgtgccctccatcctgtctttgaaaaacgatatctgctctgcctgtggaaaaggttaattgctaacaggtggtctcagccagacttctaaagtggacagaactgactctgttgaccttgtgcattggacacctccaggtgggggaattccaggagtgatatcaggggcacccaccagctccttctccctttactgtttcaactcgccccagaactttaacctggagcagctcatccacggcccacccaggcagagatgttctgagcccagccacacactgcctggttacagggagagaaggggccttaaagccagggagacccaaggggcgtcagaagacgagaggagccctgagcatgtgggacactgggcaactgcatgagcaagctctgccgggaccaagctcccttggggttgtcccagagaagagatggagctctgtgagcctaaaggctggggctgtgaggggtgtgtcctcagggagactcctgtctgcaggaaggaggtagttattgccctgggggaaactggcctgagaagcatttgtgccaagaagaatgaagggccaggctcctccagaaaattttttccctcccttcctccgtccttttctctctctctctctctctctcgctctctctctctctctctctctgtctctctctctctctctctctctctctctctgagacagggctctctatgttgcccaggct

SEQ ID NO: 3511 - DNA, 1364 bp, Homo sapiens
ctttccgcccaggcttttgcgggctcctcgggccgaacccgaaggggctgttcctgaaccttgacttgttatcatagggacccaagctctatttttgtgtggccaattcgtgcactgcagcaaaatggcccttcagtcgcgtcttggggtttctcctcggttcaaatgctctcgcgctgagaaaaagccggaggaaaaaaaagcgacaccctccctcccccattaattatttgtggggccggagtaacgcgggctggtgcaaccggtgcatataaggacttgtgtgcaaggaaggggatccgcctccaggcgcggaaagagtagggaagaagcgcacacgcacagtgcacccagctgggcgcttcggcagtttgcagctgcggcggggtcgggtccacccgcggtccccggaatgccggacggctgatcccgggtgctggtcactcgccgattcggggctgggaaggtttgccagaagcgggaaagatgggagatctgagcgctctcttggcatcgccacacccaggacttgctcgtgccgcaattccccacggaaacaaccgagttgaaacgagaagcttgctctctgggtgcagtagctagaaggcttcaggtaactccaaagccaacactgggtgaggcaacacacgccgcctcaggactcagcatttctttcaggctgcgttttcgtggcagacctacccagattgatggagaaagtttggctggcggataagaagtaacgcggaagatgtgtacgtgagagcgatttcacttcactcactttctcatttaaaggttggatgttttacagtggtatacatgattctccttctgtaatcaagagtgggaagtcgcttcccccaatccccgcgcagcccttcttctcccgccttagccatgcaaaatacctagaaagaaaacactaaaactgaacttttttccaaatacagcagtagctttgaaagcattctttgctcctctgttaacagcagaatgtaattctgaccactgcactgatggtttcttaatcatgcagtatgaagatcagcttcaaaataagtcttatgaatgaatgaatgaaagccagtgcagttagttcatcatgactgcagacattagaggactttgaaacaacctttggtgtacattgtactgtttttgttactgatattgtatgtattcatatgcattgtggatcatgcaccatgaaacttgaaaattgttccaacatctcaatggccacaacagtttggtagcttttgcctgtaaacgttgtatgtaaacatttgaacgtgttatactaaattactaaactcattttttactaaaatcatctggttcgacatagtaagtaacgtgca

SEQ ID NO: 3512 - DNA, 6821 bp, Homo sapiens
atgactgcaaacagaagaaagaccaggacgcagcagctgaactttttcttcaggttggtgtgaatcataatgaagatgtgttcagggaagtcactttgttctgagcaggaaaacaagcctaaaaaaagtgagacaaggaaaaacaaatgatgtaaagaaaaacccaatgtggcatgaggcggagcgatggactgagcaatagatttgaaatgaggtgacttgaattccagccctggtctacctcctggccacctctgcagcctgttaagcaattctcgacaaaagtcagactcaatttgggctttgaacgtggacagcagtccctcttcctcttccactcttccactcccttcttcctcttgagccatgaacactttatatgtcctcccatcattactttttctatgctgaatattagtttctggttgccttggtctacctctctgactgcactctgagtttcttgaagtcagaaaccacatcttgcaaatcactcagttcctagggccttgtaacatttgttaaatgaagccatgcatgcttgaaaaaaaaatagaataaaaaaaagcaggctgactgttttacatcaccagacctaaacttcctaaaatagtaagtggcccaacaccccttcaaaatggccagaaaaagacttctcgttatagatgatgccatagatttctgatgtatctctctaagggctgcgatgctggactcctgcatgagaagatcgagggttatctccaccacagttttgtgcagtgccctgcaagaagagcactgctgagacaggaagctgactcacctcatgatagaggctaggaattctgggtaagatagcagacatgtagccaactaaggaaatggaaacaaaaattcattaagcacgctagatgttatttcacttaacttcaccataaccagggccaccatgagacacaactctgggggcaccacgcatagcatagtctaatacgaagggcatctcctaacctgtacagggttcacttcaaaggtgttataatctccattttatggattagcaacctgaggctctaagaagtcaagggaagtgcccaagctcacagagctgaggaaatggttgcactgaggttcaaatcgaagtggatttgattccataacccatgtcctttccagtacaacatgcacagaactgcaagaagctctggaaaatagatttcactgagcaaatagagactgaatagtctctttatttctgagtaaacacctactttgttttctcagaatttattgtgtaactgaatggaaactggaagcactttgaactcaaataatgtctgtatcttttggaaaacattacattctttccccaatcactgggtttatttacaataataaatcaaagcaatcacctccggggttttgctaacccactaggggtctgaggtcccttcccatggatcccgctcctaaggatatcaggaaaaggtagtaggagtactggactgggtgttcacaaaacctgggttcttatccccattcttggtgaccttgggcaggtcacttaatatttctgcccctgagtttttcagaataattatctctgccctatgtgatttgcagagtgttgggagggcaaaacaagagcatggtattcattggatttgaactagataagcaaaaaggcacagaaggtattctgaacagagacaggagagcagcagctcagcctgggggccatgtggaggtgatacgggtagtgaagacagcagtgtgaagccacagccatgactcagcagccctgagctccaggctcttccctgggaattctccatgaactgacatccagctcattcctggaatccattggcagtaccaaccaaagcagtgcttccaccatcccagacctcaggaaccagtgactctgggaacgatgggctcctatcttgggctgctgaagttgtggaaatgattaaatgtacacagtggaagaagaattcagatagaagatcatgaagtgaagggtggaagcttgttgtattaccagaaactaaggaattcaatttccgcagacacccaacacaggtaatcacatgaccatatgacaactgaagaagaactagagaaaagaaggaaagtagcatttaaggagggcctactacgtggtagtcactttccttgcaatatctcattgaacctttactacaacactatgatagagatattgacaatcctattttaggaaatggaaaaaactgagacttagcaaggttatagggtttctccaatgtcaacagcaagtcagttctagaaccagaattccagcccaggtctgtctgactctaaaagttcatcatctttccacccaaggacatgcatctgtgataagggacagtgagaagtcagtgtgatcaagtcggactcaaggtcactagagaggcaacttcgtctgtcagacagtcgcagacaagccaccttcaccatcagtgctgcacctgccatccctgctgtgcactgagtggtaacactcaggtactttccgtattggtaaggttttacagacctattatactcccgtgagataagcacagcagattttatgagctccatttatagctgagtatagtgaggtttggaaatacaaataattttcaaagttgcatgagtgatttggaaatagtggacttagaacctgactttcacatgtctgaatgaaacaagatggcaggaagggcctgattcactgtcacaggagtggaggctcaggcagcagctgcccagtacctactctccaaggtgtggtttcccaggaaagaagagttcctccaaacagctgggtctagcgacagtcttgcaaccatcagacagcctcagccttcacagcctgtgctctgtcatggcctcagggcactcatctgaaatctcacataagggctcatgtggtcccttgacaccacccttggttgaggctccaagtccaccaggtggctggagtttctggtcacaggcacttataactgcaagaccctttctcatctctcaaattgtctgaagaaggcagaggctgaagaaactttctctaaatggcgcaaccgagggaaaagagtagcaaacttttctctacaaatgttttggaaaaacacactaagctttgaattttccaattacaccagactgtgttaagcctccaggtgtctgcactgctgcactctttctccttgtccatgtgcctgccagctctgacagcatcacctttctgcttctgaaggtcagtggaggccacctccccttccgcactatccctgctcccctttgctgccagccagtgctttgtaatgcttgcttttcatgcctgactttgctgctcaaggaaaactcctcctggtatcctttctgaaaccctagtacccagcacagtgcctggaccagagcggatactcaatgaaagattattgaactgatgcaattgtatcagagaatctttacaatcatcacgaggcttctagaggaagaacacagcgacttgcatcatcaccttcaaagaactggccaacactgaaccggcagaaatcaatgctcaaagcaaggaaatcctgtcccgacccacccgtcatgacatactcagtaccagttgcattcgtggcaggtagtaggtactcagaatggttgactgaaatacagaataacttaaatcttatatagttaatagaaatggacaagccatttctctacaccccccaatgaaacccacattgaatcagcagttaaagaggactaaaaaatacatacaaaaagaaaacagcaaagctggagccagatactgagatcctgagattccctgccaggacatctgccacaccagcttttactcaggaatgtacccctttgctagcccatgcctctgtgtgttccttacctgcttctggctaatcccccaggggcggcaggcccttcaggtcctcaggaattagcactattatccatgggagggaaggtttattgggtctgcaggccaaggcccatttttctcaggatgatcaaaactcatctgcaaaggcaaaaaataagagacagaaagagaggaggtgagagctgttttccagcagaggcagtgttaaacattaacaagatggaaaggtgcttatgcagacctaggctaggtctcaatccaggaagcctccagggctcaggaaaaagagagagagaaaagcctattaaaggtgcaatgctctggatctgtgaacagcacagatagcctagaaatagacttgacactagccgggtgtggtggctcacacctgtaatcccagcactttgggaggccgaggcaggcggatcaggatcatgaggacaggagatcaagaccatcttggctaacacggtgaaactccatctctactaaaatacaaaaaaaaaattagccaggcatgatggcgcacaccggtagtcccagctacaagggaggctgaggcaggagaattgcttgaacccgggaggcggaggttgcagtgagccgagatcacgccactgcactccagcctgggcaacagagagagactctgtctcaaaagaaaaaaaaaaaaaaaaaaaaagaaatagacttgacaccagataagaatgggctagaaagctaaagcggccaccatggaccaacctgggaagaacaggttgtttaattgctggcttggaggtaaacagggagtaattaggtccatcctgaaataaacttcatacagattttcaaaaaattatttattttcaaagaatatttaataatatgtgaaagttcaatcagtataattgtaactgaaaaaatacgttataaaacggtaaacactatccaaattcagaaaaaaaatacatttaaaaaaacgtgaaaaagtactaggaaaaagtactagaaaaaagtacacccagaatggtaataatagatgttttcatcttttataattttacatatattccaaaatttctaaaatgtacatccattattctttgactttgaaaaaatgtacaaaagtataaaaatgtaattttaaaaagctaaaaataagccaggcgtgcatgcctgtagtcccagttactcaggaggttgaggagggaggatcatttgagcccaggagttagaggctgcagtgagctatgagcgccactgcactccagcctaggtgacagagtgaacctgtctctaaacaaaccaacaaaaaacagctaaaaatataaatatatacctgtcagctctttcttcttttgatgcgatgtaggaaaatagcaaaggaaaagtttaatacattcagttgcaagaaaatttcaacatctatacaatgaaaaatactgtaactacaataaaaaggaaaagtcaaaatataaaaagggttaatataataaaagtctcccaaaataaagaggtaatcaacatgaacagactaatcacaaaataaaaagcacaattaacaagcatataaagttatggttaatcatgagagaaacccaagaggggcaactagaatactgagaaactagtttatagaatttacattcgtccgcagttttctacatgataatactcattgctggacagattataattaaatcgatatatattcaaaggatcatataaattaatgtaacctttctagaatgtattcaggccatagaattaagagcttctgaccatggaccaggctactgtacttctaggaaataagagtgaataaataaataattcataaataattcaaaagattacatactccagtttccccacatgtaaaatgattctctacattacatagttctgatgacaaatgaaagaggattaatgagataaagaatatgagttctataaagcaatacgcacacaaagaagaaaagggtttttttaaaaaataattttaatttatatgttagattcagggggtatgtatgcaggcttgttacctggtatattgcacaatgctgaggcttggggtatgattgatcctgccatgcaggtactgaataattcattttttagctctttccccagccttccccgtcttgtagtccccagtgtttattattgccatctttatgtctatcagcattcattgtttagttcccacttataagtgacaacatatggcatttggttttctgttcctgcattattaatttgcttaggataatggcttccagctgcatccatgttgctgcaaagggcatggctttgttctttttcatggctgtgtactattccacagtgtatatgtaccatattttctttatccagtccaccactgatgggcacctaggctgattccattctttgctattgtgaatagtgctgcaataaacacacaagtgcatgtctctttttggtagaaacatttatttccttttggatatatacccagtaatgtgattgctgagttgaatagtagttctgttttcaagttttctgagaaatctccaaattgcttttcatggtggctgaactaattaacattctcaacaacagtgtgtaggtgttcccttttccctgcagcctccctagcatctggtgttttttgacttaataatagccattctgactgacgtgagggggtatctcactgtgcttttgtttgcttttctctaataattagtgatactgagcatttttcatgtttgttggcagcttatatgcatcttttgagaattgtctgttcatatcttttgctcacattttaatgttgttatttgttttttgcttgttcaattgtttaagtttcttatagattctggatattagatctttgtcagatgcatagcttgcaaatattttcttccattctgtaggttgtctgtttattctgttg

SEQ ID NO: 3513 - DNA, 3412 bp, Homo sapiens
ggattggtgacctactaacagtgaccctgtggctctgtggaattttgaagtgccttttgtgaatcatgaatgaaacatttaacttgagaccctttaaaaaattcatccagaatctgttaccccttgggtagtttgatggaactgagttaagcagaagaccccagctgttttctgggtaagccaggctttgctgtatctggcagtcaggagagaggtcagcccatggtggaggtcttcagtgccgagggctcggatgagaacgtgtagttctttgacttggacctgggcagcgtcttctatggatgcctgccttgtgagcacccacaccttccctccccactgtcgggttgagtagccccagcgtggctgtgttaggagtcctttgcccaacattgtgctgcactggagcctggccctggcactgtcctcaggaccctgcccaagggcccaccgcagagcacacctatgctatggggagccctgctggcagccccgagagccatgccatggcctgcaggagccaggctcctgtgtggatgaagtccctcttcctctgtgccttgatcccttgggggtgcctttggtcatctcttctgtcctttcctgtctctgaaatagtcatcactccccttgactctctctgttcacgtcttctcagtctgcagagttaacttctgtaaggagtttaatctggggttccaagaaaacaagttccttgttaacatagcactgactttgcaacaatagaaaactaacaaatgagcaacaatataaagagtagaggtagttctcattgggtgtaacttcaacccattctgcttgtggttagaatttataattttgctaacgatgtaatttactaaggtttgaaatggtattctaacagtgagtccattgtcttgaggattaatctgatttataagtaatactgatagacatattttcgtacatctgagcagaaataaatgcatgtttctagcatatgtaatataaaaactccagaggataagtttacacttaacaagatgttgttttctatttttgaatttcttattatttccccctttttggtagtggagttgagagggggagcatactatttgtataaagaactgtcaccccagagtgacatttattttccaagatgaccctgaactcatgctgttggtttcatatggtgtttgtgtgctttgcctagattcaaggcctgaggatttgaggaaaatcgggattttttttttcctatttggttttcatgtaaaagttctaaatgtcacttattttgctaaataagaccctttcacaggatagtgtgcgcaatacctgtccgtgtttccaagcagagttcaagttcatgtcttcacaagtagatgagagtcacttccagtcgggggaagcccgcctgagcagtgttttgagagtgcgtacattggaggactgccccacgtccgtttgcactctgccttgcaaaacttactgtggagacgtgtcccagactggtctcagaccagagtttgtggcacaggaaaacctggccccctaaaaagaagttttggaattggaagcctgataatttcgggaggctgaggcaggagaacggcgtgaacccgggaggcggagcttgcagtgagccgagatcgcaccactgcactccagcctgggtgacagagcaagactccgtctcccaaaaaaaaaaaaaaaaaaaaaaaaaaggaaacctgacaattctacccacctccccccacccccgactataggcaaagagagttgatcacttccagggtctctgacttctgtgacctggaaatcagcctggcttgggaaattcatgttgttgatctttaattatttaattattctttaataatccttctattttcttgacatctgacccccagcaagagtaaggatcccagaggtcaaaacagtggtgagagccaagctgctcacagacacccacttgatgccacagccatgccatgaggcttcctcccagctgctctgctggcttgctgaagccagctctgagtcacagggttgccttggaccctcggctgtagggggcacctgtctggctccgggccctttgtcctggatacactgacagtaatgtgagcgcagcacttcagagttcaggcccagcaggtcctggcaagtgcattccacccgaacttttaacccaagcggtggggaaggaagccaaaactccaagctgcactttcttggggttctggccatgcacttcttagccttctctctgactttacaggacaaaaggtaccccacgccttcagaatcatgcttacctgcacggcagcatctgactggatggctggctaggtctcatccaccccaaattactgacccttgatttatgttgttactgctcaggttatgctcagatgccctggttgcctgaagatggtttaagtgcaggcccttcagacaagtcacgtcaggcaagagagggctggcctctgacccacaagagggcagatttgtggccaagaggcttcctggcatccacccccaggcccaagggatcagtgtggtgccagagaggatctttaagctgggactgtactgaggcttgatgggaagtatgggcagcatgtacttgacacgttatcacccagtccccttgtaaaatctggaatggagcgtttaagctgagcgttagcatcaggtcagcaggcaaagcaaacctcccacaaactgggtgccgtaaggtgggaggtgacacatggagagcttcgtcctggccgagcaggcacccagccccatgtcccccgccagcattctggatgtcagaggagggtgcgtgtgatggcgtcacattcatctgaagcacactgattgattttccacaaggtggcaagtttgatcaaattgaccgcttttcatgagacacccagatgctgtaaaaaaaaaaaacagcactgggatgtgttgaggagggggcagtttgctgtgctctgttctgtctgctgctctctctgggggccgcacaatgtccgcacacatcacggaggggagaaaggcatcagtaccaaacggaacaacctcttttttctacattgtccatacccggacatgtgaggctctattatcaacaggtggtgagaaaaattatgtttttattcgctttctggtaacttctgtaggccctggctcaaggacttagcatttcgtctcatgtacatctttttcttaagtgttctttgccatttctggaattgtccttggtttttccttagctcataggtcatagatgcagaaatatagtatttaaggcatccgcatccagcatcagatggctttgcatccagaaaaacattgataactcagtttgaagcaccaagcatgtgtaatatggctctatacaatataataaatgcataatgttaagctt

SEQ ID NO: 3514 - DNA, 8805 bp, Homo sapiens
atagaaagtaaagattttaaggctttacaggtctgaaaatgtctctactcttgattggtagtttggagtctggaaaataacatgccttcagaattttaagggcaacatttcattgtcttaaggcatttagtttttctgtgagaattctgataccgttcctttacctgggatctgtttttacactctgtaagcttttaggaacttctcattacttctgatgtttcataataatatgtgggtctttattcattcatcttgatggctacttgacttggtggaatctttcaatttagagatttgtctgcttcagttctgggtgtgtgtgtgtgtgtgtgtgtgtgtgtgtgtgtgtgtgatctttttgacagttttctctcttccattttctttgttctatctttctagaatttctgttatttgaatgttggacctcccagagttggaccgcctctaaatttaaaaagctttttctctctagttgttccttaagttatattatctttgttctttttgttatcctccagctcttctgttgaattttctttatatatatattttaatttctaagaggtcttttttttctgtttcatttcataaaaacctatttttattttatagattaactgtttccccatatctccctgaggataaaattaagatttttttcttacatctttcctgtttcttgaatggttctccccctcccccaccatgtttctgctttctatttatttgttttgggctctttcattctgaagcctttcttagaaatcatctattcatattagtcatgtattaaaaagctaatgtcataggtctttatatgtgggcagggtttataagttgtctaaagggccatcaggtagagttggccttttctgttgaggtcccctaaatttcagtggaggtcttctctttggggccagtttctctagaaaactgggtcctgatagtagggtaagaaaagacagctgaggaccccaagatttgtatgatgacttttacttaatccctctatcttcatcctctctcatgcccatccggccccaccccccaaatcctcctctggctgctgaccctcaggttcagtttttcctgtcagtggaggttgagggtggggcgtaggctggctgtggagagtaggggagaggacctgggttccagttgctctttatacagacttctagtcctgatttcagccctatacctcactctcatcttctacaatacctagtgcttccaagtcctgaacttagtagaggtttggtggggtgtgtttttgggcttctcccttttgggtacttaggctttaacttcctccactctgctaggttaggtattgcacttcctcctggtttttatctgtataaactttgttaaaatctcatggctttgtcgtctgtgcttttttgtggattaatactatttatattcctttaatatcttttggtggtttggaggtagaggaaataaattcatgtggttggtttgtatgtttcactgaaagtctagatttaaattctaatagtgtataaaaaataaaaattctttagtattaatttgtaattcattctagtgatttttaattcatatggttttactgtactacctacctcatagggttgtgaggattagaagaatcaattcataaaaagcagttagaaaagtgctgggcacgtagtgtgttgaataagtgttagttattaatattgtttactatcattattattattactactatcagtttttttttttttttctgagacagggtctcactctttcacccagtcttgagtatagtggagtgatctcagctcactgcagtctcgacctcccaggctcaaatgatccttttacctcagcctcccgaataactaggactacaggcatgcaccactactcctggctaatttttgtatttttttgtagcagcagggttttgccatgctgttcagactgatctcaaactcctgggctcaagggatctgcctgccttgactttccaaaattctcggattacaggcatgagccacactgcactctcctatctctctcaattcagtaacctgtttattcttgagtgaaaatgtttcaccataggaagaattactaatatatgggaaaatctagtgtttgataatgttgaccctacattttttttggacagtctctgtcgcccaggccggagtgcagtggcgcgatcttggctcactgcaacttccacttcctgggttcaagcaattctcttgtctcagcctcctaggctacaggctaggactacaggtgctcgccaccatgcccagctaatttttgtatttttaatagagatggggtttcatcatattagtcaggctggtcttgaactcctgacctcaggtcatctacctgccttggcctcccaaagtgtcgggattacagatgtgagccaccgtgcccagccgaccctgcatttaactagacttcatatgaaatgttcaggtgttaggtgttatctttctaagaaacattcaagccttaagaaatccaatcagttatagttactttaaaagttttaaaaagagtataacaattttgatgtgcttttaagctttattggtattatattttgtttttatcatataaatatgaagtataggagataagataatgcagatgatgtttgttatgccttacctaccgccagtagatgtaatactcttaatacatggagtacagaaatagtagattcccttcattcccagtgcaacagtgttgggaggtggggcctaccaggaggtgtttaggtcatgtgggtaccaccctcatgaatagattaatgccgccgtgtaaagggcttgtgggcgtgggtgaacactctcctgctcttctgccaaatgtctctcccttccaaaggacgtagtgctctacatagtgttggaagcgagagactgagccctaacatgccagtgccttatcttggatttctcagcctccaaaactgtgaaaaaataaattttcattctttatggtaaattcccatcactgtatccataacctcttgtaaatagttgtacacctttcagaaaatgttgtggacttacataagcaaaatgcctgcatttatttcataggtaaaattttaatctattttctaatcaaagtgttttggggaacatttaatttaaatactatgttcaatttttttaatggtctgcttcagattttttttataagttaatgttttaaaacaaaataattgtgttctaggtagaagctactctgagtttaggtttttaaatctctttcagatattttaagtatcttttttgtgtctggattcagagaggtatgataatgagattctcttctagaggggaagtgggagtaggtaaccatactactctttctacggctacagagccgcatactcgaaggagggagatttttatttgtaaggacatttgtattatctttcattaaagtagagtcccatgggcgtggcaaatggctgtaaataaagtaaaagtggctaaagaaaacagtgcctgctattagcttgatgctggcattttcttctttccctggatgtgactgttattgtctttattgggtccccttattatctgctttgatatccatctctggaactttgatctctaattttttttttttttttttgagacagagtctcactctgtagcccaagttagagtgcagtgacacgatcttggctcactgcaacctccacctccggggctcaagcaattctcgtgactcaacatcccaaatagctgggactgtaggcacgcaccaccatgcccagctgatgttttgtatttttacaaaaatttttcaccatgttggccagggtggtctcaaactcctaagctcaggagatccgcctgcctcagcctttgaaagtgctgggattacaggcgggagccaccgtgcccgacctgacctctccatctttggcgtccttatgctgcctcttctccaaatacatgttggccagggtggtctcaaactcctaagctcaggagatccgcctgcctcagcctctgaaagtgctgggattacaggcgggagccaccgtgcctgacctgacctctccatctttggcgtccttatgctgcctcttctccaaatacagtaactaatctagtatattttcataggatagaatttgccctttctgtcccataatatgttcctcttccccaaaaagttttttgttggtctctttggtaataaaacatttagagcatttactgtgggccaggtgctttacctcatgttagccttataacagagatgcggaagtacaggactaccagtgcagccaagatgcacagcaccaggattaactcatgagactgattagaatgatgaatatcttattgtatcctgaaacattaagcctttaagttatccctttatttagtatttaaattcacatgcttcttgatttttttggactagcattagttgttgaataaataaataattcagaatgtatccacaaaacctagaatatatgacagggtggattcagttttgcttagttactgtagataaaccaaataaattaatgtaaagggatattaatgcattaagcaattttttttgacataaatgaagggttgtttccatgggtaatatattcagaatattaaagatgagtaaaatgtatgactataatgaattccttcttcacttttactctggcaaggtgggaggagggtgctgttgataatctctgtgcttttgcaagtttggcacaaagacttttactcacttaaatctcaatataaagtatattgccagatctggcagcatggggacaattaggaacaaaggagagagaatagaatcagccatcaggagctataaccacactcttctttctcaaccttttctggtattagtaggcagaactccttttggatgcggtgaagcattttatgagtgaacaatggtgagtcatgtaatgaaaggagatgttctaggaaaacttttcagtcccgctcagtgctgccatctttttctcccagcactctggacttaaaattctgagagaacagggtatttcccacccttcctcttactttttgaaagcaatacctgagttattaagcaatcatttagacagtatgaataaaccaaaattcaccttgacactccatcccctagaggtaaccattcttttctagtatatattcttccagacctttttcctgtgtattgacttttaaatagatgtacattgcaatagtttggattagctcatccatagcagggtggttaaataaacagtggcacttttttttttttgagacagagtctcaccctgtcgcccaggctggagtgcaatggcgcgatctcggctcactgcaacctttgctttccaggttcaagcgattctcctgcctcagcctcccaagtagctggaattacaggcgagcaccaccatgcctggctaatttttgtatttttggtagagacggggttttaccgtgttggtcaggctggtctcgaatgcctgaccttgtgatctgcctgccttggcctcccagtgtcaggatcctggccccagtggcacatttttatgatgcatctggtactaaagaaggagctggctttatgacctttacttgagtatttttttgtgtgtgacagttgaacaattctgacccctattattgttggctggacaggcattttctttttaattcctctatgcaaggaactgtggattgcttttttctggatagctagaacgaggccattttctttcaaaagacagtcctagagtttccagtggttttctttaattgtgtatgcgtgagtgtgacagtgtgtgtgcctgtgtctctatctgtgcatgcatctgtatgcacagtttcttagttgtggacaatgcaacttggaatcattttagttttccaattgattttaaaagtttatctatagaagatgagacaaatttgctgtagaagttaccactacttggtcaaaatagagagttgtgggtttttttttttgtttgacaacaatcaaaagtatggcctacagatagtaagggttaaccacccagatttttgtcagataatatatacatgtccatgtaattaaaagtcttcatttgacaaatttatatggtaaatgagcataaaatgaatatcttttcagtattagaacatttctgtttatgccctattccagtggtatttgtggtcgctaggggttgctgggttatccaagtgattcagcatgccttcagaattggcatcctcgggtgattgtccatagcctcttgcaatggtgcctcatcttggggaggctttagaacacagctctcatttagcttattattgatttttttttcttgttttgcagttgttggctagagaaaagtgtgtagcaataagtacgcacacttactgtggtttaccatcatgaccatggatagcaaactgcctttttttttttttttaactcctgtgtcatctctgatgttgtggctaattttaagactttgatttttcagctaggattagcggagaatgacctacctacttgattaatgatgtctgcatgggcttactaagagggtgtggggaatggtggcaggggtaactatcatcgagaatatagggcaatgggtatattctaactttgcataactttgctagattatatatatctttactcacaataagcaaagttgaacaacttaaaattgattccctgttttctgttttcactatccaactaggatgaactcttaagttcatacatatactttaaaatgggaacaaacatagcctgtcatgtctttatttaggctaagtgcatatgtatgtataagtaatgtgtatatccttcacttattaatagtgccttcatgaattcaaagacccttgtcacatggtgctcaggaaaaaaaaagtgccaatattctttttttttttttctctaagaagtactagtttaggtaagtgaaattcaatagcatatcagtgctttaccttagtcactttttgtgttttgatcacccttagtcatcactggagagaagagtttgaattcatttgtggttttgctttagtggcaaacctccttacagggatgagttgccctccattctccttgccatatttggttaatctaggccatgacctttgaggggaaaaggcacagattgcaacttttctttcctgcttttgtgaatcaggccatgttcacgcagggtccttgaaggtgacttgagtgaggaagctatataccgatgacttaccaatttttggtcttataacattctctctctttttttttttttttttttgtagcatatggcttcctctactgtatgttggcatttgccacttttggggatttgactcctgcaggtatttttttttttttcttttgggggagtgtgacggcagtggatatagtcttagatgatgtttttaatagttcaagtccattagtgtcttactctagagaaaacgaaagactcactgtgtgagttttcttgccctctggttttcagaattctgtgtagtttctcaacatttcctttctacctgtcctgaagagctcttatggaaatcatggttgaatgttagtaaatttctaagagctttccaatgttgtctataattagccaaaaaaagacatatgaacttttctcattctgtctacctttttaaaattttattcactttatctttttctccagttttgatagatgattatagagttccccaaaatggccttcttactatttctatattaggtatattatttcagaaaagaaaataatcacttgggaatggcggtgagttcagggggtctgttaaccatttaatttaggattgtttatacatttatttacctcttttaaaaaatttcttcagttaatattcattgaccactcactaagtgttatgttgctagtatttatctttgctttctaattatttttttgtaatttttttgctttctaattcttgagtgaatttaaaactcactgctttattatttaatatcttagatacaatgactatcttaattataattggctttccaaaattttcactttttttcagttaactagttgaatagtatttatcattcacatttgcaccctaactattgttttaacctaaacataaataagcaagcattagaaagtagcataattgctgttaaaatagtcttttctttgcgtgtttaaatattgttagaaacataagcacatgaatttttttggccttttaaatgtctttattgtagctagttataagatgtatatatagcttatatatgtgtatatacacatacatatatatatatacatacatatatatacataaaatgattcttgcaaaagtagttatgggtatttaagtgaaaaatttgtaagtttagaagttaagaaattggaaataatggaattggtttaaaaagctagtctctaaattaacttagaaacctaatagcaaatacagattttgattgctataactaaacactttaattttgaaaaagtttcagaatagaatttctattcccaggggaaaataaacttcatttaaaaatatatgtatacttattttgtgagtatttttttcttttccaaattccaaaaggtgtatactctatatttttgtcataaaaattctgcttgtcgaaaatattgtagtaattttataaattcaataaaacctgagtgatgtgaacagtgtgggggaaaatgtttaataaatttgccatgccactgagaaaaacttaaatacagcatgttttgaaagtttg

SEQ ID NO: 3515 - DNA, 1194 bp, Homo sapiens
ctcatcccattcatattttaaaaatactaatattttgtgtttgagcattttaataggctcagaaacttaaaaatgatgtttcttttctaacaacatactcttttcaatgggatattatggttgttattatttaacatgacatttagggactcaacatacattaaggtgatggcactaagataaatgtagaaataaccagtaccatgtaattttcataagtgcttaaattgttggtaaacaattttatgagttggaggtgttgaagcaaatattattaatatttgaacataaaagctgatcaaaggggcctggtccacagaagatgtttatttgatgtaacaaaacaatacagttagtgttagatccaaccacaaagagcaaaaggaatgaaaaatttgtacaatgtacatagaaaaaacaagatatttactgtgacaactatatattcctaaaataatgcttctaaaattactcaattattgaaatctacatgaaaaaaaggatgttaatagcgacaaagtgcataaaatcaaacattgtattttgagcaaattaacatactaggcaattttgctaagaatgcatgattttttttttcttgtttacagtctgctcaaaatatctttataccaacagggtaggcagaacatttaggtttaatatcagttacacaatattagcataaacttccacaactacatagggtattgttttcttttgagctggcaaagtgactatagaaacatcagatgatttctctgaattgagaattttatccaaataaatgccacataccttctagatatatgcatatctttctatattatgtaaatggctttacccatttaaataataaaccatacagcatttaagaatcattattatatgattaacaatgtcatgttccaggtttaacaatttcataggccaaaaaaaatttcttcttaaaaactagttttataaacgcagaatatattccatgagtaactgctggtattttttaagaaaatatattgtgcaattgtggctaccacgtactgctggcaaagcattattatttatgtaaaatgtgaaaaaaaaggtgtaaaaatttttcaactgcctatgatcatgatgaaaggttactgccttcttacaaaaattatattggcatcttcttaaaaataattcgaaaaagggataaactccctagcc

SEQ ID NO: 3516 - DNA, 1785 bp, Homo sapiens
gcatttgaccgctcctccctccgcgttggaggcggaatagtgggttttgctgcaaccggtttattttccttctgttttcacccattctggcacaatctggcgccatcgtccttcttgtgaggccaagcctgaaaatgcgaagcagagaggcaggaccaaaattgaggcgaatccaggaacctgccaatgggtctccgggtgcggtctctgaaactggaggatatcgggaggaaaggctctccgatgcggagataatggggaagctcttggcatggttggctgtaggtatgtgataccggaggagcaggagtcaaataggatacgccgacttttaattcaaggaacccttttctgaaacactttgccacaatgaaggaaataagattacagccgaagatacatattaaggaattgtactctcagagatgttgagaaaagatacatgggtcttggaagataattactcaaaatatgcagggaaggatctagtttgaagcactaagaagaataagacatcagtttgaaaagaggctctatcagaacaacacgaattctgctaaaattgaagcaagaacaaacatcaaatatatgttgacacttgggtggaagaatggtgaactaattgatgctttatgaaaagttgatagggacagtgctccaaagaaatcagtttacaaatggataactcgttttaagaaggcataaggtaatgttgaagaagaagcccacagtggcagatcatccacatcagtttgtgagaaaaaagttagttcatggcgtaattgaagaaaaccaacaattaacagcagaaacaacagccaacaccatagacatctcagttggttcaccttacacaattttgactggaaaagttcagcaaactttatacctgataggtaccaaaaccattgcacccagatcagctacagacaagaatagagctttcaatggaaattttaaataagtgggatcaggatcttgaagcctttcattgaaaaattgtaacaggagatgaaacatggctttaccagcgcaatcctgaagacaaaacacaaagcagtggttaccaagataagtagttcagttaaagcacaagaggactggttgagagcaaaggtcatggcaacagcttttgaatgctcaaggcattttgcttgttgactttctgtagggccaaagaatggtaacgtgcttatcatgggagtgttttgagaaacttagccaaagcttcagcagaaaaatccccgagaaagaccagagagttcttcaccacaacaatgttcctgctcatccctctcatcaaacaaggccattttgcaagagttttgatgggaaatcactaggcatccaccctacagtcctggtttggcaccttctgactttttgtttcctaatcttaaaaaaatttttcagggcagtacatttttctcaagttaatgtataaagaaactgcattgatgtagataaattcccagaactctcagttctttagggatggactaaatagctggtatcatcacttacaaaagtgtcttgaatgctatagagctaatgttcaaaaatatagtttatattttttatcttttaaccatttttccacaaactttttgaagtctccttgaatatgtaccatttataaaggggaaaaattctgtgactactcatgttgacttaatgctgacttaattttctgttttgtaaatatatacaaacaagttgatacaaattttgtttatagcccttaaacaaatttgtgaaataaatgcattcagaaacaaactaaaa

SEQ ID NO: 3517 - DNA, 2370 bp, Homo sapiens
atatatatattttaatatgcatactcctaagtaaagtttcagagaccacatgctggagagcagtggctttcagacagcatcagcatcacctgaaggccttgttgaatacacattattggaagagaggggagaacacaggctcatgcctgtaattccagtgctttgggagactgaggcaggaggatcacgtgagcccaggagttcaagatcaggctgggcaatacagcaagacccctgtctctacaaaaacaaaaacaaaaaacaaacaggcatggtagtgcatacctgtagtctgagctgcttgggagtctgaggcaggaggatcacttgaacccaggagttcgaggctgcagtgagttattattgggccactgcagtccagcctgggcagcaaagtgagaccctgtctgttaaaaaaacaaaaccaaaaacttgattgctgggggccaccctagagtttctgattcagtaggtctggcggtggggatggtgggcctggtaatttgcctttctaacaagcgtccaggtaatgccccagctgctggtcccaggaccacactttgcagattattactctgagaagagcactaactctgacgttggattccttctgttcctcattagtgaatttatttgggggagattattcaatctggtagatccgcatttacttagctgtgaagtggaggttaatgcaacctgcctgagactgtgagaatgagaaactctaattgaaataccaggcccagcgtgcctggatgcttgaaaaatgctgactcccatggtccgtccttccctcactcttctcagctataaagtgagaagcgaaattcagtatcttttaagattcctctcaggtgtaaaatgctgtgattctaaaagtttaattttgtagttccagagacaatgccaaacacctgtgtgtgcttagtgctttgtaaagagtggtaataacagtgacaccacataggccgtagttttgtagttccagagacaatgccaaacacctgtgtgtacttagtgctttgtaaagagtgaataacagtgacaccacataggccatagttttgtagttccagagacaatgccaaacacctatgtgtacttagtgctttgtaaagagtggtaataacagtgacaccacataggccgtaattttgtttttgcttttgttagggtgttcagcatcttgactccttaaataaggttttcagtcagatttataaagcagcattgaagaagttgtattatatttgagtacagttggaatccatggcagttttatggaggccaaatatatcagatgaataggctaatttccctgagttgctggccttattagtccctactctgttgccccctggttacctaatgcatgttcaaaaggtatagttttcatcacctgcttgatcttgattttcagacagcatcaaatcagttgcaaaacaaatccaagctaaaattttgagtgtatgattaatttactatagcatgtaattatgcagtattttattttttattttttattttttttgagatcacaccactgcactccagcctgggtgacagagcgagaccctgtttcaaaaaaataagaaataaaaagtgagtcttcatattcaaattagtatatgaggttaggcaacaattcttatatgggaccaggtatatttaatttgcctttctttgcagtcatcctagtaaatccttgtaaagggttattttatatacaattttgtagtatattctaaatcccctttggcaaataaagctgaagttatctagtgtcagcatactgtgatttgtatatttatataagacaagattgcatcattctgattaagttgcagcattttagttttatctgataggcctgtattgagtaatcagtagctatgtgcaaatattaagtcaacttaattaccagacccagaaggccagaggtaatcaaagagtactttcggaagatgaaatatttataatgagttatggaaacaatgttttagaaatgtttttcttggtgtaatttaatgcagatttttacctcaattttgttaaaaaacttgataatttgatccctccatctatttaatatttaatattttcagattctagagtatttaaaatttaaacacaattataaaattaattataattcctacttatgttagctatgatttagggccaaaactaccctggttttgtcttgcaacttgaaacattgtgtattttaaactatataatttgggaacattattttatagactgtggataaccaaatataagatttgtgatttttaatgcttcatttgtgtaaaatcatttgtatattctatttatagtatgcattttctagctcattaaaagtac

SEQ ID NO: 3518 - DNA, 3231 bp, Homo sapiens
atttttgtaactttttataatgagacttacacattgatttaaattatatacaggatgctcagccagcacaaagctgtggtgagatttgggcccaagtctccgactccagattccaaaccacattaaaaaaaaaaaaatcacctgcagactgcctatagctttaacagtctctgtctccccttcttcacatccttccggtggagaaaagtttgtgaatattaagtaaatttgattcaatagacattttatttttttgtaaagatgatggggtcttgctatgctgctcaggatggtcttgaactcgtgacctcaggtgatcctcccacctctgtctcccaaagtgctggaattacagatgtgagccactgcgcccagcctggtttggtagtttcttaaaagtgaaaattagacctaccatgtgacccagccattccactactaggtgtctacccaagaaaaataaaagcatgtttccacacaaagacttgtatacaaatattcatagcaactttatttggaatagcaaaaaaaagggaaaacaacccaaacagccatcagcaggtgaatggataaacacatggtggatatccatacaatgaaacactgctcagctgtgaaaaaggaacaaactattgaaacaatatccctgttcaggagcaggatttggagaatataagaagcatatcttttataatttaaaaacttgctttctaagatttgaactgaaagatcttttttgaagatgagtgtcatggaattgacatgatttgaagtgttatggcacttcctttgaataaaaaaatcaaagttgctaacaagttccatgtacttaaaaatattgggacagagcgctcaaagctatgaaaagttttgggccacccatgaatatgagataagattaacaagagaggagaaggaagtgaaaaatatggctttccatgcatttccaattgtatgaattaccattgaaggctagtgatgaaatgttactctctaggagtcagtgttttcacatctaaaaatggtatcagtcatagaaaaagcttatctgtctactgccaaaaagggaagagggtaatagcacgtattgagcacctactgtatattcagatgaggtcctgccatacgaaattcagtccccactgttctgggggccatgcaatcgtctttagataataggtgtggggctaggggttccgctgtgaagttaccttccttcccagggtgctcagccagcacaaagctgtggtgagatttgggtccaggtctcagactccagattccaaaccacatttaaaaaaataaaatcatcacctgcagactgcctatagctttgacagtctctgtgtctccctttcgtttgcatccttcgggtggagaaaggtttatgaatattttagtaaatttgattcaaaagacatttcttgattatcacattggttctcaaagtgtggtccctggaccagtgacatcagcattacctgggcactcattagaaatgcacattctcaggcctactcctgactcccaatccagaaacacagtgtgggtccaacaatctgttttaacaagtcctctggttcgctccaggctccagggtgggacagtcactggtgcttctgctggctgggacaacagggccccactgtggaacttgcagcccgtgaccccctcctaacggctcctctcagttcccgtggtcccaaaagccctctgtcccgtgcagggctgccccacagtggccttccacatcctcctgatagcagaggcccccgccacccccagggccacctctgcagctgtgccgcagcttctctgcccaggcacctgcactgacacggagcaccctgtaggttgtctgcttgaggcctttacctaaatgcttgccgcagctgtttctaaactacaaaagcacacaatcatgaaatgaggcagaggtgggctgagtgccacaatggatgccaagaggaagagagatggacatggcgctgggaggctctgggcaccactggaggggggcgctgagttcccgggctgccccggctgggagaggagtcgagtcttaatctcctttaaggaaacataataaataaactactttgccactagagtgatttatgtgttgatttgggtggaatctctttcatgaacacattttatgtctttttaaaaaaattagattatttcttggccaggtgtgggcacagggtggctcatgcctgttatcccagcactttgggaggccaaggtgggtgcatcacttgaggtcaggagttgaagatcagcctggccaacatagtgaaaccctgtctctactaaaaatacaaaaatttgctgagagtttgtggcaggtgcctgtaatcccagctacttgagaggctgaggcaggagaatcgcttgaacccaggaggcagaggttgcagtgagctgagatcatgccactgcactctagcctgggcaacagaatgagactccatcttataaataaataaattagatttcctaccactacagtgaagcataattttatgatttaggcaactaccctaaagggaaataaaactaagtgagattccacatggtctcagtaatacctgtagtgcaaaatcaaatgcttatagggagtgaaacagaatgcggccgatacctgtggaaaagagtgcttcaattgtcttatgtctacgaccagcctaagctcatagccatacaaatatatataccatacatgtgctgaaactaagttaaatttcttgtttttaattgtcttaagtatcaaacttggatcatcagaacatgttggaaaaacacggctctgaagccaacttattaagcacctgtgctgtatcgaacattttacatttgttcatttaacatatctagataaatctactcatttacagctatagtgatccaagatttcatcacagcagattaaaacaaaacctttaagttaaaaataatttaaaatcagtgaatatattaatactatgagagtctttgcctatgagaatacagaactttggcccaaatgtttcattaatctacagggttatatacatttggagcacagttttgttgtttgtttgtttgtttttaatcctcttcccaaaaatgggtttctttaggcagctcgagactcctgtgttagacaagaggaaaaggagtgggtgcctctcgactgggaccagtggacattattatgggaatataccagtggtggcaggttgatga

SEQ ID NO: 3519 - DNA, 2407 bp, Homo sapiens
cttttgacatgactttctcactgaggttaatcatttccagcttttgatctaaagtgagaaatttgcaactccttctttcacttgaacagttagaggccattgtggggtaatgaattggcctaatttcaatattgtccctcagggaattaggaggcctgggaagaggaggagagaggggagagtggccagttggtggagcagtgagaacatagcatttgttaagtttgctgtcttcgaaggttgtggtttgtggtaccccaaaacaattaaaataggaacatcaaagatcacagagcagccgggcacggtggctcacacctgtaatcccagcaccttgagaggctgaggtgagtgaatcatgaggtcaggagttcgagaccagcctggccaccatggtgaaaccccgtctctactaaaaatacaaaaaattagccgggcatggtggcaggcacctatagtcccagctattcaggaggctgaggcaggagaatcacttgaatccaggaggtggaggttagagtgagctgagatcacaccactgcactccagcccaggtgacagagtgagattccttctcaaaaaaaaaaaaaaaaaaaaatcacacagcaccacagtaagtataataataaggaaaatgtttgaaatattgtcagaattgtcaggatgtgagagacaaagtaagcacatgctgttggaaaaaatggtgttatagatttattcgacatgacattgccacaggacttctacttgtgaaaaatatctgtaaagtgagatgaagcaaagtgaagtaacatgaggtatgtctgtagctgttgctgtagtggtttccaaatggtggttttcttttccttttttttttttttctttttggtctgcattggggtcttgctctgttgcctagggtgtggagtgcggtggcatgatcatgcctcactatagccttgacctcctgggctcaagcgatcctcccacctgagtctcctgagtacctgggaccacaggcacatgctaacgcacccacttaatttttttattcgtagagccgaggtctcactatgttgcccagactggtctcaagctcttgggctcaagcagtcctcctgcctcagcctcccaaagtgccaggattacaggtgtgagccaccacacccagtccaaaaagtgattttctaattccatagtttcttctacatttcttaactggaattttgtaaggaagagttatccttattcatttatttacccatttacttgtaggagcatgtatcataaattcttaatctatggggtgtagttagctactgtaaatttgatgcacatatttttccagattcaataagtaggatccccatcaagctatcttctgaatctttaaaaatgtattctccttatttcatgggtatataattattttctgggcaacagtttgttcatggtacatttgtctccagccctagactcagaaaaatgtaatttattttaatggagaatactatttagaagctgcagtctctgtgtagggaggtgttcctaggtaatagtgccctggcttttaggtcttctctatggaggatatggcaaagacatacaaaattatatatacgtatccacacattaataactctatttctatattaaaaacatgaccacaagccaacacttttaattccactgcagcactgctgggttatttcttgctttccaaattcccttgtctgtagctatctttcatcacttgcaaaaatagcacgtgctcaatcctagattaaaatataagctactctcagaattgataactcataccactctttttaaaaatcaactaaccagaattcagtttttattcacagttcttatctttagctcagggcgtaatataaaagcactaggtttaaaacttacttggtcagcagcaatccacttctaggtacatgtccaaaggaactgaagaaagcatctcaatgtgtgaatgcctacctgtgttcattgcagcattattcagaagagccaagaggtggaagcaaagtaaatgtccattgacagatgaattggtaaacaaaatgcattatatacatacaatgcaatatcatttagccttaaaaacaaaattctgccatatgctacaacatggacgttatgctaagtgaaataaaccagttccgaaaggacaaatacacccatttccacttatatggggtatctaacgtcaaactcagaagaacaaagtactgcggtatttgccacaagctggtggaggagaaaatgagttgttcaatgggtattgagtgtcagccacgcaagatggaaaagctttttgagatttgttgtataaaaatatgcctatagttaacaatactcttcggtacacacaaagtatgtgaaagggtaaattttatgtgtttttatc

SEQ ID NO: 3520 - DNA, 4941 bp, Homo sapiens
cgcgccccggcctatggcgcactccctgtggggcttatcgtgccgtttgggagcggcacgggactcgatggaggacgggtggggctaatagtatcggcgcgccgagaggggctgaaacagctggacccgggatggggtgggggatgtcacccaactcctctcggaccccccaaccccactccaggcccaacggcctctttggagcgcagcccggtcttggtcaccagaggtgcccccagtcgctcgtgtctctgccctttggccgggcaatgaggtgcagctcaggacttgccaggcggcggaaagggtggaggacagaccagccagactccacccccaccgacccagaagacaaccgctggccagcagccagctcctgccctgggcctggggagggaggccagaggctgccttagttagagcttgagcagccaggctaggacgaggcagcccagatggacgcaaatgtcgcttggaaagagcttggcacccaggaaagggcggcgtggggcaggggggcgcatgcccactgtcggctggcaccaaaagaccttttgtggctatgaaggcccagtgtccctcagtggtggcttttatggggtcctgcagtccaagccccacaggaaactttctaaaggtttgagggcaaagtcaggggccactacccagggagaatccattcccctgtggcttggggccccgaggacagagtctgaccagaagtaatcaagtaattacaccccatcctctttcaccccaatgcaaacacgggtggtccaggggagggagtgtggccacccatgctgaccacatacggctgtcaggatgctgaggcacagctccacagagcccaggcagccacgttctggccaccccagaacatcatgggaggggcacagtccctggagcaaggggcagggattccaggaatgaatgaggtgaggggagggccgggacagcacatgacaaagggcatggcagcagggccgggtgctactgggacttctttcctggacaattccaggcttgcacgcttgctcccatggggacaatgccaacaggaggcagagtggtggggtggtggcctctccagatagtgacctaacagtttctgtttctggctttttaaaccccctgaactggacttgcttttgcaatggaaagaagagggagggccagagctttgggagggagtggccaggagatggagggacaggcggaggtctgctgggggcaaggtgacatggccacagagggtggcagcagccaggatgactgtgtgggaacagcagggcagagatggggctgagacagggagggagacaggccaggtacgagcaggaaatgaccaggacggagccagagggccggtctcagtctttaatcgtggcagggcctcacgcacgcgcgcacgtacacacactcaggcttcagatcttgttgaaagctgcgatatcgacactctgcacctgaggagaggcggagggtgacggtcagggctgttcccctacagcccactcggagccaggagcctcctctgaggtggggttcactctgggactcgctccccactgccgtggggtggagtgcagggtatgggccagggtccccagtctcctctcccctcctctccccggccggctcactcacgtgctcctcaaacttggtgatctcctcctccagcaagtctgtccccaccttgtcgtcctccaccacacactgaatctgtagcttccggataccgtagcccacgggcaccagcttggaagccccccagaccagcccgtccagctggatagagcgcacacaggcctccagctgggccatgtccgtctcatcatcccactgtggggaaaggggaggaaaagctggggtcagccaccctcagaacacccaggaagtacctgcatgcaccctaccctcaaccactgtgtgtccacaattctgtttccttaaagggcccacagaaaacaatccaaattcacaccttcctgcctccaagtttgtgtttatcccaagacttctaaactcggctttaaagtctccccagaacccagagggcagggggagggtcacaggctgagccggctaggcgggcaccagggcagtgcctggccccctgaagccccaccccgcccactcacaggcttgacatccagcaggatggaggacttggccaccagtgcaggcttcttggccttcttctccgcgtactgccgtagccgctcctcccgcagctgtgccgcctccttgtcctcctcctcattgtcactgccaaacaggtcaatgtcatcatcctcgtcatcctctgctggtgtggctggcttcttggctgggggctccacttggcgcatgggagatacgtgctgccacaggggaagggacaggaggcacggctgagacgccccaaccagggcccagagctgcctggccacctcctggccctcctccctcctttgactggaggaagggcagcccctgtgtaccgcagctgtgtacatgcagggccccaggaaagacaaaaactgcctccacctgcccagggctaactgtaaaccttcctggggacctgaggactccagtatcctggctgccagctcatcactgctgctggggccagcccacagggcgacgtggaagccagcagggccacgtggtcccctgcagtgtcaggcgtggggagagcattcacctgggtctgtggggccgtggcccggtggccaggcgagctcttctccagcacgttcagccgggcctccagcttggagatggcctgctgcagctcctgtaccactgggggggcaaggggagcacggttagatggcaggggccagggacagccccaacccactggcccggggcctcaccgccacgcagactctggttctccacttccagactggcaatccggacgacgagctcaccgtggtctccgctggtgccgctggaggccccggggcctgagctctgcaaggcaggaggaggggagggctcagtgcccagcctgctcctagggtccccctgccatgctcaggactgcaggaactcacggaaggaaaactacagctcgggagagcaggaggtgccccccgctgatgcccagctcaaacttatgacctcagaggtggcggccaccacagaccacagtgaaattctcagccaggcaaagtccaggacaggaggctcttggtgccccagagacggaggctgtggggagctgggccatggctgctgctgcccggcggaatcctgctgagcagccaggctcagaggctgggtgggaggtgctgaaggactcacagtcctagggacaacctgggacacgcctcaggggaccaggcagcactggaaatgggaggcgggagcagctgagggcccagtgggggaagaaggaaggagcccacctgtgtggacagcagccacccaaagctttgtctccctgggcctcacgcctgccatctcactcagcaagccagtctctaggtgatccagggccccaagcccacctcatactctgccatagctgagactgatacctcggggcccagacaggatcccagcctcctggcccttaacactagccagtccttaagcatctacctgcacgcatgggccatttagcctgcccaccctccaacaggatggctcgaaggacagggtgcacctggctgcatggagctctcagcaaaccccatctcggcagctccccggggctccctctctgtggggaggggcctggagtagccgggcaggcaaagccgctccttgcagcaggtgcggacatactcaggcctttgcccaacgtgcaaacccatccctggggccctcctgccaccgtccttgggaccatgctgtggggaatgcttgtttatgtatctggagggtgtgggagctaagccccgcagatcatgggcaaggccgagccaaactggcccaggaggcccacctggcagcaaggccaggaggaaatggacagggaaaggccaggctggcagaggcgcgtgaatggtggtgggggtacgggaggcaccggcagaaactgacaaactcgggggcagaagccggagcacgggagggccaggctttggggcgccagggggcatggagaatcacagcagacctcccgcgggagtggggctgggtcctgaggaggccggagtctgtgagtggcacctgaggcctcatgcaccccacacagcaggcccaaggacagggaaaaggtcccctctggaagaggcactaagtcagcactggccccgggctgcatgatgagcagcgggggccgtctcaccactgcctggctctgcgggccactaggccagagcccacagcactcaggacacagggagagtcccctcctttgatgctgactcaggggggactagggatgccaggcatcagaatccctgagcacagcttcaacgggcaggctcaggtcacccagtgcagtcacagcgggcctcagagagcccctcagggacttgggggatgccaaaggcaaacacttcagagccagacccatgcctgtaaccctgtgccagcaccacgctaccagaaaccctgcagttctgaaaccccagtgtctgctgagcactcccaccccaaatccaagatgagactgggcccctgccatgggctgaataatgtccttccaaatccacatgctggagtcttatcccccggtatcttaggatgtgaccttatttggagacagggcctttgcagaggtaactgtcactgaggggcagggggctaatccaatctgactggtgtccaataagaagacatcaggacacacacacactcagatggatgaccgtgtgaagacatggagaagacggtctacatgctgagagaggcctcaggagaaaccagccttgctgccacctcgatcatggacttccagcctccagagctgtgagaaaatacatgtggtttaag

SEQ ID NO: 3521 - DNA, 13316 bp, Homo sapiens
cttgtacagcatcaattttcttacattctcagttaattggccattaaagtgctggaaattttcttaatcatgataacatttgttaaaaagaaatcagaactaatatcaggaacatggcggcatgaaggaaacagttcccttacaaaacacagaaaatggaagcccctcatgttgagggggtgggttggacaatttgcaaacagattctaatttcctctcaccgtcagcaccaaactggctgggaccaccacccctgggtgaaagaaacaacactaaagaaccctaaaaacacccacacaccctgactaccaccacctctgggccatctgtgggcgtttgctgtttgaacagatccagtctcaggaaagaggaagacctgacctccgtctgcaacccatcaccccacccacccttactaacaaaagcccccaaagtcattacaatgaaaaagtgggtttccattaccccaaaactaacaatgttcagtaaaaatgaggataataaacacaaaagcttgcttagtaaacaggagctctcagcagtcaatgcaaaaaaatatatatatatgaaatcttaaggcaaatactgttgactttgcacatgggctggacgaacttggaactctttacctatctgtatagttccaggagcctacaggcggtcggtttttcagcgcttgccaccgggccaggcaaggtctttgcatgattgctgaggcagtcggtgtgtttccctttggagtttatataggaacacaccacccaaggctgatgttttgttatatatatatatatgtacacacatacaaaggcctgctactctttctttgtggaaactgacagctccacctcgggaagctggatgccaaccttattcccactgtcattgctagaagaggaggacagtcgggacttcttagaggccagggacaccccactcccctgtaacttgcctgtctcatcatcgctcccagtcacctcataatgacctttgctctttgaccccaatccaccaaaggtaccgaatttcagcttcccgtgtttccctttaactttcccaccttccagagacacttccccaccttcaaactccagcgtccccgtcggggtggaaggtccagagaactctctttcatcactgaatgaatttgagcggtgccgtggcttcttacttttaaataaggagaatttgcctttcggtgaagaggcttcggcctctgcctctccttccagagagcccaggctggcctttgaacttttcaggtcacctttggacccagaaattgatgcttctggtgagccagtgacaccacctttccctttaggtttggaaaaattaaacttgggcattttgatcttggactttttcagtttgacttcagactcttcccactcgccgtctccagcaccagcttggatgctggcctctgctttagggaagtgaacatccacccccatttctctgccaaccagctcacggccagagaaggtaaatttggggatcttcattttagggaatgttacttttccagatccactttccaagtgaccttgaggcccagacacactcagcccaggagcctggagtccaatctgacctcctttcacacctccttccacctttggtcctgagaaatgaaggcccccagcaaacttagatgtgtccaagttgagagcagaggagacttggggtcccttccactcacccccggaacctttaacactcaaatgcccttcaccaaggctgatgtctggggcactgacaccccctgaaacatccgcacctcctttgatttttgggcccttcaagttgatgccaaaatctgactcaggagatgccatattaaaggcaggccccttcacactgatatcaggagcagccccatggaaacctacttctgaacctttcagaccacctttgatttcaggcccagaaatctgcccagttgggagtttcacattcacgcctggcaggttcacatcacatccagaggacttaattccaggcatctggaggtttccttctaggccttgaacaccaatgcctggaagacctcctccgacagtggggcctttgatctcaccagtggccccaaggctccctttcacttttggtccttccaagttaaagtccacattcggtgctgaaatccgaggccctttcaggttcacatccacacctggccccttcagttcgccagaaacctgtggccccttggcattgacgtgcaagtcggaccccggagtagagatgccaaattggggcagcttcattttgggaagtttaatgctgccttcggatgcctccaagcttagatcaggagctcctacggatactttagggcatttgatgtcaccagagacagccagatctccctgcaggcttggtcccctcagtgtcacatctggtgccccaacgttaagctttgttgtggcatcgatccctggcactttcacaccgtctcctcccacctgcattttgccaccgacaccactgaggttgagccctggagcatgcaccttcatgctgggaacagatgcatccaggtctcccttcaaacttggtcctttcaagttcagatcaaggtcaggcccagagacttttggcatagagaggttcactgaaggcaagtctactcctggcccctttagagaaacatcgggcccttcgagcttaacatctggtcctctcaagtctccttcaagagagggtagctgggcatggacctcggctcccccaccctccattttcacacctgggatgccgatcttgggcatggaaaacttggggaacttaatttttgcttctggaccttgcagatctacatctggtccttccagtcccacgctggggacatcaccctttatctttggtcctttcaagtttacattcacatcagggatggagacttgaggggcagaaatgccgaaggacggtgttttgactttagcatctaggccttcgatgttgatgtcaggtgcacccaagtttgcctgcactttggggcctttcaggtcaccctctatttttggcactgagatgtccacatctggcatcttgaccttgggagccttcgccttgatgtcaagaccttcgacgtgaatcgctggcaaagaaagttccagatcaggtgcctggagttcaccctccagtttggggctagggagaggggcctcagctttaaatttaggtgatttaatgtcaaactctacatctgggaagtacatttttccaaacatcgttttcttggttttgggcgatttcacgtcgactttgagtgcagcatccggccctgcgatgttgacatctacatccggagccttgaggctggcatcaatttcacccccaggaacattcaggtcaaatccctgttttttggccttaatcttaggaccactcatatgaattttaggcattttaaacttacttttcttgcccttgccaccaacactaatttcaggagtctcaaggttcagctctgcctcaggaacagtgacatccagtgaaggtgacttgatgtcagctttggggctttttgccccaaatccaaacttgggtttcttaaatttggggattttaacatctggcccttcgatgttaatatctgggctgtccatgtgtacatctaagcttggagcttcaactttgggtcccttgaggtccacttcaccaccttctaacttcggacctgaaaatccaatttttggtgccttgagatgcaaatcaacatcaggagcagttactttaggagcagatatctccagcgatggcatcttcaaagatgggccactgagtttggcatcagggccttcgaaatccagacgtggacctttaagatctacttctgggcctttcaaagtcccttcaaccttagggacagacacatcaaaatctccttttactttgggtcctttcaaatccaggtcaacatcaggtatggagatcttgggagctttgatatttatttcaggcatcttgaacttggggcccttcagttttgcgtctggaccttcgatattcacatctggaatatcaacgtccaccttgggtcccgagacatcgatgtcggccttgggcaggctcacatccacatctggaccttctcctttgaagccaggcatgctgaatttgggcattttcaccttgggcatcttcaggtgccagtctgggccatgaacatccacatcaggggtgttgatgtccacttttgggcccttgatgtcagcttctgggcccttgaggtcaccttccactttaggaagggtaacatccacatcgcccttcactttgggtcctttcaggtttaagtcaatatcaggcatggagatcttgggggctttgatgctcatctcaggcatcttgaacttggggccctttagtttcgcatctggaccttcgatattcacatcaggaacatcaacgtccactttgggtcctgagacatcaatgtcagccttgggcaggttcacatccacatctgggccctctcctttgaagccaggcatgctgaacttgggcattttcactttgggcatttttaggtgccagtctgggccttgaacgtccacatctgggacatcaatgtccactttggggtccctgatgtcaacttcggggcccttgaggtcgccttccactttgggcagagaaatgtccatgtcgcccttcacctttggacctttcagattcaggtcaacttcaggcatagagatcttcggtgccttgaggtgtaagtcaggcattttaaatttggggcccttcagtttcccttctggaccatgaatgtcaatatcaggagtgtcaatgcccactttagggcctttgacatccactttgggacctttcagatctccctccagtttaggaacggaaatgtccatatctccttttatcttaggtcctttcaaattcaaatcaatgtcactcatggagatttgtgggcttttgaaatgtacatcaggcatcttaaacttgggacctttgagcttcccttcaggaccttcaatgtctacctctggccctttcagatcactttccaccttaggtagtgaaacatccacatcacccttcaccttgggacctttcaggtgcaaatcaaagtcaggcatagagattttgggagctttgatgttcatctcaggcatcttaaatttgggccccttcaattttccttccggaccttcaatattgacatcaggtgtgtcaatgtccaaactggggccttttatgtcaatttcagggcccttgagatcaccttccactttgggcagagagacatccacatcacctttcactttgggacccttcaagttaaagtcaatgtcaggcatggagattttgggggccttgatgttcatctctggcatcttgaactttggacccttgagttttgcatctggaccttcgatactgacatcaggggcatcaatgtccactttggggccagaaatctcaatgtcagccttaggaagggtaacatccacatctgggccctctcctttgaatcctggcatgctgaatttgggcattttcaccttgggcatcttcaggtgccagtctgggccatgaacatctacatcaggggcatcgatgtccactttggggcccttgatgtcaacttctgggcccttgaggtcaccttccactttaggaagggaaacatccacatcacccttcaccttgggacctttcagatgcaaatcaaagtcaggcatggagatcttgggggctttgatgttcatctcaggcatcttgaatttagggccctttagtttcgcatctggaccttcgatattcacatcaggaacatcaatgtccaccttgggtcctgagacgtcaaggtcagccttgggcaggttcacatccacatctgggccctctcctttgaagccaggcatgctgaacttgggcattttcactttgggcatttttaagtgccagtctgggccttgaacgtccacatctgggacatcaatgtccactttggggcccttgatgtcaacttcagggcccttgaggtcgccttccactttgggcagagaaacgtccacgtcgcccttcatctttggacctttcagattcaggtcaacttcaggcatagagatcttcggtgccttgaggtgcaggtcaggcattttaaatttggggcccttcagtttcccttctggaccatgaatatcaatatcaggagtgtcaatgtccactttgggtcctgagacatcaatgtcagctttgggcaaattaacatccacttctgggccctctcctttaaatcctggcatgctgaatttgggcattttcaccttgggcatcttcaggtgccagtctgggccatgaacatccacatctggggcatcaatgtccactttggggcccttgatgtcaacttcaggggcctttagatcaccttccatcttaggcagagaaacatccacatctcctttcaccttagggcctttcagatgcaaatcaaagtcaggcatggagatcttgggggctttgatgttcatctctggcatcttgaatttagggcccttcagtttcgcatctggaccttcaatattcacatctggaacatcaacgtccaccttgggtcctgagacgtcaaggtcagccttgggcaggttcacatccacttctggaccttctcctttgaagccaggcatgctgatcttgggcatttttatcttaggcatcttcaggtgccagtctgggcctcgaacatccacatctggggcattaatatccactttggggcctttaatatccaagtcaggaacttgcatgtcaccttccacttttggcagagacacatccatatcacccttcactttgggtcctttcaggttaagatcaatgtcaggcatggagatcttgggggctttgatgttcatctcaggcatcttgaatttgggacctttcaactttccctctgggccttcgatattcacatctggaacatcaatgtccaccttgggtcctgagacatcaaggtcagccttgggcaggttcacatccacatctgggccctctcctttgaagccaggcatgctgaacttgggcattttcaccttgggcatcttcaggtgccagtctgggccttgaacatcaacatctggagcattaatgtccactttggggcccttgatgtcaacttcaggacccttgaggtcaccttccattttgggcagagaaacatccacatcgcccttgactttggggcccttcaggtttaaatcaatgtcaggcatcgatattttgggagccttcaggtgcatctctggtatcttaaatttgggtcccttgaatttaccctctgagccttcgatgttaatgtcaggagtgtcaatgtccactttggggcccttgatgtccacctcagggccttttagatcaccttccactttgggcaaagacacaaccacatcacccttcattttgggtcccttcaagttcaggtcaaagtcaggcatggagatcttgggggctttgatgttcatctcaggcatcttgaacttggggcccttcagctttgcatctggaccttcaatattcacgtctggaacatcaacgtctacattgggaccagaaatgtcaatgtcagctttagggagggtaacatcgacttcagggccttctcctttgaagccaggcatgctgaacttgggcattttcactttgggcatcttcagatgccagtctggaccatgaacatccacatctggggcattgatgtccactttagggcctttgatatcaacctctggccctttcagatccccttcaagtttgggaagagaaatatccacatcacctttcaccttggggcctttcaagtttaagtcaatgtcaggcatggagatcttgggagctttgatattcatgtcaggcatcttgaatttgggacctttcaagcctccctccggaccttccacattgagatctgggccctcaatgttcatacttgggccctctatgttgatgtctccttttggtagatccacagctacatctggcccttctgcttttaagccagacacactgaatttgggcattttcatcttgggcattttcagattccagtctggaccatgaacatccacatcaggtgcattaagattgacttctggtgccttaatatccactttggggcctttaaagtcaccttctaaattgggacctgcaatatctaagtctcctttgactttgggacttttcaaatttagctccacgtcaggcatagaaactttgggagatgaaatactcaggaaaggcattttaaacttggatcctttcacttttccttggacctcgacatcaggagcattaatatcaacttttggacctgttatgtcaatatctggctttttacctttgacatccacttcaggtgtctgaactttagagcccgaaaaattaaatttgggaagcttaaaacgagatttctttgacttgccttcgatattaagcttaggaccggaaacgtccacttctgggccctttatatccaaactgggagctttaatgtcaccttccaacttgggcccagagacatcaacatctcccttaagctttgagcctttcaaattcaagtcaatttctggcatggagatcttgggcatgtttacatgcatgtcaggcatcttcagttttggaccttttaatttggcatctgggccatgaatgtcaatatctggagcatctacatctatctttgggccttttatgtcaagagcaggtcctttcaaatcaccttctacatttgcaagtgaaacatccacctctcctttcattttagggcctttaagattgaggtccaaatcaggcattgatattttaggagctttgatgttcatctctggcatcttgaatttagggcccttcagtttcgcatctggaccttcaatattcacatctggaacatcaacgtccaccttgggtcctgagacgtcaaggtcagccttgggcaggttcacgtccacttctggaccttctcctttgaagccaggcatgctgatcttgggcatttttattttaggcatcttcaggtgccagtctgggccttgaacatccacatctggggcattaatatccactttggggcctttaatatccacgtcaggaactttcatgtcaccttccacttttggcagagacacatccatgtcacccttcactttgggacctttcaggttaagatcaatgtcaggcatggagatcttgggggctttgatgttcatctcaggcattttgaatttgggacctttcaactttccctctgggccttcgatattcacatctggaacatcaatgtccaccttgggtcctgagacatcaaggtcagccttgggcaggttcacatccacatctgggccctctcctttgaagccaggcatgctgaatttgggcattttcactttgggcatttttaggtgccagtctgggccttgaacgcccacatccgggacatcaatgtccacttggggacccctgatgtcaacttcagggcccttgaggtcaccttccactttgggcagagaaatatccacatcgcccttcaccttgggacctttcagatgcaaatcaaagtcaggcatggggatcttgggggctttgatattcatctctggcatcttgaacttgggccctttcaactttccctctggtccttcaatgttaacatcagggccttcaacgtccactttggggcctgagacatcaacgtcagccttgggcaggttcacatccacttcagggccctctgctttgaagccaggcatgctgaacttgggcattttcatcttgggcatcttcaggtgccagtctggaccctgaacattaacatctgggacatcaatgtccactttggggcctttgaggtcaacttcaggacctttcagatctccctctaccttagggcctgtaacatccacatctccttttatttttggacctgtgagattcaggtcaatatctggcatggatatctttggagtcttaaaatgcatctctggcatcttaaactttggacttttccactttccttcaggtccttcgatattcacatcgggacattcaacatccactttcggtcctgagacatcaatgtcagccttgggcaggttcacgtccacatctggaccttctcctttgaagccaggcatgctgatcttgggcatttttatcttgggcatctttaggtgccagtctgggccatgaacatcaacatcaggtgcgtcaatgtccacttttgggcccttgatgtcaacttctgggcccttgaggtcaccttccactttaggaagggaaacatccacatcacccttcactttgggtcctttcaggtttaagtcaatatcaggcatggagatcttgggggctttgatattcatctctggcatcttgaacttaggccctttcaactttccctctggtccttcaatgttaacatcagggccttcaatgtccactttgggtcctgagacatcaatgtcagccttgggcagcttcacatccccatctgggccctctcctttgaagccaggcatgctgaactttggcattttcaccttgggcatcttcaggtgccagtctgggccttgaacacccacatctggggcattaatatccactttgggccccttgatgtcaacttcggggcccttgaggtcaccttccactttgggcagagaaacatccacatcgcccttcaccttgggacctttcagatgcaaatcaaagtcaggcatggagatcttgggggctttgatgttcatctctggcatctttaacttaggccctttcaactttccctctggtccttcaatattaacatcagggccttcaatgtccaccttgggtcctgagatgtcaacgtcagccttaggcaagttgacgtctacttcagggccctctgctttgaagccaggcatgctgaacttgggcattttcatcttgggcatcttcaggtgccagtctggagcttggacatcgggggcatttacatcaactttggggcccctgatgttcatatctggtacttcaagtttaccttctacctcaggcacagacacatccacatcccccttgattttgggtcctttgagatttagatcaacatcaggcatagaaatattgggggctttgaaatgcatatcaggcatcttgaacttagggcctttcaatttgccctctggtccctcaatgtcaatgtctggcccactgacatccacatgtggccctttaaggtccccttccaatttgggaacatctacatccacctctccttttgccttggggctcttcaagtgtagatcgaggtctggcatagagattttgggagctttaaagtgcatatctggcatcttgaacttaggagttttccacttgccatttgggccttccacagctacttctggcatgtcagcatctaatttgggacctttgacatccaattctggaccttttaactctccctccagctttggggcagaaacatcaacatctcctttgattttgggtccctttaaattgaaatcaacatcaggcatggagatcttgggggtcttgaagtgcatctcaggcatcttaaacttggggcccttcagcttcccttctggaccttcaaggctcacatctgggacttcaacatccaccttgggtcctgagacatcaacgtcagccttgggcaagttcacatccacttctgggccctctcctttgaagccaggcatgctgaacttgggcattttcatcttaggcatcttcaggtgccagtctgggccatgaacatccacatctggggcatcaatgtccactttgggccctctgatgtcaacatctggcactttcatttcaccttctaccttgggaacagacacatccatatcccctttgactttggggcctttcaagtttaagttcacatcaggcatggagatcttgggggtcttgaagtgcatctcaggcatcttaaacttgggccctttcaactttgcatcaggacactccagctcaacatcaggcacctccacatccacactggggcctgttaaatctccctccaattttggcaaagacacatccacatcccctttgactttggggcctttcaagtgtaagtccacatcaggcatggagatcttgggggccttgatattcatctctggcatcttgaacttggggcccttcagctttccttcaggtccttcaatattcacatctggaacttcaacacccaccttgggtcctgagatgtccacatcagccttgggcaggttcacatccacttctgggccctctgctttgaagccaggcatgctgaacttgggcattttcatcttgggcatcttcaggtgccagtctgggccttgaacctccacatctgggacatcaatgtccattttggcacttttaagttcaacatcaggaactttaatctcactttcaacctttggcattgtgacatcatattctccctttacgttagggcctttcagatgtaagtccacatcaggcatggagatcttggggactttgatgttcatctcaggcatcttaaacttgggccctttcaatttcccttctggttcctcaatgctcacatcaggagcagtaacatctatcttgggcccggaaatgtccacatcagccttgggcaggttcacatccacttctgggccctctgctttgaaccctggcacactgaatttgggcattttcatcttgggcatcttcaagtgccagtctgggccatgaacatccacatctggggcatcaatgtccacttttgggcctttgagttctccttccagctttggtacagttacatcatactctcccttcacctttgtacctttcacgtgcaaatctacatcaggcatggagatctttggtgtcttgacactcatatcaggcagcttaacatcggggcctttaagttttccccccagaccctccaagttgacatctggggcttccacattgaccttgggccctgaaatactgatatctcctttgggtagagtcatatgaacatctggaccttcccctttggctcctggagtgctgaacgtgggcattttcatcttgggcattttcaggttccattctgggccatgcgcttcgacatctggggcactgacatccactttggggcctctgacatcaacttcagggactttgactttcccttctactctggggagtgtgacatctacaccccctttcactttaggtgcggccacatttaagtctacttctgacatagagatcctacaggttccggttttcccggaaggactgccaagcctagggcc

SEQ ID NO: 3522 - DNA, 1294 bp, Homo sapiens
acggccccggcctcgccccgagggtgaccagggaaggctcccgggccacgggattttcacaaagacagactcgcctccgtttctagcggctttatttttgacatacacgacctcagacacaagcggggcgggcagcgctaggtgtacagaaaggagcgggctcggaccgagcaccccctcccccgcacgcaaggtccaaagcaaacgcaactgcggcgggagccaccggcgcaggcctcgggcggtggagacaggcttagcttccaggaaagagcagcagagagcgattcccagaacgcgagggcttacagttccccgagaagcaaaagaaccaggtccttcccagggttctccattattttttcctcattaaaatatattttaagtcagcacaaacataaccaaattgtacagctttaaagttcaaagcagtctgcatctagggaacgtgcatgtggtcaggagtgagcgcgtgagcagcggctacgtaactagcacaggtgccaggccccttgatgggaatccccatgctcactgcacaggcccagagagggaggggtggggtccctggcaagttgctacactggtccccttcctcttttaagcaccacccgtcccaccccaccctcaggggctggtgtcagcttggcccagggaagcactatagagagggctcacctgagcaccccaacccatgatcccatgttgcactttgttcccaagttggggctaagaaggctgggcctggcagggacagggctctctggcatggggcagggagaaagcagtggcagacagtatgcacacacacttgcccactaccattaaataacagggctgggtctccaggtgtccaaagtgctgaaaagaggggccctgctctaagggagcagcagcaaatcccaggccttcccactctttgtagtgccaggaaaatactgaatgtaagtgggtgcagctttgctcgctgtgaggagcagcagaatgcggcagcctctcctcccagaatcgaggaatctgggaggcacaggacatccccaaaaggtcccaaacagttccagaccctatgtcttaccctccaccctaccagggaatgactatctacactaatgaagggctactgcccccatggctgaagccacagaatggtacaggagagaagactgtaatttgtgaccagaaacaggcaagctgtccctcccagccccaaagaatgggaacctgcccaccagtggcaccagggctgggggctaggagagatggcatccatcaaggagcccttaagaggctgcat

SEQ ID NO: 3523 - DNA, 729 bp, Homo sapiens
cgggcgccactcgctttgaagtgcagacgaggaggcgcgggcgcgagcgtgtgtgtctgtggggctgctgtgggactgtctgtgctaggagagcggcggaaaacccggcgtggagcgcctgcagtccgccgtccggggtcgcgcccgccgcggggctcaggagggaccggcacgcaggcgcgcacggccgcgcacctgtctcgctagaaccccgcgcgccccgccgagccactgccctccaggttgcccagaccgctggagcctctgcgactccacgaccggctgcttcctgcgaagtttcacaaacaagatttgattgaaaatggcccatggagtacaaccacctgggaacatatcctcgagaaagacagttgaggcttattgcctaaaccacaggctactgaaaacttggccaaaggcgactactctagactggtgacttcaaaagtgctgatgaatacagtgaaccatgaaagatgcattatttgttttgaacattttactatgattgatgacccagatttggcaagttagttcactcccagtggagatgaaagtttcactgccttctttctttcaacattcttgttgagacagatttcacttttattggccaatgtactaacaaatcacttgcatttgcagcataatgaattcattagcaacactgtggatcaatgctatacataatattcctgagtcaacattaactcttaattaaacttcctt

SEQ ID NO: 3524 - DNA, 9647 bp, Homo sapiens
agccagggcttcctctctgagctgagccacgtccaccccagagcatgggaacattctcttttttactctctctttttgaatgtattgaaaaggtgaacagaagtatttcgttgtcatattaataataccgttggaagtaaagtgtttggtgtcgcaaagtgaaaccagtactcaggcaaaagtttttttagtaaggcaatttacttctgcaaaaggtttttgtttgcattaatcacgatcgcaagagcaccctgaacaaaggagggaaggggtttttatttttaacgtaaagtctcttcctctgtgttactcccccatgggctagggtcggaccccacaatctaaactgacccgattggctatttgtaaatatttttccaaataaggaagggaaggggcatgtataagtcacagtggtgggacgtgtggttttgaagggtgggaaggctgcagagtgagtaatcaagggaacagatgtgaattattgattagagctgttgggaaggaaggttgttacagtaactaggggcaaggaggcatggagaacaagcaagttgagtttgagaacaaagaacaagaaagttaagactaaacctttgaagaggaattttattgtattttacaatttcccccttttaatttttataattaaaaaaaaacctttttttttgagatggagtttttgctcttgctgcctaggctggagtgcaatggcacgattttggctcactacaacatttgcctcccaggttcaagcaattctcctgcctcagcctcccgagtagctgggagtacaggcatgtgccaccacgaccagctaattttgtgtctttagtatagatggggcttcttcatattggtcaggctggtctctaacttctgacctcgggtgatccgcccgcatcagcctctcaaagtgctgggattacaggcgtgagccactgcgaccacacgctttttaaaactttttaaacatacctttactttgttgtttgacttgatcttttaaaaggaaaagtttatctgaataaggtggaggagaactaagggaggttttcgtaagtgtcgtttttataagtctttgtactagcccacagatgcatggtatgacacaacacccaacaagaattagtacacctattacaactataagagaagtaagaattgaggctatgactttttttcgtttactgaaccacctctctagccattctgaaaacgtgttattgaccccagaatttttagctaattcattggataaagtggtaagttcgtgtaaggcccttcttatgttcctattgggggcagtattgtttgggatgaaggtacaacatttgagttttaatcataacacaaactccacctttttcagctaatattatgtccagggccattttgtttttctaagttatctggctagtaggccttaattggttggctatttctttgacagcatttctggtgtaattaataaactaatattgattataatagatgtgatttatctatctaatctacatttttattaatagttacccgtggaaatattgatttaaatcctgcagctatttgatcttgggctttgaattcatcaggtaccacccgtgggactccagttgtgtctaaataaacttgaaagtcaaaagacacataaggggcttctcttattttacagtgttgtggtttttctttttctagtcgatgaaatgccagagtgaaagggatagccaactggacaacagtgcaagtgccgttccagttacttggcagagtgtccagtaagggtccaccacaataccaccatatatttgctcaaagatgaacaagggaagactgactggtaagatcttggaaaggcttaagctcactgtatcccattaagtctccaagaaatgccaagttttccccttgtcgtgagagacacgaggtaaaattgacgctaggagatggaggctggatggctcttggggcctgacccacagggtgttggactttaagaaatagcagagagagagctcagcaggatttattaccctaggctgtggggtcttggaaaagagctactatacagtttatgcctggtcaactagaagaccatctgagtgggaaagggacaatttgggcctctggctggccgcgtgcacaagcataacaattgcttttgcttaatgtgtgcacagaatatttgatccattttaaccaggcatttgtatcttggtatcttgttttaattgttaaagtttgccttaaattagttacttttacaatatctattttagtcttatcactgggcatagaagatatgacagtctggttagaaaagagcttagaagagaggggagtgaagagcatgagggatgattagacgcattttgaaagaccctatgagatttgtgccagccaagttgggtcttatgccatagaagcagctcaaatcaaagtggggttaggatccatagaagtgggggtgagaatagaaatttgcaccagattacattggttaaactggcaattggaaggagtgtttcctttagcaaagcaaatatatggctttaaggacatacaaccacttgttgatgaggtccagccctgatattcgattgtttataaaacatcattccagctgtggcaggcctgttttttttacatttgttaaagaacaggagtcgtgttagggggagcctcttgtccaaaagtgacagagatatttctctgaggctgagagctgtttttgactctggagattttcacagggcataatgaggcaagcactaaaggaaatagtttggggtgagcccaacctagttacattaataacgagaggattagcaatagaaggggaaaaggagaaggagtaacagaacagatggaagataggtaaattttcttagctttagtttggaagggttctcccctggaactatggcccatgattctggagagggtgtagcaggacgagccacagacaaaactcctcagacaccgagttaaagaaggaaggggtttattcagccaggggcattggcaagactcctgtctcaagagctgagctccccaagtgagcaattcctgtcccttttaaaggttcacaactctaaggggatgtgtgtgagagggtcatgattgattgagcaagcagggggtacatgactgggggctgcatgcaccggtagttagattagaacaaaacaggatagggattttcacagtgcatttctatacaatgtctgtaatctgtagataacataaccgattaggtcaggggttgatctttaactaccaggcccagggtgtggcgctgggctgtctgcttgtggatttcatttctgccttttagtttttactttttctttctttggaagcagaaattgggcataagacaatatgaggggtggtctcctcccttattcccccactttgagactctcaatagtgggagttctcacttttatttttactacctatgttttcttgcaagacagatcgatagtgattcatatattacacttgtgctgaagcattttggtgaaccaaggtaacaatgaagctttttatcatctgaagaagtacaggtagcaaacaagggagcagtaagcagattcctattactattataacttttattataagagttttaaatcctcttagcgctgggaaccattttctaaacatggccccaggatcaaatccatgccacacttgcatgggcacgtgtgccagttttgtcatatctctaactatgtcttcaacaactggcccttgattatctatgtgtaggcagcaattagtaaggttaaatttcctgcagacccctcattcagctgctggcaagtagtcgagggctaatctattttgatatatagcatttctcatctgagtttcttgccaggccagaatagtcaaggctctgctggttttattagtgattatttttaagacagcttgtaaccatatgattcggttgatcatgtaaatgggggtccggtatccccatgagccatcttgtgcctaagtagcaggcctataatattgtatgattctctcagggggccatttatcattttttcaatttcttatagctatgattctcttttcgcgggaagcgtagacagggaagccaaggagtttgcctgtttttatgggcagtaggaagaaagatggtttaatagtgccaataacacaactacctgcctactggtcagtaatctgtcataagctctatgcctacatatccagtataatccagtgggggctgtccagtcccggtgggactccaggtgggtccagtttgcaactttgagaatttactaaattttctctctgtgtgatttgaactccaccaagtgattgtttttgtggtaccattatacagtttctgtctccgacaactaagtcatcctacgcggtgagtgaattcttttccttctctagctatgcaatattgtttaataattgaggcttttaggatcagaaattatcagggtgattcttttgagccaggaattcatcaggtactgtaggtactaattctcaggcttcccatggccattgatctcttattacagcttctccacatacataacatgaagtgacattgagagactgggctacatgcttggctaattgcaaaaacaaatttcttgtttttcctggaatttctggtactggcacatttagttcatcatagaaagtttgaaacactggctcaggagagtctttgtaagcttctcgaaccaagatatttactcaaggatccagtctggccccgtcgattcctaaggtcacatgctcctctttttttctagcgaggatcaaggggattggttatgactagctctaaggggttacattgtccctgagtacaggaagggccattttttcctttctgaaggtgggatggatctttttcatttttttttttaatccaagtggcctaaatgacacaagaccagtgttcacatttatttccacacagtgctaatttatgacagttgtatttattttctgccatatagcctcttttctaattaagagaaccacaccttattcctaacttattactattaatgacagcacaggcatcaaattttaaggtgacttgtttgggcacccctttttcttctgttttagctaacactttactcatatcatttatgagccccaaccagtcctcagtccttaatcttatttaaaaaactgtccctccagggttcaagcaattctcctgcctcagcctccaggcatgcacgaccacgtccagctaatttttgtatttttagtagagacggggtttcaccatattggccaggctgatcttgaactcctgacctcaggcaatccacctgcttcattaaattatgcactaaaagtgtataattacactgtttgtaatacaaatgataaacgctagaggtgacggatatcttatttaccctaatgaaatttctacatattgtatgcctgaatcaaaatataccatataaggcataaatatatacacatacaatatacccacaaatactaataataaatttcagtaagaaaaaaataggcagggtgcggtggcttatgcctgtaatcccagcactttgggaggccgaggtgggcgaatcacttcaggtcaggagtatgggaccagcctggccaacatggtgaaaccccgtctctactaaaaatacaaaaattaaccaggcatggtggcgcacacctgtaatctgagaactcccacgttcaagcaattctcttgcctcagcctcctgaatagctgggattacaggcatgtgccatcatgcccagctaatttttgtatttttagtagaggtggggtttctcagtgttggtcaggctggtctcgatctcctgacctcaagtgatccatctgcctcagcctcccaaagtgctaggattacaggcatgagccactgcacccatcccatacaactttatatttaaagaaccataaatattatattaaaacctgtctaaaccaataaatatacctggctgtattttaatatttttaactataattaataatttctttctgtcactataatgtagaaaagcattactctgaaaccccaccttattttttatctttgcttattaataaaataattcattatgatttttgaaaaaaagttttaagatgttccgcatacatgttaatgtaggttagaccatccaaaagacattcaaagcatcaacattaagtcattggctaggattatagaaatgagaacatgaacccccaccttacacattacttaatatcagttaactacaaagagcctctccacttatattttcatcatgcatcttacattttaatgtccttactcttttatagaaaaggtcatacataatgcccaactaataaaaaacaatctctaatatctctaatgcagcaacaattgatcacatgctttcacatgtgaatataataggaataaaatagcataaagcaatgtgaaagctgtattatatcattattcacttttcaaaaaaattttttcaagaaaacaagtatactttcaatgtaattacagtgcttcaaaaatccactttttaaaaaattatatagaaataatttatctaacagctgtagctgtggattagtttttatactgaacattctgatttagtgtaatgtctgaagtgtcagtgccttaattattctatggaaaattctctgatatttacatagaatcaattttgaattaaatattttttgatatttactgcatctgcaaaaatatattttggtataaaccctctggtgttttctaagctgtcatttttggaaaagaaaagtctttccattcattacatttgcagtactattctcaatataaattcccttgattccctgaaacaaagcttgagcaactgcttcagggttttcctctagtactacatgtgtgcactaagatctgtgacacaagtaaaggcactacaaccccctttatatttgtaatggctgtcttcagaataaatattcttcactttaaagacttctattttctgaaagattttttgacagtaattgcacttttaatgctttattaactatgaaccttcttctgttcagtaagatgtgagtaggcattaatggtttttccatattctttgtatttgcacaatttttctcaaggataagagctttcctgtgaaataaggtataagcactaataaaatattttgccacattcttcacacttacaggagttttggcagtatgacttctatcacctacaatcatgtatgacaatcatataaaggctttgtcacattttatacatttctagggtattacactagtataatttatttttatgtataggaaatgtggaggtgttggtaaaagcaatgtcgcatctttcaggtttccagatttcctcttcagcatgaattatcgccatgtctcttaagaattaagaacttgtagccaggcatggtgtctcttaagaattaagaacttgtagccaggcatggtggctcacgcctgtaaccccagcactttggaaggccaaggcaggtggatcacctgaggtcaggagttcgagaccagcctggccaacattgtgaaaccccatctctactaaaaatccaaaaattagccaggcgtggtgttgggcacctgtaatcccagctacttgggaggctgaggcagaagaatggcttaaacccaggaggcagagattgcagtgaacggagatcatgtcattgcactccagcctcggtgacaagagtgaaactccatctcaaaaaaaaaggaattgagaacttgttataggtttataggttttgccacattcttcacacttgtagggcttctgtttggtatgaattatgtgtaataagggttgagaacttccttaaaaagctttgtcacattctttatatttgtagggtttgtgttccatataaactctcaaatttactaagagtcgagggctggttaaaggctttcccacattcatcacattcatagggtttctctccagtatgaattatcttatgctaattaaaagtggaggaacatttaaaagatctgtcacattcttcactatgtagggttttcgttcaatatgaattttcttatgtttattaaggtctgaggaccagttaaaagctttgccacattcttcacatttgtaaggtttctctccagtatgaattctcttatgtgtagttagagttgaggatgcagtaaaggatttgccacattcttcacatttgtagggtttctctccagtatgagttcttttatgtttggagaggattgagggccaggtaaaggttttgccacattcatcacatttgtagggtttctctccagtatgaattttctcatgtgaaaaaagggttgtggaatggttaaaagctttgccacattctctacatctgtagggtttctctccagtatgaagtatcttatgtgtagtaaggtgtgaggataggtgaaaggctttgccacattcttcacatttgtagggtttctctcctgtatgaattctcttatgtatagtaaggttagagcagtgcttaaaggatttgccacattcttcacagttgtagggtttccctctagtatgaattttcttatgtgtggtaacgtgtgaggggtgcttaaaggctttgccacattcttcacatttgtagggtttctctccagtatgaactatcttatgtgtagtaaggtctgtggatcggttgaaggctttgccacattcttcacatttgtagggtttctctccagtatgaattttcttatgtgtagtaaggtttgaggactgcttaaaggctttgccacattcttcacatctgtagggtttctctccggtatgaattctcttatgtgtagtaaggtttgcagattggttaaaagctttgccacattcttcacatctgtaaggtttctctccagtatgaattttcttatgtgtagtaagggttgaggaccgtttaaaagctttgccacatattatacatttgaaaagatttattccagtatgtcttgtcttatatgtgtttgaatttgaaaacttatgaaagacttttccatatttatcacattgaaatatttctttctgggtagttgtcaaacattggttaagtccattataacctcctttgtgcaccttatgctcacccacgcttttacagcctttttttaactgtaaattgtcatgtctgcattcttcatatcttctcagcatccctatttggaaagaattttgtatgttctctggccaaaggtcttgggcaaaatgagaactcctacctgggggtttggcaatcatctcatgtctttccatagttaaaggtttttttccttgctccagacaggtaaccaggtctggcttagagacaacaatacctgttttattaaaaataaataacatgaatcttgctcatatactcccattacaagctagtactgtgctcagcagagaggatgtgataaaatattccagtaaatcaataccaaaataataatttataacagaaatttctaaatatttagaaaatactttcaatttgtaggtttcttattttactatctgatactactgaatcaaaaattagtggtagcaattagattttcaggtggggcaacaatattttatgccactaaatttctg

SEQ ID NO: 3525 - DNA, 13271 bp, Homo sapiens
gtttcctcgcatacattaccatcaatgcccggcctgtgagtgtgtgtcggggaggggggagagcggccgcgaaaggcgggcgggcgcgcaggcggcggcggcggcgggcggcgggcagccccggcacctgggcccggcgcgccctcggcgactctcatcagctcccagttactggcgccggcgctcccgggccatctccctccgtcgacaccacgctcactctcagccggggcagcggcgccaactacacggcggcaccgcgaaccggggggaggggggcaagacgacgcgtccggctcagccccgcggagagcgactgcctcctccgccttctcctcctcctgctccgccgcctcctcccctcctccccccgccgccgccgctgctgccgccgcctggtccttcttctcctcctcctcctcccgccgccgccgccgccgctggtgccgccgctgccgctccaccaactacatccgggcaactcggacgctgccgccttcgggaaacctcggcagtttccgccgggcccctcctctcccaccctcggccttcctccccgcaccgcgcgggtccggaacaccgccctcggcaaacctcggctggctccggcctttctcctcctctgaggcctggatcttctcttcgcgaccagtctgccctttccttcttttcctcactcgcgagtcggccaccgccgttcccgtttagggatagtctcgctcgggcgcctgctcgaggctgatctcaggggctccgggctgcgcagggagggagccgccttccggaagaggacggtggggcgcgagggaagccatcgcggactaaataagggaggctgcagcggctgcgcgtgcgcccagaggcgcagcgggagggggtgctctcgggcgagctctccggccgcggcccccgcccctgcgctgtcgggcggggaggtcggaaaccccctggcgagaccacgggcggacgcttcccgaagagctgcctgggctgcagccgcggaagctgcgttctggggagcggggagcgtgctccggcgccttcgggccgctgctggaagccggaaccgagcccgggccgctgcccctcaccggacgccgcgcgccaccggccctccgcggggcaggggctgctgcgagctcgccgggcgccctttagacagtcgtccttgtctactccactaccaaatgttgaagttcttcaagaatcagtcctttggaggcatttaaggaaatctgtttctcttttggatcactagctgcaaattaagctaacagaacaggagctcagctggtcacacacagcaacgaatacagactttataaagttcagaaaagttaccaaacagtggtaaccataacaagtaccaacaatgaactatggggagggaggagaatctgatttccagagttaccacattataatactattcaaaatgtcacatttttagcaaagattacatgacaaggaaaaaccagaaaagtatggcccatacacaggtaaaaaaagaaattaatagaaactacccctgaagaagcacagacttcggatgtacaaaacaaagacttttcatcaactcttttagatatgctagaagagctaaaggaaaccatggacagagaacaaaaaaattaggaaagcaatgtctcatccaatacagaatatcaataaagagattgaaattgtagaaaagaaccaaatagaaattctggagttgaaaagtattataactaaaactgaaaattcactagaggtattcagcagcagactggagaagtcagaagaaagaatcaacaggcttcaagataggtcaattaagattatacagtctgaggagcagaaaggaaaaagaatgaagaaaaatgaacagagcataaaagacctctgggactctatcaagcataccagtatatgcatgaggggagtcccagaaggagaagaaagagagaaagggacataatatttgaagaaataatggtagaaaatgtcccagctttgatgaaatacatgaatctagatattcaagaggctcaaagaaccctaaatagggtaaactcaaaaagacccacaccggaatgcaaaagtgagctgggtgtggtggcacgtgcctgtggtcccagctactcgagaggctaaggcaggaaaatcgcttgaacccaggaggcagagattgcggtgagccgggattgcgccagtgcactccagctgggcgacagagcgagattccatctcgaaaaaaaaaaaaaaaaaaaaaaaaaactattgctgcagtcattcagatggaaatggggaaagaataatattaactgatttcaaaaaggacttgaagatgtgaatcatctattttgctgaagaaatcttaactctttgaaattactttttgttgctgttgtcatactcttaggtgccaaactgcggtaaattttttatcagtgaagtggaagcatgtgttttgttgttttgggaatttttatcaagtatcttcagagaagattatttcctgctttatcttcaaaaactggaaaggaagggtcaaagaaaagacagtagctggccggtcatggtggctcatgcctgtaatcccaacactttgggaggctgaggtgggcagatcacctgaggttgggagttcgaggccagcctgaccaacgtggagaaatgccatctctactaaagatgcaaggattggccgggcgtggtggtgcgtgcctgtgatcccagctgctcaggaggctgaggcaggagaatcgcttggacctgggaggtggaggttgcggtgagctgagatcacgccattgcactccagcctgggcaacaagcgaaactctgtctcaaaaaaaaagaaaagacagtagcttatgttcatgtcaagcacctctcatcacagtctagttccaaggaaaaaattcccagcgttttctacattcggtgctgcgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggcttttgtatcgtaacctgaaactggcttagtactttttcctaaaagctcaggatttgagaatgaggaccccttcgccaggaaaacatgtatacactcaaaattttgcttgcagttctagggtgtttagacctttctcagatacctgtgcatcttatgggttttgtttttctctttgagacagtctcaccctgttgcccaggctggagtgcagtggcatggtctcagctcattgcagcctccgcctcctgggttcaggtggttctgcctcagccccttgatcggctgggattgcatgcatgtgccaccatgcccggctcatttttgtatttttagtggagatggagacagagtttcaccatgttggccgggctggtcttgggctcctgacctcaggtgatccgcaagcctgggcctcccggggtgctgggattacacgcgtgggcaactgcgcccagcccttgtgtaccttatgtgaggaagtcctgctcaatcaggatcggtcacgcaggccctgatcttgctactctggttccatgtcctatggaagaccaaagtttaccaagatagatttttcccttcatagtggcagatactgttaacccctgcaccatctataactcagaaatccccaccatttcttcccctgggcttcagaatagaattgcctggtttctctgatgatcagcacacttccttaaaacccaaatcagcaaggaatgaacaattttgtttggcatggatgaaattagcactgtttggctcggtaggccccagacaggcaggcaccttaattttttccttgcatattctagtcttcagaagcattgccttttgtcctactggtagtgacatagatcaataacagggcatctggggattttaatcctgaaaacagtgagtctgatactgcttgtgtttttcatcagtgtccaccccgagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggaccctcaagcatagctggtaaatcaagttagagatgtaactgccttaaaacgtgccagcttaggctgggcgcggtggctcacgcctgtagtcccagcacttcgggaggctggggcaggcggatcacctgaggtcaggagttcgggaccggcctgaccaacgtggagaaattctgtccctactaaaaatgcaaaattggccgggtgtggtggtgcatgcctgtaatcccagctacttgggaggctgaggcaagagaattgcttgaacccagggaggcggaggttgcagtgagccgagatcacgccattgcattccagcttgggcaacaaaagcaaaactctgtctcaaaaaaaaaaaaaagtgccagcgtatgaggtaattagattggttctctccagaggtaacctgccaagaagagatgctatagatgttactcatatactgtaaaacattgtgaaatcagattactttaaaatgatgtattacaaagttttgcaaaaaagcagttgtgactgtggaagcccaaggcttatatcccagctctgtcttacactaaatatgggtagagtgtttccactctgtccataaaatgggagctaatattctccaacctgtgtgcctgacatgatggttaaaaggattaaacaaaacaatagtttgtaatttattctgtcagagcacactgctggtaaataaaagggagtaagttgactaaaactaaatttaaaaaaaaatcctaataaaacaagtttgtaatttataattgtatacaaataaaagatgttacaaaaaaaaaaaagacccacaccaagacacatcataattaaaccgtcaaaagtcaatgacaatcctgcaagcagcaagagagaagcaattcctcacgtacaaaggattctcaataagattaatagctgacttctcattagaaaccacagaggccaggaggcagaggcagtgggatgatatattcgaagtgctgaaagaaaaaactgtcaagaattctgtgtccagcaaaactatccttcaaaaaaaaaaaaaaaaagtgaaggagaaattaagacattcacagataagcaaaaacagaaagagtatctcactagtagtcctgccttacaagaaatactaaaaggatccttcagcctgaaatgaaaagacactagacagtgattcagatccacatgaggaaataaaaaacactgaaaaagatttaaatacataggtagatataaatgaaagcaataattatatctgtgtcaaagcacaatgtataaaggtgattcatgatgaggaaaagatgaagtataggagcaaaaattttgtgtactattgaaactaagttggtatttatttgaaatagattgttataaatgaaagttaattgtaatccctagagcaactactaagaaaataactaaaaattttggaaagggaataaaaatggtatgctagaaaatatctaatacaaaaaaggcataagggaggaattgaggaagacatagggaaaacaaatagcaaggggcaatgtccttcctactaattacattaaatgtgaatgccttaaattccatttaacagatggagagattggcagaatggagtcttttaaatgttctaactatatcctgtttacagaagactgactttagaaccaaagacacaaacatgttgaaagtgaaagggtgtcaccttagttttctttctttttttttttttttgagatggagtttcactctttttgcccaggctggaatgcaatggcgtgcttggctcaccacaacctccgcctcctgggtccaagcaattctcctgcctcagcctcctgagtagctgggattacaggcatgcgccaccacgcccagctaattttgtattttttagtagagatggggtttctccatgttggccaggctggtcttgaactcccaacctcaggtgatctgcccgcctcggcctcccaaagtgctggggttacaggctgagccaccgcgcccggccagcaccttagttttcttgtgctgccgtaacagaatacctgagactgggtaatttatatagagcagaaatttattttctcacagttttggaatctgagaaactcaaaattacgacattggcaggtttggttgtctggtaagagctgctttctgcttccaagatgacaccttattgctgcatcttctataggggaggaatgttacatcctcaacgtggcagaaggtaaaagggcaaaaaggaatgaaattcctcatcaggccctaagttaagggcacctaatctcattcatgaggggaggagccctcaagacttaaccacctcttactggctgggcgcagtggctcacgcctgtaatcccagcactttggaaggccgaggcgggtggatcacaaggtcaggagatagagaccatcctggtcctagtagagacacggtgaaacgcggtctttactaaaaatacaaaaacaagattagccggccgtgctggcgggcgcctgtagtcccagctacttgggaggctgagatgggagaatggcgtgaacctgggaggcggagcttgcagtaagccgagattgcgccactgcactccagcctgggcgacagagcaagactccgcctcaaaaaaaaaaaaaaaaaaaagacttaaccacctcttaaaagtcccacctcttaataccatcatgttggccattaagtttaaatatctgaattttggagggcacacattcaaaccatagcaagtggaaaaagacattccaagatatctcaggttcacatggaacattcttcagaataaaacatgttagtccacaagtctcagttttaaaagattgaattacaaagtgccttctctgactacaatggaataaaactgaaaataacacacccttaaacaaccaatggatcaaagaaagattaaatcacaagagaaatcagaaaatactttgagatgaataaaaacaaaaatgcagcaccctaaaacgtttggaatgcagcaaaagcagtgctcaaaggcaattttatagctgcacatgcctacattaaaaaatacctagaatcagcaacctaaccttccaccttcaggaactagaaaaagaagaggaaatcaaacccaaagctagcagaaggaaggaaatagtaaagactggagtagagataaatgaaatatacagtagaaaatagaatccacaaaaccaaaatttggttgtttgaaataataatgttcacaaacccttaaaaagactgagcaagacaaaaagattcaggttactaaaatcaggaataaagtggggacattactgccaatcttacagaaataaaaaggattgtaaggaaatactattaacaattatatgctaacaaattagataacctagataaaatggacaaattcctagcagcacacaaactaccaaaactaactcaagaaaaaactaaacctataacagtactagttaaaaaaaaaaaaagtaaaccagttaaaaacaaaaaacttccaagataggaaagatcaaaccatgtggctttactggtgacgtaaagtattttaagagtgccagtccttctcaaacacttaaagtaggggaagagggaatatcttaactcattatatgatgccggcgttaccctggtaccaaatccagacaaagacatcacaagaaaataaaactacagtccaatagttctaatgaatatagatgcaaagatcctcagccaaagtgaatcctgaagcacattacaaggatatccacaaacaaaactgttagagctaatacctcaatatcacaggatgcccaggatcaacatacaaaaattagttatatttctgtatccttgcaatgaacatttcaaagtgaaatgaagaaaactcatttacagtagtatcaaaaagaataaaatactaataaacaagatgtaagacttacacactgagaactacaaaacatagttgagagaaatttaaaaagacctaaataaataggcattttatgttcacgtattagaagactttgaaaatggcaatactcccccaattaaccaacagaatcagtgaaattcctatgaaaattccaactgccattaatgtagaaatgggcaggttgatcctaaaattcataagaaattgcaaggatgtggccaggcgcggtggttcaacgtctgtaattccagcactttgggaggctgaggcgggcggatcacgaggtcaggagatagataccattctgggtaacacggttaaaccccgtctctactaaaaataaaaaaaaaaaaagtgtagccgggcaggtggtgggcgcctgtagtcccagctactggggaggctgaggcagaagaatggcatgaacccaggaggcagagtttgcaatgagccgagatcgcgccactgcactccagactgggtgagagagctagactccatctcgaaagaaaaaagaaaatgaaaaaaagaaattgcaaggatgccaaaacagtcttggaaaagaacaaagttagaagacccacattttgtgatttcaaaatttaccacgaagctacagtaatcaaaagagtgtggtactgacataaggatagatatgtaggccaagaaaacagaattgagagcccagaagtaagcctatacatctgtggtcaattgatttttgacaaaggtgtcaagatagatcactggggaatagaatagtatttttaagaaatgctgaggatactgggtatccacatgtaatagaatggatttggacccttaccttacaccacatgcaaacattaagtcaaaataaatcaaatacctaaatataagaatgaaactatacaactattaaaagaaaatattggggtaagtctacatgacctgggatttcccagtggattcttagatatgataccaagaactcaagtagcaacatgaaaaatagatacaactgggcttgatcaaaatttaaaactttacatatcaaatgacactatcaagaaagagaaaagagaacccactgagtgagagaaaatatttgcaagtcgtatacctggtaaagctcaaataactcttacaagtcatcagttaaaagacgacccaagttaaaaatgggcaaaggacttgaatagacatttctccaagggagatattctaatggccaagtacatgaagagatgctttgcatcataaccttccaccttaagggaaatgcaaatcaaaaccacgatgagataccactttctatactcactagggtgctattattaaaagacaagtgttggcaaggatgtggagaaattggaaagctcataaattgctggcggaaatataaaatggtgcgttcattataaaatagtttgatggtttatcaaaattttaaacggaattaacatataacccagcagctctcctaaatatatactcaagaggatagaaaactaatcaaacaaaaacttctgcatgagtgtgtatagcagcactataatagccaataagtagaaacaacccaaatgttcatcaatagatgaatggacaaattgtggtatattcatataatgaaaaactactcagccataaaaagaaattaggtactagtatatgttgcaacatggatcaaccttgaaagaccttgctaactgaaagaaaaggccacatcttacatgattgtatttatgtgaaacatctagaagaggcacatccatagagacagaaaacattggtggatgctaggggttagggaaatgtagaagtggggagttgctgcttaatgggtttcttttttgagtgatgaaaatattcagatttaggtagtggtgatacttgcaaacattgtgaatgtactggaaggcactgaattgtacagtaaaatggttaaaatggtgagttttatgtcatgtgaattttaccccaataatacctcaataataattttttaaaagtagcccctctcttagtccattttgtgctgctctaacagaatacccgaaactttataaagaacaaacgttggccgggcactgtggctcacgtctgtaatcccagcactttgggaggccgaggtgggcagatcacgaggtcaggaattaagaccagcctagccaacatggtgaaaccccgtctctactaaaaataacaaaaactagctgggcgtggtagcacatgcctgtaatcccagctacttgggaggctgaggcaggagaattgcttaaacccgggaggtgggggttgcagtgagctgcgatcacgccattgcactccagcctgggcaacagagcaagagattcttgtctaaaaaaaaaaaaaaggaactatattggcccacatttctggcagttgagaagtcctagatgaaggggccacatctagtgagggccttcttactgcatcgtaacggtggaaggcatcacatgatgagagagagagcaagaaaaggtgcttttgttacaagcccattccattataatgaacccactcccatgataacaagctattcatgaggacagagccatcatgacctattctctaattaggccctacctcccgacactgttgcattgaagattaattttccaacacaagaactttgggggacacaatccatagcagtccctctcttcactaatttctttccatgaattcttccactcccctgacttttgtgtgtagttaccatctatacacagatgcttcactagaggcagtttgtatctccaacccacatcttttttttgagttccagatgtgaatatcctgctgtttacttacctaccacctccacacatagcttcaaatgcaactttgaaatataaaactgagttcattaccttttctcctaaatttgattatctgtgaatgctttctgtctcactaaagatagcttccagtcattgagagtttgctgtatgtttggactaaagtgttaatccattaatttacttaatcctcacaagaacctcagataatactattttccatttgcagtgagaaagttgaaaggtaaaataacttattgaaatcacacaccttttaaggaaaggctagccctcaacaaaggcagcctgacttttcagagcctatgttcttaatgccattgctataccatcctctaactttttctagagacctagaagtcatctttgtcacttctctcctttacatgctttatcaagttgatcatgaggtcctattgatttgacttcctaaataactctcactccatccagttcatttcatctgctaccaccagccttattcaagcaaccatcttttgtctatacaatggcctcttaactaacctcccatattcactgacaacaacctaataaaaatatttataaatataaatttgtatcttacaggtagggaatttatattcttctcttattatgcccaaggaatatttccaaatattaatcataagattgatcacctagaaaaccttagtgaatcatgaaaagtagaaatcttaagagctgcttttcagatgatagtgcaataaaacctaaagtcaacaaaggttgtttttgtttcttgatgattttaactgttggtttactatcagtctctccaacactcctgccttaattcttggtgattttaatatgcacatcaatgatctttccaatatcttgacctccagcttcttggacacctcttttcattccacttcagccactcctttggtcattccctagttagatctgcttattaccattaactgcaaactcaattatctcaacttcatgcatccacctttctggctgccacatcctgtctttccagctttcccctctagatccctagctcctcataattatttatctttgttggtaattctaatctattgattctatcactgtttcactgcccctcacccttattttcctcctcacttggcttaaattccatagccagtcattgattggatattccttttacccactgacaaaaccgtaaccctaatcattacttatctactccattcttgctcccatgtagctgaacatgactggaagaaaaatgcaagagtttcactttaaattcttgaagacaaacctcatgtgacctcaaaatgctgccagtcaatcaaattatattttctccaagtttattcacttgtagtcagcttgggctgctacaataaaatatcataaagtaggtagcttgtaaacaacagattgtcttccttctggttctggaggctgggaaattcatgatcaaggcaccagcagatttagtgtctgttgaagtccagctttgtggttcatggatggtgacttctcactgtgagaagatatggtggaaggaaagaggggtcctttcttgagcctcttttataaggacactaatctcaatcatgaggaccaccccccataacctaatcaccctccaaacgtgattaggccttccaataccatcaccttgtgggttaggatttcaacatacgaattttgaagggacacaaacattcagagcatagcacccccttttcctgaaatgattttatgtaatgattttatgtaattgtctcttctcgaatatccaacactctattcccagtcttaccctcgatgataactcttgttcctatttcctggagaaaatcagagcaatcagaagagatcccctgccactaaatctatccttctagcagcttgtgaactcatataattttctttccagcctgttaccatacatatatgcatgatgtccatgctctcatctaaaatcagcctctgcttgtgtactagatcagggttgacaaaatgcagcctgtggcccaaatcctgcattttgttttgtttttgtacagcccgtaagccaagaatagtttttacttttttttttttttttttttttttgagacagtcttactctgttacccaggctggagtgcagtggcacaatcttggctcactgcaacctccacctcccgggttcaagcgattcttctgcct

SEQ ID NO: 3526 - DNA, 2435 bp, Homo sapiens
gcgttcttttcgaggtcggccgcgtggctggaagacatggccactccagtcggtgttgagcacggcgagcagtctcaggcctttagtgatgatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgttttttttttaacattttatatttttgctttattttattttattttattttattttattttattttattttattttttgagacggagttccactctgtcgccaggctggagtgaagtggtacaatcttggctcactgcaacctccacctcccgggttcaagcaattctcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttttttaatttaaatttaaattttttttcatttttttgagaggttttttttgttttgttttgttgttgttgttgttgttgtttttgagacagtcttgctctgtcacccaggctgggagtgcagtggcatgatctctgcaacctctacctcccaggttcaagcaattcttgtgcctcagcctcccaagtaactgggactacaggtgcacgctaccacacctggctgattttttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttgggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccatgtagaactgtaagtccaataaacctcttttgtaaattaaaaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtaactgatgtgcctcaggaagtctcttgccagctgtccctgtgaagacccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactaccgtca

SEQ ID NO: 3527 - DNA, 285 bp, Homo sapiens
ctcccgatttgaaattctacaggttaccagtacacacctcttctcagtcgagtctcaaaatagcagcctgaattatctatacctctaaaaatgaaatgaaatcaagacatgcctctgctcaaaatccttcagtgtttcttctgctcagtcaggataaaggacaaatttctgacaatggcttcacggccttcctttgctctcacccgattccttcttcatccccatcttctagtctcttctgctactccaatcacactggcttccttctcttcacagaaacatcag

SEQ ID NO: 3528 - DNA, 16511 bp, Homo sapiens
agatagggtctcgctctttctcccagggtggagtgcagtggtgctatctccgctcactgcaacctctgcttctggacaaattatactttttaaactgcactgacttatacaacagtctttttttttttttttttaagacagggtctcactctgtctcctggctggagtgcagtggcatgatcacagctcactgcagcttgacttcctgggaagctcacctgagtagctaggacaacaggcacataccaccacagccagctaatttttctattttttgtagaagtggggtttcaccatgtttcccaggctggtctcaaactcctgggttcaagtaatcaccctgccttggcctcccaaagtgttgggactacaggcgtgagccacagcacctggccttatgccaacaaaactcttatgagtaaaaccattattaaggtctgtagtatcagagacctcaaaatgtgaatatacagcatatgatttactacatcatttaataaatgtctgtttatttcagtaatgggagaatatcacttttactttgataatataagggtagatcaaaagtttcagatatgtatgagaaaagccagattatatttttaaatgctatatgtactctacatctctttcataatggaataggagaaagatgtcctgaaaaaactggcaacagtggatagcctcagagttctaaattaatcaaaatatctcaggtttctttcattcacataatctttcttctgtgcttatgatctcagtggggtttcttggattctgagataatgtgcccctttgctatctagaatgtgtatgccatagaaatactggatagaggtaggatcagcagctaatctatgagaaattttgtatgattagacacaaaaaattgaatgcttatcctaccgtccagtaaaaaatatttttcggtgtccccaaaaatagcaatttattaatggaaaaatataattttatcactaccactttttaatgctacaagtttctccaggagcaaaggataagaagaaaaagagaaattttaataagttattattattattatttttgagacagtctcgctctcttgcccaggctggagtgcagtggctccatctcagctcactgcaacctccgcctcccgggttcaaacagttctcctgcctcagcctcccaagtagctgggaatacaggtgcacactgccacaactggttaattttttttttttttttgaggtgaagtttcattcttgttgcccaggctggagtgcaatggcgcgatctcagctcaccacaacctccgcctcccgggttcaagcagttctcctgactcagcctcctgagtagctgggattacaggcacctgccaccacgcctggctaattttgtatttttagtagagatggggtttctccatgttggccaggctggtctcaaactcctgacctcaggtgatctgcccacctcggcctcccaaagtgctgggattacaggtgtgagccaccgcgcctggccacacctggctaattttttgtattttagtagagatagggtttcactgtgttgcccaggctgttctcgaactcctgagctcaggcagtccgcccgcctcggcctcccaaagtgctgggattataggcgtgagccaccacacccggccaataaggtattataatggcagaatgtggttgaagtgaatccaaataaggataataatagttcctacttcacagtaaagttttgaagattaaatcagataacatgtcaaatatttaatactttgctgctattcttactgtgtgaatatgtacaatatgatacctgtttgtaggcagctgatattttgtgttactgtttgcattaatttaacattaatgggtaaagatggcaggtgaaaactcctaaacatctgggggccgaaatggcagtggactccttactgaaaacaaggagataaagtgaaactctgcatactgaacaatgagctagcttcttgccttatttcgtctctgagaactgacagctcagctcctactacctgagatagatttctctccagaaaaactgacccatcctgaagaaaaacctttaaaaaacaatgctgggggtgtgaggctgaggaaaatgttttgctgttcccttacctataatgaagctcaccactgaaaagtcctacccatgtacacagagatgttccagatagctttctctgtgtctctcaaatatgaaggatcctgagataattacggccaagcttctaacttgaaagactatgaccaaaccaaacagcaaaaaggaacttaaaggaaatacaggtttaatagcccttatctgaaacagctgggaccagaagtgtctcaaattttgaaatatctgcctatatataatgagatagcttggggatgggacccaagtctaaacaaaattcatttatatttcatgtacacttaatacaaatagcctggagttaattttatacagtattttgaaataattgtgtgcatgaaacaaagttttgacccatctcataaaatcagatagggaattttctacttgtggcatcatgttggcactcaagtttcggattttggagcattttggattttagattttcagattatggatgctcaacctgtagtgttaatgcagggaacaaagaaaattttaaaacaaccaaaaaacctaagttaatatccttagaattttgagaagccattgcactctccagaacaaggtactacttaaaagacttggattaccagctaagtacagtggcttatgcctgtaatcccagggctttgggaggtcgaggtaggaggatcacttgaggccaggagtttgagaccagcctggaaaacacagtgagacctctatttccacaaaaaatttaaaaattagctgtgcacccatagtcctagctattcaggacactgaagtggaggattgcttgaactcaggagttcaaggttacagtgtgctgtgatcgtgccactgcactacaacctgggtgagagagggagaccttatctatcgtgaaagaaaaagacttggattccccatatctcttaaatgcaagagaaaacaaagggaagtcccaatatgatcaattctgttatgacaactgtgttatttggacagtagtcagtcctgactgagggccgtagaactcgaagaagtctccctgtgatttggagaataaaaaatgacaaacgattctgatgatcaattaatagaagatacaaatgaagttgaacaaattacaaccaaggcaattactacttccagagatacaaaaatattataaaagaaagaaaatgtaatcatggtatgctatagaagacaatattatctatgtacatttatatattcgatatgaatttaaaaaaattatacaattaagtgatgataggagtagaagtcccagtgtaagatcaggttggggaaggagaatagggggagaagtatgaaaagcaaaatcctcatcttccatagcagagagttagataatatttataattaaaaagaaaaaatgaggggattgtaagcagaggaggcaatatgctaatatatttggagattagatgcccaggttttaaaaaatgctttatttattttttaataaacagatacagagtctcgctttgttgcccaggctggtctcgaatgcctggcctcaatcctcttgcctcagcctcccaaagtgctgggattataggcgtgagccaccacgtctgatcaaatgcccagatactaagaattagaatctaatccaagctctgtcacttagttaatctgtgactgggtaaattacttaatatttctgctccagagtttcatcatttttaaaatgatcattctaagaatttacttcataaatgcagagagcttagaacataattggcacatttttaataagtgttcaaataaatgttataattaaaaccttgtcacttggaaatgaagtaaacagcagagaagtgactaaaagttgaaagtggctgcctctggagaatgggaatgagaggtagggagaacaggacaggggtctaacattttctctataatgtcttacagcaacactgtccaatagaattttttttttttttttttgagacagagtctcattccattatccaggctgcccaggctagagtgcagtggcatgatctcagctcaccacagcctctgcctcccaggttcaagcaattctcctgcctcagcctcctgagtagctgggattacaggcacctgccaccaagcctggctaattttttttattttttagtagagatgggggttcaccatgttggccaggctgatcttgaactcctgacctgaggtgatccacctgcctcggcctcccaaagtgctgggattgcaggcgtgagccactgcacctggcccaatataattttaatgcaaaccattacatgattttaaatcttacacttaaaaaatttaaaaagaaagtgaaattaattttaatgttttatttaatcctatgtatccaaaatatttaaaatatgtaatcattataaacaaattagagattttatattattttgttttgtactatttgaaacccaacatatatttttacatttacagcacatctcaattcacactagccacgttttaagtgttcaataaccacatgtggctagtagctatcatactggacaactatggtaatattggatttttaaaaacaatacatatcatcaatggctgctattaaatcatagagaaacccagccactttatgtctcctgattaaagaccactacttaatttgtacagtggtctactaaaaaaaaaaaaaagacagaaaaaaaggaagcaagcaaacaagcaagcctgaatctgatcaagcctgtagattcaattaccaatttacagaaaatatagaggagaaaataacacattaaatggcatgtcaaggatgcaatcagcaaaatccagatggtgagagactcttagtagacaagcaaaccaaaaacaggaattttaaaaatgtgactgggaaggaattcatgaatttaaaaagacatggctgggtgcagtggcgcacgcccgtaatctcagcactttgggagcctgaagtggacagatcacttaggtcaggagttcctgaccagcctggctaacatggcgaagccctgtctctaataaaaatacaaaaaattagccaggcgtggtggcatgcacctgtagacacagctactctggaggctgaggctggagaatcactcgaacccaggaggcagaggttgcagtgaacaagattgcgccactgcactcctgcctgggcgacagagtgagactccatctaaaaaaaaaaaaagaaaataaaataataacaagacaaaagacttgtcaataaattgtaatatgtgatccttatttagatcctgactagaactctaacaatttttatacttgtgaaataactgaaaatctgatattatttttactaattctttttgaggcacaataatacttttagtttttttaaagagctattatttcttaggaatatatgctgaaatatttatggataaaattatatgatatctaggatttgcttcaaaataagatgggggatggcaacttacggaaagtgggtgggagtttagatgaaatgaaattggccataaattgataactactgaagctagatgataggtacatggaggttccttactttactcctgtatatgttgttttaaatcttccacaataagagactgaaaacaaaactatgaggcatggtattaattttaaaaataaacacttaaagactataggtcttacctaagcccaacattaattccttcagacctgaggagagctttttttcttattaagcccaggaaacctatatatgtcatcagtctgactttacacagtctcgctttccagctcatttgatacgctccatcagaaataaattttctatttaaaatctgtttgtaatgatttgaaattacccccttgacaacctataaaaggctttaacacttaactaaaggaagaagaattctcaaaaaacaacatcaggcaaattcaaaaagataaattcaagacactagtcgatacagctggagaagttacttttattcttgcagttttatactaggaagtcaacatttaataagccatcatccacaattgattaaaaatgtttaatccttaaattgtgcatcaatatcctatgactccaaattttatttatcactctccttcaagtctgaagaaaatgattaatttgctaagttccacagacagtacagtcccactgacataacatttagtatgatgtcctactctcatattagaattaaggacagccagtatcaaactggcctgaaacctgattgtgttcctggttcagaatacctgtagtaaatctgtaaatccacaccaagacacaacattaaactagggtgtgtatatcttataaaaaccttttcacagtaaaaatcaacattaaaattttaccaaattccaacattatggtttttgaatccaattaagctttcaaaatgcctgattagctgtgaattaattataaataacttcatgtagtttgcccagcatttcaaaatggttatggactatcatgtttaaaatgtcaaagtatgctatacatattgcacttttctgctaggctgggctagtatcttccatggcaagatcctcaaactactgaataaaatacacttttaaatcaatataggtacttgattaatttccctgaaattatcaacatcattaccaaaatcttccaggattttgtaagatttgattccttaaatacagttttaaagttaaacttatggagggaaaaaaaccctcatagattgactgtaaattttacgtccttttttggtccctcaatgaccaaagagaattttaaacaaattatgcttcatgtttcctggcttaataaaaagctacaatttttattatccaaattaagaaatattatactaatcaaaagctattaattttgaaatgtctatgtatgtctgtctgtaggtccccttagaacctttccaaacatttataatcaagagattttaatcaattatgtactagaatcatattaaagaaaaacttattttgcaaaaataaaatcactttccaatatgcttgacagaaacaagctattcattttcatttgtgttccactgaagacattactgaaatctgtccaatggtttatttccaagtggtccactatggaattcttcggaatgttttaagattggctgtagctagagttctgacttccatttggaccctgctctccttcactgttcaaatggggaagaaagagattttataccaattaaaagatccatttttacaccctgataagcctactgacttttaaattcattattctgtggcacaactatacaaaacaaagacattcctcattataagacacgtgaaaaattaaaatccagaagactaacaaacattggttttatgtttttattcttatataactttgtgccctcacatataacaagcattctggaagttagtgtccatatatactcaaaaactttaaattagggtatgggatttcattgttattacaggtatcactcaacatagagattacagcttcttctaaacaaatttcctataaaattaaatcttacatataaaatcctattcctactatttatgaaaaacaagaagtgttcttcaaaaaaaaaaaaaaaccaaaactgttgtccaaaggcataataaaatcatatataaatacagcaaacctttataagtcagcaagaaatatggtaatttcctggaaaatgctgaatacttaaaataaaaatgctgaatacttaaaaataactaaaactgaaaataccagtaactttggcaataggattattgccttatcttgtccaccatcatcttgcagcttcaggccctgccactagtggagaatcactcagggaatttctgcaaaaaatgcatccaaaggtagctgtttgaatgactgccttaaacagctccttgaataaagtattaactttttccaaattgtaacattaacttatgagtagcaatccataaatctatcttgttatataacaatcatttttctaaagaaacaattaagatggatggcatttctttatttcccttctgactttttctccctgccccaaatgaactgatacacagtgagggctgagaaccactgaactaaatgaacacatcttacttaaaacacacacatacaccccaataacaacaaaaaaaaccctcttagcacaggtgattcatttttagcaaaaatatattcttatgtgccatggaccttagggtcacttaaaaaccaaaattctttatctttacaatatcagatcattcattgaaatttttgaaaattgctactgaaatttataaaacaggacaatagccagcagtgaaaaaaaaaaaaaaaaaagatggcacagaatcaaactgacatgaaactactatagttctgaattctgccctgaatttcagatgaacttacctaattctgtcagctttaaatttatggtatatgaccatatgttgagagatacctgtaatatacctccactgcattaggaaaagttactaatcagattagtgatttttttaaatgagacattctcaatcaaatcacaaatttaaaaaataaaattaacatggatcatgaagttttggaagaaatgttttaaaaactacaaaacaacataatctaagaaaaatatagtaagtatgatatatgattaaatgacatcaataattaaagtctacaaagtacctgtttggaggtggttttggttttggcatcttactaagaatggttgccatctcttttctctcatcgaaattcttccactgctcatatagttttaaaataaccctgattatttccaaaatctagaagaaaatatttgaaaagttctcagtggcaaaaacaagcaacattttttatataaagagcatacatcactacacaaccctcagaaaacagtaaatagtctctgtccttaaatcctgataaatttgaaagcagtatttttcaccacagtgctgtttaggattttccttctagcatctcatttttcagcatgtgtgcattgtccattcttatctatctctgcagctgatttccttccatctgatggtatcttttaaactgaaacatactaagaataaaggttctaatcatgagggaatataccactatagagcacactcctctagtataaattattttaaacaacttaatcgggggtagtgcacaaaagatgttttgattctctgttactacacatacattaaggtgctcaaaaactggcagctacaaatttgaaacaactagttaacaaattagctatttttttcccacctgagtagaacctaaccttaggattaattttaatgcatttaacacttgagcagaaaagctagaaacacagcaaaagccattctgccaggagataggctatgttacagaagttcacagtagtattcagtggttaccagggagcttttaaaataatcctgggaatgagaggctactttgcaaccaattaaaccaaaagtttaccattctgtttaatcctaaactgaaaagagatacataacttaaataatcagcattaactcttcctaccaaactttttttttttttaaacggagtctcgctctgttgcccaggctcgcgtgcagtggcacgatcttggctcactgcaacctctgcctcccaggttcaagcaattctgtctcagcctcccgagtagctgggagtacaggtgcatgccaccacacccagctaatttttgtattttcagtagagacggggtttcaccatattggtcaggctggtcttgaactcctgacctcaggtgatccgcccacctaggcctcccaaagtgctgggattacagacacaaaccaccatgcccagcccatgtttcttaatattttgtaaccaataatcttcttagcctggtggacatcacaagattttaggctcatgataagtaaatatgacattaatttttaaacatccaagtttacatacaactaagggaataccttttccatatccacagaaagctcagcaaaccattgcctggcatctttctgctgtacaacacaggctacatgtaggcaagctgaaatgaaaatgagagacaactgtccatgtttaactgcaaacacagaatatatgatctaacaaagatttttcactatttcctgtgtattttccaacactctttaaaaaacattaaacagctacatatgagagttaccactgaccatctcatcaatgtaatccgagacagaaaaaattactagattacatcaagttcttgacatctggtcctcactgcgtgctagtcatggtgcagttgccttgagagtcaggcacgttaaagaggaaaaacatccaatgaggagagcagaaaagggaagttatccctgagtagtgtacaaagtagccgttaaactgcacccagaagtcagtgtgacaaaacaaaacaaacaaaaatgttaattaatatactaggttttaacaatgttgactgtgtttccacatttcagttaaaagcagtgttgcctggccttttttcttccttttcattattagcacatgatcaagttatgtgaaagctgggcacatccttacagaattcagtgttgtaatcaaataaaggttagaaaataaatgtaatatactgtatacaatattagttatatatgttatatacaatataaactaacaaaagagaggaatctacatcataattttgcctaaaacaatttctactgagcagcctgtatacccttaacccactccagcttaagttatactccgtggtctggttatccatgtctttgctaaggatgacattctaggcaaatagcaactcaaatgtgaactgacacactggttgccctaagtcaagcaaagctatgagtagggcttaggtcaagaagaggttaaaaaaaaccaaatgactgacatgataaaaacaggaaattaaaatacagtggacaatgctattaacatgggcatgcatagagtacactgaagattgaggaagcatcctaaacccagactgaggtgatgctgaaagggtgggggagggtcactgaagagctgatatctaagccaagtcttacaaaaaaaaaaaatgagagtgggagaagagaatagtatgtatatcaattgggagacgaatttggctagctccgggtttctcaatcttggcactactgacatcttaggttgaacaattctttgacactgtcttgaatactacaagatgcttggcagcatccctggcttctacccactagatgctagtagcaccctaccctagttatgacaactaaaaccaaacattgccaaatgtcccctcggggcaaaattatccccaggtgaaaccactagcctagctcaacagtttggaagatagacaggctctctgaggatgggagtgctggaggctaataagccagttaggagactgctgtggtaacatggatagaaatgagaagatgactatgagattacagaaggaacaatcgagaggaaggcacaaaatgtactggtaaacaactacatgtgggtattgagggagatgaaagggcctaactgctgggtttccaactaaggtatataactagtgctattcaccaaactggcaaagacattaaaaggaggaacatattttggggcaaagtgataagctcaatcctcatcatgagtctgaggtgctggtgggatgccaagcggagctatgtaaaaggaagatggatataaagaactgccaagtggcaagatcttggctaaataaagagatttaaatgtttcggcatgtaagtgatagtagaagccatgaatctcagttaaagtacccaagaagaagacagcagggatggcaaagatgtgacacatgttctgttatcccttccttcctacctatgcagatcccagtattcctacccactgggtaggacaccactcaaaatcctttcaaatccagtcctttcagggaactgccagtaatacagaagtgtaagtataacctatttgtcagccctgatgtaagaaggccaagaaacatcaacatttaaggaataattgaacaactgaacaaagacaaaccaatggaaaataagaggggaaaatcaagaggatggagttataaaaatcaatagaaggggctggggtgcagtggctcacgcctgtaatcccagcactctgagaggccaaggagggtggatcacctgaggtcaggagttcaagaccagcctggccaacatggcgaaaccctgtctctactaaaaatacaaaaattagccaggtatggtggtggacacctataatcctcctgtaggcaggagaatcgcttgaacccaggaggcagaggttgcagtgagccaagatcacaccactgcactccagcctgggagacagagtgagactccatctcaaaaaaaaaaaaaaaaaaaaatcaatagaaggaaaaggaacaaaaattaacaagtgcccaatatataacaggcattatttggtgctctacaacctatctcatttaattcttcaaacggctcagtggaattattagtattctctccattttacaattaaggaaacaaacacggaaaggtcagataattttcccacaattgtaaaggaggtaaagtttaagcctaggactatctgactccacccattacagcactgctttccacagactgtagaatgaatgtacttaacgtcttcctccagccaagcattatggaccacagatgctcctttactcaacctctgagtatttgtttgggctcaggatatgaaagccccaattattttacatgctacaactaatattagctggcttaattctgaacttttccctctaaacaaacaaatatgttctattcagacaccgattaaaactattttgaatggtttcaaaaaaaaaaaaaaaaaacttaccaaaaagggggtgggggaataataatcctgatttatgacagttgcagttcatattattgaaagctcacatgcaaggattagtctattacttcatggaacataaaaacataaagtacaatagggtgaaatttagtttaggatgacctaaataagtttataacaatttaactcataaaggcacaccatgcttacatacctaaagctatcatgaaaggaggatacagtaggcaaagatccgttctgtaggtatcattcactatcctcctatagaaatgtaaatcatattattactgaaagcagaactacctcatctgattgtatatttcctccagagagggccagatttcccatctttgcacacatttatttccttttatactactgaagcacagctataaaagtgaaaacatcaaggcaaaaggatggatacatgaatgtgacaacaaataagcacatatcaatgaataaaattacagctaaatatattttaaatttcaaaatctcataacaaattataaacacatttttctaattttttaaaaatcagaaaaatcaaattaaaaaaccagaaattatacagtaaatttatatgtatgttgcagactaccaaaaagtattctgattactttaaagataacttcagtcttaatttttatgttaacagtctgtgttttgtataaaattaaattttaataggtatatttatggaacagataatttaggattgttttcattttggcatttacaccactatagttattaaaattcaacaagtggtattttgctcaacataaaatatcttggggcaatagtttaatgactttaaaaatacttaacttcatatttaattgtcaaccttcctatctaataacatgttacactattaataacttctgttctaattaccatgcaaggggaagcaacatgtcttcttggcccatgtcctgcacatactggagcaaaggtctataaggatgatacactatcaagcaacaatcctagaaacagtttaaaaaatgtgtatgtataaaaaacagatttattacaacacaaaaatgttatcattacccaactgatttgtaattgtgtatttcaaagtgaatttcactaactcatgcttgcttcccttttattctcttaagctagcagtatgacagccctaaactctaccgtaatagtgaaggcagtgctctctctggaatataccttgataaatcggttggcagtcagtcagcatccattcattcccttagagactcaaagtgtcacatctgcaacacactgaaacctcttattagcctataaattcataattcccaactggaggagcagaattctgccaaagacataatctatctttaaataacactgcacgcacacacaaattgtgcacataatttatggtggtttaatgtcctgacttgtctgtttgtaatcctttcattatagttacttactatagaacagaaaaattttcccatcctaagtaggatatacaaattattttacaggcttcagagagactctaggtgctaatataaataggctaccatgatttcaccatcacatattaggtggatggttttaaaatgtacctctctaaaatcatttctttaaataatttccaacttcatttaatttaaaaatgttttaatctattaatcacagaagatttacttaccattagttctaacagatagaattcacattctaatatctgtttaaaacaaagattatcaatgaaatgtcaatatgaaaccaaattagataagtccacttaatctaacataaattacagacattatagtaatttatcaaaaatttttactaaaaagttttaaaaatccagacaataaacatagtttatattaaaataaatatctgcaataaaaaattactattagaaatgcaattatgattataaggattttaatccttgtaaggaaaagccagcttctcacaatcattcttattactcacttttatttaaaatatcctgtaaaaccatcagattttccagtatactttctactcagcaaatgcaaaaatacaattatttctacttaatttaaaaaatgtaacttaaagagaataaacaaatcccttgcaaggtggaaaaaggacatacctattaaaatgtcaatagaaattcaccttatatttcatattgttccattagtttttaatcccagctaaatagtagtatcacctgggaccttttacacagtaccaatgttgggagccccaaggctgaaaattctgattttgttgttctggaaaggatccaacatcagtattatttacaagttcccaaggtgatttaatgagcagccagggttgataatcgccactatgaagtattttttttaaatggtaaaagctatttagctttaatttagaataatgtctgtatttatgtaatatttgaaactgccatttctaggaaactattaaatttagtctaatataaaatagagctagtttatatatagctttgataattgttccattttatatcatatacttacatgattcatcctataaggaaattcctttggaaaggcatatgaaaatctagtttttactgcagaaaataaaaaaaaaatttaaactgagaaaatgggaaataaattaactcaaaattcctttaacagagcagaatattagagggtagagcaaaattattttcagtaggaattcttggcaacacttacggacgcagatttttatttactttcagggaaggggaaagactggggggcaggacactctacacagcttcaattttatatttactaccttaagaaaggattctgatgtttaaaaaagaaaaagatcaggaaaaaaaaatcactggcttttatcatttctaaaatcttttcagctacagaatggtattcttctgttttccagtgactgagcttagaaggaacacaggggttacatatgtgtttacaatatatacaattggtaaaaaatatacatataaaatattgggaggatagtacaccaaaaaaatgttaacagtggttatttgtgagatttaagaactttttactaatctgcactttctaaactttttacaatgaccaggtatttatcaaaatatatattttaataaaagcattaatatatatgcaaaggtctcgagttactcataaagtagtagtagtaacacataaagttagtactctattatctattactttattggttagtcactaaataaagtacaaatgaaaaaaaaatgttaaccatcaatcccccatctccttaaaatggtgtgagcatatacacataagtactatttgagaaactgtattcaagccattatgacacatttaattcaaccaagtaactactgacaggtcctaaaaaatgtttagtgtcagcttccatttgtacaaagcccaagtgatttcactgaaattaaaagaaattccatttctggccaggcacagtggctcatgcctgtaatcccagcactttggga

SEQ ID NO: 3529 - DNA, 459 bp, Homo sapiens
gaaaactccagaaacaaccaatactcattggcatacattaacggtctgcagtcagctctcttagtctctgtgatggctattgcaaacttctgctggattcctttagccttgactatcatcagtatgaattgaagaaacaagattgtcctttgaactaaaatcctgttcatcctcattgtcactaccaacgactggaattcctgcaagatccccagagttcaaaaaataatcatcttcatccagcaatgaattttcagatcctgtttgattcggcattccataagacatgctgtcaagggtaggagttaagttgtggtctatatcttcagacatttctgtatccatgataccaccaccttaaaaagtaaaatactgtttagacaaatgatagtgctaaagatgaccacaatgataaggtcagtctggtatttaaccaaataaatattttttcaaacaaaa

SEQ ID NO: 3530 - DNA, 423 bp, Homo sapiens
tccactccattgttttattatgtacaaacgctacagaacgagggggacagacacgcgtggggtaagaagggcctggtgggaggagttcacagagcagacggtgcactgggaccaggagagcagaacacaggccataactatagggcaggaggtgcgggggcgtcgtcccccttctgttctccccccaaggtcacagtgcatgcaataaaatatatatacaggagctagatccgtcctctgcaggggctctgagggtccagagctcccttcgggtggcgggaagccagtggcgctccctggcggccaggccgggctggagccacatgcgtcgggggagcgggggtcagtcccagccgttgtctttgatcatgtggttgagttcaatgatgtacttcccctctttgtacttctggctgctctcaa

SEQ ID NO: 3531 - DNA, 650 bp, Homo sapiens
gagccatgatcaggccactgcactccagcctgggtgacagagtgaaacactgtttctaaaaataaaaattaaagaataatggatggcattattcagccatggggaggaccacctgaaatactgttacacacagtgggtcaagaccacttcaaaagccttatgaaaatagcacaactcaggcaaggcttttattccacaaagaaaatgcagtacattttttagttcctttaaaaaaaaaaaaactcagatttactccagagcctatgcacttagtcactaatctatactgcatccccaacctattttttccatttggttcaattttatacatttaaaactaactgctttggtcaaatacgtaccatctttggttcacattaaaagattatggtccaaaactggccagaagttaagaaatatcaacaaaataggaagtttgaaatacaatttaggaatggaatgcttttagagcttgtttcattgaagataataatttatctcatattgaactacattaacgatgttctggctaggtgcagtggctcacacctgtaatcccaacactttaggaggccaagcttctatttcattaaaaatatatatctctctctagattctttttgtatctcttcatgttaagtgcatggaaa

SEQ ID NO: 3532 - DNA, 584 bp, Homo sapiens
gaagcagaggggacgatgaggtgcggaggcgttggcagttgacttttgctgatggagcctctctgaagggcaaattcaaagtacagctgggtgctgcagcactggagtgcgaacttgtggctgtggttatgaaggagcctcgtcagctatgcctttagcccctggtgaagcagtgccagtcacactttgccagtcaaacggagaggcagcagtagtaagaccagaccaaatcaaaccaaaccaagcaaaccacggggaatggagacacagagtttcattctgtcacccaggctggagtgcagatgcagtggcatgatgatagtgcactacaacttggaactcctgggctcaagccatcttccctccactgcctccaagtagctggggactacagattattgcctgctcctccaagcccttcactgtagaatggaagcctgtgattttcctggcatcatgcatgactgagaaggtcagtgtggctaattctgagcttcaacatcaggaaacccgtagttcttcacactgagccgcctcctgcagcacagtcatccttggtaataaagctgatattttaatcaata

SEQ ID NO: 3533 - DNA, 796 bp, Homo sapiens
atgctgaaaggaaagaaggccaagggaaagaaggtggctccggcccctgctgtcgtgaagaagcaggaggctaagaaagtggtgaatcccctgtttgaggaaaggcctaagaattttggcattggacaggacatccagcccaaaagagacctcacccgctttgtgaaatggccccgctatatcaggttgcagcagcagagagccatcctctataagcggctgaaagtgcctcctgcgattaaccagttcacccaggccctggaccgccaaacagctactcagctgcttaagctggcccacaagtacagaccagagacaaagcaagagaagaaggctgttggcccaggccgagaagaaagctgctggcaaaggggacgtccccaccaagagaccacctgtcctttgagcaggagttaacaccgtcaccaccttggtggagaacaagaaagctcagctggtggtgattgcacccgacgtggatcccatcgagctggctgtcttcttgcctgccctatgtcgtaaaatggtggtcccttagtgcattatcaagaggaaggcaagactgggacgtctcgtccacaggaagacctgcaccactgtcgccttcacacaggtgaactcggaagacaaaggcgctttggctaagctggtggaagctatcaggaccaattacaatgacagatacgatgagatctgccgtcactggggtggcaacatcctgggtcctaagtctgtggctcgcattgccaagctcgaaaaggcaaaggctaaagaacttgccactaaactgggttaa

SEQ ID NO: 3534 - DNA, 266 bp, Homo sapiens
ggtcaatgatgaatggtaaaaggtctgagtcctcagatcccctcccggcatcccagttatccccagctgcctctcctccatcgcacttcagaagtgctgcgatgggcagaagggcagctgacactccgtgatgtccctcattctgtgttcctccgtgagctcagggaagacactggttggcatccaacagcttagtcacaaagggatttgattgttgggagtgctggtatctgtggctatgatctgccttgttcaagctgagacct

SEQ ID NO: 3535 - DNA, 4375 bp, Homo sapiens
gtgttgtcccggaagtgccttctctcctcccgggtctgcgcggacgcggcctccttacctcatttgtcctcgcccctccccgtccctctacgcgttttggtccctgtttggtgctttctgtttgcagctacggcagtgagtatgtatgtgacggaccccgagtcacccgcggcctgggacccctgcctaccctccgtctcgccagccgagctgtggaactagcgcgtgccccctcgccgacctcggcgtctccggtccgcccctcacttgtggtggggcgcagctcctggtccctcagctgcgcgccgccccacgcggccgggctgcgggtctagggggtccgcatctccctggctttccaagggctaaggtcgtgattctagggcggctgggcgtccagggcctcggtgggggtggcgtgtctgccctttttatctccccgcaaggcccccagtcttctagggaagccagtcagtgaagcgcggaggtccgggcgcgccgagagagagtccagtctttgaggaccgagtagtcctgggccacctcccgcctctgctgtcagaagcagcagctgccgccgtggaatccaaaatttcgggagctgtgaccctttcctcatgtaaaacgagtagtcttggacgatctgggcataggaaccaatcagaaacaatcgcttcagcaatcaagaccattgttcatcatggaggaacccatggatacctctgagcctctatctgcattaccattcactgggcagcagtcttttgagccaagtggcaaatttggacagtatccatcgatgcagatgaaccacatccaggcactggggaagtggaggacatagaacagctcaatcagtgtttgatccaacacttccatctcattaagacaagtttgatttttctttgctttttatttcatggaatacatgagaatctcttaactgttggagtttccaaggaggcatacctcatgacttcagttaatggaaagaacaaaactaaaatgctgtatggccaaagccacaaagggaaggatccacaatttacattcttggagctatcatctgtactgtactgttgtgatctactgattggcattggcatagtagtaggggtcaagtgacagaatccgtgccagcagtctccaggttcagaagcaattcaagaccctgatgatagctctccagcaaccaacacatggtgattgtgccaacttgttgctcagttataatgcagggccagtgattggtttaagtgaagaccatggttgagatcatttgtctttggtctaatagaatttgagtctagtagaatttgagtctccagggaaagagctacttgaccaaattaaactagtagcaggtagagcatgaatgacagcatattataccatcaagatgttcttagagcagtgtatggatggatcgattgtactgccatcagttgtgactgacgttgtattcaaggagaaagagaaacttgtttagaaagcactttgaaagttttttgagtacgggggtgccctgtatcaccccgttatggttgaactttctccttcaaaattaccagacttggcagcagtggcaaattattgggctaaaagacttaatcagacatattctgggttcaaggctcctaatataatacctggtgcaaacattatacttccactcattcagatggttgcatcctgccaggcatccagtgggactgggaatatggacacttgaacattaaacatcctgaagaattttggaatgacaggttacaagtgaacataatcagttctctatattaaaaaaaaaaaaagatttgggcatagattgggctcacataatctttagagagattttttcatttttgtgaaagtacagaaattcttaactgcttatgaaatgctgattgttaaacagcatccacagctattttgtgttgtttccctgaccccaccctgaagaaaagaaaaattatggcatattgaaaacagcagtatgatgtaagagaaaagatcacaaattccttgagggtgggtcttttccatactcataagcctatttataatattcagagtaatttattgacacatattaatattccctcctatcccattaattgccaaatcatcaaacatttattgagcacctactctgtgtagggtgtaagcagtactggggacttacagtgataaaagacatagttttagccttaagtgatgtactgtttcactgaagagatggaatataagaagccaagtaatttatggaattctcttctttgtttttcttttttttttttggcagtggagtcttgctctttaaatagagcaaggctagtctggaactcctgggctcatgtggtcctcccgccttagctttcagtgtagctgggactacaggtgtgaacacagcttggaaatctcttaaccatgggagttaagtctcaaaattctggtgatacaagtggttgaaacttaaaactgtatttaaaaaataggattcgtgaatttgagatagttcataagtctgcaaaaggctgtataaatacatattttacatttactattattaattttgtagtaaatttgagtacagcactctctttatctgtggaaacttcagactctcccctattactttaatttcagtgagacattattaaatataagtgggcttacacatttgttttgctttactgacaaataatacacaacttggaggcttttttttcctttctattcttcctctaaatgttcaacacttttctgattttgtgatttgaggttgtttaatagcttcctgaggctccattgagaccgtatatacgtgacacttaacagtctagccttcctcggtacatatagatatatgatggtggctttgcctgtagtaaattcatgccaaaacataggctttcagtgcctattacatatggctttcagctctctctactgagggatgtaggagtttatttctgaggtctgagcctcttttcctttacttcctttactctttcctaagccttctttataaaaactatgcatgttctattgttttcctttttgattccctttcttttattatccccagtaggagtgacttgtaattctcatatgttagaaaggcagatctcctggttgaagaaaagatccacccaagcaagtcagcatgtttaataatttttgagggggatctcaaatgtgggaaggattgttatataagacaaccaaatgatgacatgagacaataaatgctataggaattatggaggaataattagctatttattttcttggttagggaagagatattattagttgtagaagtaattactaacttctacattttttattgtggaaatcaaaaatatatatatgaaaataaaatgttataattgacttcagtgtcccataaaccagcttcaacaattaccaaattgtgaccaatctttacacacatgcacaggtgtccctcagtatctgtggggcattggttctaggaccacttatggataccaacatctatggatgctcaagtccctgatataaaatggtggactatttgcatataacctgtgtacatcccgtattatttaaatcatccctagatcacttataatacgtaatacaatgtaaatgccatgtaaataactgttatactgtattaaggaataacaacaagaaaaatgtacatgttcagtacagacgcaattttttttgtgtgtggaatattttcattccaaggtcagttgaacccatggacataggaggctgactgtgtgtgtgtgtgtgtgtgtgtgtgtgtgtgtgtgcatacagacacacatatttctgaaatgtaaatattctcttcttaaaaaaattattatcacagctaaacaaattaccagtaattcttttatcctcatatacccggtgttcagattttctagattggctcctaatttttttacagattatttgaatctgattcaattcatgtactgtaatgtttgataacttaagtaccctttataggttctcttttacctcttctttattaaattccttgtaatttgttgtactaaatagattgtcttctagaatttcctgtagtctgaattatgtagtattgtttcacatgttccagtgtcctcttatttcctgtgagttggtagttagatctagaagcttgattaaattcagattttctctctttagatcatcaactttagatcatcaacttggatcatttgtttcattttgcttttgatatgttgttttttagaattacctcttaaaattttgatttaattttataatcatgtaaaatgtttataaatttccaaattcagatcagcaaaacacaataaaatctattcagagaaggcaaaccttc

SEQ ID NO: 3536 - DNA, 677 bp, Homo sapiens
ggagggatacatatacggagggggatcttactcttcccattcctcagaccagcaggaaaagaggggagacgtcagtctttttcctgtggttccctctcatttgtcccagttactaactacggaaatagcatcctctgctggtgctaagtgtgattaggaagaagcctggggagaggtgagtctggaattttggtcacaagagggaaggacttggagaggagaattagttttctaggctcattggcatttagtttccctaggaaaggggtcaaaacttcaagacactggtggtggtgggagatcaggaaaataacttggcctagctcaaacaatattggataatcccctccttgggggagagggattagagtgtgctcctactggccccttggagcctcccctagcttacacagttaacttgattttaaaatccaaggccaggagagaagaatccaaaaagcaatatttttcatcacatgccaaaaacgggggatagagagaaggagtggcaggcctaggcccctccgattgtcccttgggggttacccctcagcccacctcactatggtgctgggtagaggggatacctgggttctaacctctaaataggggagatcccagcctccacaaagaggcccttttattttttattctgattagccattttaaaccaacga

SEQ ID NO: 3537 - DNA, 1209 bp, Homo sapiens
aagctttaaaccagcagagacctcagacaaatcatatccctcctggggtgaccaggtgcagatcttccagggagccgtctaatggaatttcctggttaatggacacagagaaccactgctaagaacgatttccttttctctttcaatctgcagtactttttatgaagactggtcttttgtgatggatgaagagaggtccagtatgcttcctaccatggcagcaggtccgaactccatactctttgcgattaacattgacaacaaggatttgaacgggcagagtaagtttgctcccaccgtttcagacctcttaaaggagtcaacgcagaatgtgaccttgctgaaggagtccacgcaaggagtgagcagcgtgttcagggagatcacagcctcctctgccatctccatcctcatcaaacctgaacaggagaccgaccccttgcccgtcgtgtccaggaatgtcagtgctgatgccaaatgcaaaaaggagcggaagaagaaaaagcaagtgaccaacattatctcatttgatgatgaggaagatgagcagaactctggggacatgtttaaaaagacacctggggcaggggagagctcagaggacaactccgaccactcctctgtcaatatcatgtccgcctttgaaagccccttcgggccaaactccaatggaagtcagagcagcaactcgtggaaaattgattccctgtctttgaacagggagtttgggtaccagaagcttgatgtgaaaagcatcgatgatgaagatgtggatgaaaacgaagatgacgtgtatggaaactcatcaggacggaagcacaggggccactcagagtcgcccgagaaaaacggagcacactctgtcacccaggctggagtgcaatggcacgatctcagctcactacaacctctgcctcccgggttcaagtgattctactgcctcagcctcctaagtagctgggattacaggcgcctgccaccacacccagctaatttttgcatttttagtagagaaagggtttcgccatgttggccaggctggtcttgaactcctgacttcaggtgatcctcctcgcctgccttgcctcccaaagtgctgggattacaggcataagccaccacgcccggccctgcctcttgagctggggagttcaagaccagcctgggcaacataatgagatttcagctctattaaaaataataataatt

SEQ ID NO: 3538 - DNA, 612 bp, Homo sapiens
gagtcccgcggacgccttcattgctgctgctgctgccgccgcggccgccgctgcctcttccttcctcctgcgccgtcccctcctcggcccgggcggggggctccgcgcgctgagctcggtcgggccgggcgctccgggaggcgggagccccaggcggcggcggcggcggccgcgacggtggtggcggcggcggcgcgggccgggaaactttgcccctttgtgcgctccgccccggaggcggcgggcaggcagcactgccttctccagcgtccagaccctggaggaaaaataccaggagaaactgctcactcagctctgcccccaccacacccctacctgctcaactcatgcctgggtccagggtgggtgagggtgaagaacccaccgggccaagatgatcccttttctgagggctgctgctggtgtcctcccccagatcctgggccccagcaggtgggagagtggccccctacggagtccgatcagactgctgcagaggaggtgaagaggggttgagaagaggcatccatccacgagactgaagccacttgccttcacccttgtagactcttgactgttctaggcgagaaggacctgttggtggcctttgga

SEQ ID NO: 3539 - DNA, 22021 bp, Homo sapiens
acagaaacgccgcttggcctttggactacaccatctgtcgctcgctctaacgagccggcgttgccgccaggggacgctcgggccgcaggaggtcgctgggtcgtgagctggcgccggggacgccgagcgactgcggggtttccctcagcgtcctgctatccggctgcccgccgcgctccttggtagtgtccgtgggcgcgcaggccttgaagaacctcctcgtggcgggaccccgagcgcaggagaggtgtcaaagagctggcgcgtctccagagccccgggaggaaggctgtaacggcagccccatcgtagacagggacattcgcatcccgagccctggatctctgaaaaccagcccagaatttggaagctggaaggaactttagatcgtccattctgagtgtctctcttcgctggcgttttcccactgaggttatgtaaacatgaagaggagcctacaagtgtcaaggaaaaaacgacagctaaccacagggcaggccatgggcaagatatctcagtgttctccgctctcataggtcagagtgagactcacctaggctggactgcaatggtgcaatctcggctcactgcaacctccgcctctcatgttcaagccattctcctgcctcagctttccgaatcgctgggattacaggtgcgcaccaccatgcatggctaatgcttgtattttagtagagacggggttttgctatgttggccaggctggtctcaaactcctgacttcaggtgatccacccacctcagcctcccaaagtgctgggattacaggtgtgagccactgcccccggctgatatactcattttatagatgagaaaactgaggcacaaagagactaagttactttacagcattggggttgaagcccaggcagctggtgccagagtcagttttctgactctcgcagcacctataccatgatatctacctgtatgattctaaccttgtgtatacccctgcctccttcagaagtacccactatcatgataaattcattgtgttcaacattcaaaaaaaaaatggggcgcagtggctcactcctgtaatcccaacactttgggaggccaaggcaggtgtatcacctgatgtcaggagttcgagaccagcctggccaacatggtgaaacccccgtctctactaaaaatacaaaaattagccggcatggtggtgggcacctgtaatctcagctactcgggaggctgaggcaggaggatcgcttgagcccgcgaggtggaggttgcggtgagccaagattgcgccgctggactccagtctgggcgacagagtgagaccctgtctcaaaaggaaaagaaaaaaaagacctctaaacaacccacaaactgggagaaaatttttgcaaatcacatgttccataagggacttgtatctaggatacataaaattcttacaactcagtaatgaaaagacaaatagccaagtttagaaatgggcaagggagacaacaccaaatgctggtgaggatgtgaagcaacaggaactctccttactggtaggaacgcaaaatggtacagcagctttggaagacagtttggctttctgacaaaactaaacatactcccatcagaagatccagccattgcattccttagtgtttacccaaatgagctgaaaacttatgtccacacagaaacctgcacatggatgtttacagcagcttttgtttttgtttttgtttttgagatggagtctcgctctgtcacccagggtggagtgcagtggcgcgatctcggctcactggaagctctgcctcctgggttcacgccattctcctgcctcagcctccaagtagctgggactacaggcgcctgccacgaagcccagctaattttttgtattttaagtagagacggggtttcaccatgttagccaggatggtctcgatctcctgacctcgtgatctgcccgccttggcctcccaaagttctgggactacaggcgtgagccaccgctcccggccagcagcagctttatttgtaattgccaaaacttgaaagcaaccaagatgtcctttagcaggtaaatggataaataaaccttggtatatccagacaatggactatattcagcactagaaagaaatgagctattaagccatgaaaaggcatggagaaaccttaaatgcatattagtaagtgaaagaagacaatctgaaagagctacatactgtatgattccaactatattacatcctggaaaaggcaaaactatggagacaataaaaaagatggcaggggctgggagtggggagaaatgcacagaggtggtgcacagagaatatttagggtagtgaaattactctggatgttataatggtggatacatgttattacacatttgtcaaaccctacaggatgtacaacaccaagaatgaaacctaatgtaaactatgggatatgggtgatactggtgtgtcaatgtagcttcattgcttataacaaatatatcctctggtgcctgatgttgttggtggggggaggctatgagtgtgtgtggggtgggggaaccctgtattttctgttcagttttgctgtgaactcgaaactgctcttaaagatgaaatttttattttaatgggtaaagtatttgaataaccatttctccaaagaggatatacgggtgaccaataagtacatgaaaagacattcaacatcatgagccattagggaaataaaaatcaaaaccctcgtgagataccatttctcacccagtagaatggctagagtgaaaaaggcagacacagccagtcacggtggctcacacctgtaatcccagcattttgagaggccaaggccagtagatcacttgggttcaggagtttgagaccagcctggccaacgtggtaaaacctcctctctactaaaaataggaaaattagctgggcatggtagtgcatgcctgtaatcccagctactagggaggctgaggcaggagaattgcttgacccgggaggtggaggttgcagtgagcccagatcatgccatttcactccagcttgggtgacagagcaagactccatctcaaaaaaaaaaaaaaaaagacaaaagatagtgttggcaaggatatagagaaattagaactttctatactttgctggtgggaatgtaaaatggtgtagccatttgggaaaacagtctggcagtttcttaaacagttaaatatggccaggagtggtggtactcacttgtaagaggccgaggcagaagcattgcttgagcttaggagtttgagaccagactaggcaaaataatgagaccgtatttaaaaaaaaaaaaaaaagttaaacgtggacttactatatgatccagcaattccaatcctaggtatttaccctgaagaaatttttttccacacaaagacttgtatgcaaatgttcatagcagcattattcaccatagccaaaaactaaaaacacccaaatggctatctgttgataagtggataaacagaaggtggtctgtcacccaggcatggtggctcattcctataatgtcaggattgcttgaggccaggagtttgagaacagcttgggcaacatagtgagactgcatctgttgagggaagtcaggaaccccgaacggagggaccggctgaagccgtggcagaagaacataaattgtgaagatttcacggacatttgttagttccccaaattaatacttttataatttcttacacctgtctttactgcagtctctgaacataaattgtgaagatttcatggacacttatcacttccccaatcaatagccttgtgatttcctattcctgtctttaatctcttaatcccgtcatcttcgtaagctgaggaggatgtatgtcgcctcaggaccctgtgatgattgcattaactgcacaaattgtttgtagagcatgtgtgtttgaataatatgaaatctgggcaccttgaaaaaagaacaggataacagcaacgttcagggaacaagagagataaccttaaactcttgactgccagtgagccgggcggaacagagccatatttctcttctttcaaaagcaaatgggagaaatatcgctgaattctttttctcagcaaggaacgcccctgagaaagagaatgcgtccctgagggtaggcctctgaaatggccacttggggggtggctgtattttacagtcacagctgtagggatgaaataagccccagtctcctgtagcgctcccaggcttattaggatgaggaaattcccacctaataaattttggtcagaccggttgtctgctctcaaaccctgtctcctgataagatgttatcagtgacaatgcatgcccaaaacttcattagcaattttaatttcgccccggtcctgtggtcctgtgaactcgccctgccttcatttaccttgtgatatcttattaccttgtgaagcatgtgatctctgtgacccacaccctattcgtacactctcttcccttttgaaatcgataataaaaacttgctggttttatggctcagggggcatcacggaacctgctgacatgtgacgtctcccccggacacccagctttaaaatttatctcttttgtactctgtccctttatttctcagaccggccgacacttagggaaaatagaaaagaacctacgtgaaatatcaggggtgaattttgcccgatagcatctctacaaaaatttgtttaaaatagccaagcatggtggtacgtgtctatagtcccagctactcgaggggctgaggtaggaggattgcttgaagccaggagttcgaggctaccataaactatgatcctaccactgtactccagcctgggtgacaaaaaaacaaacctaaacaaaacacaaaatatggtgatacggtttggatatttgtcccttccaaatctcgtcaaaatgtcatccccagtgttggagttgaagcctggtggaaggtgaatggatcatggaggcagatccctcatgaacggcttagcaccatccccttggtgatgagtgagttcatctgtaatctggttgttaaaggtgtgtggcatctcccgctttgctctcttgttcctgctgtcaccatgtgacatccctgctctcccttttccttctgctgggatttgaagcttcctgaggccctcaccaggagcagatgctggagccatgcttgcacagcctgcagaactgaatcaattaaacctctttttcctctctctctttttttatttttattttttttgatatggagtctcactctgtcacccaggctggagtgcgatggcacgatctcagctcactgtaacctccgcctcccgggttcaagcgattctcctgcctcagccttccaagtagctgggattataggcgtacgccaccatgcccaggaggcagaggttgcagtgagccgagatcacaccactgcactccagcctgggtgacagagcaagactccgtctcagggaaaaaaaaaaaaaactaccaaattgttttccagaataactgaatcattttacattctcattggcaattcatgagtgatctagtttctccacatcctcttctacatttggtgtagcaactgtttacatttagccatttggaataagtgtacagggatagcccattgtagttttagtttgcatttccttaatggctagtgatattgaacatcctttcccaagtttatttccaatgtgtatattctctttactgaagtgctttttcatgtcttttgcacatttttatttagattatttatttttgagttttgggagttctttatatattctagatactagtcctttatcagatacgtagtttgcaaatattttctcccactctatgccttttcatcctctgaacagggtctttcacagagtaaaagtgcttaattttgatgaaatctattttattatttttcctgttatggattgtgcttttagtgtcaagactaaaaatgccttgtgtagctctaggtccagaagattttctcctaaatgtttgatgatgtacatttaagtccatggtttggtttggtttttgttttttggtttttgtttttctttgagacagtcttattccctcacccaggctggagtgcagtggcatgatcttggcttactgcaacctctgcctcccaggttcaagcgattctggtgtctcatcctccaaagtagctggaattatagatgcgcaccatcacgcccagctaatttttgtatttttagtagagacagggtttcaccacgttggccaggctggtcttgaactcctgacttcaagtgatctacctgccatgctggaattataggcatgagccactgcaccttgttgtaatttttgtatataatgtaagatttatttcaaggttcattttcttgcctatgaatatctgattactccagaaccatttgttgaaaagccatttttcctccattgaattgcatcagcacctttgtaaaaaaccaactgggcacatattagttggtgacaaattcttttagttttccttcctttgagaattttacaatttcccccagcattcttgaaggatattttcattggatatgggattctgagttgatagtttttttaacaatggaaaagtgttgtgtcacttctttctggtttctgttgtctctgatgagaaataagctgtcattcaaattattttttctatataagtaacatattgtttttctctggctgctttcaaaaaatttttttgttttgttttcagaagtttgactataatgtatcttggtgtgaacttctttgggtttatcccaattggaattctctcagcttcttgaatctattgttttatgcattttgccaagtaggaaagttttctttgaatatttgttcatttgattatttatttattaatgtatttttttgagacagggtcttgctctgttatccaggctggagtacagtggcagaatcatggctcactgcaacctagaccttccaggccgaagcgttcctcccacttcagtccccagagtagctgggaccacaggtgtgcaccaccacactcaatttttttgtttttgaggcggagtctcgctctttcaccaggctggagtgcagtggcatgatcttggctcactgcaatgtctgcctcccagattccagtgattctcgtgcctcaacctcctgagtagctgggattacaggtgcctgccaccatgcctggctaatttttgaatttttggtagagacggggttttaccaagttggccaggatggtctcaatctcttgacctcatgatccgcctgccttggcctcccaaagtgctgggattacaggcgagagccaccacgcccggccccctcctatgttgtccaggctggccccaaactcctgggctcaagcaatccttctgcctctgtctaccaaaatgctgggattacagggatgagctatcatgccccactctgatcttttattaacagtctcacaggccctgaggttgtgtttattatttgtttcttttcttttcttctttttttttttttttttttttttttttttggttgagatggagtctcgctctgtcgcccaggctggagtacagtggcgcgatcttggctctgcctcccgggttcacaccattctcccgcctcagcctcccgagtagctgggactacaggtgcccaccaccatgctcggctaatttcgtttttgtatttttagcagagacggggtttcaccgtgttagccagggatggtctcgatctcctgacctcatgatccacccacctcagcctcccaaagtgctggggttacaggcatgagccactgtaccggcctcttttattttctcttttctttcttgtttactttttccagtccattttctctctgttgttcagattgagtaatttctgttgtcctgtcttccagttaactgcttgtgttgtcctcttttccacttttgagcccattcactgagctttttatttcgttgttgtattttctatttctaaaatttctatctgattcttccttatatctcctatttctatgctgagactcttttttattttttcaacatgttcataactgtattttttttttttgagatggagtctcactctgtcgcccaggctgaagtgcagtggcacgatctcggtgcactgcaacctctgcctcccaggttcaaaagattctcctgcctcaggctcccgggtagctggaattacaggcatgcaccaccacacccagctaatttttgtactttttgtagagacagggtttaaccacgttgcccaggcttgtctcgaactcctggactcaagcaaccaacctgacttggcctctcaaagtgctgggattacaggcatgagccactttgcccggcctgagttgcattcctctatgaattttagaaaaagcaatcaatttcaacaagaaaattgctggaatttttattgattacactgaatctatagattaatttgagaggaactgacatctttaaaatgttgagtcttctgattcatgaccatggtatggctcttcattgatttacatcgtctttaatttctctcagcaatgttttgtagttattagtgtatgattttgcatgtagcttttgttatattttttgtctatgtattttatattttggatgctgttataactggtttttaagaagttttaattcccaattgtttattcctattatatagcaatataattgattttaatacagtgatcttgcatccttcagccttgttaagctgtagttgctttttggatgatcccacaggattttacacacaatcatgttatttgaaaatacagttttatttctttctttccaatctgattgccttttacttctcttttttgacttgttcactggctagagcttctagcacaatatcatacagaagtgatgagggtagaccgggtgcggtggctcatgcatgtaatcccagcactttgggaggccgaggcaggcggatcacctgaggtcaggagttcgagaccagcctggccaacatggtgaaaccccatctctactaaaaatacaaaatttagcttggcgtgatggtgcacacctataattccagctacttgggaggctgaggcaggagaatcgcttgaacctgagaggcagaggttgcagtgagctgagatcatgccattgcactccagcctaggtgacagaacgagactctgcctcaaaaaaaaaagcaatgagggcagactttttttgccttaaattaagacattcctggccagctgtggtggctcatgtctgtaatgccaatactttgggaggccaaggtgggtggatcacctgagatcaggaatttgagaccagcctggccaacatggtgaaaccccgtttctactagaaatacaaaaattagctgggcgtggcggcaggcacctgtaatcctagctattcaggtggctgaggtaggagaatcacttaaacctgggaggcggaggttgcagtgagccaagattgtgcccttacactacagcctgggtgacaagagtgaaagtctgtctcaaaataaataaataaataaataaataaataaataaagacatttctgaacttaggaacaaagcatttagtattttaccattgagtatgttgctagctgtaggtttttcgtagatacccctcatcggattgaaaatgtttccatgaattcctcgtttgctgggaattttcttttctttgaggttcagatgttgattttgtgaaatatattttatgcatctattgatataatcatggaatttttctttttctgtctgttaatatggttaatttcatttattggtttttgaatgttgaaccaaccttgcattcctgggagtaaatgctatagataatgttgtatatatttacatattattttcaatgtgataagattttgttaatatttgcatctgtgtttatgaggatgttaatctgtatcatctttacctgttttttttttgttgtttgtttgtttttgagatggagtcttggtctgttgcccaggctagagtgcagtggcgtgatcttggctcactgcaacctctgcctcctgggttcaagtgatttccctgcctgagcctcccgagtagctggcagtacaggtgcttgccaccatgcccagctaaattttgtatttttagtagagatggggtttcatcgtgttggtcaggctggactcgaactcctgaactcaagtgatccgcctgcctcagcctcccaaagtgctgggattacaggtgtgagccactgtgcctggcccattaaggtgcatatgtatttaggattgtgatattttcctgttggactgattttttttttttttttgagacagagtctcgctctgtctgcccagcctggagtgcagtggcgtgatctcagctctcatctcactgcaagctccgcctcctggattgatgccattctcctgcctcagcctcccgagtagctgggactacaggtgcccaccaccacacccggctaatttttttgtatttttagtagagacggggtttcaccatgttagccaggatggtcttgatctcctgacctcgtaatccgcccgtctcagcctcccaaagtgctgggattccaggtgtgagccactgcgcccggctggactgatcttttatcgttatgtaatgtccctttttgtctttttttttttttttttttttttttgagacagagtctcactctgttgcccaggctggagtgcagtggcgcaatctcggttcactgcaagctccacctcccggcttcacaccattctcctgcctcagcctccagagtagctgggactacaggcacccaccaccatgcccagctcatttttttgtatttttttagtagagacggggtttcaccatgttagccaggatggtctcgatctcctgacctcatgatccacccgccttggcctcccgaagtgctgggtttacaggtgtgagctaccacgcctggcccctttttgtcttttttttaaccgttgttgctttaaagtctgtttgtgtgatataggaatagctactcggcaaggcatgatggctcatgcctgtaatcccagcactttgggaggctgagacaggtggatcacgaggtcaggagattgagatcatctttgccaccattgtgaaaccccatctctactaaaaatacaaaaattagcttggtgtggtggcatgcccctgtagtcccagctactcgggaggctgaggcaggagaattgcttgaactcaggaggcagaggttgcagtgagccaagttagcgccactgcattccagcctggtgacagagcaagacttagtctcagaaaaaaaaacaaaaacaaaaaaacatagctactcttggccagctcacatctattatcctagcactttgggaggccaaggcaggcagatcatgaggtcaggagattgagaccatcctggctaacatggtgaaaccctgtctctactaaaaatacaaaaaatttagctgggcatggtggcgcatgcctgtagtcccaactacttgggaggctgaggcaggagaattgtttgaacccaggaggcagaggttgcagtgagccgagatcgtgccactgcactccagcctgggcaacagagcgagactccatctcaaagaaaaaaaaaaaagaatagctactcgtacttgcttttggtttccatttgcgtgcagtatctttttctacccctttaccttaagtttatgtgagtccctatgcattagatgagtctcttgaagacagcagatggttggttggtgaattttatccattctgtgtcttttaagtggagcattcaggccatttacattcaatgttggtattgaattatgagatagtgttttattcatagtgatagttgtgcttttttaaattgtgttattgttttataagccttttaaaacatatacttaaaggaggttctatttttgtttcaagatttagaactccttttgacatttcttgtagtgctggcttgctagtggcaaattctctcagcatttgtttgtctgaaaaagactttatctctcctcatttatgaagcatagttttgctggatacaaaattcttggctggcaattattttgtttgaggaggctaaagataggaccccaatcccttctggcttatagggtttctgctgagaaatctgctgttaatctgataggatttccattgtaggttccctgatgcttttgcctcatggctcttaagatgtttcccttcatcttgactttagataacctgatgactgtgtgcctaggtaattatctttttgcaatgaatttttcaggtgttctttcagcttcttgtatttagatgtttagatctctggtgagagcaaggaacttttccttgattattccctccaataagctttctaaatgtttagatttctcttcttcctgaggaacaccaattattcttaggtctggctgtttaacgtaatcccaaatttcttggaagctttgttcatttttaaaaattcatattcgccgggcgcagtggctcacgcctgtaatcccagcactttgggaggccgaggcaggcagatcacaaggtcaggagatcgagaccatcctggctaacacggtgaaaccccatctctactaaaaatacaaaaaataagccaggtgtggtggcggtcgcctgtagtcccagctactcaggaggctgaggtaggagaatgctatgaacccaggagacagagcttgcagtgagccgagatcacgccactgcactccatccagcctgggcaacagagcgagactgtctcaaaaaaaaaaaattcttttttatttgtctttgtctggttgagttacttcaaatgctttgtcttcaagctctgaagttctttcttctacttgttggagataaatgttcagtgccacaaagcgaaaccagcactcaggcaaaaattttctcagcaaggcaatttacttctgcagaagggtgctgcttgtgtcaatcacgattgcaagagcacactgaacaaaggaaagcaggggtttttattcctaatgcagtccctgcctctttgtcattcctccatgggctgtggttggaccgcacaatctaaactgacccaattggctatttgtgaatactttcccaaataaggaagggaagggaaatgtgagttacaatggtgggatgtgcggtttcaaagggaggaacgggtgaagagtgggtaaccaagggaacagatgtgagttattgattaggactgacaggaaagttgtttacagttacagtaactaggggcaaggaggcatagagaacaagaaagttgagtttgagaacaaagaacaaggaagttaacaggctaaacctttgaagaattttattgtatcctacaatttcccccttttaatttttatagttcttcctcttcaaacctttttaagatgtcttggctttgctgtttgacttgatcgtctgaaaggaaacgcttatctgaataaggtggaggagagctaagggagattttagtaagtgctgtttctataagcctttgtactagcccatggttgcatggtgtgacacaacacccaacaagaatgagtacacctattatgactgcaagagaagtaagaattgaggctatgattcctttctatttaccaaaccacctgtctagccatcctgaagaagggttattgactccagaatttttagctaattcattagataaaatggtaagtccttgtaaggcttttgttatgctcccatctggggcagtatggtttgggatgaaggtacgacactgagttttaatcataacacaaactctacctttttcagctagtatcatgcctagggccattctgttttcctaagccatctggctagtcagccctaactcctcagctattcctttgacagcatccctggtataattaataaactgctgttggttataatagatgtaatttatacagtctacatttttattaatagttacccatggaaatattgattcaaatcctgcagactatttggtcccgggcttttaatttatcaggtactccccatgggactccagttgcatctaaataaacttgagagtcaaaaaacctataaggggcttctcttattttatggtgttgtggcttttctttttctggctgatgaaacgccagggtgaaagggatagccaaatggacaagagtgcaggtaccactccagttacttggcagagtgtccagtaagggtccgccacaataccaccatacatcttcttgaggatgactaagggcagactgatgggtaagctcttggaaaggcttaagctcactgcatcctgttaagcttccaaggaacaccaagttttccccttgtcgtgagagacaggacgtgaaattgacattgggagccagaagctggatggccctctggggctgacccgcaggatattgaactttgggatagagcaaagagagagcttggcatgattgattgccccaagctatggaatcctggaagagagctaccatgctgcccatgcctggttgactgggggaccagccgagtgtaaaggggtctatctgggtctctggctggccgtgagcacaagcataacaattgcttttgtttcatgtgcggacagaatatttggtccattccaaccaggcatttgcatcttgatattttgtttcaattgctaaagtttgccttagatcatttacttctacaatatctactttagtcttatcattgggtatagaaggtatggcagtctgattagaagaaggcttagaaggagaagagagggaagagggtgaagaggatgagggattaataaaacgcatttcaaaagaccctatgaggtctgtgccgcgttggtccctatgccatagaagcgactcaaagtaggtctagagggtcggtagaggccggagtgagagtagaaatctgcactggattacactggttatactgaaaatcgaggggaggggtgcttcctttagtaaagtgaatgtatgattttaagtatatacagccacatgttgatgaggtccagccttgatactcagttgtccacagaacatcattccagctatggcagacctgtttccctatattttatgaggagcaagagtcttggtagcgggagccttttattttaaagtggcagagatacttttctaaggctgagagttgcctttgactttggagatctctacagggtatgactaaacaggcatcaaacataataacttggggtgagtttgatttagtcacattgataacaaggtggtcagcaacagaatgaggaaagaagaaagagtaatagagtagacgaaagagagttaaacttttcttagctttagtttgagggggttttcccctgggataatggcccatgactctggaggtgacagtgctttcttgactcaggtgtgatgggtctatcctttttctgctgtccggactgcagtttcagtggttagaagcaccaggtaaggtccttcccaggctggctcaagtttctcctcttttcagctcttgataaggacgtgatccccaggctgatgttgatgtactgggaactccagaggcagagcctgtgctaggagacctttggttttaagaaaagagaaagtaggggagagactaagaatataattcctgaggaactggtgtttttggaacatcagcagtggagtgtaaataaggcaatccatagagcatcttgtaaggggaaaggccagtatcttttcgaggagcagtttggattcttttttttttatttggttttgtcaaatgttttattgagtgtagacatctggagtactataaaacatgcattatctgtagattcaaaaaggagcaagccacattgttctcactgtcaaatgtgttaggcttggcatacatgatggagattaatgaagtatcatgagagtaacatggttcttgaaaagcttctataatttggagtagggtcttaatcacatgaaaagcaaaggtgttcacatttagtgaacttgcatttcattggggggagagggtacacagtattttaattttaaaacaaaaataatttgtttgtcaaagattcccatctccccaactttatttgtcccattggttttcagaaattttaatttttaaaaaatcagatgccttttggaagttgtatgtttatctgagcagtaactaaattttatttcttcttcagttgttaaggtgtgttaaatttgaagaagataatatctccatcttcaacaatataatttctgccttgttgtctgtactttccagcagccttgactgcattttcagaaccttcctctttaaaatcttcatatttcattacttcagccataatgaatcccttttcaaaatctgtgtgaatctttcctgcagcctgaggagccttagtccctttcctgatggtccgtgcacgcacttcatctgggcctgcagtgaaaaagtattttagttggagtgctgcaaacccagccttaatgatctttggcaaagcactttgtgtcatgttcgcttccagatactgctgtctctcctcagcactcaattcttgcaacttgagttccaaggccccactaaaaggaatgaccaaggcacctgggtcatacttgtccacccactctttaatttttttcaatctctttgtcattccaatcatgatagaagcgaacaggttcttttgatctataacccaggattttactttgcacattatatcatatttgggttttagttttttatctcctcctctcacagccaccttttctagtttatctataatgggcccagtcattcctcatctttaagctgaagctcttcatgtattatttctatatctcgaataggatctacactttcttcaacatgtgtgatatcatcatcttcaaaagcacgtgttagatgaaagatgccatcacaagcactaaaatgagataaaaaagcattccccaggccctgcccattgtgagctcctttcacaaggccagcaatatccactacatttagaaaggcaggaattttgcttgctggtttgtgatattggcaaagaaagtcaaacctttcatctggcacaggtactctgctctcattaggatcaatagtgcagaatgggaagttttctgctgaagcctgactattggttaatacattgaagaaagtagatttcccaacatttggcaatccaacaataccaattttcagtgaggttccaaatcttccaatgattgggggtggtttaattccatcacctcccttttgagggggcatcgtgctcagcctgggctatgacacggggtcccagtagcagcgagagaaaggtcctgccggcagccagaggcggggaggaaggaggagagaacgcaggcccggcccctccgccgagcggcatgccgcactacggcggcgacagcggtggaaccgccgtttggattcttaacagggcaataggaagatatttgatccctggcaaccgaatctatagaactaacttggttaaatggttctttaaggtctgattcatcctttctactctccctgatgaaggtgggtgccaaggagtatgatatttccatctaatgtctagcgcttaggatagctttttaatgatatgtgctatgaaataggtttcactgtctgagtcaatattttctattagcccaaacctgggcactatattttcaattaatgctttaactacatgattggccattgcatttgaaaagggaatagcttcgacccagtgagtgaggtgatctgctattactaagtactttaggcaaccgattgggggcatttcaatgtaatcagtttgaacactttggaatggtcttagccctgaatccctccccgcccagggatgatttctttataacttgtttgttggtttccttacatgttaagcaactatccataacctgtttggctagggtatatacccataaaccctgagaactgtgtcacacatggcttggggtccccagtgtgtcccttgatgcaggtgggtaggatttctctcatgagcggtttgaatagcatttctctttgatctggtaacacccattttccttctgagttttctttggctccatttttattaatttttccttttctgcagcagacaaggtaggggttgcagcagggggaggaagacgaggggttaagtgaaaggtgtttcagatgaaatggcagcctgtttagccacttgatctgcaaggttatttccctgacttgtaaaggaaaagtcgttttggtgtccggggacatgtacaatggctatttcttctggcaactggagattgtttaaaacatggacgattagctcctcgtgggtaagatattttggcctttagtttttttttgttttttggtgtttttttgagacggagtcttgctctgtcacccaggctggagtgcagtggcacgatctcagctcattgcaagttccacctcccgggttcacgccattctcctgcctcagcctcctgagtagctgggactacaggatcccgctaccacacctggctaatttttttgtatttttagtagagacggggtttcaccatgttagccaggatggtcttgatctcctgacctcgtgatccgcccacctcagcctcccaaagtgctgggattacaggcatgagccaccgcgcctggcctggcctttagtattaataagaccttgctcagcccaaatttttccaaatatatgagctactccaaaaatgtatttagaatcagtatgaatagttccttccttgctctgtaagtgttttaaaacctggctgagtgcaaatagttcacatgctttggcagaccaactattgggcaaccttcctgactctgtttcttcaagagtttctccatcaattactgaatacccattgtatttttctcctttaattgcttgggatcaaccatctataaataagtgtcaccccattttgaaaggggtctctcttagatccggcctgacctttgtttggtagtcagttagatctagacataagtgttctctttttagatttgggtcccctgttaagaaacctctcggattgagtgagttatcagtagtcaaggttaaatcatctttttagtaaaatagcctcctattttaagattctggagtcagtgagccaccttcctgcttttttatttaaaatagctctaacttggtggggtgtgcttacagtcaatttccccccaaagattaattttctactttcttcaactaatactgctgtagctgcaacgaattggatgcactgaggctacccacaggtgactgggtctaaaatttttgataggaaggctacgggctgccggtgaccaccatgttcttgagtaagaacccctaaagctaccccgttatttacattaacaaaaagatgaaatggcttttctagggaagctaaggctaagacaggggcagttatgagtttgtatttcagctcttcaacctgattgacttcctcagaagtccacaggagacggtccagtttccactgggtaagcttttcatataaaagtttactttttagggcatatgagtcaatccataagcatcaatatccaactaatcctagaaattttctgagttattgcttagtttgaggcaagggtaaggacacgatgccttcaactcgttcaggtcctatcctttgcttacctgcacttattaagtggcctaaatatttaacttcaggctccacatactgaagctttccctttaagaaccataacccctcgaactccagatggttaaggatatgtgtagagaagccagctactttctctacatcttcaacagatacgagaatatcatccatgtactggagcaggcatatttgctttgggatgacaactttttctaacacttgttctaaaatttgaccaaaaaggtttggagagtctgtaaacccttgaggtaaaactgtccatcaataatgttgttttcgccctgaatggggatcctaccactcaaaagcaaatatgtctcagctgtcttcagccaaggggcatgcccagaaggcatcttttaaatctattactgtaaacaactgatggttttttggaattttgctgagaatggtgtatgggttggggacaacaggatggttagtttggactatttgatggctctaagatcttgtaccaagtcggtatgacgcatctaatttcttgactggcaatattggagtgttatacggggacatacagggttcaaggagcccatctttaataagactttcaattataggctttaatcctatcctgccctctaggggtttggggtattgtttcctccttactacttccctggggattcttaacttgatgtggattggagggattcagagtttctcccggtttccttcccttgaccagacactaggattaatgcatttttcatctgtggtggtgagtaggtttaatgaggtaaagaatcctttaggaccaacttgtaagcctgtgcctaattctagcattaagtctcttcctaatagattagtttctgcctcagggatcaacaaaaattggatatgagtcagccgatcttggtatttaacttctgtactttctaagatttttgctttaaatccttctccttttaccccagagactaaaagttcttctgaagagcaggcaatgttggatggggggaagcaaatggaggagcgagccactcctgaattgactaaaaggtgataagctcatgtttggttcccacctgtaaatttatcaagggctcctggtgggactcgagataaacagagcccctgacccccctgttcttcctcaaaagtcatgagttgaagggcttctttctccttttccagtttgggacattctcttttgaagtggcctgcccttcaaacggtctggacggaccgtttatagtttctggccccctggaagctttgtttagaagcataaacgagggtctggaccttttatagtttctggccccctggaagctttgtttagaagcataaacgagggtctggaccttttatagtttctggccccctggaagctttgtttagaagcataaacgagggtctggaccttttatagtttctggccccctggaagctttgtttagaagcataaatgagggtctggaccttttatagtttctggccccctggaagctttgtttagaagcataaacgagggtctggaccttttatagtttctggccccctggaagctttgtttagaagcataaatgagggtctggaccgtctatcgtttctggccccctggaagctttgtttagaagcatgtgggtgtggggccacctgctggaaagtggataacgtgagtttttgccttttgtttttgcttctttcctcacatatattttttgagcttctcccagaagttcacttagaggttggttttcccagtcttctaatttttgtaacttttttgaaatatctggccaacttgtagtgacaaaatggagctttaacactccctgtccaaggagatcttccaaatttaggcctgcatattgtcttgtttggtcctttattcttgtctagaaatttcataggccccctcatctttttcctattgtatatcaaatgctttagagaggttttgggttcagggtactgattccctaattccctttattatcatttcccttaggtcttgcatattttcccagtgagctgcattaatatcgtcccaccgggggtcttgggtgggaaacttttgatctgcggtaggaatgtttgaccaggagggtgttcgtgttcccaaattgccatagcagccctacagatcatgcttctttcctcccctgaaaagaggacgcaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcagtggcgggcgcctgtagtcccagctactcgggag

SEQ ID NO: 3540 - DNA, 2005 bp, Homo sapiens
ctgtagagagagacgagccactcagtatttatgagatgtctgcacctttatccctaagcctgactattagcaatacgcatatcctatatagaatctattacagagctacgttatctccacaccttttgaggaggacagaagggactggaccgtgttggagctgccgcctggcaggtggtgggcctgggatctagccgcctctcctgccctgccttcctcttccccaaggggatgggcccaggaggcagctgggttgcatggagaggtccaggagggaccggaggtgtgacagatactgtgagcccggcgggccgcgcctggctgggtgcctcggtacttgaattctgtcttgttttccgcattgtgtctgtccacccgagttctctgtcgtcacttaactttgcattggatttggttgttgtactttgcccctgaatgtggacaaagctgtgggcaagaggtcagcaggacccgcctgggggtgccggcgttggtgactgcgggtcggggctcctagaacataggagccggctgcctggcctcctttctcctccaggaagagtcattctttggcatttgtgtttagagccaggaggaaggcggaaggtagggagggagggctggtccccctctgagggggctctagtgcctgaccctgacctgtcctcattcgacagctgaaactgttaagcgctggcccagtccccccaccccacccagccgtgtactgcctgggctcccctcaaagggaaatttttatggaaacatcttggcagcaagtggaaaaagatctatggcccatgaaccaactgaaaactccaagaaccctctgtctgcctctgccagcagcgagtcctaagcgcagaatccagagctcgtagctgtcctcagctgtaactactgtttcagaatgttgctgctgcatacttttgtcatgtcagccagccagctccgtgggtgagagtgtgcgtgtgcgcgtgtctgtgtgtgtgtgcgtgtctgtgtgtgcacgtctgtgcgtctgtgtgtgcgcgtctgtgcatgtgtgtgtctgtgcgtgtgtgcgtctgtgtgtgtgcgtctgtgtgcgcgtgtgtgtgcgcgtctgtgtgtatgtgtgcacgcgcgtctgtgtgcacgtgcgtgtctctgcacgcgtgtctgtgtatgtgtgcacgcgtgtgtctgtgtgtgtgcacgcgcgtgcacgtcaccaccggagcatttagggtttggtacaagatggttctaaaatggcaaaggtttttcgtgtttgtttgttttgtttctttggaaaaagaaaaggaaaggaaaatcatgcagaatcgcaagcattcagactggacgaccggctcgtattccgatcagtcgcttccattgttagcatcgtacacgattgtgatttttatgtcaaaagaagccaaaacttgcaatactatttttagcagacaaaaaaaagaactaagtataaaatgtataaatatttttgacttgaagatttggatggcactgggtgcaagtagagcatccatccttcggatggaatgtttggaaaaaagagacttttaaaaaggagacggttgttttaaagagtctgtttaggggttaaagtactgtaactcacgactgttaaaaaataaattttcctgtgctgtaaaggaaggtttcacagtaccactgagttagatttcagccacagatgcttagctttttttttttgtcttttttttaaggaggaagcctttgttttgttttcctgagccctcactctgtttttgtgctgttactcggtagagtcaagactgttactttttagccatggctgacattgtatcaataactaaaactgaaacattcaaaagcgaacagggaaaccgagggcttcaagcgtgctcagagccgtttcagacagtggaaatccatgacaaacaaaaggatgtgatcattaattgtaaagcgctttgtaaaattcacatttacaaaataataaagtcagttcaaacct

SEQ ID NO: 3541 - DNA, 514 bp, Homo sapiens
tgatttatctactgggacctcatcagccatgatgagatgttctcccacatttacaaaatccgggagactgcggatgggctgtgcctggaggtggaggggaaattggtaagtaggacagagggtaacattgatgacttgctcattggtggaaatgcctccgctgaaggcactgaaagcgaaggtaccaaaagcacagtaatcactggtatccttactgtcatgaaccatcacctgcaggaaacaagcttcacaaaagaagcctacaagaagtataatacaccaaagattacatgaaatcaaccaaaggcaaacttgaagaacagagaccagaaagagtaaaaccttttatgacaggggctgcagaacaaatcaaacacatccttgctaatttcaaaagctaccacttctttattggtgaaaacatgaatccagatggcatggttgctccacaggactaccgtgaggttggtgtaacccatgtgggatttcctttaaggatggcttagaaatggaa

SEQ ID NO: 3542 - DNA, 1625 bp, Homo sapiens
aatgggtctcaaaattctgtgacaaatttttggtcaagttgtttccagtaaaaagtactgattttaaaaactaataacttaaaactgccacatgcaaagaaagaaaaccaaagtggtccacaaaacattctcctttccttctgaaggttttatgatgcattgttatcattaaccagtcttttactactaaacttcaatggccaattgaaacaaacagttctgagaccattcttccaccactgattaacagtggggtggcaggtagtagggataatatttatttagccttctgagctttctgggcagacttggtgaccttgccagctccagcagccttcttgtccactgctttgatgacacccaccgcaactgtctgtctgatatcatgaacagcaaagcgacccaaaggtggatagtctgagaagctctcaacatacacgggcttgccaggaaccatatcaacaatggcagcatcaccagacttcaagaatttagggccatcttccagctttttaccagaatggcgatcagtcttttccttcagctcagcaaacttgcatgcaatgtgagccgtgtggcaatccaatacaggggcatagccagcacttatttggcctggatggttcaggataatcacctgagcagtgaagccagctgcttccattggtgggtcctttttgctgtcaccagcaacgttgccacgacgaacatccttgacagacacattcttgacattgaagcccacattgtccccaggaagaacttcactcaaagcttcatggtgcatttcaacagattttacttctgttgcaacgttgactggagcaaaggtgaccaccataccaggtttgagaacaccagtctccactcagccaacaggaacagtaccaataccaccaattttgtagacatcctggagaggcaggcacaagggcttgtcagttggacgagttggtggtaggatgcagtcaagagcctcaagcagcgtggttccactggcattgccatccttacgggtgactttccatcccttgaaccaaggcatgttagcacttggctccagcgtgttgtcaccattccaaccagaaactggcacaaatgctactgtgtcggtgttgtggccaattttcttaatgtaagtgctgacttccttaacaatttcctcatatctcttatggctgtagggtggctcagtggaatccattttgttaacaccaacaattagttgtttcacacccagtgtgtaagccagaagggcgtgctctcgggtctgcccattcttggagataccagcttcaaattcaccaaaaccagcagcaacaatcaagacagcacagtcagcctgagatgtccctgtatatcaatggtgataccatgttcacgctcagctttcagtttatccaagacccaggcatacttgaaggagcactttcccatctcagcagcctccttctcaaatttttcgatggttcttttgtcgacgccaccgcatttgtagatcagatggccagtagtggtggacttgcccgaatctacgtgtccgatgatcacagtgttgatatgagtcttttcctttctcgttctggcttataggtaggggtagttttcacgatacctgtgttctg

SEQ ID NO: 3543 - DNA, 343 bp, Homo sapiens
aaaagaattccggaaacacactcgtggagccagaggtggcaattcaccgaattcgaatcactgtaacaagccgcaaagtaaaatccctggagaaggtgtgtgctgacttgatcagaggagcaaaggaaaagaatctcaaagtgaaaggaccagttcgaatgcctaccaagactttgagaatcactacaagaaaaaccccttgtgaatgttctaagacatgggattgtttcgggatgagaatccacaagcgacttattgactggcacagtccttctgagattgttaagcaggttacttccatcagtattgagccaggagttgaggtggaaggcaccattgcaga

SEQ ID NO: 3544 - DNA, 708 bp, Homo sapiens
ttccagccagcgccgagcgatgggcatctctcgggacaactggcaccagcgccgcaaaaccgggggcaagagaaagccctaccacaagaagcggaagtatgagttggagcgcccagctgccaacaccaagattggcccccgccgcatccacacagtccgtgtgcagggaagtaacaagaaataccgtgccctgaggttggacgtgggggaatttctcctggggctcagagtgttgtactcgtaaaacaaggatcatcgatgttgtctacaatgcatctaataatgagctggttcgtaccaagaccctggtgaagaattgcatcgtgctcatcgacagcacaccgtgccgacagtggtaagatgtcccactacgtgctgcccctgggccgcaagaagggagccaagctgactcctgaggaagaagagattttaaacaaaaaacgatttaaacaaattcagaagaaatatgatgaaaggaaaaagaatgccaaaatcagcagtctcctggaagagcagttccagcagggcaagcttcttgcatgcatcgcttcaaggccgggacagtgtggccgagcagatggctatgtgctagagggcaaagggttggagttctatcttaggaaaatcaaggcccggaaaggcaaataaatccttgttttgtcttcacccatgtaataaaggtgtttattgttttgttccccccccccc

SEQ ID NO: 3545 - DNA, 225 bp, Homo sapiens
cttgtcggcgccattttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaaggtgagcatttgtacagtgaaacattttgctacacaaaagtgatgttt

SEQ ID NO: 3546 - DNA, 2913 bp, Homo sapiens
cagagtctggtcctcacattttagattcagctttgggaattttgttcaggaactgcatcatacaacccaaaagcaaaagaggaaaatgcataagccaggatacctaaatgttcatttatttaaacttgaaaatgtgactgcaaaaggagtcaagaagtttagtactcaacacatttcttctttgtagaaataactgctcaagaagataaattgttacctaacagttgattgatgaatatgaaatcagagcaagaggggctaattagagattttactagctagggctatttacccaaaccatctatccagactgtagacatagaatcaccagatggctaggatcctggtgcagctggttcccctttttccttaccctgaatgtcattaaggatgcattgccaaatgctgcccctctggcctgatgactacactccatattggtcacctgccttctttttcctacagtcttcctccagacaggcacgccatacaaccgactacacttgggctcactgaatgaatcacattcttctgctgtgcctcccagagatttcatcaaagcacccgcagtggccttctggaggctcctcaaactctccactcaatgtttcctgaaagtgtcgtgtttctcacctctagattgttattctcatcagttacatgtgggtttcacaaatttatttctcagaatgcaagtctgtctcttatatcctcgggaaacacacctttatatcccagttagtactgacaaaaattaaactagggactggccaaaaacagtgcctttcctcactttaatctcactaaagtagataagactcaagttattttgttcttgcaatggcattgacaaatgtttgcaccaaaaaccatgttgaagttcattaaggaaactgtgatccaagatccaaggtcaaaaaaacaaattcatcaattcagcacaccaccaactcacaggctaagcatcttactgctaattcattgatgctgccatttgtcaagtgccaaattgaattattgatttgtcaataatttccttccgttggttacttatatagtatattgcaattcttgttgctgaagtcagctacactttttctatttgaaaaacaatttcttgcatttgggatttcaggtatagtgattgttacaaatatgaaggacttgaattaacagcaagttttcaagtaaaactttacttatgtataactgaatgagttcttaaagacatttactaacaattttccacaaactaaaaatttataaaacaataaataaaatagactttaaaaaaaagcgtgtcacacagctgcttgttttttgtttgtttctttgtttgttttttagtagtgaaatggtgaaaaatcagacaatggtcacagagttcctcctactgggatttctcctgggcccaaggattcagatgctcctctttgggctcttctccctgttctatgtcttcaccctgctggggaatgggaccatcctggggctcatctcactggactccagactccacacccccatgtacttcttcctctcacacctggccgtcgtcaacatcgcctatgcctgcaacacagtgccccagatgctggtgaacctcctgcatccagccaagcccatctcctttgctggctgcatgacatagacctttctctttttgagttttgcacatactgaatgcctcctgttggtgctgatgtcctacgatcggtacgtggccatctgccaccctctccgatatttcatcatcatgacctggaaagtctgcatcactctggccatcacttcctggacatgtggctccctcctggctatggtccatgtgagcctcatcctaagactgcccttttgtgggcctcgtgaaatcaaccacttcttctgtgaaatcctgtctgtcctcaggctggcctgtgctgatacctggctcaaccaggtggtcatctttgcagcctgcatgttcatcctggtgggaccactctgcctggtgctggtctcctactcacacatcctggcggccatcctgaggatccagtctggggagggccgcagaaaggccttctccacctgctcctcccacctctgcgtagtgggactcttctttggcagcgccatcgtcatgtacatggcccctaagtcccgccatcctgaggagcagcagaaggtcctttttctattttacagttctttcaacccgatgctaaaccccctgatttacaacctgaggaatgtagaggtcaagggtgccctgaggagagcactgtgcaaggaaagtcattcctaagaggtgtgacatttgaactgccagcctcagttgtcacgtggactcttgatgcccaattattgcctcaatccagaaaagtttacttctctttatctgtgctttactgacagaagggcaagtcttctctcgttttttgcagataaaattttagatgtgttgcattcattgggtttctatgagatgtggttttatcagacaattttttcttttatttcacaattactttaatatctgtaaaataaagaattattttaattcattttcccagtcccaaaagttaaatacaggccacttacttctttaaccaaatgatatagtttggctctgtgtccccacccaaatctcatgtcaaattgtaatccccgcatgtcagcggagggacctggtgggaggtgattggatcatggggagggatttcccccttgctgttctgttgatagtgaacgagttctcacgaaatctgatggtttaaaagtgcagcacttctccctttgctctctctctcctgctgtgccatggtaagacgtgccttgcttcccctgtggcttccgccatgattgtacctttcctgaggcctctccagccatgtggaactgtgagccaattaaacttcttttctttagaaa

SEQ ID NO: 3547 - DNA, 2543 bp, Homo sapiens
tgaagagaaaatatgtttgggggtggcagagtatcaagtaacattcttctcatatgggttatttcagttttcatcaataggaaaattgctttgaagatagcatctgtagaaacaaaaatgggctttgaaattgagtaatgaaatgtggttaacagttaactgatgtgatgtcattaacactttggggagtggggtgggggtggagatattctagagatgcttagttgcattgaatgagtttcattcctgactggcatgagccgtttaccctaatcatccttccacactgtacctcatcctgttaactatacaagacctcaaaatgagagggggggacataatgcttctcaatttcataggttttgcctttttttggagtagggaaaattacagttccttattcccattccccttgcatttttttttcattattaaaatgaagttgtcattgtcttttaaatatgaaactacttttcccaggaaggacaattggttggaaagactgttctatagctgccagagactggataagcgtgaccagtcaacaattccacgcaatctcctgaagacagatgctatcctttggcagtgggccatatgggaagctgcacaattcactgttctttctaagctgagaaccccactgggcagagctcaagacaccttccagacaattgaaggtatcattcgaagtctcgcaggtcacacattaaaccctgatcaggatgttagtcagtggacaactgcagacagtgatgaaggccatggtaacaaccaacttagacttgttcttcttctgcagtatctggaaaatctggagaaattaatgtataatgcatacgagggatgtgctaatgccttaacttcacctcccaaggttggtttccgggagatagtgttgttttatagcagtttaatggtcacagctggcagtatgtgcagagctgaaatcacaatagacttgtgtatttggtttatatataggtgagacatccttacctacaaattgaaccagtcctgagcttttctttctcttatcgtaaaggtcattagaacttttttgtataccaatcgccaaacttgtcaggactggctaacgcggattcgactctccatcatgagggtaggattgttggcaggccagcctgcagtgacagtgagacatggctttgacttgcttacagagatgaaaacaaccagcctatctcaggggaatgaattggaagtaagcattatgatggtggtagaagcactatgtgaacttcattgtcctgaagctatacagggaattgctgtctggtcatcatctattgttggaaaacatcttctgtggattaactcagtggctcaacaggctgaagggaggtttgaaaaggcctctgtggagtaccaggaacacctgtgtgccatgacaggtgttgattgctgcatctccagctttgacaaatcggtgctcaccttagccagtgctgggtgtaagagtgccagcctgaaacattgtctgaatggtgaatccagaaaaagtgtgctgtccaaaccgactgactcttcccctgaggttataaattatttaggaaacaaagcatgtgagtgctacatctcaactgccgattgggctgctgtgcaggaatggcagaacgctatccatgacttgaaaaagagtaccagtagcacttccctcaacctgaaagctgacttcaactatataaaatcattaagcagctttgagtctggaaaatttgtcgaatgtaccgagcaattagaattgttaccaggagaaaatatcaatctacttgctggaggatcaaaagaaaaaatagacatgaaaaaactgcttcgtaacatgtgaagtccagatccaagggaacctcagaaatccattgaagttccattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcgtctgctttggagaccacagtttctaacagactttcaacagaggtctgtatatttttacaagcacactcttatgactattaatggtcattactgtagaacaaagaccttattttttgagttttttggaataggatttgtagttgggcaagctggtaaatccagaaatctaacatgctgttttcaggcagtctttcatttgggaagtacatggggcagatggaagaacctgagataatcgcaaggatggcaaattgctcagttttttcttctatttttggggtgggaggtggtgtatgtaaagacagttcctttaggcagatcacgtaaattttagatttgctgcaaacaaagatctctcctcttcatcctaaatggggtaaagttcgaccagagatgggggcttctgaatgaatggtgatcttcgagaacttcataataaagcattagttgtaatgtt

SEQ ID NO: 3548 - DNA, 48586 bp, Homo sapiens
acatccttggtgggacggagcaggaaggctggagatttcatcaagctactcacagcagcatgccatttaaaattcatgaattatttatttctggaattttccgtttaatatttttggaccacaattgacctcagattttactttctactcttgtcagtcatatctgcaaggctgacagttaccaggggctgtggccaggcatgagggagaatgtgtcattgctggctgcgttggtcatagcaacgtgtctgcctcagaacagatccagcatggatgagcaaacagaaaaatgtgtaagaaggcttgtgactgaaacagaccaaggcagacacttgaagaagcatctttcttgtgatctcctggctggtaccctgaagtcctgttatgccaatggaccagcaaccctcgcaggtggctaaggaacaagcaggcccgctgtgtttcagtggctttcagagaaggtggcgggaaatagtctcttctcagcagcagctgaatcccagtgttagcagacggagccttgtttcttgaaagtacattcccagggattcccttgaagaatgtgagagatcagctggaatgaaactggatgttttagggtcctgagggaaatgtaaatccagcagcttattctcaagatgtggctccagaaccagcagcactgattcttctaaagagttgagagtgcattttagctgtgatatctttgtactcttaagaaatcctcctcaacaagacaaaacttgaccaagagcattcagttgtcttccagaaggctcccttgaggactgggactcttcctggatgcacccaattaatctattgaaacaaggactcgtgatggcagcccctcacctgacaaactggattttccccagagatcatttgtaatgtttttcctgaatcttatttgtgtttccctattagcaatgttatgtatttctatatcgcaaatcctaagtgccgcctgtagaacctaacctccatttatagcatggaacacacagcccatcacgtatccttgccctggccttcagcctctgaatattttaataaaaatcactctttcctccttaaggaccatgttctttaaaagcttaacacatagttcttaataattggttgctttacttgatgtttctctgtttatcttggctgcccagaagctcagacttaaatgtaagagtctacttacagtaacaaccttgttgcggatacaattaattctccctatcttgtatgtggtttccgttgtctttatttattatctttatttaaacctttaaaagagtataggatatcaatttatgaaaagaaaaatattttttttagttcaattgaaatccctgttttgtaccacactatatttaatgccccatatagttctaaaactctgcatgattcaaagcaggggttcttattctggcgtgtgtgtgtgtgtgtgtgtgtgtgtgtgtgtgtgtctgtatgtacatacctcaagggagtctctaatttatatatataatttatatgtatatatacacacatatatgcacacacacacacacacatatatatactttatatgtaacatatatattaaatattatatatgtgtatacatactacacatatatatacacatagtgtttgtgtgtgtgtgtgtgtgtgcacttttggagagagagcatctctaactttcattagtttatgcaaagaatttatgacccttctcttgccccacccccagacccaaagttaaaaattactggtttaaagggacctggaagtaaatatccaagaataggaatgcacacagctccgccttcaagtcttcctccccagtcagtaaacatcattgtcatttatttttggcctcttttaggaatcgttcttctgaccaagcaagtagatgaattgctatatatggagccagttcaaagcaaggcacaactcgctggttttagataccaaagaagtcctacagttcaattatgacctgggggaggtcagagctcggcaggtgaatcttgcttctgaatgaagctgaggcagagggagccgacttgcttcaccctttccctcactggtttcccccagggaggcctgggtaacaggcagggtgcagctcctaggcacaaagatgcctactgattgtgctgggccaggctgtggatgggagttgatggggcagcgagatgctgggctagaggcagcagtgggcacccatgacactcagggagctggatgtcaagccacggaaatgaaatctaccagagtatcaatgagtcacagctgcagcatgttctgagtccatgcacagtgctgttgccaggagacccaagacagtgttttccaaagatgcttaaagcaagtctcctgagctggctaaggatgcaccatagggtaagcggcacagagcacatgcgccatcactttcctcctcctctccaaccagagaagtacagcaatgatctgcttaatagtaagacatgtgacagcaacaagtacacactaagtcactattcctcttgtttccctgtaaggggaacttggcagtttttacatttctgtcccctcattccctcctctccagaggaggagtggcttccctgattggggaacttgggagcgacgcttgagaatgtgggctcagtctcctcctctgccctcgagctttgggaacagcctgcctcagaggccatgtattctggtctgtttgattcctttgtactgtagttttccctgagaggactccttcataggagacttctagctgtccagcactgctgtggatacgcttaatttggggatgtaatgctggcatgctcatttggtcctcacatctaagtcacagtctccagtagctttaccagtaatgatactgacgttttgatctccacttctttctattggttctgaacataggccagtaaggcaggaatgctttgtattggtcttttaaaattccaacaatttcttctgaagaaagggctctcctagtttgaaaaatcttaagacaatctgatctcaggccctgtgggtggttaacaatatttagggtcataaaagctggttaacatcagcaggcaagagatcttggagaaatgaagggacagaagtggagcagacaaggaaagggtcaccctaccccagcagtcacagaagtcaccaaacttcaccaacatgatcttccagcttgagctgcctctccatgtcctctctccccggccagatctgattcagagagtgcctgggccaatgaacatctaactgatatattgaacaaatagagtttaatctggtatgatcatgaagtcatgtttttctcatcactgctccagcgaatgccatcttggctcctttctgctgactcttgcctttgaatgaaatctcacaaagacatcctcgttttggttattcttagacaataatggaaaagtcctctagttacatctagccacaaaaaatatatatcttatttgaaattaaaatgtccaggcccatgtaatagtcacatttagagtagaaaccctgttatcctccatgcaggctggctttctcctagaaacttgtatgaagtcagggaggggaggcatacctactttctgtatttctacggagcatgtttaccattctcctttacttactaggttgtcttggatgacccagggctgaggcaggggaacaagaagagatagggaaagttcttgctggatggtctggtgctggtctcctctggctatgggtccttaagaggttcttttgctgggtcccactaactacagcttctagccttttcggctgaggtcactatactatttccagaacgtacccctgagtggggtcaccttttaaatgacccaagttgacagtcctactacgagttacacatcttggagtcacatgccagtggcctggcatttaaatcagaggaggcttcagctaacatcctcttgcgactagtggcaaagggttggtggcctgggtgtggctggctgctagagtgtggagctggcagaggttttgctggtgagatgctgccggggttttggaggaggaagtgggtggaaatgtgggccttgccctctctcagcctgtgacagcctctctctttcctgctcctgttccttgctgttggttgcccacttttcccttgcatctctcaggccttgccttcttctttgcagtcacagcatccacgtcatcttttcctttttttataggatttttggcttcatagagaggcttggtggtaccagcctctctgttatttttgttctaagccagccacatcttcccctttcacttgctagactgagagtattctgggtgactttgaattgagcagaggttgccttggcaatctgtgtacccagggatattgattgggacttcaggaagttcatgtgagctgacatgcagacataagaaagggtctactgggcagaaggagccagggcaggacagaagctaccaagaggaagggagaagggaggagctgccttagagaaacacaggatctgcctgccaggagttcacagggttcagcaaatggcccaattgtgatagacaagaattacacagagggagtaagttctaaagcatttaaacattccaagcaaaacaataagggctgtgaatatcgactcaataatccttcctattctaggattttggaaaaacccattttacgaattccctacaaaaagtttccaaatcactcagagaatagtgtatttgcctgaaaaacatccagacattccttatcagcaggcttatgctgccagcagtggtaacactgtgctttcccctaagatgtgcaaggttatgagccatggaacagatgtttgcggtttatgactacctctgcttaagcctgatttcttaaacaagtagtatctttcaggtgccttctaatatgcactgactgcatttgctggaggcctctgtcttaacacagtctcttaattccccttccttttgactgtgtggttccaggaatgcttggattttagtaaaatcctggcctttgattagggctgaaactgtgcctactgccctaatggtacatggcaaattaaatatcccccaacttgggttttgatgtgtttgctctgatgaacttttctcattatgggttgatatggttaggctttgtgtcctcacccaaatctcatcttgaattgtaatccccataagccccatgtgtcaagggagagaccaggtgaaggtaactgaatcatgcgggtggttttccccatgcggttctcgtgatggtgagtgagttcttacgagatctgatggttttgtaagggactcttcctcctttgctaggcacttctccttcttgccaccttgtgaagaaggtgtcttgctttctcttcgctttctaccatgattgtaagtttcctgaaggctccccagccatgctgaacggtgagtcaattaaacttctttcctttataaaatttcccagtctcgggcagttctttatagcagtgtgagaatggaataatacgtgcatcgaagggcaattcacgtcctttctctcctgggttggatttctggagctaaactcaggtttgcaggagttagcattacttcttcaccatggaaaagaaaaacaaggacaggtggttgcataaaggacccagtgattaaatcgaaagcacctgtgaaaactcaaagtcaatattttctttaaaggaagggagtgtacacaatcatggttgtttaagttagctaccatagcagaaatgacctgaatatcaatgattggcttcagctgctcagcacgtccttcgggtcgaaaagttgggcagtggcctctgccaacttgtttttaatgagatatcctaatattttgaacaacattgctatgcttctatttctaccttaatgaaaacaatgatatcacttatacttattaagcactagccatgcatccagcacagaactaaatatttatatggattatcttgattaaactcctcacaataaccctatgaagtagctgctattttcacgaatagatgataaaacagaggcttagagacaatctgcccacagtcatatagtttgtaattgagtcaacccatggctgttgtgactccaaagtccatgctcttacttagtattgcctgcctgtcttcatcagttgggtagaaggtaacttctaagtttgtgtgtgtgttggtggcaggggttggtgtttttttttttttttcccttcccaggtgtttgttatcacaatgattttcacaattccatgtcctgttcctgtgctctctgtggtgttgactgcatcagtgggagcttagctggggcacctgagttctcctccaggtgtcctctgtgagtggtgtctcatcctccagggcatctccacatggcttctctccagcagaacagcctagtcttcctcacaacatggcagctgggatccaagagggagcttaaccaagaaaacaaaccccttttccaattgcttatattaagcctcgcttgctaaagtctcattggccaaatcaagtcacatgatcaagcccagattcaacgcaggagagaactttaccaggggtaaatatcaggaagtgtcattcattggcgaagccacagtagaacagtctatctcattagtaataatagtaatgatatctttcatatattgagcacttaccatgtgctagtcagtgtgttataggctttacaaaattattttaatcatcatagtaacccaacctatcagcttggttttattcccatgttataggagaggaaactgaagctcagactaacctgataaaatgacaagagtgaattcaaacactgatcattctaagttcccgatccaagagatagaaatatggtatacagaaaatgaaaaaaaatttttttttcgtataatgatagcccttggaattcataaggaaaaaaataaaggtactagtcaatgactttaatgctcagtaggtagcatgtttaggggccttcctgcctcaagactaattctcttgtatttgcagccagcctttctaattctggtattttgaatggagaacagtcaataaacaaaattgggtataattaggctaatcaaaatgtgaaataatatagtgtaacttttcttttaatcagcctcttgttttattctttggctaaatgagctggtctttcctctggctgtgttttcaaaaagttctgctccaaaccatttggcaagcagtgagctggagaaagaacgaaggggaagggtctataccctataatgatgcagatttcaaaacatagcttggatttttggaaaatcccttcatgagcatgaaaaatacaacaactatgttcagatgcttttgccagctgaaaaccaccatgacacttgagatcagttgcaaacgttctctccttccccaccagcacccagggctgtggtccaggcagtgaacacagtgtttggcctgtcccaggcctaagggtgtatgaagtgtgggcattgttgggtgagcttggctgggagggcagtgcctcaatgcaagggaatcatgtggaaagattcatggaaatttatattaaaatatgatacctccaaaaataatttcttgcaagcagcaagaattaacgcattgtgaaacaaacagagctttcactattaacttcagggaagaaaaaaagggagggtggctggctcagtggaaaatatcggctgtaagctgtgattttttttttcttgcctttcccatgctagatggcactaattgaagagctcagttgtttggggagggggtttttggaggaatgtaacatgatcacgtgatttttggtgcatcgtggggtccctattttattttcactgttaactccaccattgttttggtctttgaggtaattttaaattttaagctgattgcatgatttttctggaagtcaacactcggagaaaaggctgatttggagggcctgcagaagtgctggggtgggtgttgacagatctgagtgacatttgcatggtatttccctgtgtcaccccacccctgccacccttaatcaccctagtggcagtggtttaatgacacagagatcctggaaaagagtgtttctcaaccagtttctttcaaagggaagccatggaggaaggagccattttatctgagcaaacagcaaattcttacaggagcttgtaatggctgtccattctcccactccaccccccaaaatagaacttgtggtgtgaaatgaggacagcaaatgattcatatgtagatgggtttataattcattctagaaataaagctgagcctgtaaatgacattccaggaaaaataagaaagaatgagtggctttaagggtacaccagactgcttaggccaaaattaaaatatttggtagacttaaaataattatatttatttttttgaaaggtaatatgtaattaaaatttcctctgtggaatagtcacttaaaataggtttgtagtattcatattgtgaatttatggagggattgtatgctttgatctcatcaatggttctataaagaagctttgacatgtaatgttgatagtgacagaacagaggctcagattctgtcactttccaaaggtcacacaggttgtaagtgacttaaacttggaaattgtgtctctaaagctcattctcttttcattaagttatacagcatctcactctataaggctgtgtaatgatgacagtcatggacctgctcactcatgatctgggtggtgaagagttttggatttagaattagaagaggtaattggattagattagagtctcacctgatgttacttagctgggtgacttgaagcacatcactaaaattgtctgaacctcaatttcattatccgtaaatttgaaggagatatcatttatttatagagttaagaccaaaaatcgtaagtgtaaaagttctctgaagatggtacagtgctctaccatgatatactatttcttaggtacaagctattatttattaggcacagcaacagactaggagctaggagaaattcagaagtcttttttatagcctgcctgacaacctctttaattattttccatctgctcaagaagctccaagccctggccacactgaactttttaatttatcctttacacgatttgctctctcatatctctgtgctcgtgcgtaacacccctctcctatgatctcctatgcatctttcagaggctcttttcagctctattggtagttttcctcttctaggtgcctatgcattttgttcacaactcttatggcatttcctacagtgtgttataattcatctgtttatatatatgcttctgctccttcctaagctataagcttctcaaggagacatgctgccatctgtattaagtgtgcctggtacatagtggacatccaaaggcttgctcaatgaatgcatgactagaggtgtaagaattactgtcctgatcctcatacacattacaacctaatcgaggatcatgacaaatagacatgaaacactagcaaaataaacaggaaaaaggattctgtgatgtaggtgcaaacccttagcattgcataaattcagaggagcaggagacctttgaaagctaaaggaatcagggaaagtttctgtatgtggaattgcttaatgataagtgatgaatggggaaatcattaaacccaccagaattccttcagggagaaaatcctgttaatttggaaggtacgtagatgctaaatactcaagggatctgcttcggggcaaagctgtaccataagaggaagagcatttagctattgttctaagagataaggatgaggaaagggagagtggaggtggattgaagatgatggctgaagaccacacacccagcaaatctcaatgacattgactaaatcctgaagtgcttgaactgaatggatttttttaaaaaaggaaacaatgaatggactcaaattatccattccttgtgaatataggaacgtggaaacaaagagggaaccaaggcacagctattcagagaatacgagatggccttctcagggttcaaagagatagatttggggtttgggccaggtttaaccaaatctctcaggattgcagctgaggagcaaagaaaaggggaagctgatatctggatgacaatatccaaatgagttgcatctccaaagcagagaattggccatgggtcttaaggaatcatccaagttaaagcaaaataatacttcagccctctatataaacattcctgtagccactgccccctagacctatagtttataaatctcagtctacccagtatgctgatggaggaaaagctttcacctaaacaccgaccgtgtgagttgttcataatactaaattcatttaacttacagaactatatttcaaaatgttatttttctgacataattgttcgtttttaaatgaattgatggcttttgatgtctttacgtggcaaaattaaaatgtgtcaacttcgtgttcattttctaaatttcttagagattttattggtctataaaatccaaaatttgaagaaccacctcttttaatatgacccatagtatcatttcagttagctaatttgctctgaattaaatggcagatttattttcagttcctgaattcattactggtggtcatggttggtgtggtttattaaggcaattccttttcgagtcacatcattcgtagcctcttcaaattaaaatttgtgaacaggtatactgccacaggtaccctgaaggctgtctgcatatgaacagggtttggttttgtagtcaatatgccattcaacaagatgaaccccacagttagtaaaaacaatagcttgcattgtattattacaaagcagtgtttgtgtaatgattacatattttcacttacataattatgaaatgtacaagtgtgactgctgcacagtaattagtcacaaatggcacacatttcatgtaaatggctgcaattcctgtgactcttcctattggggctagcttcatgagcgtgtgacctatctagtcccacagggtccccttgctcaagagggccccatgtttggtttaatgtgctgtggctgctgtcttgaaattgttcataatttttgacaaggggacccaccccacatttcccctttacactgagccctccaaattacatggccatatccaactgctattgcaaagattcaagctgggctgggaggtagaaatagaaggaccaggtagagaggcagggagcaagactgaatccttttagtcatctcaggagcctctgcctccaatccaacaagaagggcttctcctgttacttagaaagtcttggctcttttattcaactggaacaaggaagaagaattagcttttcagaaaataaaaagttttggttaggtcacagtaagggggagctggggagatgctatggttttgatatgtccccagatttcatgtgttggaaacttaatctccaaatttgtatgttgattggagatggggccttttggaagtaattaggattagataaggtcatcagggttggagtccccatgatgggactggtagcttaataggaagaggaagagagatctgagctggcatgctcttgccctctcaccatgtaatggtgagaaatcaatgtcttttctttataaattactcagtctgtggtattttgttatagcaacagaacatgaactaagacagataattgatactgaggagatgggctattgctagtaagaaatacctgaaaatgtggaagcagctttggaagtgggtaatacatagaggctaggctctgagaataactcacagtggtcaagtggcctaggaggtgccttcagggagaccagaagcacttgatgggataaatagtggtcataagataggcagtgtaaactacctcactcttccccactcttccgtagcatctgctgtgaagatactgtttcttatggttttgttagtggatttctttgtggagctcaaagttctgaacccaggttgattcaacgtgaaaataaacattgatcgtgcaggctcaaggagccagaagacaggggtcgggggatggaaggcgggacagtgggcaattgggctcagagtgatgtgtcctcagtgagaattccagttttgccataatcttccctgtgaagttctgagaatgagtgtacaatgccataatgtcctggactatggtggggatggtgggtgttccccacacttgagcagaacgaagcctgtgtaagctgtgaaactgtcagctttggagattagtcatccttgctcagaccctataaagcttttgcattagttaggctgatgtttcacttttaactcatataataggcttcagacacttggaaatagtgcttttatcattaggtatgttgccatttttattttttcaagtttctcgctctctctctcaccacataagtacacttaaagctttacccttgctatgaggttaacctaaggcagagggtatgttgccagctataggccaaaagtctgggtaggcatgcgagaaagaaatattttggtagcaatatagcttaggaagtcaatattttttaacataagtgacagcaaatatttacaaattcaggctactgtgggtgttcagattctgagtgaaaagcaatctcatgcactgatatttactttgaatatgttctccttttttcagcacccatgactaattccccttttcacagggtgaagagcaagttggctcttgatctagccagaaaaaaaaaaaaaggttttcttatacttctggtagtaggcatgtggttagaatacaggagtaagaaaacaaatgtgactcttaaaattatagtacacattaataaacgaactaaacatctaaatgttgctaaagtgactgaatcacagatccactgtttcttactctggtttttgctagaggggcaatgaacatgtaaattgagggtacaatgcagcaaatgaactaaattagagactttatttgagtattgttgatgccgggagagatgagaaaaataagacaaaccttgccttcaaggaacttatatttgtgaggaaaatacatcaacaaagcaaagtcaagtaatcataaaaatatgaacggctctttaacagtagaagggagggagaaagctgagcgtggttaatttatacatggaatgtatgaagttgtttcagagaggcaagaaattatttgcctctctgagtcttcctggaaacagtctccctggaggaggtagatttgagtattgaaaggagcattctaggcaggcagaaggcatgagtggaatcacagaggtggtgaaagatccatgagagtgagatgagtaagccaggctggctgatgtgaggttttgggatggtgaataattggagactgtgctggaaatagctagtgcattggactccagagggtcttaattggtgggacaggagcttctgcatgcaccatgaaagacctgctctgacacagtgaaaatctctgcatctccctttcccactgagtcatcttaggcttccctctctgcttttcccttgaagccaggagtccattcccagtgggcaggcccatccttcctgaaatccagcacaagatgaggcctggtaggtgagtgtgcagggccatggtgcagactcctccaagctcatcattactccagcttggtcagggtctgtttggaaaatggagtggtgacatcctcttgcctcaggatgtgtggaagctccttccatgtatacagtagaaacagagcatctctgatcctttattacccccagaacccactctcctggctcctggccgaagggcctgagaagcaattgtaaaattgggagcttgcccaaaggaccagtactatataaagattcatttcaaaccctgagcaaggcgttacggatgcagacctgataatgagccattatgagaaaatgaaaagcacagactttgtggtggtgccctcagagctaagtaattctggagagtaattatgaagcagaagaatgattatacaaactgcagactaaacatttaggccctgtgtgtgaggccagctgacaaagcagaggtaattaataggcagttacaatgtggaagattctggaaagtagagttctgttgtctgaaatttagtctgacagaggaatattagcaagataaatgtatttggaccaagcactcccgagaggaagggcatgctcaaattgtttctgtaaaaagtctctggcggtgtttggctcccttctgcgtccttcatgaaacagttctccttgagtattacggttggcaagcatgtgggtgggggagatgtcacacgcacccgctccagctgtacaagcaagccactgcgaggattagacgcttgttagttatgaacttaggtgtctggtctgtttctttgcctttcaaaggcacttcctggcagagaggtacaatggtgctttgcaggaaaccctgtgcccacagcatctgttctgcagcttggcagaccgcagctggccctgagcatggcctactaattctctgggtcaggtgtggctgtggtgagatggatctcagccaggtaagaccctctaatctctgttttctttctcctgccatagatacactgatgattggagggtatgacaggaattcttgcctgcctttgggtcgtgagggaaacagagacagcgtaatggctttttggagtgccaggagcagagtccccagagttcattcttagaaaactatgaagctgttctttgaactccaactttttctcctatattcattcagggctctttcctctacaaccccctcattcttgctgttgatagatgcctctttcctactctctaaatgtccaattttatcttcctttggaatgccatcaaattcttcctccctttttctgtaccccacctccaaaaataatcccaacacccacctcgtcagagtgtccatttatttcctcagggctaatcccagaaggagcatacaagttggtgaactcatactaatatgtgaatgattgttgcccttggatggttagaaaatcaaggtagttgtccactgtagaagattgtttaaagccaagtggttaagaatattctatatccttccttttgcatatattatctcgttcatccttgtgaagcagataatctcaccatctcaatgtacagaaaaggaaactgaggctcagaacattttgagtagcctacttaaatagtctaggcagagattgaacccccacgtctctggccccaagaggtcttgataattccctcacaactgctgcctaacagcagataaaatatatttggattcttctcacctttaagaaaacctagtaagttaatctctaaaaatcagcaatctgctcaggggatacagggagaactaggactattgtcccaaatgtgtagtcatatttatctgcttaccaaatgaccatgtgttgaatccctgaaaaccatgggagaaataccaattaaaaaaaaaatcagagttctgtgacttcttctttactaggtttccctaaaattatgttttactacaaaaccctgagtatagaccacatgctacgagatgatccgtgatatctcttagcccagttataacaacttacagttttccttttttttttctaattgaatacaatgttcccaattatattagttataaaagataattgcaaaaaccatgcctggtcatttaaagtcatcttcttcttgaaccagttggttccatctggtcttctggatgaaagaagtggaagacactgagctgagttctgccctccagtgagctttgttctccagaagttactttctatgatgccaaacccacacatctggtgagaagcagatgaggaagtttcccttgggataacccaactggaggtgattcacatcactcaagggtgatgccatagtcagaaaaggaaacttgacttaggcagaaaaggaattgttgtctctcataaccaaaccatgggagcatagggttgtggctggaccttaggaataatctggatgaggagtcaatgatcctaagcctttgtctccccatccctggcctctgcttttctgtacttgttgatttcattttgtctgacagacatcctcctgacagctgaaaacaagaccagcagaagcaaccaaccctcactgctcacagcttgggcccagtgctcagccccaggaccagctgacactgatagtagctgttttaaaccacaggaataaaatggaggaaaaatcatcttccaaagacgagaaatgctgctcacaaaagaaaggtgctgtgtagattcccagtaaacaatattatctataaatgactctgggaatcactaataagtgatgatgaagctgattatgcattatataaatgtttagatttgaaaaaaattgatttatagcatataaaatcccattattttatattactgaaataggaatatgaaggaatggaaacattttattttaaaaacataaagttacactaagacattagctcctttgactcacatatttcaaaaacaatgacggttttcagtggaaaataatgctaagaagttctgaaaataacagtaataaggaagaatttgagtaatgaaacatttattcactcattttccttcaagtatgtacaatatagctataaaataattagactaaaaaatggcaggcacagcagaaccttaaaccaacaaatttaaagtatagacattttgttggtataataagagcattaatatgtattgaatgtttaccaagtgcaggtaactattataaaacctttattggcatgatctgaattagttctcaaaacaaatagttggcaaactaaggcctgtgggccaaactcggcccaccttctatttttgtacagagttttattggaacacagcaacactcattcaattatgcattgtctatggctacttttatgctacagaattgagctgtagtggcagagactgtatggactacagagcctgaagaatttgccatctggccctttacagaagaagttagttgatccctgcaaaacaatccaatggagtaggtactgttatttctgctttaccccaaggtcacagaatggtagttgtcagggtagtgattcaaatcctgaactgtctgactataaagtctatcatctttttagatagatttatagcacagagcacaggccctagagtcagactgtttgggttcagatcagattctaccatctagtaactgcatattggacagtttgcttaactgccctgtacctcggattcctccataactcttcccattggtaatagatgtggctggtcatccttcgtgtcagtacaggccttggacccggggtgtctgtcctaggccctgcatctcagggcctcccatgctttggagtgcctccttcaacattctcaaagtttctctgggaacagctggagtagcagtgccatctgggcagggtaccctgagctgggaccagtaagtatcctagtccccatttctgccctttggattgctctttgatctctacttcccagccctcatgtggggctgatctgatgccccaaggagctccaggactcatatctgtgggtttattttgggatccttgacctggccctgattccgggtgggtgaccagatgagccactgctccccagaatagcccagtttttcttgttgagtcaccaggcaagtgcagacatgttgattttgatgactctcacttacgtaaaacccatacgttcagggctctgaggttctcatggcccactgctggcccttgactagagccatatgtggggtccatgtgtcaggtctcacctctccatgtctgaataaatagtggcttccattctacagcaccccaaggtagtaaaggtggtgtcacttaccctctcccctgtacccctcccatcactagcaccaggaaagtcaaaccccatcgctgagcattcctccagagcattgtctgtccccaaagaacatttgacacttgttctgcaatgttagcagaccctcctgcttgaggccctccaatcgatgtgttgcctgtgtcaatgtgttgacatgaaccctctgtgcttaagccatgttggggagacgtggacatttcttgtacaaataggaccactcttctttttctacccatgggtttcccccacctccccatggtgaaagtgtgtggaaggcaaaggtgctgtcaacattaaaagaaatcacattctaggaatgcaggaattaccgtagggagttcaagagaagatatggtcagaaaatatgctcttctatatttatgctataaaatttcaaacagtgaatttaacattctcagaaaatgaattaacattcacattttcctgcatattctgggcaagacttgactttgtggtcatcatctccaaaacacagtaaccgccctcccttgagagcatcagtggaagccaggattcatgggtggcagcagggatgacacaacatcatgattgatgatataaccagcattaaataaatgatattaaggaaatccagaggctagaaaagctgttatttcaatacaaacaaatgctgaagagccagtgttgtaataacagcattgcaacccttttctcccagtgagacatgtggaattagcacatctaacaataaaaaacacaaagaggattctggcatctgcacagaaagtgatggtgcctagacactatgaaaaaatcttcccttgcactgattgaacaataagcaaatacaaaaatacctgttctttacccattattctaaatcttcattgataaatcatgactcagataggcctacgaattttgtaaaacattaaatcaaattccttatacagacagggacttggcagaaaatattttccagggacacataccataaagatgccctgcttggtattacctcattttcttttctatgaagtcactcttgctttcacttgcagtttctcctgtctttcttcacgttggtgctttcccatgttttttttttttttctcgtttagggtgttctttccttcttttcaaaaatcactttatgctttgtaatatttgtagccctcaacttctttccaagcaggtaattttgcctttctctctgtctctttggtcatctgcctgtcttagcctttcagacattctcacactgtaatacacacatgcacgtgcacacacacactctatacatatacactatgcacatatcatatatacacacaactgataaacattttgttttaacgtacaagcagcatgtttacacagaatttgtccttggctttagtaactatactcaccaaatagagggctacatatgtgatacaggagagtcagtccaggattacttgctttcattctcaatcttgtctggataatcaggttacagtatgctaaggacatcaagatgcccagaatggcacaagtggaaattcttttagatgccttgttgtgcgctcttgagtgtctgtggttagaacttgattctttactggcctatggatcaagtgtcctgtggtttgtgacagctgcagcattggatgagataactgggggtgccaggcataattcatccccgtatgtccacattctgactatagaaagctattgacctaaaataacattttatatcatttaaaaatatttgggtagcctaagatccatttttttgttttggatcaggaggtactacatccaatttttacatgtcgtacctctttgttttcacagataatttatatttctttatctctgacactatttggctgtcctagaaatagctgatgacaccaattaggagatacgctcagtcactgatgacgtcctatcctattatgtgttcatgcacagcagggcagggtatctgaaatgcatttgctttagcacatttagataatgtgtgggaaaggtgacaggtttttattttcttttttgccaatttgtacattagtgtctcttaagtggcagattaaaaatttcttaaagcactaacactgattaaaaatgtttgtttaggcttgttcagaactcttaagtgcttgcaggagccaaatcacattctcgtcctttaagcaaacaacattttaaaagcctataatggctgtatcttattgaagcaaatgataataactttctatagggctattttcttttataaggtaaataactaaaacttgtaaatatggaaaaataatccagatccatagacatatttgtaagtatatatttcttaaaaatgtttcagtcctattagtctctatcattttaatacactggcaaaatatatagtactttgttcttttctcaaaactctttttcagaatttatggcatttcttgtacctggtaaagactactgataagccatttcttgtggactaataaaaaaaattagtttttggtaagcattaattttagtctctgctttttatctgtttattcattctttcatccttcattcagcaatagcttctgtgctgggctgggagtcaggttggaggaatgtgccctctcaccaggaggatggacttgattgtatcactgtgggggacccactgaatagtgggacctctgcaaagtgcagtgcagcccaagaggagagaacaactgattctaacacaggcttcacagagaaggtgacagaggttttaacgggttagtaaaaaaggagttcatgcaaagacagaaaggctgaaaagacgggtatttggggagttctgcaatggtaaatgagggggaagctaaatgtgtgtggctggtggcataagtaacgtgggatgtgtagattgaggccagaaggcgaagggacttgagtgccattttcaagactttgtttggactttgtctcctagctatggagacctcataaggacctttagtcagggtggtgacttaagagtgggcactattggaatcagaggctcttacaataactgtgagagggaataaggacttaaggcaaagaccttctttgtgattatagacaaatttattatgcaatacaatagataaaaaagattaatgcataagtcttcatagcccctcttcctcttcttccccataccccccaggaaaattctagcagagctatggattatgaattggattttctttggagttctttaagagaagaatataaatattctaaatgctttaattcttctttgttgctacatcttgatttgtttgttttttcactgtaactgcactgagatcagtccccatggagctctaggttattagggctacataacatgttttttttttaggagagccagtataatgttgggtgacccaaaggtttatgcctacttgggggcagtttgaagacctactagttagtcacatctacaaagataagataggcaaggttttaaaaacccaaatcctgtctggtttcctgctaccacagtaatttcctgaggaatactccaggataagaacatgctgtttattaccagctagggctttgtccttgacacctcacaaaagtgcctgttccaggtcatgaacttgggtcaatctgtgggcaagatgtaagaaccctttgcctcctctgaactcggaagcaattgagatgacatccatctttggatgttctctcctggactctacctggttcctgcttggttttctaacagagggaaaaaagaggatgccgctttccaaccataaggaggcctccatccaatcttatcctatcagctgccaggaaggaaaaagagagaagtgatctctgttctaagaaagttgcattttaaaggaagaagttctgaatgaagtgccccaatcaggagcaaggatgcttatcttctttcctcctctgatatggtttgaccgtgtccctacccaaatcttatcttgaattgtagttcccataatccccatgtgtcatgggagggacccagtgggaggtaatcgaatcatggtggtgtttacctgcatgctgttctcgtgatagtaagttctcatgagatctgatggttttataggggcttttcccctccttctctctgcacttcttcttgctgccaccatgtgaagaagggtgtgtttgcttccatttctgccgtgattctctttcctgaggcctccccagccctgcagaagtgtgagtcaattaaacctctttcctgtatatttaatcaactatctagtctctgttatgttgctccattagcagcatgagaacagactaatacagctaacccactttacccttagcagcatagattcaattccaccttctttgtggaattgaattcctaattcatattagggtgttgggcagagtgagtatttgactttcatttattcattggattttacatccaggttgtgccactagcacaaacagttcatggagggccttgtatacctgtttaggaatttgggctttgtatggtaaaggagagtttctgaaggttgttaattagggactttatgggtttagatgttcagttagagaagcttaaaatattttttaaaatatagtatctaaaaaatatttttagagcccatcactcaaaattaaaaaggaaaaacattggcaggggtcattctaaagacagtgaaatagttaggaagctgttgctatataatagaagcaaggtatgatgagggcctgaatggagtcagtggcagtgggattggagaaaagagattggacatgagaaatatttaggaggcaaaagaagagggttgtgtggaaaaaggagtcacttcccgggttttgtcctgagaagctggctggatggtattgtcactcacaagcacaggagaaggaggatggaagcatatttttgttggtggtgaacttgatttgaaatatggtaaatttggggttctggcaggccaaacaagcagagatgtccagggctcatctggatattcaggtctgaagcccaggagttgtatttgggcaggagatagagatgtgggagtcatcagaaaatagatggcagttgaagctctgaaacaagacatcaccaaacagaagaatgagaatgaccctagggtgcgtggtagcaatggggtcagtagtcgaagaagaaccgggaaggattcacagtggtgtagttggtgggagagaaggaaaaccagagagaagggagtgagaggagcagcagtgccctggagagtcaagtgctgcagagaagagaagaaagggaggtagggtggggaacatctgtgactttaggaaggtggttcattggtgactgctgagcgcagcttcagtgaacggtggcagtagatctggaggaaagtgactcagtgaatgtgaggtgagcaaatggagacattggtgtaaatgcccctttcgaggttgtggaagtggctcacgtttttgaggcagggctgtgtttgtttttcagaggtagggactcgagcatattctctgcagaagcccccagtcagtgagactggtaaagactgttgtcatgtagtcagaggcagagtctcagttctactccttctcttatctctgtcacactgaacacttctgctctttcttaaatcaccagttggctcctggggctcccaggcctttctgggtttgctctgggtttattcacctcttgtgtcagtctgttctcatactgctatgaagcaatacccgagactgggtaatttataaaggaaagaggttgaattgactcatagttctgcaggactggggttgcctcaggaaacttatggtcatggcagaagcggaagcaaacatgtccttcacgtggcagcaggagagagaagtgcaaagggggaaaaccccttatataaaaacatcagatcttgtgagaactcactatcatgagaacaacatgagggtaactgcccccatgattcaattatctcctgctgggtccctcccatgacacgtggggattacgggaactacaattcaagatgagatttggctggggatgtagccaaaccacatcacccctgttagaggtggaggatttgctgtgccccactcactgccacccccactgccaccagggcagtcatgtctcacatggtgcgacatttggtatccccactccttcacccacttgtgccttcagagaggactcggagccctcaggagagctacagggtagtcccgtaaatagccaggggccagtgagatgatgtactctgaggagaggcttcccacaatacaaaccttaggtgtcaaatgtgctatgaggacactgaggcattgtaccctcagcacctgtggcaggtaggtggggcccaggccagccacaacagccctttcatttccccatggtgctgtcccaatgtcataattttctttgtcatgatatgggaagcactgcctgatggggccccacctccagcacattggctgtctctctgtcacttggcttcctgaatggtatttaaacgccccccgcatcactgttgggtctcagcaaactctctggcctcttgttcaatttgccctctgcatactgggaaggcctatttaactttgcctggcatctgtgtggaagaaacacttcttaggcaaagagctcctggaagacaatctccctagcaacaatgaagcatcctctctacagtcttttctgcctctcttttgttgttatctggatgacagggattgaatctggcctctgcccatatcaaatgctgtctggggctggaaacaagcctcaaaacatgttttaaatattttatttccccccgtctcccctaagtctgcccaccatgcatacgcttgattaaagttatgccccagtgatcaactgtgagtgacagtgaccctcctaaaggtagtctacttagcctctgggctcaggcaacacacctgtgtctgattagacactgttaccctgcttgaacctgtgccacatgaaagcagctttctcttgtgctctggtagtgggagatgctttcttgtaatgttaatgcagggctagacttttctcctgctgatcctttgcctggaatgttctcctcttccttgtcaccagccagagcaccactaaatcagtgtaaactccttaagggaagactaaagtcctgggaagtggggtcatcctggccttatctccttaaagaacctaactcttcaagggggtcttccctgttaaccctctgtattagttggctagggctgcagttgccagtaccatgaactgcgtgacttaaacaacagaaactaattgtctcacagttttggagatcaagatcaaggtgccagcaggtttggtttctcctgagacctctttctttggcttgcagatggccaccttcttgttgtgtcctcccatggcctttcatctgtgtgtgtgcatccctaatgtctcttcccctttttataaggacgtgagtcctatccaattagggtcccacccttatgagctcattcagccttaattacttcttcaaaggctttagctccaaatatagtcacactgagggttagggcttcaacatatgaattttaagggaacacagttcagtccacctcattatccttaacgttttccatttttctgtattctctccagtgcttgggtattgcatcagtttcctataattgctttagcaaattactaaaaacttggtggctataaacaacagaaatttattgtctcacagttctagaggccagaagtctgaaatcggtgtcactgggccgaaatcaagctgtcagcaaggctgtactccctccagaggctctagggggaaatctgtcccttgcctttttcactttttggtggctggcagcattccttgatttctggatgcatcaatccatcctctgtggtcacattgtctactcctcttctggtcaaatttccctttgcctctctcttatagggacaatcgtgattgcatttagggtccacccagataatccagactaatgccccatctcaagatccttaacttaatcatatctgtaaggccccttttaccaaataaggtgacatttataagttccagacattagaatctcctatcttgggggccattattccaccagccacaggagtattgttcataatatatcatttgatgtttaaacaaatgatgtatcatttgatgtttaacagctgacctacaaaaagagcccttgttgcaagggcaggagacacaaagatgtttttgctgggtgtgttcagacaagatcacacccttcataccataatctagagccttggctctgtcctcccacatgaccttcgcctgaggggaggggctggggactagggagccaaggagtctccctggggaggtgaggtttcagatgatccaggggttggaagaagtttctcccatgcatttttatctcatggctggttaagaggggtgggcatcccactcccggaagccatttcactttgaatactttgtttacttctggttagaagagtcttcaggagtgtgggctctggtaagaaggtcccattttccctggacttatacaaccaggtctgcttcttgtgttttgctatcgtgacacttttacaatttttcctctcagttacctaaggtacctgatgaatagtcaacatgtttgtgaagtccagagtgccagatgtattgaaaatgagcaattttaatcaacggtgaacctacctctttatattttttttttaaaaagagggcgattactgaagcttcacaaatagtgctttatttagtcataggagccatgatctggtactaggatgggaggactttattggctgctaatctaagattgtgtttgtctgttcttccttcttgccatttatggtggaaaaatcttccagagcaccacaggtgttttgtttcttgcttctagtcccatcccaatttcattttcatgaaatgggagtcaggtttggaagataattaccaatttccttttcctacttttaacaatgcccctgcttacggtacaaagttgtgtctgaacattactgcttattctgaaaaactcaatatgtaatttttaatgtcgtttcaagccttttgaagtttcatctgtttctggggcattgctaatggtttaccttacaacgcagaaagaacttataaaggagatgtcaggagaaaataataatctcctcaatgcaatcatgtcattaagatgctactgttaagagtgggggatgaggcagaggaaagaccagacagtgacttagaaacatgagcatttggcatcgaaggcattactgtcttgaagccttctggcctgtagggtgtatggaaacatgtcagttatggagagttttatattaatctcctgtaccatctaatttggttgattcaaaattaggtttaattacaagtgatcttctggcactagggagaccggccaacaataaccttcattatctcttctggtgaaggccacatttgctctcaggtaaatctctcagaaaagctcatcactgcccatttttctttggtcccaggcaaaattatgcattacatgaactcactcttcatgtttttcctggtctctcttgctacctggtcccaggccagttgctagagacttgtgctcccacagtgggcatctgataagtgagttcacttttcactgttggtggcttgcagatgttgttactcctggaattattctaaggggactccatgcctaatagaaaaagcctcacctaaaaaggaacccatctccaagggtagatttttctagccctggggcagctgagtgtagaagaaattgttttgagcagtactgtttttctagggtcacacaagttctgcctatttcacttgtaacaatgctgcccatgggtataaggatgacatcctttggagttttaatgcacatttcctgggacttaaagatgggaattttctatggacacagtacctcaaagggtttctttgttgggattttcgagacccaaatgtaatgaaagaatcttttcactacagatgatccttgacttatgatgggggttacgtcctgataagcccattgtaagttaaaaaatgtaagtagaaaatgtgttttcaattaagaaccatcctaagtcgggaaccatctgtacttttgtgggtatttggggtgcaaacgttggggaccatgtgttatgctgataatgaccatcttgctgatgtgccttgtagggtaaggactcaccctgggagagactgtgagtttccctgaggggtggacagtccacacgtcacctctgggaagaggcaggtcctcggaagtctggggcttctgctcctctctgagcctcagttctatgagtctggacttcaaggagtttgagagaacttccagggctgtttgtttctactcaattgaattgtttttcctactttgtaagccataactcctggctctcttgggttctaatgacccaggagactcttcaatgacatttggattctgtttcctggggagctttcttccttaatcctggggatactcaaagtgtaagccagcctgggaaaagatggattgaaaggagttccgaggagggaggatcacgagttcaggagatcaagaccatcctggctaacaaggtgaaaccctgtctctactaaaaatacaaaaaaaattagctgggcgtggtggtgggcacctgtagtcccagttactagggaggctgaggcaggagaatggcgtgaacctgggaggcggagcttgcagtgaatcgagatggcgccactgcactccagcctgggtgacagagggagattccgtctcaaaaaaaaaaaaaaaaaaaaagttcctggggctgggcacagtggctcacgcctgtaatcccagcactttgggaggccaaggtgagtggatcatttgaggtcaggagtttgagaccagcctggccaacatggtgaaaccctacctctactaaatacaaaaattagccaggcatggtggtgagcacctgtagtcccagctacttgggaagctgaggtaggagaatcagttgaaaccaggaggtggaggttgcagtgagccgagattgcgctactgcactccagcttgggtgacagtgagactctgtctcaaagaaaaagttcccggggatatagctggtgggacaactgcccagtgtgttcagcccagggactgcaataccagcttgcttcatctggagttgtttcaggagacacttagcccctctcacttccttcaccttcgtaaatgactttccctgagcacctcacgtcaacctcactattgaggtgtccctactctggccttcaggtctctgaatgggcactatagactgggcatgagctttcacaaaatgctggctaattttatataaatatctatcctgggaaccacctgttcagcagtctgattctagaatcttcttctactggagtcttctcaggagtggatcccaatcttgcagacctagaagtgggcattttttactccaatccctgtttctggactgttttgaatagaagcactactaggatgtgagtgtatcctttggttagctcatcatattctttcccttccaagaatgccccctctccctaaaatgatctcagcagaccctcaaggtaccttttgggtccttctcttccacaaaactgccccaggtctctccctccccagaactcaaagctcttttttcccccagtgacccttttggcaatgaatcacgtgcatattttgtgacacactccaataatcacttcatggtgagcataatacccacttcactgactcagctttgctcattttgatgtatggcagacatctctgtctgcgtgatgagtctctggaatattaactctattctgcacgatggctttgctttgggcagatgtttttatctatcacccgtgtcgatctgttttccatgagggaaatttggctgaccttcagaggatggattactgatctcccgggagccaatggaagtgacatcattaacggattttttttttttaacagcaaaaatggaagataattaaatgcagcacagtagttgtaaaacagatttcattgtgttatacatcacttcataaagtaagcatagttcccattcttccacatgatgctttttgcagcattgtaccacagaataatgactccctaataactcagctgaaaaatatttagatctacttgctctaagaataaggtcaacattaaacattctcagatgaaaagcttgctggatgaaatagtgcaccatcagaataaagcatgcaatatatttacagtcagatgaaacaagtgtgtccataaatcaaccaaaagaccatctcctcctttaggaaatacatgtattgcttagccagtaccaataagttaacgtcgtgtgaataattttgggtattctggccttcctgaatctcatacagccaaaccaaccagaaggcttccccgctgggttgatggtggcttatcatttggcatctggaaacttctcttattttgctggatatggctgtctagtgggtggcttactgacttgcctaagaaaaaataagtcaatcattcagattaatctgggaggctaattctaaaatcggattttatgagaattgctagatttggggctaggttaacctcatttccaaaagaaaaactcttactggagagaaaccatcatgttggctcattctattgtgtttatatatttcacagtaaaatgattcagtcttgccaggttccatattaggaggattagaactacatcactcaatattttcttttgtctgttctaaaatatttatcaagttaatttatggacttatggattttttccattccaggacttcatttgcggggagccttcagaaaaaacaggtcacttgcagtaatatagaaggactaaactgtgattctggagacccgggtttctctttgctgttcaaccagtgtagtcttttgtgtgtgctgttaacagtgatttctggctcagtgaaatgtgataatgacttcatatttgtgaagagctaagtatcctgatattttgatcttttcaagcagataatttcaggcagaaatgatatagcttgtcttttgttaggtctcactaggggaaaaaaatcgctcacaagagccttgcctacctcaacaagaagtgtctctacttatacaaatggcatggtttcttttctggttactgggtcacaggtggctcgccatttgctttgagtttgcaaataaagtacatcttgggtttccttatctttaaacaagtaaagataaattaggttaaagtgggagaaggttcacaggatgagaacatcaattcagctcacagcaggtatgggtctaaagtgcctctctgcaggaaagaaagccaccaccagcagtccacctgctctcaggggaagggaccaggcattggaaaggctgcctcgggagaagtgactcaacaaaatcataagccgcatgtagctttgtttcctctttctaatacgggcatatttattgccatctcaattatacctaattcaattaatggaagaaaatgtacatgaaagaactcccagaaactaaaatggctaactgtaggcaggatgtgtgattaatatttagaatctatcaaacccagtactggcagggctgttctctccccagtacttaccagagagggagtagagctaatgcacagccatactcctccccttttcatgaaatagtttcatctttaccttgaggtcacgctacagatgaagagtaaaatgaaagactgaatatgatcaatactaattaaaatgggggggaggtattgaaaagagtctaaaattggctacaaataatgagatacattggactcttcgtcattaacaagatttagaataggctgggaaatttctctttggaactgtgaactgtgacgggtgtggtccaacagaaaaaacactggagagtcatggataacgaaatacaactgagaagttacggaaagcacacaatgccctagggcaagcttgtccaacctgtggcccgcatgaagtccaacacaaatttttaaactttcttaaaacagtctgagatttttttttttttttttttttgcaattttctatttttatttttttaagctcatcaactatggttagtgttagtgtgttttacatgtggcccaagaaaattcttccaatgcggtccagggaagctaaaatattggacacccctgcctaggggaacttgtttcgtctacttggttagttgtcctaattgcattttacctgcagtccaaaggttattttagatgatagaactgcaagaaccccaaacccaaagaaagaatcgttgaagtggttgggagaggaggtcatttctgagatacatttccaggagaaatacaagtttgagagaaggagctggtagttactgtgtgcaagtgtttttctttgatggggaaggagtagttggcaaagggacaggaatctgtgtgtacatttcctgctcctgtttccttaaccaccatcctcagggcatctctggcaccttggggtcgggtaagtgctctctactgccctcgttttagctgcctttatctcgtctatatggcactttctgcgtgaaaagacatttgccttacagggatgaaactggacttgcaagagtttgctgtagaaggtgttcaagtcaggaagatgctcagaaatgaccactgagagggtggcatcagtgctgacttaaaaaaaaaaaaaaaaatctgacctcacatgttcatttttccaaaagtagagaggctcagtttctagcctctcaaaccataaggaagtaatcaaaatgagagtagatggaaatcatctcttaccttaagggctcatgtacatttcagagaagcaatttctctagctatacttattctcttatggtcttgtttattactataaacaagcaagttcactttatcatttactttttattgtgttgcttgaagtacctatgtaatgcaagtatgtactgtactaaaatacctatatttccaaataacatatgtggtgtagcccacagtctctgcagaagcatcatgagtaacctgtgcctttacactttacaatccgttattggttgctgttaaaagtatgataacagatgaagaaaaaaaaactaagtatgaatacacttttccaaacacgcacatacacagcttacaatggaatcccaatggaaataagtgacaacatctgatgtagaatctataaaatgtagactctgcaataaaaagccaaaggcacgtaaaaatatattttaactttaaaaataacttagttacagtaatactttgcctgtgtcttaccaacatgtagctgacagtcaaaattttgcaatatagatataatatatagggatatataagaactacaagaaaatccccaaaacccataaagttcaaatgtgaaaacagaaaagttttaacactggagaattcgctatggtgagcctaagcaatatatagaaaagagtctacaaaaaggcttaggtgttaaataaattttgacttcctcttgctcagaaaatgtcggagtgctataaagttccgtgaagttccttaatgtgactcgctcagcccttcatagctagtgccaatcctggccaagccagatttcttgtgtgtctgcaaacaatatgtgagccgaacatcaccaatgcctcctgaaaatgggctctgactcacttcctttttttgccaagataggttttgctttgttgtttttttctaaattgtttttgcaaacagggcataacaggtaaaaaaatactttgtaagaatattattttagaaaacccaacacaaaactgcaaatacagctccggaagcccttctcttcaactgtggttagtttgtttttgtaccttttaccccaaaggaaaaaagttggcatcttgttacttatttttatccattacattcagcacctcatccaaaagtgagggcccaagatcaagctgcagggagaggagggaacctgtaaggtcagagagggactcctctgacttagtctttcccttgatgagctcgcatggggtgggatggtcaaacatgtcctcggctggccagtcggggtactgttcggacaggctggaggagtggctgtctctgccttggctggactgagatgcagaaccgctggagccccacgaggtgtctccctggtggactgtcccattctccaacagactgcttttctcctgagctttttcctccatgacgggctcgcagctaagcctgggcagctttgctggcccgaaggactcctgtttggaattaaatgtcactggtgacaataagggcaacatgagagcttgggatcctccaatggtcgggagggagatggcatttttgagcaccggggagggcgtttctgtgaacacagagtccgaggtgctgttggcccggaagaactcattatgcccagggaactggcccaggtgtgctttctcctggtttccaggtaaaagctcgtagttcccttgaagaaaggaaatatctccaaagacatcgtgctggccctctttgccaatgtggatggtgtggcgaaagtctccaagcgggggactgatcatatcaggagacagaatgtccctcagtttaaatttctttcctttcttgttattggctgctttcaggtaaattggggtcttggctggcattttggaatttgagaatgtctattttgcaagcgggagaaagggccactttcttcacagatggtatatgtttctgaatcctttttgataggaactgtcacatcatttttctcaagtggcttcagaagtggcttcgaaatgagatggggtcaaagagaaccttcctgaggttacggccaagtgaggcttcctagagagccagttacatcatccagtcttgaccacaaccaggacaaacctgcagaagaaaccaaagcaggttataagctaaagacccttttgggtgccctagggcctcccttttcacaagagcctgtaaataatggcagggccagtttcaactaatgctgaacttattgtttccctccagtaagtggataaaaattttcatcttagagaaaacaggaaagagaaagacctaaaaaccccatatctatgacaccagtactttttagacatagccatgggcacatcttctggacatgtctatggttttagtcattttcctctaagaattgctgtaagcataggatcagtgatttcagctccttaaatacaactggatttgttttaaaatacattttccttttgctttgatgtgcatactagcaacactaatatttcattgttgagttccatatgtacataagttaatgcaataaaatgaacagtcctaaaggaaaggtgctggaattatttaataagtgacaataactattatatgctactgtcctaaaaatgttagtggaatacattcttacagataagaaaacggagattcaggataagcccttcccctagaaagttaccttttctcaataacatatagccagtaaataagagagctagagttgtaatcaggttgtggcaaagtattgggctgtcgaggatgtcaggatttgaagtcattctgagatgggaggaaatgaacaaaactgcttcacttcaaagagaaaacattgtgaatctctattacaggctgggccttcacttgggaacacttctgaaacattactgataaggctatatcctccatgcagtaggcagaattcgaagggagcccccatgatctgcctcctggtgttaatgcctttgtgagtagaacctgtgactggcttctaaacaagggaatgtggcaaaggcaataggtccctgattaggttacattataggagatttcatctgagctgacaagggagaagactccctgactccctttgctggctgtggagaggtgagcagttacactgtgcaagggcctatggaaatgaaatctgccaacaatgttggggagcttggaagtagatcttttccccagttgagcctctgatgagaccaccaccctgacccacactgaatcataactcagggagatgctggaactcagccctgcccagattcctgacccacagaacctgtgaaatggtaaatgttgtaagccctcaagtttgtggtcgtttgttaccagtgtagaaagcaacacatcctccctgcacatactatatgataagattaggagggatgagctacaaggcattggggttgtaatgtgctcttttgccaatgagatgctcttatctcttgaaaataatcctccacctctgatgctgacacagagaagctaaaccctttcccactgcaggaacttcccaaatggctctgccatgacctcttccctcaggcgctcctcccactggctgcagagcctgcaaataaatactccaagggctgggtgggttagttggtgttttgaagggagccacatttgcttgtagcagctggaggctgtctgcatctgccccatatttctttcctttcagcaagagttttaaattcatttaccagtggcaggtgacaagaactgtgctccaccacccactggctcagtaacagctaactcaatttgggaagcagctagctcagcgtgtcagcatgctggccagcaacccaggccggagaaggctgagaacaatgcactagagagagccagccccactcgggctttgggtatggggaggaggcagagaaagtacgaggaggtttgcattcatgcagagtgggctgaccatggggctgccagcaatgacatgatcgtgggtcctgacactcgttctcatagttttagctctaatttgggtcttgttgtggtaacaaaagttgaagcccatgttcttcctgttaaaacatcagaacttccttcctgtatgagtgtacaatgcctagtcctggcctcgggccccctgctgttcagaggtggcctccctgccctttgggcacagtgtggctgactgcctgcaggagcagctgggtggcctgaggaacagctgcccacaggagtggtgtcctcagcacacacggccaggaaggcagctgccatggaaagatacagcgtgtccaccacaactcaagggcatgccagggctgcctggggtcagctgatggaggcagggttatgcaaggccaggtcccagggcagggggttccaattatttaaaaaaaaaaaaaaaaatcgatcacttaaggcctggagtttgaggtcagcctgggcaacatagcaagaccctgtctctatgaaaaaaaaattagctgggcatgggggcacccgccggtagtcccagctactcaggaggctgaagcaggaggactgactgagtccaggagtttgaaaccagcctgggcaacataatgggacctcatctctacaaaaactttcttaaaaaattagctgagaatggtagcacacacctgcagtcttagctacttgggaggctgaggtgggaggactggttgagcccaggaattcaaggctgcggagagctatgattgtaccactgcactacagcctagcaaggccttgtctcaaaaaaaaaaaaaaaaaaaaaaaaaaaaaaaaaaaaatcccatgaaaatgtagccagagagcagttccctgccactctgactggatcattcacatacacccttgaattaaacaaggatttgggacagtgaggaggaagagcaaagggggagaaagtgtgtgctgctgagggtgcaggggagggagggcccagtcggtaggctggtgggggctgggcacccaccagggagcaagatgctcgtcaagccccagcctttggtcagtccttgcccagccacaggcaccagcaccaggggcctccaaccagaggctcactcatcctgcttgaagtggggcttcatgtcggtggcatggaggcaaaggttggagggaagcagcaaagaaaaaggcaagaaaagggttggtggggaggctacctaagctgtagtgagattctggtgagtaggagatactggagaagataccttcagaggcattttgctttctttctacaaatatttacatcatatttactgcatgatggggcataggcttctaggactatagaaaaaaataatttgaattgaatctgaattgccaatcctaacagctcccaaataccctgaaagttaagaattttgggcaaaatgtcagttttacaactctaggtaagttgacgtttgtgctgctgggaaagtatctggcagctctgatctagtccttctattgcatctgttctcttcctccccagctcaggggcaaccatgattgatcccaggagagtcaatccaacgctgataatccaatgcccataatttctcgaactgaccacttccttctctctcctttctgaacattctgggctaagtccatgcagcttgatcagtttccccttctgcttcctgggctcactgctctttcaaaatctttgccaattacttacttaggcagaaacctaatgggatagtttcttccctagcaagaagtggctgctcctggagagggtatgagcatctcctgggtaccagcagcacttgatacaagtcggtatttgttgagggcttctctatgtaccgagcattgttccaacccttgacatggactagctgaggaagccatgaggctgttactgtgactatcctcattttacaaatggatcactactgacgaactgatatccagccactctgccaaggctgcatggctaccaagcacgaagccacatggctgggctctgagctttgaggtcttgacatgatatttaatgagcaccctccctgggaattctgtctgctccctaattatgaaaggggtgcattccaaagcctgtttaaaacacaaatgtgtggcaatgtgctgggctgatgaggatgggaaacaggccctgcatacactgacagttgaagtatgaacaggtccaaactcagtagaggcagtggggcaatatctatcaaaactgcaaatcatatgccctctgacctcagattgcacttatagggatttacccaactcacagagaaataacaaggctgttcaaaccagcacagtttataacagtcaagagttggaaacaacctaattgtccacctatggaggactggttcagttaagcgtatccttccaaataaatactactcagatctaacaaaggatgaagaagtgcttaatatgctcatccgagaagagcccaaagatgtacatcatcaaaggaaaaaaaaagaggtgcaaatgcgtgtatttatatttgtactggcttatctatagagtatttctggaaacacacaagtaataatagtgactgtccacagagaggggaagtagatggaaggggaacagggtggcaaagaaatttcactatccttttatgattttggattttcaaatcatgttaatgaactggctatttttttttaaatcacaaatatataaatgtgtatgcagggctcagattaggctttcctggagagccaattttatacatggctgttaggtcctgaaaagcctactatgagttactgatcataacacaaacatcaggaaaatgtgtctaaaagcagcatctgcaatggcagtgtgtgggtatatgaagacttcacaaaaggcctgagccacgtctcccctgaccctggctatgggacagatcactttttgcttctgtgatcaggccttcaccaaagaggcagcatggatctgtactttgtaaaagggaagagatctcagaagagaaacatttgtagtcggaaaggaaagtgagaaaattcaacaggtgggagaggatgcaggaggagctgctggccagggcatgagcgaggagggaagtgcaggcaggtggaatcgcctgggcccgtgaggacagcaacttgtgcaagggtgactagtgacacacacagataacctttgatgatggaatgggcctatatgccatgacttgaaatcccatccctcctcatcattttaagaagacacctggggccgggcatggtggctcaagcctgtaatcccagcactttgggaggccgaggcgggcagatcacaagatcaggagataaagaccatcctggctaacacggtgaaaccccgtctctactaaaaatacaaaaaattagccgggcctggtggcaggcgcctgtagtcccagctacttgggaggctgaggcaggagaatggcatgaacccgggaggcggagcttgcagtgagccaagatcgtgccactgcactccagcctgggtgacagagcaagactccctctcaaaaaaaaaaaaaaaaaaaaaaaaaaagaaaatagaagacacctgggttccaggagactgctggtgaatgaccaacacatcagaacagtcagcatgagtcaggggaaccccagggctttgcgttctgcccagaaggaagaaggatctgcttggaggaagggatgctgggaaaagagaaaaggaggagctaaacaggaaaggcttacaggccggaagcgaattaccagactacaactagggagcgggccctcctgggtgttccacaacccagatgagagaattttagctttctgtctcagtcaaaactctcaacaccagcattaacctgtgggcactgagccatctgagggtgctgagcacattcactcgtgtctgtcctttcctcatcttgaacccctttcctgcaaccaagggtcaagtcatgtggtcacccaggctggagtgcagtggcatgatcacagctcactgcagcatcgaaaccctgggctcaagccatcctcctgccccagcatcctgagtagctgagactacaggtgcacaacaccattcccagctaattaaaaacaattttttttttttttagaacaaggggtcttgccatgttgcccaggctggtcttgaactcctggcctcaagtgatcctcctgcctcagcttcccgagcagctaggcttacagatgagcctcaccatgcctggctctctagttttcttgcatttctctactcccactatcttacctaaatcttaaaagacagacaaaggttcttatagttagccctttctcaaaaaccttgaccctgaaatttgaacttcccacaattattcctggtttctttctagttccacaaactttctcctagttcttggatcatggtttgttcctctttcccttcatagataacactggagataacattcatctcagaagttagattcctttaaaaacaaatgctctagttcctggggcactagagagaaaagatttgccaacaaaagggtccagcttgccagtcagtcatgtggcaggtcagagagaacacatgtggcaggcagacaggtgggcacagtgctgctgagaacggacatgctcccttacaggttgtgtgagaaatccaagagtttcaatacacaaaaggaccggagaggaagctacggccctggtttttataaggaaggaagagagccgggttgcactaggctagacaattctagtttcttgtgactgactgaagcgtaaatgacagtgataatgatagaaataatcacagcagtaataaataatttggttaagaaaaaaactgaagcggtgctttgcttcatttcttaccatctttttggcaaacagaatgatgctgaaaatatcaaaacagggcagcagccaggaggaagggaaaatcaagcggttttaaaaaatgacagacagaaaaatcagctcctaagttacttagagttgatgcactggcaacttacaggactctgaaaagaaccaaggagttgggatatttttaaaattccatttattttaaaggaatgtttggtttgcctactaattgtttttagattaattcttagtggagagaaaaagtaaaaaaaaaaaaaaattgcatcctgcaaaacaggttgcagtgttaatttaaaacacacatgtataaaaatgggcaggtgggttgaggggtgctactgcccccagggacctgcggctctgttcttttctcctccttgcaggaagtgagcctgcatccgacttcccctttctggctcggttgtcacatccttcagggacattccagcttctgatcacttttcgctttgcctcagcacagtcgcactatgcggccagtcacggcaccactgcactactgcaccatctgagccccatgccagagtatccagcgactcctcctgcatgttggaaccaacagtcctaggggaggatgatgactcggccaagtaccctccgccgcctccctacccccaaccatctgtgggctatgtctctctgctgccaaccagaagataataattccactgtgccaagcgcccagaacatgatcctaggctccacatttagaagggataaaggctacctggaacatgtccccgcatgttcagagggaggcaaatgggaggaagtgaaggagctcgattaggacatgtgagaagaggctgaaggaatagagcagcttaaagagaactcatagaaagagaaaactaatcttaagggatctgaaggattcatttaattgtaatgaaaaggaattaacttgttctgggaggccctagagctaccaagcagaaactacaaggaaagattttggctcctccaagtaacagctcaggtttctcaaaagatggaatgggctggggtggggaggggacagcaagtatggccatgggatgaagctctcacagaggggagggcggttaccctgcgcctccctgacagtgcgtgaagggaggtgttcacgttcccatttattctgagtttcctgtatgggaacacgatcactgccaatttccttgtagtcccatgtcacttttccatagaaaaacgcacacggactttcccttgaagaagctttctctttgaacacggcagtcttcttactaatatagaaatgaccagccaatctttgggatcagaaacactaaaatattactacaatgtggacgctcatgtcaatccttttacaaacctctgtaggagtgcttctctgaataattttaaaattgaaggggaaaaaaaccccatagtgttagattttcatttaagttcaatgctgaatttctaaggcggaaatcagtgtaaccagaagcacccagtaacccgaaggggatgcttttcatattttcagtctgtttaactccacccatttgagaagataagaagatgccttttctatttttagattcttaccctctccccatatcatctaaactgaggacatagctctaagcttcaagactatgaaactctattagctggctccccagctgctgagctctgttatgcaaatgaacttagccagaacgagcaggcggtattttaaagacccattcaaagtctgatacatctcaccttccattattttaaaggactttcatttgtgattcagctacagcttgaatttattgttcttttacaaccctgattatatacagacccacaaataccatatgtgagactcagtgctaatttgtgtacacgtctcatttttatgggatctaatttgaaagatctcttagaagcaaaattggaagacagaaggtccacctcacatagcaccaagtctgcacttttgaacagaggccattaggaccttttttcctataaaaatgagttactggggaagactcaatgtggacatagaactctggcagttacaacaaggcaggaggagggcaagtcctctcatgcctggttcatttatcaggacgtgttgtacatggcaccagggctggtcagaagcacccaggcaggcactctagtttcatggatgtgaatctctgataaggccattgctgtgaactgctcacgtgtttccataactaatggatctgacttggtctgtgatgctgcaaggacaatatcaatacaggaagagaacttgactctgaagttttcagcagtattcagccaggatattcattctaatctctgctcaaaagcaaggaacttgctctcagttgctcacaaaatattaatatttaagtcagcaattattctatgcagtactccagttctggtaatggtaatttcaaatgatcccaaataataagctgacactgtccagaaattcagattatggtcatttaacccatactaccttggagggcaaagttcctagccatttgcctttaggccacattctcaagttctctgatggggtaaagggacaaatacaggacttccatgctattctgccaccctgctagggctgtctacaataatccacgttccttggatgggctgaaacatggcttttctgtatgataccagcactggctatatgtggaatctggtagtcgtcattctactctcaatctacttccactaccaacatccttgcgttatttgtatatgtgttactacaaatatatttgttgaatgatttccctctaactaggctgaaagctcttctgtgggcatgagcttattcatcttttgcctcccacaacacatggcccacagtgaacttcaaattcacaagtgttaaatccataacccctgctagactttccatcatgagagccaggttgacttgctcccgggggccaaaccctagagcaagtctacagaggctctctggaaagtgacaaatctgaaatgctttgttctctaaataatttacacctgtgaagagtactagctagcatgagtgctttctgtgggccaggcaggcatgtaatgctcagagcatacctcttaggaagcagtcttagatgaagcctgtgtctccagtcaatcacccaaaatgtggaggagctaggattccagccatagctgcattctgtagccactgccgatttgataactcaaggactgccaacctgaagactatgtatcttgaagtctgacagcaccaagaggaaatgacacaccaagagcgcaacacggatgagaggtggagatgctaacctgaccttgtcagaagccaaaaatgagaagaagggtcctagacactggtccctccatctctaactcactaggacttttcagtatttttgctattgtcaacaagaatctcaaaaggaatttgacttgtggtaaacgtcaaaagatttgaattgtaaagtaacaaagccccccccccaccccccgccccccgccatcctcgaggagaaaaacaaacatcctgttcttagaaaatcgtgttaagtgctgttcattcttttcccagaggaagcccattgcatgcgacagtgaacaatcacaggctttcactggggacaatagctccctagcttcctaactgacacttcatttccctcctaacctgaaactaagaaccttgtgttccctacatggaaagctctcccaccttcttaccatcagcctctattcacaacatcctctgagacctgctccagatgcacttccttcctggaggaagtctactcgaatgcacctcacgtaatccaaccttgctactgctttgcttaggggttttcttaggggttgtggagggcttgtattatgtgatttgttgttttcctgttttgtggttttaatgcctgatatttccaggtggctggtgagctcaaaaagaataaagtaagcaaaagggctatacatgagtgttcctgttgggaaaactctcctcctttttatgctgaatcacttacagagcctcctcttgagctggggacacagaaggccctcaaatcttactgaataagctcttctagttttctttctgaccatcccttaagtcaagggtctacaagctacaggccggccaaatccggccccctgcctgtttttatagataaagttttattagaacacacctatgcctattcatttatgtactgtctacagctcagtggggttctcaactgagggtgatatttgttccctatgcgatatttggcaatgtctgggaatattgtgggttttcgtgactgggggtggtgtgctcctggcatctagtgggtagaagccaggaatgctgctaaacatcctacagtgtacaggacaactccccaaagcaaagaattatctggcctcaaatctcagtagtgctgaagttgagaaatcccagtaaaggtgcttttgctctatcaggtcagagttgagtagcctgtgacagagactgtatgttgctctcaaagcccaaagtattaactgagcccttacagaagaagtctgaacccctgtcttaaatgttggcattttcatagggttggatggctgctgcccatcccccactcctcaacaattcccccggcaatcacataccacctctagggataacttccaagtcagtaccttcaacccacatgcatctacttaagtccagaccagtgctactcaaagtgggttcatacagtccatgatgagataagaacagaagttggaagcaagatctttttgacattgccttaacatcaagcatgtgaccaacagatttttttcttactgaataggctattgacaagtttgggagctgtatgctgttgagcttgcatggcggttgtgtgtggcccaagctccatattccttgtgcacagtagtattgtacaatggattggaaatggaaacaaacaaaaagacagtggcccttcccagagagtttgaaaagcattgattggcctttcccttcccttatattccagacttctctactttgcttcccttgtcccatataatactcataaaccttgccccaaatgggatttgccatctttcttccccctgcctgccttaggcatctgccttccaaactatgctttcctggtaaatggcagaagtcactcaattccaaaacccagctatcatcccagcacttctccccgcctccatctctacatcaagtcctatagtcctatcagtctgtctggactgtctctcctcattcatccctgctccatcagccttactcctggcccccatgatctttctcctgcacaaggacatttgcctttcacctacctccctgcctccccggtccttccaccttatcttccaatctacaccagagtgaggtacctagaatcctcatgtaaccttatcactctctgctttaaaacctttcaagggttttaaggctacagcttggagataagataaaatagcttgtgaagcccacttcagcaatctggggggcctgccacacttgcaactgaatctcctgccagttccccatggcatcctaagctcccatagcgtcctgtgtacacctcaaacctagcaactatcacactggattattaccactacttatttaactcttccccaatcaggctataatctgggagagagaacggagatcttattcatagcaggtattgaaaaaaatgttgaatggataaacaaatgagaaagcttgaaagacattgctgtgcctcttcctctttaaccctgcctgctctattgaaaatgcaagatggaatctatgattcttacagaagaaaacaaacatgtaacaagaagctgtctcctcttttcttgtggcaaaggctttcatttttccatctgtaagccattttaaccttcccctatccatgcagggtaataatttaacagtgtatcaatgcaagccagagtaattctacaggaccatacagatctttggcaaatatacagataaaaaatatagatcttaaggcaaatatttgtggacatgctgtttgaaagagatatgactcctatccctgaatgcaatgtgcaaatagtgtcttaggtaagactcaaagaaaatttgacaatacagtcctctgaattcaaactcagtgactctacttaaatcaaacttaaagaatgaggccctggagaaacaatgaacttgctcttttctcttttcaaaaggagatgtgttaagggagaacttggctcatttggcctaaaatgtacaaggaaacctcaagaaactacaatggacagtctatagaaaagggttgtttggaagatcaatgtgtgactggcacagatcagatatgtggggaaaaataaacctatcaaaacatttgccaaaccaaaccaaatgaaacaccgactgtacgggccaacgaaactgctatctcactgctgttcctggcctgagcgggggaagagctggaccaaaactatgagccagccctgtaagacgcagaagccctgatacactgggtaccagttaccttcatgtaaaatggagataatcatcccaaactttataataaccacaggtgttagagctgagtgttaaaatctacagtgctatgtaaacacaaggcattatcttttccccaaatgagaccagactatctactgaaatacagagtggaggggaaactattctcattgccaaaataaacacttctattttctccttaaatttcgcctgtaccactcattaataaaattgttgcagatgaggctaaaatggttcctattgatcctgtggacagtctccacagttggaagggattcctaccaccagcttgattagaagttaattcccctgtcaatgggacatagggctggggctatcttctcattcacacctacatgcatcggttatcttcagttggggctcttccagccttaggaacaaatgaaacgtcccggagttgggaaaattacaacaactgctatataggtcagataaaagtggtgttttcataccaacttgggatctcttacagtagcccctgaccttaagacataaataaatacaaacaatctaacattttttttctcctaaattctctgttgac

SEQ ID NO: 3549 - DNA, 1286 bp, Homo sapiens
acagcagccttggccatgtgacctgggcagttgcggatacatctgagagcctgttttctcatctgcaagattaaactccttacagaagttaactctgcagactgagaagacgtgaacagagagagtcaaggggagtgatgactatttcagagacaggaaaggacagaagagatgaccaaaggcacccccaagggatcaaggcacagaggaagagggacttcatccacacaggagcctggctcctgcaggccatggcatggctctcggggctgccagcagggctccccatagcataggtgtgctctgcggtgggcccttgggcagggtcctgaggacagtgccagggccaggctccagtgcagcacaatgttgggcaaaggactcctaacacagccacgctggggctactcaacccgacagtggggagggaaggtgtgggtgctcacaaggcaggcatccatagaagacgctgcccaggtccaagtcaaagaactacacgttctcatccgagccctcggcactgaagacctccaccatgggctgacctctctcctgactgccagatacagcaaagcctggcttacccagaaaacagctggggtcttctgcttaactcagttccatcaaactacccaaggggtaacagattctggatgaattttttaaagggtctcaagttaaatgtttcattcatgattcacaaaaggcacttcaaaattccacagagccacagggtcactgttagtaggtcaccaatcctcctgtacaggaccgatggagaagctctaagacaatgggctatgtgtttcacctgatggggtccctggccatttgtaaataaatctcggatattagctagtttgtcatttatcttgcagtcaagcatacacaaaacagaaagacacacagtatgtttgcactttgaataaatgagattttgctgtatcatggcagtttataaagtattctcaagtctgttatttgacctaagatccaacattataatcgtacatttaagaggttacaatgtgagaggtactcattgagcagaattttctaataatctaatcaccttgccgatttgcacccagtgtccatttagaaacatgaaattaagctactggcactcaattgccacattgctagcatttaataaggactccactagatggaggaacaagggctctcaaaccaaataaccaacgaccacaagcatttcctgtcagacaagccaaggtcctgctggagctgcctctgaaggcagccggctgatggacaggcctggt

SEQ ID NO: 3550 - DNA, 5813 bp, Homo sapiens
atgggaagagaccttataaggtcgctgcggggatgggggccggaaatctcctccccaatatccttcgatgctcctggccctccttgatgacgtaatcatcgcgaggcgaaagatctcgttttccctgacagctgacttcctctggcgcaattcatccagaggcgctggagggttctcgggcccagagggcctgccaaaaaggcagtcagacagttggtttatgagtcattctgtctctgtctctcctctcttttttttttttgagacggagtttcgctcttgttgcccaggctggagtgcagtggcgcaatctcggctcaccgtaacctccgcctcccaggttcaagcgattctcctgcctcagcctccctagtagctgggattacaggcatgtgccaccacgtccggctaattttgtatttttcgtagagacggggtttctccatgttggtcaggctggtctcgaactcctgacctcaggtggtccgccctcctcggcctcccaaagtgttgggattataggcgggagccactgcgcccggcccattctgcctctcttactgccaagtatcctagagccatcttccggctgcagggaatgtgaactgaagagaaaggtgtcctctcttctcataaagagacccaaagacgaatgccccgcaggtaaaaccagtcacattttgccttccctgttggcccatttcctcaaccaaacaaattaatagtttcaccatttataagaaagtaatgacaaccgaaccgtttctcaggctgtgcgaatcgaacagtgcgcgttggcgctttgcattaattataattaacattctttgagcgctttctctgtgccgggaattatgccaaaggctttttaaacatgagctcattcagtttccaaaattcctattaagtacctgcctaagaactacaattcggagttgctgcctagtgaagttgagggggtcggtggagccccgctgggaggccaagggctcaatctgttgagcccttctatgatgctacatatttcatcgtatgacaaggagtggccagaggcaattcttgaattctgtgggaggttgcagtatatgactaggaaacaaatgtaatgactgagttctgctttctatgtatgcaactcaccctaaaaacgttttgtaaggtagctggttgaagatatttggaatgtctaacaagttggctgactaatgtcatgaaaactgtacaattgtgttggagccagtcttttttttttttttttttccttgagacggagtttcgctctttcattcaggctggagtgaagtggcgcggtctcggctcactgcaacctccgccctctgggttcaaacgattgattctcctgcctcagcctcccgagtagctgggattacaggcgcctgccaccacgctcggctaatttttgtatttttagtagagatggggtttcaccatgttgtccaggctggtcccaaactcttgacctcaggtgatccactcgttctcccaaagtgctaggattacaggcgtgagccaccgcgccgggcctggaaccagtcttaagaatgatgttaggtggccagtcatggcggctcatgcctgtaattacggcactttgggaggccgaggtgggcggatcacctgaggttaggagttccagcccagcctggtcaaaatggtgaaaccccttctctactaaaaatacaaaaattagctgggcgtggtggcgcacgcctgtaatcccagctcctcgggaggctgcgggaggagaatcgcttgaacccgggaggcagaggttgcatttagccaagatcgcgccactacactccagcctgggcaagaagagcaaaactccatatcaaaaaaaaaaaaaaaaaggaggccgggtgcagcggctcacgtctgtaatcccggcactgtggaatgccgaggcgggcggatcacgaggtcaggagtttgagaccagcctgggtaacacgatgaaaccccgcctctacaaaaaaaaaaaaaaattagcctggtgtggtggtgcgcgcctgtagtcccacctactcgggaggctgaggcaggaaaatcgcttgaacccgggaagcggaggttgcagagagccaagatcgcaccactgcactccagcctgggcgacagagcgagactccgtgtgaaaacaaacaaacaacaacaacaaaaaaccaaaacaaaacatctttcagaaatagtcctggcttctacaagatccaaggcacagctgagtttaggtagccggtggaaccaagatccacctgaaggaatgcagtccttttttgttccacagaacctcagaatttatagtcccttcccaatattttagaaagattttgttttattgttctttaaaattacgtttggcctgactggttctgtggaagaaatgcaggaaactggaccttagggattttggctgtatttcactctttactggagggccttcttgtcagggttccttgtaacacactcccataacaaacaaattgtgctcaaaatgctcttagaatagggagaaattttgcagagagagacctctaaatgaatttatattatacagtgtcataaagtagagcttctgacaccatccgtaaattattgctgactttatccatgcttttgcttttatcataggcaaaaggttcagctacactctattctctttttattcatttatggagcaatactgaaccaaacttggtgcccttttcagcctctgtccctgtgagaacagtgtgttgcttcccttcacagtttcgtcacccatttgtacatatttccctgctatattagtttcctgtagttgctgtaacaaattactatggacttggtaacaacacagatacatattttctcacagttctggaggcagtaagttcaaaatcagtatcactaggctgaaatcaaggtatctttgtgctctctggatcaaggatctaaggcagaacgtgttccttgctcttccaatttccactcatctaaaccactcttgaattcctaacccatagaaactgttagatcataaatgtgtgttgttttaaactgtttaggggagtaatttgttaatatagaaataggtaatataggaggtaaggaaaaattgacaatgaggacttggtgaatcgtggtatcatttgtcaagagttgacagataagaggaagggagtaggtttgtcagggaaagggttaattttttttttttggagacttgttgcccaggctggagtacaatggcatgatcttggctcaccacaacttccgcctcctgggttcaagtgattttgctgcctcagcctcccgagtagctgggattacaggcatgtgccaccacacccagctaattttgtatttttagtagagatgggatttctccatattggtcaggctggtctcgaactcctgacctcaggtgatccacccgcctcggcctcccaaagtgctgggattataggcatgaaccgctgcgctcagcccgaaagggttaattttgaaaaggctgggttcaagatgctgatagggatattaaggtacaactgtgtagtgggaagttaaacatgttcagaagagtgtttgtaatatgatttattttatgttttaatttttttttgagatagggcctcaccttgtctcccaggctgaagtgcagtggatgatcagggttcactgcagtccctacctcctgggctcaagtgatcatcccacctcagccccatgaatagctgggactataggtgtttgccaccatggccagctaattttttgtatttttggtggagatggggtttcaccatgttgccttggcaggtcttgaactggactcaagcgagcagcccacctcagccttccaaagtgctgggatcacaagcgtgagccaccatgtccagccaaggatatattttagtagtaatgaacttatggtgacagaatatgtgggataacgtcacctactgtcacaagctggcttctctggaaacagttactgagactgactttggggttcaagatatttgttacagatcaagtcttgtgaagggaagggggagaaaacagtgttaggcagaggaagaagttgcatatgttataggcccaactaaacctcagtcaggccgtgtgtggtggcttatgcctgtaatgccagcactttgggaggccaaggtgggaggattgcttgagcacaggagtttgaggctgaagtgagctatgatcgcaccactgcaatcaatcaatcaataaacttcagtcaaccctgccaggagctatggaacaattattgtttgttggagtgttctgtgttgggctaaatgtgaagcctctttatacttctaccttactcagtcaccatatgggggctgccccagagaggtcatgacctcaagtgaggaagtactcagcagctgagccaggccctactgatagctggaggatgctgctgcccatgctgcccactgtgaggcagcaagcccttgcttgaagggggatctggatagtatgtttctgtgtctaccacccctagaaatggtgcctagagtgagtcatcacaaaaagaatcaggatagcttggtgtagtggcaggtgcctataatcccagctactcaggagactgtggcaggagaatgacttaaaccagggagttggaggttgcagtgaggtgaggtcacacaactgcactccagactgggtgacagagtgagactccatctcaaaaaaaaaaaaaaaagaaaagaaaagaaaaaagaaaaagaatcaggaaatactaatatttaaaggataggtgaatggaggaaaataatcaattgaaggaggctgagcagatgaggtcaaagaagatagagatccataacagtaacctcatagaagcttatggaagcattttgacagtgctaaaagccacataaagttcaagtaagacagtttcagaaatgtataaacatgaatgcctttgcagtgacttaagtgtgattctgttgtttccttctaaaaatactgccttctcaggtgtgggaaggattctatctttttaggctttaccaccatagttctctgcaggcttgcaatcctgaatcaggcttgacttcagaaagtgctttaaaagggaggctgggcgcggtggctcatgcctgtaatcccagcactctgagaggctgaggttgtggggaaaagcaagagagatcagattgttactgtgtctgtgtagaaagaagtagacataggagactccattttgttctgtactaagaaaaattcttctgccttgagattctgttaatctatgaccttacccccaaccccgtgctctctgaaacaggtgctgtgtcaaactcagggttaaatggattaagggttgtgcaagatgtgctttgttaaacaaatgcttgaaggcagcatggtccttaagagtcatcaccactccctaatctcaagtacccagggacacaaacactgcggaaggccgcagagacctctgcctaggaaagcaaggtattgtccaaggtttctccccatgtgatagtctgaaatatggcctcgtgggaagggaaagacctgaccgtcccccagcctgacacccgtaaagggtctgtgctgaggaggattagtgtaagaggaaggcatgcctcttgcagttgagacaagaggaaggcatctgtctcctgcccgtccctgggcaatggaatgtctcggtataaaacccgattgattgtacgttccatctactgagataggaagaaaacgccttagggctggaggtgtgggacaagccggcagcaatactgctttgtaaagcattgagatgttta

SEQ ID NO: 3551 - DNA, 5667 bp, Homo sapiens
acgctgcagtctgcgccagagccgcagcggtacatggaagacctgggcgggcaggcgtccttactacgcggatcatgttgcggctgaagtcgcgaaccgagacgtagctgggtgtcccgaccctgcatacagcagtagaagacctgggtgaccgtcagtaccctgtgaattgaggcactcctgaagccatgcgctgagacctggctgggtgtcgctaccctgctgacggctgcggaggaccttggtgggcatcagtaccctgcggattgtagggatgctgaagctgcgcactgagacctagctgcgtatctcccctgcggaaggctgcggaggacttgggtgggcgtcaataccctgaggattgtggcactctttccgcagttccctgctctaggctgcggaggacccgggtgggcgtcaataccctgaagattgcggcactccttccgcagtcccttgctcttggctgcggaggacccgggtgggcgtcaataccctgaagattgcggcactcgttccgcagtcccttgctctaggctgcggaggacccgggtgggcgtcaatactctgcggatcgcggggatgctgaagctgcgcgctgagacctagctgggtatctcccctgcggaaggctgcggaggacctgggtgagcgtcagtaccctgaggattgtggcactcctgcagctgcgcagagacctagctgggtgtcctcccctggagaaggctgcggaggaccagcgtgggcatcagtaccctgcgcgtcacggggatgctgaagccgcgcactgagacctagctgggtgttcctaccctgtggaaggctgcagagacccgggcgggtgtcagtaccctgtggattgcggcactcctgcagctgtgcagagacctagctgggtgtctcccttgcagaaggctgtgggggacccgggcgggggtcagtaccctgtagactgcggcactcctgcagctgcgcactgagacctagctgagtgtcttccctgcggacggctgcggaggatctgggcgaacgtcattactttgtggatcccgggatactgaagcagctgagacctagctgtgcgtcgtcccctgtggaaggctgtggagaacccgggtgggcttcagtaccctgaggattgcggcactcctgcagctgctcgctgagacctgtctcccctgcggaaggctgcggagaactctggagggcgtcagtagcctgcggattgcggcactactgcagttgcgcagagacctcgctgggtgtctcccttgcagaacgctgcggaagattcaggagagcgtcagtaccctgcggactgcggcactcctgcagctgcgcagagacctagctgggtgtctcccctgcggaaggctgcgcaggatcacggagggcgtcagtaccctgcggactgcggcactcctgcagctgcgcactgagacctagctgagtgtcttaccctgcggtggcgacggagaaccccggtgggcgtgtttaccctgtgaatggcctagcgctgctaaagccccgcactgagacgtagctgggtgtcctcccctgtgcacggctgtggaggatctgggcggacgttgttactttgtggatcgcgggaatgctgtagctgcgcactgagacctacctgggtgtcctcccctgtgcacggctgcggaggatctgggcgggcgtcattactttgtggatcgcgggattgctgcagctgcgcacttacatctagctggtgtcttcccctgcggacagctgcggaggacctgggtgggcgtcattactttgtgcatagcaggaatgccgcagctgcgcactgagacctagctggtgtcgtcctctgcggacggctgcagaggatgagaggagggaggaggcgtcgttactttgtgcatcgcggggatgctgaagccatgcactgagacctaactgggtgtccccacccagtggacggctgcggagaacccgggcgggcgtcattatactgcgggggcgggcgtcattatactgtggaaggtggtgctgcgggaactgtacagagacctagccgggtgttcctgccctgcggatggcagcggagaaccctggggggcgtttttagcctgcggatcgcctggtgctgctgaagccgcgcttgaagacctagctgagtgtcctcccctgcggaagcctgcggaggacctgggcggactctttaccctgtggattgcgccgctgctgaagccgcgcacggagacctagctgggtgtcttcccctgtggtaggctgcggaggatctgggtggctctggagatcgcaggaatgctgaagcctcgcgctgagatctaggctgagtgttctccgctgtggatggctgcggatgacccgggcgagctctttaccccgctgatctcagcgctgctgaatcccctgcactgagacctagctgagcgttccctaccctgcagatagctgtggaggaccccggcaggcgtccttaccctgcggattgcctggtgctgctgaagccggcactgagagctacctgggtgacactaccctgcggttggctgcggaggacctggtgagcgtctttactgtgcggactgcggcaagggtgcgactgcgtatgttggtgggcatccttatccttcagacggcggcaattctgcagctgctcattgaggacatgagctggcatctttcccggtaggactgcggcacgtctgtagccacgcactaaggacctgggtaggcgtcatgaccctgggagcagcggcacagctgcgactgcgtatggaggacccaggcaggctcctcactctgccgactgcagcgcgcctgtggttgtgcaccaaggacccacccagacaggcgttcttaccctgtggacagcggcacagctggggctgtgcaccccaagatccagctgggcattcttatcctgccgactgtggcacgtctgtggccaggagtttttatggtgtggacagcagcacagctgcggctgcacactacggacccagacgggcgttcttgccttgtagactgtggcagggcggtggcggggcacccacgatgcaggcgagtgtattaccctgcgactggcaacacaggctgcgcagccaggactcaggcgggagtccttactctgggggagtccttaccctacggactgtggcacaactgtggctggcacaagaacccaggtgggcgtccttaccctgcagacagtggcagggctgcgcatggcggactcgggtgagccgtctcatcctgtggaccgtgttactgttgcggctgtgcactcaggacctggtggggatggggtgtgtgtgttcctcttctgctgactgtgactccgtgccagctgcacggaggaccagggcaggtgtctttgctttgtcaacgacagcactgctgcagcagtgcacgagaaccagacctggagccgggtagaggaggtccctccccttctgactgcaacacagctccacctgcaacctgagacctgggtgagcatctttgccctgccccgtgccattgttctggctatacaccagcgacctggacaggttttcacatctctatgctggatgggctggcccagccggttgtgcactgtgaggtgctgcaggaggagctgcgaggacacattcttcttgacttctcagcataggaatgtctcacgtccagtccacgtccctgtcctagtcctcctctctgctccttccacacttcctcacggtggtctcctgcacgctcgtggctgtcagtatcagacgagggcagcttctgcattttctcaattccaaccactcctctccacttacctacccagtatctctactgggtgtcttccagtcatcctgcactcaacgcgactgacaatttacttccaaccggctttacaatttccctgactttgttgatggcaactttttccttccagttgcttaagccagatacgttggagtcattctttaccattctgttcaacttcatacctattcctcaagaattctggtttctctatctctaaaatgtatttggaagcagctacttcttaccttcttttcacggattcaggtcaccattcacactcacttggattattgcaataatttcctaactgggttccatgtttccagcttttctgtctgcagtctgttttgttttcaacatgtggccagagggatcctgttaacatctaagtgaaatatatcatttctctgcagtggctccctagctgctcagagtaaaatctaatgtttttacaatggcctgaaaggctctccataaccttatcccctcccacttacctccctgtctcctctcctccctccgacactcagcccctgtgtattttagctattgaaagaatatgtgggcacactgctaatttattgtctttgtggaggcttggtttgtgcattccttatttcaaacacttatgggtggactctggtaatgagcagtcatatttatgagtccccctccaagtgaggagatgtactaggtggaatgtgcgccctccctcacgtggtatactcttgatacagagccaagcaggtagtaccgttggtcctgctttgtaggtgagggaaagcagacccaaaatgaaggaagttgtccagggttacatgctgggaagtggtggaggtagaattcaaacccggagcgcaggcgttgtctgcacctcggagaggcaccgctcttcctgaaatgctcctccctggttatctatgaggctgaagtcctcacctctttcaggtctttgctgaattagaaccttctccataaggcaaggctgatgctgagcaccccactgaaaattttcctctctcccaagaccctcttctcagtccctctacttggctcatttcaggtgtctagcacgtcacgccctttaatacattttgcaagtatttctccacgagtgtgagaaagtggttttctttggtgggggttgatttttcatggcacataaagggcagcagggtttctttgggtcctgtctggaggcctgaaggtcacgctgggcttctggggagcgggtccccttcctgcagcctccctctccacttgcgtgtttctcactcctctctctccctgggaagtgttgcttgataaagatgcagcttttaattaatgtaactgttcaagattacagccggtcatcagctttctaaccagtgcctcacagctctgctggaagagccttgctccggtgatggttgatttgccattctctgtcccagcccagagaagctcccctcactgtcaacgtgccatctgtcaggtgcatgttataaagctgtcatcatgatcagctcattcacgcaccagctttagctttgaggaactgccggccatggcgttgaagacctgctgaagcctccagccagacatctgatgttcaggtctcagggggtccttgctgcttgtgtagcctgacaggtgtggccacggcaggcacaccatggtttggagtttggaaagaagagaccctgtgttattgtagagtgaccactggattgggcttctggaaatccaattctaatcagacttgggttatgcatttactatttcaataaaacatttatggatggactctggtaatcaacagccatatttttgagtacccactgcaggtgaggaaataaatgtactaggtgcgatata

SEQ ID NO: 3552 - DNA, 1224 bp, Homo sapiens
cagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattctacatgtaccaaaggtgacagctgcccattccgtcactgtgaagctgcactaggcaatgaaactgtttgcacattatggcaagaagggcgctgttttcgacgggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaagtgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccaagcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgcattttggaataaaaactcttgaggaaattaagtcaaagaaaatgaaggaaaaatctgaggagcaaggtgagggttcttcaggagtttccagtcttttactccaccctgagcctgttccaggtcctgaaaaagaaaatgtcaggactgtggtgaggacagtaactctctccaccaaacaaggagaagaacccttggttagattgggccttactgagacactggggaaacgaaaattttcgacaggcggtgacagtgatcctccattaaagcgcagcctggcacagaggctagggaagaaagttgaagctccagaaactaacactgacgaaacaccaaagaaagctcaagtttccaagtctcttaaggagcgattaggcatgtcagctgatccaaataatgaggacgcaacagataaagttaataaagttggtgagatccat

SEQ ID NO: 3553 - DNA, 3553 bp, Homo sapiens
atataattgtctaaaatgacattttcttcaagagttatctacagtttaaagctcacttttatgaagtgtcacatccatcaccattttaagagacataaaatcatgaaaagatatcaccagaagctacgtaaacatttcagctaagggtaaagagaaagttaagagtgttttcacaaggaaattgaaagaaggcaatccgaatgaagtcaacttggtcacacaaaaatcttggtaaaagaactagaatggaagcccaaactgctgagcaagtgggagaagaaaagaaaacttggttcaaacagatcacacaagggaacccaggacaaatgctgactttggcattatctaggtaacccttttttttgtcataggtgactctaataatagacctgttgttgcaaaaccagtcaaaatcctaccaaattaaaaagaagtccctcattgacttgttgggtgtaggtggtaccccatgtcctcgcacaccaaaagagatcatttctggcaagaaagctcctacatgccttgatggtgctgctggtaggatgccttaggccaggcccatcccagcgatgttctgctggctgtggtaaaaggtgggaggagaatatgccttattcattactcaatcaacttcttagccttgaagaagcatcacaggtagaagacctgccaggtggctagtccagtgaggcagaacattgaaaagatgctgaagtgtaggacccaagtgtttgttgactcactggtatcaccatctcctcttctctcttcttcatgtaggcaaaatcattaacaatagattctgaaaggtcttctaggtgtcgcagcttcacctctaatggtttgagcttctcaacttttgcaatctctctgtaatttttcacctccactccatgcttcatgtctaggatcacaagttggtcaggtatctgccctgtttccttgctctcaaaacacacttcaaacatgtcataatcttcagtggtaaaggcaaatttccccttggttgtattctttttggagtagaaaatatggccagcagaatctgtgatcttgaggtggctgcacaggccaccagtgcccccagactggtcagagatctcgtatgtgccagtcactagtaggtccttgtggatctcctcatggaagcagttgtgagaattaatggacagatggaaggagatggcgaggaccaagctggggcccagcaggaacaaaagcagcaacgccgatggacaagggccatgccgggctggtgggccagacaaaccagacatggtgctggagactcattccccctttagcccttctgctggggatcaacacccactactatgagtcctctaccatgatgtgttcaggccccaacactgtcctatctatgctccccgtcctcctgaaaagctagttttgacctttcctcagcttaggcagaggcctgtgtctttctccacggttagagaccaggtggcagggaaggacacaaccagcacaaagactcagaccacaggtccatcctgccctctacctgggatgacttttcaggtcttgcttcctttctctggagcaggacttcaagcttccaaacctgatgtcatctccaggctggagcggggggacgaaccatagacccctcacatcctgagaactcaggggagctggagctggaggcacaagagagaaggctgtgattctaggattgaaaaagaggaaatgattccaaagcaggacatttctgaagaattggaatcccagagagcaaaatcagaagatcatgtaaggaatatttttaaggaaactgaagagatgagtaaaactgagggaaagttagagaattgctggagaaaatatgcagtagaaggagttaagaactcattctcccagaagagcaatttcagagaaattaccatgaggtatgtgaaaaccctctctagagagaatggccagaagttcaatgctgttggagaaaactgcattacagactcaaatcctgccaaacatcttagagggtctagagaggagagtctccatccaagtgtgtcaagtgtagaaaacttgcaacaacatgaggacctcattaacctccagagtttccaattaggagaaagagcctatcagacagatgtgttagtgaaagtgcccagacagagctcagttcttagtgagaatcagaggatgaataatccagagagatggtttgagagtactgggtgtggaaaaacttacaatcagaacagagcttttaaccagcaccagagatttcatagtggagagaagacctatgagcacaatgaatgtggaaaagctttcagttggccctctatcctcagtaaacatcagagaatccacactggtaagaaactctacacatgtgaggattgtggcaaatctttcagtgttcactcatactttattcagcattgtaaaattcacactagagaaaaaccctatgagtgtattaaatgtgggaaagcttttagtacacattcatcttatgttcaacatctaaaaattcatacaggagagaaacatcatgagtgtaatcagtgtgggaaagcctttagtcatagctctaatctaattcatcatcagagaattcatagtggagagaaaccttacaagtgcaaagaatgtgggaaagccttcaacagacaatcaaaccttattcagcatcagagaattcattctggagagaaaccttatgactgtaaggagtgtggcaaagccttcagtacacaattatttctcattcagcatcagagaattcatacaggagaaaagccctatgaatgtaatgaatgtgcaaaatcctttagcctgaaccgaactcttactgtccatcagagaattcacactggagagaaaccttataggtgtaatgaatgtgggaaatcctttagtcaatgctcacaagttattcaacataagagaattcacactggagagaaaccttatatctgcaatgagtgtggaaaatcatttggtgctcgtctatcccttatccagcatcagagaattcacactggagagaaaccttatggttgtagtgtgtgtgggaaaacctttagtcaaaagggacatcttattcagcatcagtgaattcacacaggagagaaaccctatgaatgtagtgagtgtggaaaagctttcagccagagttttaatcttattcaccatcaaagaacacacaatggtgagaagtcctatgaatgtaatgaatgtgataaagccttcagtttgctttcttcccttgttcaacatcagagaatacataatggagacaaaccctatgagtgtcacaaatgtgggaaggcctttagccaggggtcacaccttattcagcatcagaggagtcacattggtgagaaaccctatgagtgtaatgagtgtgggaaaacctttgggcagatatccaccctaattaagcatgagagaacacacaatggagagaagccctatgagtgcagtgactgtgggaaggccttcagccagagtgcacaccttatccaccatcaaagaattcacactggagagaatccctatgagtgcagtg

SEQ ID NO: 3554 - DNA, 7036 bp, Homo sapiens
tttggttagatctattttccctccacttaccaatttatttttatttttatttatttatttatttatttattttagatggagtcttgctctgttgcccaggctggagtgcagggacgtggtatcagctcactgcaaccccacctcccagattcaagcgagtcttcctgcctcagcctcccaagtaactgggattacaggcgcctgccaccacgcccagctaattttttgtatttttagtagagacagggtttcaccatgttggccaggctggtctcgaactcctgacctcaggtgatccacctaccgtggcctcccaaagtgctgggattacaggtgtgaaccaccgcacccggccttatttttttatttttgagacagcatctcgctctgttcaagttggccttgaactcctggcctcaagtgatcctcccaccttggcctcccaaagtgttggaattacaggtgtgaaccattgcaatggccttattactactttatatttgtggagtgctttaaagttgacaaagtttttagttaatcctcacactattaccttgtggcgttgaagaacagatttcaggagcgtgaaagtgaagacaccaaaaaggaagttcttgcaatatttcaacaaagagatgaagatttggattagattccagttctacctttttggcaccagggagctgttctgtgaaagacaattttccacagggctcggggggtgggcatgaggcagaggatggtttcggaatgaaactgttgcacctcaagatcatcaattagatttccataaggagtgtgcaatctagattcctcacaggtgcagttcaaaataggttttgagttcctgtgagaatctaatgctctccttgatctgacaggaggcagagctcaggcagtaatgcttgcttgctagctgctcacctgctgtgcagcccagttcctaataggcgacaggtctgtgttggggcgttggggtcctctgaattagaggaatgacagagagaacagactcaggcagctttctggatgtagaaacaacctaacttagtgattatagatactacctgtgataatagtgaactttcttccatatcaaagttacacacctttgcctccggttcttcccacacccttagagcatctgcaaacctacagccctcctcctagctgactgtagtcacatgacttttacctttctggccaccagttgtaccagcagtgttcatctggccccaaattggccaatcattttcctgctcctggaaaattagacttggctttatattcaagtctgacctcaggaatttatggggcaaagtacacagatagatgtgtgtgaatgtccaatcagagaaagcacatctgcagaaagattaagaaattgatgtcgggtgtggtggctcaagcctgtaatcccagcactttcggaggctgaggcaggcgcatcacctgaggtcaggagttcgagaccagcctgaccaacatggtgaaaccccatctctactaaaaatacaaacattagcctccagctacgcaggaggccaaggcaggagaatcgcatgaaactgggaggcagaggttgcagtgagctgagatcgtgccactgcactccagcctggatgacagagcaagactctgtctcaaaaaaaaaaaaaaaaagaaaaagaaaaagaaattgagatactaaggagagagtcaaagataaataaaccatttgaattctgactcctttccagatcgcctttccagtttctcagaagcctagcagtacttactcctcctgctcttgggttcttttttactttttttttttttttaaaaaaaaaaccttgaactcttaaggattaatgctcttgagttatgagatatccctacattccaataactctaccttctatttttattgattaaactagtttgagtagtttctgttcctttcttccaaaacaacccactgagaacttggaaataaggcaaactagatttccctctaatagttaaattggcattctctgagaatatttataaatgtgttaattgaaaaattttggagtgtggtggctcacacttgtaatcctagtgcattgagaggctgaggtgagaggaccatttgaggccaggagttagagactagtctgggcaatgtagtgagaccccccaactctacaaaaaaaaatgttgttttgttttttttgtgtttttgttttgagatagagtctcggtctgtcgccaggctggagtgcagtggtgagatctgggctcactgcaacctcggcctcccaggttcaagcgatactcctgcctcagcctcccgagtagctgggactacaggcacatgccaccacgcccggctcattttttgtatttttagtagagatggagtttcaccatgttggccaggatggtctcgaactccagacctcatgatccgcctcggcctcccaaagtgctgggattacagacgtgagccaccgcgcctggccaaaaaaaacctttttttaaaaattagccaggtgcggtgatgcacacttgtagtcctagctgtctgggaagctgaggaggggagattgcttgagcccaggagttcaaggttacagtgagctatgattgcaccttgcaccactgcactccagtctgggcgaaagagtgaaactttgtctcaaaaaaaaaaaaaaaaagtataaatacatatatataaatgtatatatatagagatacatacacacacacatacatatatatgtattctttatatataaggtaatgtgtatcaagtgatctaatctgctcctaattcacctcctctagtatgcttacaaaatgagagtcctggaatagcagacatgcattgtaaataaatgaacatctttctacaagtatatttccccaaggttcaactgaatatagtttgctataatttcttaaaattcaatcaatttcacatccattaaacttacaagtaccgtaatccagttttcctaggaaaactaagcccagccgaaccttgggaaaaatacctctgtgttaaacatatatacatgatcgattttaaatgttttcaccacaaaaaatggtaagtacgtgaggtgatggatttgttaactcagaagcaggcacaccaaatcacaatgggtctgattcgatcctccctgatggcaatggagacccatctaactaatcccacttctaattacctttctttttctccttacagacctaaaaaatctcaccatttctattagcctgaaaataacatccctctgttcttctcttcctccttcagcactgaatctcgcttacactaggttttacttaatgattctcctccttatactttctgtctcaccagtttcctctcacacttatttacctgctacacaaaattattcttattgggcttatgtgccctttcctccacttattcgacctctcacctggattgatgctcctgcggaaatctacattaacgatagtttgtggatgcctggagctacagatgaccgttgccctgctcaaccaggagaagaaggcactacatttaatgttatcatgggttataaataacaccctctgtgcctcagaaatgcacctggttatatccatctagaaactcaagtctgggctgcttatcttcccgagagatcagctacagaggaaccgggacatttggtctctggcctctccctttctcctttaaaacaaatgaaagggggagtaatgggacataccccatactttcaataagtagcctccaggcattcccttccaccagaggagcaattgttttttaaatagccctttggcgcccagtctattactaaaccatatgagtcattttttaatattactgcatgtgagttaacatagtcttcccaaattaaagttttagatgggccctcaaaatttttagggcatggttttcctgcaggtttatatggaaagtatggggtccctgacttctcgcaacagtggcctacactgcctttcagtttacctaggcctccaaagcactttagcctgtggggcttgccagaactcgggttccagctcctggaatggacagttcccctctggctagggttgatctaatgttccctctgggttactggctgagttctgccctgtgtggctttctgctgtgccagggctgcactgagttcaaatgcagagtctcacaatcattgtattcttcctcccccaggagcacccattctctctttacaccaattggccactgccaggggatgaagagggatgatgttgacaattcaagactatttcttaccctcttcagtgcctgtttccttaatatgataataaaccaggtactgcgatcactcacctgattattggttcttatgaaggtgcttttttaatgtagttgttcagtttgatatttctgtcggagggatgactgctggaggattctattaagccatcttgctctgccttcttgcaacacataaaattcaacagttttgtgcaactgtaagttcaagtgtttgtaattttatttatttcatttttttctttgagatgaagtctccctcttgttacccaggctggagtgcagtggcgcgatcttggctcactgcaacctctacctcctgggttcaagcaatcctcctgccttatcctcccaagtagctgggattacagatgcctgccaccatgtcttgctaacttttgtacatttagtagacatgaggttttgccatgttgtccgggctggtcttgaactcctgacttcaagtgatccacctgtcttagcctcccaaagtactgggattacaggtgagagtcactgctccctgctgcaaatttcttattaaatctgtttgacagattttagaatttctataagtaatgtttaaaattacaaccatttgggctgggtgtggtggctcatgcctgtaatcccagcacttattttatttcttatcaggagaacgagaatcatcatactactttgcatcggaggttaagctcattcttttccttaaaatgggaagataaaggcattaccccctctccgaggcctcatatgatactccccattctgacccagaacacccagaactttggaaattggctattgccatgtctggactgcaagtatgggaagcagaaactattctgtctgttgtccccactaccatctccctctctcagtatcaacgtagatccagacattctgctttacctacctccaacctgtttccatacagagttctgttaagcctccttgcatgctgttagtgagatatatcaaaatttggatgaacaatcaaactgtccaatgcattaattgtcatttatacacttgtattaactcccattttgattccaggaaaagtgtaatgttggttcgagctcaagaaggaatctggattccggtaactttgcccagaccttgggaatcctccccttcaatacatttaattaatgaagtgttacagtgaattctaaaaagatctaagagatttattttcactttaattgctgttatcatgggcctaattacagtcactgcagtggccaccactgccggaatggcattacaccagtccattcaagcggctcattttgttaatggttggcaagccaattccatccaaatgtggaattctcaacaaggcatcgatcgaaaattggcaaatcaaattagtgatttaagacagtctgttatttggcttggagatcaggtagtgagtctcgagcatcacatgcaaatgcagtacgattggaacacttgagatttctgcatcaccccgtattcctataacgagactgatcattcatgggaaatggtcaaaagacatcttctgggtagggaagataatttatcactggacataactaaattaaagagacaaatttttgaagcctctcaagctcacttatccattgtgcctggagctgaggcgttagatcaggtggcagaaaatctttctggattaaaccccaggacttggattaagtctattgggggctccactgtagtaaattttggaattatgtttctctgtttaatcggcttgtttttagtttgccagactagtcaaagaatcctgcgtcaaaatcaagagaacgaacaagccttcattgccatggcacatttattataaaaagaaagggagagatgttgcgggaagtcagggaccccggagggaccagctgaagccatggcagaagaacataaattgtgaagatttcatggacatttattagttccccaatcaatacccttgtgatttcctatgcctgtctttactttaatctcttaatcccgtcatcttcgtaaactgaggaggatgtatgtcgcctcaggaccctgtgatgattgtgttaactgcacaaattgtagagcatttgtgtttgaacaatatgaaatctgggcaccttgaaaaaagaacaggataacagtgatgttcacggaacaagagagataaccttaaactctgactgccggtgagctggacggaacagagccatatttctcttctttcaaaagcaaatgggagaaatatcactgaattctttttctcagcaaggaacatccctgagaaagagaatgcatccctgagggtaggcctctgaaatggctgcttcagggcagctgtcttttatggtcgcagctgtggggatgaaataagccccagtttctcagagtgctcccaggcttattaggacgaggaaattcctgcctaataaattttggtcagaccagttgtctgctctcaaaccctgtctcctgataagatgttatcaatgacaatgcatgcccgaaacttcattagcaattttaatttcaccccagtcctgtggtcctgtgatctcgccctgcctccatttaccttgtgatatcttattaccttgtgaagcatgggatctctgtgacccataccctatttgtacactccctccccttttgaaaatcactaataaaaaatttgctggttttatggctcagggggcatcacagaacctgccaacatgtgatgtctgccctggacacccagctttaaaattt

SEQ ID NO: 3555 - DNA, 1745 bp, Homo sapiens
attacaatggcgcttctcgctgctgtggcaaacatcgcaaatccagggggtgagaaagcagttgctaaacgcaggcggccccacctggcccggcgtcccagctggccgcggagaacagagcgcgcccacttccccggcccaccgggttcctcaggctgtttacactagcgctctaccaacgatgcccagggttcagaggcagaagggacttgcttcatctcatatgagacttgggactgcggacttttgagttaatgctgaattctggaggctggaagatcaaggagctggtgggttcagtgtctgacaccaggtctcactgtgttgcccagactggcaggctggcacgatcatggctcactgcgcactgacgtcctggcctcatggaatcctctcacctcagccttgtgctttcctttatatgtaaggatgacaccacacagcatgcttaattatctacttattgctgttggcttttatttggggtttagggagtagatcaatcaatcacattctgtagattaagttttggttttctgttgttgggtatttgttctttggggtctttgtgtttgtttatttccacaaagaggcctgtcagtagggattggagtcatttcaccaactgatataaccaattctgatggaatttttttaataggattgaacttaaatattctgattcattgcattataactactgacttacaaggttacaatttttattcatgaggaattgaatggataaactattgctctgctctagatacttgccagtgaagtattaaatcttttcattaaaaaaaaataaagataaacaaagcatgactacatttctcattttactgaaattactgaatggaaaaaccagtataaatgtgccctattaaaagaacacctaaaaaatgaaaatccagctatttcttttcaaaagaattaatcacagcttctctatacatcataaactctactgtgtcatcttaaatatgattgaatttatataaaactcgaagaatatatttatcagaaaaagagctataattgtattaattggcaggttgtgatgatgttttaacatgaaatatcaaaatccattgattcatggactggcttcagtggagaaagacctttaccaataggccaggctagagatcctaggagcctctcaaatgttttctatgtcctgaatgatactcagtgcttaaaggataaataaataaataagtaaataaatagtttcttatgatgtgcacattcattcctcccttttcctggaggagtaatttcagggttgtgtacattctcccaacctcgcagagtcatcagactgccatgaaccacccatcccatttccttagggcagtgcactaaaaaaaaaaaaaaaaacaggactgtaaaactcctagaaaaaaacatagaaatacagagtgttggcaattatttcttgaatatgacaccaaatgcacagacaaaaaagccaaaagcaaaactagacaagtaggactacatcaaactaaaaagattctacatagcaaaggaaacaatagagagaaaggacaacttactaaatgggaaaaaatatttgcaaactatacatttgataaaaggttaataccaaaaatatataagtagcaaaaaaaaactaaataatcatattaaaaaataggcaagggacttgaatagacatttctcaaaagaagacatataaatggccagcagatatttgaaaacatgctcaacatcac

SEQ ID NO: 3556 - DNA, 468 bp, Homo sapiens
tgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctga

SEQ ID NO: 3557 - DNA, 5575 bp, Homo sapiens
aggcatgagcccttgggcccagccggctgtttaatgttcttaaatagcacaagggacttctatgaactttcctagatgaaatatttattaactactaggtaaaacacttgtttgatactgcaaagggttatttctgaaacttaaacctcatgattggccaaccaagaactttttctccacagcatgctttaataatgaaatgcggattaagagtccaatattataaaacatttccacaaaagaaagaatccatctgattctcaactctgaatgcacatttgaattccctcggggagcttttaaaagtctaatgccccagtgtaccccccccagttaattaattaaataattctctggggatgagaactgactgacagcaacacttaagcttcgagactgcagtgtgcagccgaggcccactcctccagcgtcaccacctcgtctttatctgccactgtgtctcctcattgcccacagctttagcaacagcaaaagtagaattcaaaccttggtaaacaaggcttaaattattactgttcatgaccttaattaattgaaaatgattactggtgaccacagcactccatgctcttccttatggaaaaagggttgcctagaagatttaggcaatactgggagttcttatttgaagtcacagaaaggagaaacttttctcaagccgtttttattacacttagtgtattaagacaagtacaaaataaccttgtaattaagatactgtatcagtcaaaaaagaagtcactattgtatgaagagatttacaaatgactaaaatatacaggctgtgacagaattaacagtttgaaagagggttgcttttttcttttagaaatgctaaattttcttaacaagacaaaaatacagtgctctaaatatgcattaccatgaaaacgttaaagaaaagcagtcttaacacttaactactattaacagcctttgccaacacatgcctgcctactccctttcctaactttaaagaactgtttcctctaaggaatactagtgcagcataacccttaaataatttcatttatttttaaagttacaacctacagagaaattaacatcttgtcaatctaataacagtggcaaccattcttcacatgcacttctcttagaataaatccccttggctggcaggataaggcttatgctgtagaaccttctcccccacagccacaaatccccttctataagtccctcctaccctcatccccccgcatccccactggcattcacctttcccaccccaaaaagtgcagctcatggtagccttctagaaaatggttttaatgggtatcccagcatacacgcttttttaaaagccccctctgaacaccagaggtggtgaaaatgaattgtgttcttggatttttttttttttaagcctccactgggtcaaaaatatgtgctcttaatacttgagtttttgctttgtgtgtgggttttctttctttttcatttagatatcgtgggataaagtggagaggacatctccattttcccatacaaactgagggtgagaagagaaagagaagcaagctgttgcccccactttggcctggcttcccagccatcttcccagctctggttctttcataggaactagttattgcttccacaatgccgttatacggaatgttccacaaaggctgtgaacctagtcacagtctacccacaacaagaactctgctctgaaaaaccagcccaagagctcttacccagaagaacaatctttagccctcaaggtcactgaaacttcattagagcagtttagagtagacgtgtaagatttggcatatattaaatgattattggcacaatgttctccagttccatgtataaatgttgatatgcacatcggccagggcccaggatgaatcagccaatctgcaccatttttatgtcagcaataattccatctcttccctttgagcactgtagggagagctgcttcatccggttctccaaggcctggccctcaggggaggtgctgctttggctcttactgctgccaccactgccactgctactgctgaggccccggttgttgttggctttgtcacttgttttattctctgccccttctgccctgtctcctatagaaatacaaggattatcaaaagtgagtattgacaattctgccctgtctcctatagaaatacaaagattatcaaaagtgagtattgacaattctaagtcacttgagctcaaaccagtcagctaactcagccctgtagaagtcccactgttacctaccgtgcctatcagagaggttctcagtacataatcatttactgcttttattccttgtgatgttttatatattccttagctatagagatgaaatttgccatattcactttattgctgagaaacaaacctctctactatgtgcttgccaaggagactgttctgatgtgagacataggacctaagctctactttatagaagctgagtggagccaggagcccccccagaacagcacttggaaacaacctcagtgatcaatactgacagcacaaccacagagacctggtaatgcagcatgggggccctgagacctggcagaggtatggaatggcacaacagtcaggctacagaggcagtgtggcatctgggacggggtgagaaggctgctactcacctcgttctacttcacattcaggggaggaggccccgctgcattcacttcgagggcccaacactgggaacatcatcccaaactctgacagggacacagggctgggcagatccaggctgccaggcctcacaaccgcagggaactggtcaggcatctcagacgggcttgttggtcctgaactaaagctggacacggactgggtttccgagtcatcttcagacacaaagttgctacagctgtcatcttcaaaggcctccgaggccactaagttgagagagaacaccagtcacatgggttctgtcacctcctcaaacaccacaagtgcttgctgctggcaggcagctagacacagcatgggggactaaagagtctctacctctgtgagtgcctaatgaaggaatgtgacttcccaagcctgaatgaccagcctctaaagcagctggaagggaagcagctggcagcaggatcccatggatattaagcgcccttccaataaccttataaccctgccaagaaatcagtgtcaccagacaccacctaaaaatggaagattaattcagccacaaattaggacctttactccacctcagtcccccaaatacatcctcatgtgcacaggaagaggttctagtcctctgtaacatatcccaaacaaagccagctggactcaggcttctttcttagggcaatagaagcaagagctgctagaagaaacaggccagcatggaacatctgttgggacctttgttatctccagaatcctgactttgaggaacacttagtaccttcttaatgaacacagtgttccataaaacatgggaacccaccagaaatagccctcaggcctgcccaactctgagacctttcactgatggccagagaaagtgaggaccttgggaaacaaatcacacagtctgatatctccccacatacccagtggagcccctgacttaccagaaatggcatcaggctcaggtttgctccctggcagatcctccacagatgtgctgctgccctcagcaccaacaccgcatccccgaggccccatggcactggagcgccgccgctcgtggatctcatctgagatcatctccaggttcttcagggccatcttgtactcgccttttgccagggtcagtttggcctgcaggtcatccacagtctttttcagttgctgatcaagagaacaggagactaagtgaagactaccctgctagccttaagatgctttctgaatgacaggttcaagtacattttctgcccatcattctacttcaaggaattttccaagacatgactgaagacctaattaccattgtaactgctattcattcaccagacaaaatcagccaccaccatccccagatcccatccaggtgacaacctctaatatccaaaaactctcactggtggaacaaaccccatcagggaagcaaaaatgggcatcagacacaccaaagtcccacagtctagacatctggttcccagtacagtggttctcaaagttgagcttgcatcaaaatccccttgggtgttaagactcagctcactagactccaacctcagagtttctaattcagtcggtctagagtgggacctggtctatcaggtctccaggtgatgctgatgctgctggtcctaagagcatgctgtgagaaccactggcctagtacaacagagaaggtgactgaatggcagttacagaggttcagagaccactgaagacccaaccgagacaattttgaggtctgaaaactcagtaaagcctgtctctccactttccccttatagcaagtggcccatgtgatactctgctaccccagaaaagtgaagctttgagtgcagaaaaatctcatcagtgacgaagcccaaagctacacatacctcgagctgcacatagtactttgccttgagttcaaaataaggcctgcagaagacaggaaggaaagccatcagagtaatataatacagtgaccacagtcaactccacaagatgaacaagaggcatcagctaccactggccaggtcgtccttccaatatttagtaaactcttaacaaggccgtgacatgtcagtgatgctcctagctctggagactgacagacaccagatggaacgactgggctcacccagggctatattaacaggaggcccatctcaagacacggggaacccacacacacatatcttggggactctgcaacttagctcatgttcctcctctgtgggaaggctgttcagagcctcacaggttatacccagcagtaagggtggcctggatctgctctcctaatgaagttggctccccagggatgaagagcagctgaggctggagaaggggctgcttaaacctcctcctctactgaagtcaactggggaagagagagaagcaccactcctccctcacagcacagcaaggccaccactaggagggggtctcaggttggtcctcccaaaccttgtccaaagactggagttattagttggctgactcagccacataatgggcccaagaaatgccagcgtcctagcagttcccttggttctgggtcagctgaaagagcttggctcttttttaggaactttggtgcctgaacattaagagtagatcactgctttattcttgagctgttcaccctccatgaagctctcaagtcctgcatcctgaggatccagatggatgacaaggacacaggactgccattgagaaatgaagatgaactgtgtcacagatgcagtggattactgactgcccttgtaatagtccattttgcatctgttggtaattcattgaggcactcttggttttctatgagtttgtattttttgaattcaagaattgtaacatcactgttagatccctccttatttaatgagagaaataaaatatttgacacgagaaaatttta

SEQ ID NO: 3558 - DNA, 549 bp, Homo sapiens
cccatcgtctgggatgtgaggagcccctctgcctggctgcccagtctggaaagtgaggagcatctccgcccggccgccatcccatctaggaagtgaggagcgcctcttcccagccgccatcacatctaggaagtgaggagcgtctctgcccggccgcccatcgtctgagatgtggggagcgcctctgctccgccgccccatctgggatgtgaggagcgcctctgcccggccgagaccccgtctgggagtgtaaagaactggccaagtccaaggcagaagtggcctgcatcgcagtgtacgaaacagacgtgtttgtcgtcggaaccgagagaggatgcgcttttgttaatgccaggacggattttcagaaagattttgcaaaatactgtaggcgttttaattttatcctttgtattcccaatctcaaaaggatcgcaggcaagacttccacagtattttcttctaagctatcataagcattctcctagaaacgatcctaacacatcttcttggattcagcttaccaaataaacactgcttaacactgca

SEQ ID NO: 3559 - DNA, 1904 bp, Homo sapiens
agaacaggagagtgaatcttggggaccgaagggaaaaaggagccactcagcagcatgcagtggctttggggagacagaggaaaggagagattgcgagtggcagaattgtttggaaggtttttattttggaaaagctgtgcagaaaaaaattcaagaaaatgttgctgtgaaaagagaaaaacaaatcttaagcattaaaaaaaattcaaccaactagctcagaagaggggagaaggccaaggttgagagaagagtcacagcctgtcaggcagatagctggcctccggcgggaaggccatttccctgagcacttgcagaggaagacagggtggtggcaggactggagtggcagtggctcccaaggctctctcctccaacatgtgcatctgccatctgctctgcagtcctgccgcaggattccctagtgaagcagctcaggcctgggggagccgtgtgtatcccagctgtgccggcagcatcataccaatcgtgggggtggtgaaggagccaggggttcattcatggttggtttctgatcaggcatcttgggaatggataatggaggcagccgctttcaggacaggcatgtccaggggctcctcccagcctctaccccgaagtcctcttcccaagtgaccccagtgatgtttccattgagatgcgctcctggctatggcaggcaccttctcaacttatatgtgggaaggggtcccccatgcttgggggacctaggcagctggcttggcccaagagagatgaggatggaggccaaaccaaaggggggcgccaatcccctgtccaacaccttctcaccaaaagctcccgtttggctggaggcagaccctgtggctctgaccagacttctctggcagcaatcctccaccatttgtatcttaagaaggccctcaccctctttgagtggagtcagaggatgcctcagattccagatgtaagcatcagaactgctttctgtcaagagctccctaattttgggaaagaagagcctgtcccacactgtcaggccctgaggtcagcagatctgctcctccttcccgtgcggtacgtctaggtgctgatgagggcagtccagggcgctcttgttctgggacaggctccagtccccttgctccagcaggtctggggcaaggaggtcagaggtggtgggagggcccctgctctctgtttccacttcgtctggatccttgctgctgcaaagtggcactgattctagctctgtcccttcctccttggctttccggctccgatggggccagtggcagggtccactcctacaaacttgattggaagccacattcctctggctcaaatatacttccagcatgtagtaaacagtccagaagacggtgaaacagcctaccagcaccagggtcttgagggtgttgggggtgatggtgtaaccatcttcctcaggaattttcagccccggtgggcagggcagggcgaagtcatcgtgcaggtattttccactcatggcactctctaacagcctttgtctgtccctgatgtctactgcactccacacagagccatatagggtcagctgccattgccggaggatgccgacctggaatgactcatcccctagggcagcaaggggcagctcgtgagccacgcccctctgtcagccatgccagacagcagaggccctgcccgccctgccacccaaaggggctcaggccacatggtctgctccaggagctgcctcactgtgtcccactgaccccaggttctgcagaagggcctcactgggtgcccttagggatggaaagggttgaaaggctgtactccaaagcagagtcttgcttttctctcccgtattttgggggttcagctgggattagaaaaaaatgtctttccaccaaattaaagaaagctttgaaaac

SEQ ID NO: 3560 - DNA, 4658 bp, Homo sapiens
caaccgaacccactctgtgttcaacctgatttatgaaaaagcagaagacaaatgggcatatggaccttcacccccggctcccatcacgcactctggacgccactgcccaccaaagccgtggctatgcgcagcttctcgggccacgcaaggtggggcacccttacatcaggtgccctcctgctcctgagtgtatccagtgagctgtagccatgggcaggcgtgttccccaccccttgctcccgacgtccgcgtcgtcccctccttcctgtacggaatgttcgctcatcgccgcctcctccttgtctcctcagggaatcccctcttctgtcctggaaaaggctcctgtaccagcagtttgggagtgccgtccacgaccctgacagtcccagccctgctgccccatggccacgtgcccacagatgtgctgttggtccaggtgtcccagtctggccacagccctgcctccgccctcacctacatgccctcccagcccctcccatctctggacgaggcctccttcctcaggttcctcctgctcctgacctcccagtgtgatgtccgggtcctttatcatcctattcatcctggagaggaaaagtgtcgggcaaagggggatctggggggagctcagcagtgactggggagctggtctgcctcagagacagagtagggggtgggagcagagcctcggtgagggtcttggccacagggcagtgccttcctgaacgtggcaggctttactaccaggaacgcactcggtggtggaggccccatgttcccaggagccaagattcgtagcatccttgaggccatcctgataaaattcggcgctattgcccccgtagctctggagctctaaaccgtctatctgcttctgtgctgaacgcctttcccatctgctgacgtaggcccagggctgccctgcccctgctgccagtgtaccgtgagcggggctccagccagttcaagctcagagccagagctggacgggccagaactgcgctgcacacttcctggactgaggcggggactttgggtcccacccggtttctcctgattatggctgctgtggggtgaggggagggaggggcagccccgaggcagtctcttccctttgagaagatattttcccacaaaggggtgggaagccaggagtgagaaggaattcagggagagcaaaggagccagtgctgagatgctgctgtgttggttgaggaaaacctcgggcctgagggccaggccggagcccaggtctctgctgacaatgggggttcaaggaagacgtcgttatctcccctccccacttactcgaggagagaggtgagggggggatgacttgcgggttctgatcaggcccctgggtggggaaggggcacagtgtccctcagcagcttacgcccctggagtcttggggggcccagcctggccctggggccttttccagctactgtgcccttgggcagctgcgtctggggctcaaccccccaatcctgttcccctctccagctgcgggtctgtaggcagctgtcacatctgaagggtttctgcaacctggaccccatctgggtgtgggtcagaccctgtgacccacatgccacccccaccctccacagagcccccttgctgggacagccagctcacctccaaggacatcccctcctggcttctcccccttccgagtctgcagcgccgtgggcttctctgccgatgggcccgggttggggttaaggtgggcatcctccaggtacaacgagcctgaagagcccctttcagtgcagacggggctgcagagtgacactggctgggcacctgccccacgaccaatgacaaggatttccagctgaatgctttattcccatagggatctggacctgtgcccaagatataaatactacactttttttttttttttttaactgacattgtgaaattctccctatagcttttgccattcaagcaacattgtgatctttcttccccgccacgtgtgtgggaatgattgagtcctgtttgcaagctggagaggagctctccctttgctagtactttctctaaagtactagtctagtaaaatttattcttgttagaaggtcaacaaaatatctgtttagcttttatgaagagtcaccgtagcagcccccacggctggaaagaggcctgtacgttctggacgcgttttgttggctgggcttctggaggcactggcaaggtcaaactgcatttctttaagaacagttgcaggatctggctcgcctctgtgggaagccggcattacaggtgcttggtggatgggccgtgtcacattgccatctggggtcctttggggtttccaggttgtcaccatgctgtcccatttgggaatcccatacctgcctgtccccactgcgctggctgacccttgctgcctgctgcctcttgggagggctttgtccctgcctctgagctggtgggcaggatggctgggtggcccccagagaagcacagacctgagatggggtctccatgcccggtttgctgttggaatgatctgaacaggaccccaaatgcctcttccctctggtcatgcctcactatctctaggagctccatcctgtggcttccagagtgtgcacttccagcccacccgggcagtgctgagagggaggaggagaacaaggatggcccagcctcccctccctcccctagaccacggggcgggcagctcgggttcctggagggctgtttcccccacgctgtccctacatctgctctgatctaaaatgtctttccttttatgctgcgcccagtcttggggctcaaagatttgcccaaacctcattggccctcgtgactaggctcatctagatggtgctcacgctggtgtttgaggcatttccactgtgatctccacgaggggatgttttccgggacacatctctggctctgggaactgcctgactcactgaagaaactacttttcaggcactgtagggtcacccatatgcctccagctcagttgacgcttaaaaacaggtgcagaaaagctcgcgatggaaggtcttaatgagagtgtctgtctatgccaatcatgtaaaatgacgtttcttgaaaaagattcagtggttcagctttgtcagcatcatctcaacacaagcctgctggctctttttagcatctcatccaaccatgtcatcgtccagatgagaaatcttagcccaggtgaggggagtaacttgcttgaggtcacacagctggctgttggcaaagctgggattagaaccctcaacccagggtcccttcctctgcagcgcctacatggttggttgaataagtggctgcgtttcctggggccctgggttttggggaagccagttagctgctgctttggcactggcatggaggtgagcagtcaaggatgctggtgaggctgcagtttctgctctttttcatcaggggggatagtctctaggatttttcagtgaggacccttgggctttggatgcagcttgaaccaagaaaacgaggagggaaagggattcagtgaactattcctcagtgggatcggttcttcagctcctgatgggggctgtgtaatgggggcagaggccagggaaaaagatgctgttcacccaccctcagcttcccttttcctaaattaagaggaaaagtggtcaaagaaaaactcttcatttctccctgattcttaaacgaaggtggttaatagaaactcaggctcccgtgacaaggcaggacaagagcctgtttcgctttcctccctgaccctgccaggtgccaactcaaacactacctttctcattggtttctaagtcagtagagacagatctgttttaagcagttgggggttcgagtagatctcatgggtacaggaggccagcagggaccaggccagtcagccatgctcaggacccctcggctcctcccccagcctctagctaccctgtatcgaggcaaggggaggccagtaaagtttgccaagcctgatcctgcagcctggtggggctggctggggtattcttttaccaaactctgttttaccgccagccccttgtacaccccaatcccatgtctccctcccttcagctggaccgtgtgcccctttgggaggaagaagacaagccccactagggccaagggcagcagagccctgccgagtgagaggctgtggggcagcggctctgtcctgtgccttaccagccctggggaggggggcatttggctggaagactggaatttaattgccatcgtctttgattttgtgacatttctgcttggaagtgtgaactacccccccccccccgcttcctgctccttagcatgcgtgcagctctctcctgttttgggtgttccccttggacactccagctcggggactgctggcgtgtgaatgtgcagattcccctgtgtggtcgaacctaagaactgtggcttggaagtgatgctccatgtgacgacgactttgctttctttcctcttagtgaggaggtgattcgtagatcccaactgcctatgtaatgtaaataatgtacatttaatttattgctatggtagcacattgtatttgttaatgtacaaaacaaattctaaaaggttgacaaatgtatattttgttgcttaaatgtgtctttgcagaaattgacaataaataacatattttgtgt

SEQ ID NO: 3561 - DNA, 5762 bp, Homo sapiens
cgaggtgcggactcccggccgcagccgggcggaggtgggacggtacccagtcacgccgcgctcccggctgccctctcctcccctccaccgcgcgcgtcgtcctgccccgccccctttcccacctggattccgggtagacttgccaactcacggctacgtgaggctgggaggggtggggacggctccgaccccagcgctccctcagatgtttttataccccatctcccgtgcagctaggcttttgcaggcggcgcgctccgcaccctgcatgcgggggagagaggtgcttcctcctgcagggcgcgggcacaggtacggcaaggcctcaggcacacagcgccccgggggctggattccttcagagcccctagtcctccccctacccgagtgcccgaaacctacctgcgtctctatctttctctccctctctctctccgtctctctctccgtctctctctctctctctctctttctctctctctctctctctctccctgttactcccaccccaaaccccgcgcccgagacacaagctgcttccagaccgtgctctggggccgggcatgccctgcgcgtgccggagggcgtccacccggaccccgaccgggagccagggtgggacccgagccccgtcaaaggtcggcgtggatggcaccggtgcgcaagcttgcacctcctgggcaagccgatggcaggacagagcctaagccgaggctggcgccgaagtgggctcgggaggacgcgctgccttctgcaccctgggcaccaccccaccccctctcccccggccgggaaggggcttgttctcgggttcccaaagggtgggggacagggccacacacaccctcccccgacacggaacggcttagggagccagattcgcccgccggttggaaagaaagccaccgctgttgccttcccttagagcctgtcacccccggacctcgctcccagcccgaagaggtcacccagcgcccggcgtcaggctcgcgggctgcaagggtccaaagttcactgcagggagaggagggggcggtcagaaggggggggcgaaggtaatgaatgaagaaccagccccagccgccgtggcaactcacctcggcgctgaccagacgcaggtagcagcagagagacaggaagagcgcccagcagcgattcatgccgactccgggcccggccccgcggggccccggacgcgtagatcgagcgcgccgcccccgcggccagggtggggggctggggaggggggtgggctcggctcgggtccgcggcgatcaggcgctcaggcctctgcagccgcggctcacccgcatggcccccgggcgccgccgcccccggccccggctccgtcgctggggggcaggggaggacctgggcgcaggacctgggtccgaggccgctacctgggcggatcccgagcccgagtgagcatccacggccggggggctgcgtcgcgaaccagccgaggcgtctagccgtgtgggggcgcccaggggactccaacctccaagaggaaaaggaacacggcagtcgatggttcgtcttcactcgccggctacaggcgttttcctctgcccgccggcttagcttttttgcaacattttctggaaaggcccccaaaatcggaaagcgcggagctgggcacctcaaggcccaagtctcccccaaaaaactttttccaaagttggctttgcaacggcagctcgagcacccgggcagggagaggtgcaaactcccgcccgggccgggtaggggggcgggagcgtgtgcgccctggcgcggggcccgggcggcgggcacggctgctccgcgcgcgcggcgtgcccgctgcgcgctcggctgggcccggccgacaggtggacgcggcgcgagtccgtcggtccgtctgcccgcccgctcgccgctctgggcgtcctctgcgggctgcgggctgcgagctgcgagctgcgagctgcggctgctccggttttctctttgcagcgaggctggagggtgggcttttttttttttttttcctttttgcgcgcgtatgtatgtgtgtgcgcgcaaagtatctctatctagggaatgaaaaatgggcgctggcggccggaggggagccctagggaggcagcgggggaggctgcgggtgcgcagggaggcaggcaggccgctcccggctgcaggaggagaagttgccaccctttcagctgttccggcctttataaaggagaagggagagtgcgagaggtgggtggagacagcctttcctcttctggcccggagtcagcgccaggaggggggggacgcgggagctgggggagggcttggggccagggcggggcgcttagggggtctctgagagccgagcaacccttcagtccatgaatctggccctggggaaaaaagaactaggggtgacccaccgtcccgcccctcagcacagtgaccatggacaggttaggagcccacgtggtctagggggatgtctccagagccaaggccaggagtccacgctcccctccaggaccagacatttccaccctggcacaggcatggcagggagggactcaggctctgcagtctgagagcctgaattcagatcctgccctggcactcgggagcttgggtcaccttgggcaagtcacttccctctgtcccctccatctagcctcaacctggagatggggctattgtaaggactcagtgttagcaagggaagacaccgcaaggtgaacccacagaacccggcagccagcgcccttcagctgcaagctgggtccgagtctcctcctcctagctggttgcctggcacaacaggccctgccagcgttggctgaatttgaatttgttgaactgcaaagtcacacaaacccccacagccctgcagcatcttcgcagggctaccaacatgatcttcccgtcagtcaccctgctgtttactatctccctcagcccccgggttcgaggcccagagcccacccacccacaaccagccttcacacagttaacgccttctgcccccagtcagggagctgctgtgtccctgccttcagcagtcacactgtctcagtcacagtcacacgtactcacactgggcccagcacccccctcgggacacgcaggctcctgcatcacccagcctcccggctttgaggcaccctcatctcctccgcttgcactgtctctgttatccgcccttccctttgggatgtcagcctgcttctcacagaggagcacactgagagagtcacacctgctctctcttcatagactgtcttcttggacctggacagggtggaacagaggaggaaggacatctcaggtggtctttacagaccactgcaggcacccacccactgctgcctaccacccagcagcgtggcacagtggcagagacacagcctgaagacacatcaccttggtccaaatcctggagtggccacttgctggacaagtgtctgcaggaaggttttttaacctctcagtacctcggtttcctcctttataaactggagatgaatttataaactggagctgggtgtggtaacaagctcctgtagtcccagctactcaggagactgtggatcgttttgagcccaggagtttgaggctgcagtgagttgtgactgtgccactgcactccagcctgggcaacagagcaagaccctatctctaaagaaataaaaataaatctataatgggaaggagtgagagagaacagagaggcatggcaaaattttagtggtgatggaaatgtttgtcatttttgattgtggtgatgggcttatgggtgtatacgtacatcacaacaaaatgtgtgcagtttgttgtacctcagtgcagttgtagagaatttttaccctgctcctggagtggtctggaggctcccatgaggtcctccatgtggaggcgctcagcaaaacaccttagcaggaagcaagcgcctggaaccttccatgcagccttcaagttcactggtggccccgcactgctccaggcactggggagacaggtgtgaaccagcctaatgcaggcccctgcctttgaagagccccattgagaaggacaaccagatgtataaacagataaattaggagacagggtgacaagggagatggggcagcgggacgaggagataacccccaaacactagatttgaagtctaacgactcagagataaaaaccctcttccaccggacagctgggtcatttgaccttgaccttctgtgtcttctataaatagaatggtaacaactaccatgattagtgagctgactatgtggtagctagtgtttttcttactctacctgtagcctctccatgctcctgtgagatgtgttattcctatcttacagatggggaaatggaagcacagagaggccaatacacttgttcaaggtcacacagcccgtaagtggtaaggccaggacttgaatctgagcagtccagctacagagcccacatgctgagaccaccgtgctgtgcaattttctggcaggtgatgctgatgacaatgatgacacttttgacacagcgctttggtgagcgccacatgcattaatatgtgggaacctgctctgccagctaaaaagtgatggacccatatgaactctgacttaggtacaagttgagggagagggaaggctactcagagcagcatcgtagaacgcctactgtttgcagaccctgtgtgaagcgctgagaaatggaatgaggaaggagtcccagcctcggcactcagggacttcccatgctctcagtgagatagacccaaatcattgcagtgcaggtgccagtacatgggttagaagtggcagaagagggcccagcagacacctgggcctgaatgctacgtgacacctgcgtgacacctgggcctgaatgttgtgctaagggctcctttcttgtaccttctctgtgcagaggaacagtctgtaaagaacacctccccaggcacggtggctcacccctgtattcccagcaatttgggaggctgaggccagaggatcatgtgcagccaggagttcgagaccagcctcagcaacatagcgagatcccatctcttaaaaaaaattaccaaaaaaaaaaaaaaaaaaaaaaaaaaatatatatatatatatatatatatatatatatatatatatatatatatatctgagtgtggccccagctactcaggaggctgagtcaggagggagaatcccctgagcccaggagttcaagactgcagtgagccatctcagagacggggtctcggtctgtcgccgaggctggagtgccgtggtgcgatctcttctcactgcaacctctgcctcccaggttcaagcgattctcctgcctcagcctcccgagtagctgagaccacaggcgcctgccaccatgcccagctaatttttgtatttttagtagagacggtttcaccatgttgaccagggtgctctcgatctcctgacctcaagtgatctgccccactcagcctcccgaagtgctgggattacaggcatgaaccaccacacccagcctaaaaatttttttttaataacacctgatcgtctgcctcctgccaggctgggtgtagcaggcacctcctccagaaggcccaccaggcttggcacttgttccaggctccacagcatgcacacctggcatcgtcatggcctgatcatcaatctagcactagactgagtccagagtgttcaagggcctcctgccagctcctagcatacagtggctgctcaggaagtgccgctcgctgaaggaatgaataaatgattaaaatc

SEQ ID NO: 3562 - DNA, 569 bp, Homo sapiens
acgcatgcgtgcaggatccctgggcatagtcgcttgttctccgcccgcggtggaccagctgcgtaacggttcacacactgatggcgcctggaggtttggcgaaatactgacaggatgcgacgtcaacgggagcgcagggccaagataccctttatatcaaaccgtctatcctggagcagaaaaatcctgtcttcattgctatagctacagattcagaaatgagcatgtaacaaattcaggccaaagagaggcaatggaaatcagagaaacactgttcctgaaagcttctgtcactcaagaatccatgaaacattcatgaacttcacatcagagtcctcagaagggaagatagtgttaatgtagaattgataacacagaatgcaccactgctgtgatccttatatcttggctggccattacccctccacttggaaatgaaaaagataaactaattgaagcagtgagaagagaaaaagggagaggaaggtgctattgtggaggtgcatacccaacagtttgataatgtagaggaagtgatagctttgtctcgtggaatctgggtcgacctc

SEQ ID NO: 3563 - DNA, 4895 bp, Homo sapiens
ttcccaacagacctctcattctacttcccccaggtaactccttagccacacatttgttttttgagaccgtgtctcgctctgtagcccaggctggagtgcagtggcatcatcttggcctactgcaatctccatctcctgggttcaagcgattctcctgtctcagcctcccgagtaactgggactacaggcatgcaccaccacgcctggctaatttttatatttttagttgagatggggtttcatttcaccatgttggtcaggctggtctcaaacttctgacctcaggtgatccactcaccttggcctcccaaagtgctgggattacaggtgtgagccactgcacccggccccttatccacaaatttggattgagctacaggcagaggattgaaaatgtgtccttcctccttccctatactcatgccagctctctgctccagcttctcttggccccactagtcaccaatggccaggggcaggagcagaagccagagctggtcagggaggtaggatgaggtcttgtctcactgccctttcatagcattcccctttggaacctgatcctctcctggcttcctagggtctagccaggtggttctgttttccatggcctgcccctccactgttcctctcctgtacagcctgcctttgtagaagacagaatctcaggtgactttgatctccatggtatagtcctctgctttttctgtccttcatgactaggctcattggaggttccatctctggagcttctatcagtgggggcctggcctttgggtggtttagtcctccagagatcgaggacactatgctctggcccccccaaggtaccatcccagatgatgtggtcctctgagaggcccaactcttgtgtcctgactgttcggcagtcaggctctttgtggtctagttttctgggagacatctccttaatatttgagtcctcatagagtgcagacagctgtgtcctggacttcctgggacaatggttcctaggttttaaacctctgggggtctggtcctccaggattttcatctgcagcaggcaggtccctccaaaggtctgtcttccatcgtctggccctttggtgagcctgtcccccaaggcctggctgtttgatggtatagacgacggtggtccagacttgctgtagcatggttctctgcacttagccccagcaatgtttttttgtgtagtggccaaacttcctggggatctgtggggtgatttgaccctgtgacaggagtcatcctcctgttctagctctccagtggtcctgtctctgtaggactggtcctccagtggtgcgcttggttgtgactggtccctctcacaggcctgttccccatgttctaggaacacgcggggttcctctctgatcgggcccgcctctggggatctcagtgtttgtttaagaagtaggtactgttgggggagagaacatacattgtaccaagcaggcctgcttgggcatggcaggtcgtctctccctaacccccacccttgaccctaaatgttcagaaagagttccaggttagtgttacctccttacggctattgatggcctgttgcagccacagcaattccatggccaagtggctgcggtggtactgaagctcttgaagctgaggttggctgtggggcagtctttgatctgtggcttctgtgaaggagggaagaaaggaaggagaaaaccttgagggaccagaccctgggaaatggcctagccttagactttggaaactccctcccctgcactgcccaaccatgtggtggccctatcccggcagagggaagacgggaaagggatgcagcttatctagcgcaagcctttcactcttcagatgggaggctgaggcacagtgagggtcaggggcttgccctgatctttgcagagaggtacctggattctccatccttgtcgtgtctctggtcttctcttggctgggtttcctgttctgcttcatctgaagccaggagctgtgatctctgcagaggcttccttgatttgctgagctctctcctgacttcttcagcaccatctcctcccaggtggcctctccctcagactcttcacatgggaagtggttccacagcccctgctctggatttgctaccctgtctcctgctttccaggtctgatgggattttgccttctgagaaacaagagagatgtgagagccccagggctaaacccttccaagtatctgggcaccatgatctagcagacaagttggtgagggttaaggagtggggtgtgaggaggtgtgttctacctctgggaggaatcgcggcctgggaatgcggccctcggtccactgaagcgtgcccaggtcgccctcgacctctcgtacaatcgcctcatactcagctcgcaggctctggaactggcgtcggaccaagaagccccggacgcaggcctggtatggagaacgagaggaaagaagtcccttatcacggaaaaatcctgtgaaccccgcgcccgcccccgcacctgcaatgcagacaccttccgaaccagcagctctggctccatgggcgccaactgccaggcccgcccgcgcgcctgcgaagtacgtcattggtcggcgtcgctcctgagcatgcgcgggcgtgggctttgccccagccgttcccacggcaacctcctaccgtccagggtagaggcgtcctggcgacaggcgtacctgcgtccccccagcccccgactgcccctcccacagccgcaaggggcactccaatcccgcaggcggtacctccataaccgagggctgtctccgcggagaccgggaggaaaggcgcaaggaggggaagcaggacacggagccgcttgctttctttctggtttaattccattcaacgcccccctcccccatagcacctggggggccgcagaacacccgcccgagtctgtaaaaagtcacagtttgaagagaatgagaggggcagtgtgggcctgcgtgggacgcctacgcagcggactgctcctcaggctcggcgttctcggccaggtgcagcttctggctgtgcccgtcaaggatcgtggcgctttggaccagtccttcctcccaccccggtctcccatcttgcacaggtttagttccctcacctgtgcaaagggccggggacgagggtctcgggccgtctgtggactgaggttgcagtccccgcctgccctctctcaccccctctctcttcatccagatcgtgcaggtcagacacactggggtgtgtgcgcgcgcactcgcgctgtttctgactgaggaccaggtgaggtggtagtgtaaattagtaaaaataattgttcaatgctgaaaggataggaggacatcggacaagctttgctatgattgatgtcagctaaagtactcacaaagattttgatcagtagtaaaacatcccctacaaccacttttcttctaattttggggaaattctaaattcctgtacctgggtttgggcagtctgtggctaaatctgacaggactgcaagaggtggggaagttggttgtgtgtgaatactcctggagggctggagaggaggaaactgacctctcaggaacacacacacatagacgggttccttggaaaggatacatagaattactgaggtcttccagctgccaacaaagagaaaaagggaggcttctgttaggaggggaaccaggccaaatccccaatgctctgggggctatcttctggggaggttgaggggcccagagctcttggatccatgcactcccaccttttcacccagggcccaggaatggctttgggagtatgtaccttctccacccctcatgcccccaggaaccaaagcacccagacatgaacccacattgctaagcagctggtccaggttacggtcagccattgtcttcttctgctcctctggcagcccctcagtgaccccatcctcttcctcttcatcgtcctcctcctccccacacacatccaggctgaagtgcagccgggctagcttctcctgcatctcccgaacgtgctccagctgctcaaaggagcattccttccctggaacgaagcccctgtctgaaccctgggaaagagtcctggaaccctggaaccctggaaccatggtcccagccatgccccatggactgggccctacagccctatccacacacccgctgaaaccagcccccaggactcaccgaaggcctgcagccggccagagtggaaatcattgagcaggttcaggagtcccccctccatctcatagacatcagtcacctcggtcaggaaggagtgctgcaggggcgtgcctgcagagccgcttccacctccagccaggactgggcggcacttctctttgcctactctgggtggggtggacatgaccatgatcacagggtagggggcagtcaggcacctcccgatcttttgtgccatctgcctatgcaccagtttatctgtctatctgcactaactcatctgcccatctacttactagcataaatgggtaactttatggttccccttgggcactgggaaggggtgaggaggcgtgaagaggtcaaaaagaagtcttttctgctaataacacagccagagcagtgcctgaaagggggtccctgggttcctgtctgagtgcctcactcatttgttttatgaccctgaatgagtcacttatcctccctagtcttcagcgtatatagagacagctactcccttattgccaccagggctgtcttacctcctcccaaaatatctttctgcccctcttctttttttttgttttttgagacagagtctcgctctgttgcccaggctggagtgcagtggtgtgatctcggctcactgcaacctcgcctcctgggttcaagtgattctcttgcctcagcctcccaagttgctggcattatgggcgcctgcc

SEQ ID NO: 3564 - DNA, 2809 bp, Homo sapiens
attgtgacttgtattttgtgatgagtctctagaatgattaaatgactatttttttatgaaaaattttttgttaataaaatatctgagggtattttgagtatgtggaaggaatgcctgaatagaagctgatctatcttaacatacctcaagaactccagttttaatatggtgagtgaggagttgactgggaaaaggagagatccaattcttgttctagtccttggcacatacactctctgggttttgagaaaaggatggtcctacaacgattctaagttgttttctcattggtcctacaacaattctaagttgttttctcaaaggcaaaagcatgatttcaaaatgacatcacttgtcagattttctggtgtatggaaagatttaataatcctgcctcttttgaagcctgaaacttacaatttaaagcctgaaatctaccataaggaacttggtaaattgtgtcagataccatgaaaatgcatcttttcatagttaaccacagattgtttatgtaaaggcaaattggtggtcaggttcaaggtaaaatggattattgggttgattagtagccaaaaactaaatgcatgttcaggtcaaaatgaatttgtttgttttagttggtgccattttccttttattattcagaactacagagtgtgcattttattaataggaatgaaagctcatgcttgaggatttgaatagggtggatgtatatattttataaactcaagttgcaaaatatgtaaagtcactactttttaaatagaatataaatgttaaaacagacaaatctatgttatatattttttaatacatgtatcagacttgttagttgaatgcagattactttgctttatggaatttcataacttttaataataaagcagttgttattggattttttctgtagacttgaatactaaatgggatagataccagacctctttttggtttatgacgtaaaagtatttgtacagtagtttctcttcacaaaagactgaattttaaaggattatagaaacaggaacatgtccatttccaaaatgagtgcaacagaatgaagatagtcacttaaaccatctatttaacacatcacctttatgtaatatgtagctagttttagtgttttaataagtcccaactaaagactgagtgttttcagtgaagatggaaatggagacccaggcacttgcttagagttatcgtgagtccgatgttcctgaacttcaagttgtacaattaagggcatactctaagaacttctggatgctttctggagtatacaaacagatcaactaatgacttaaatgagtgactcttgaagctgcaagaagaggaaagaaataaccacaagaaggggctatctcagcatctgttattcctgacaggaggaattaaatatgctctgctggtaattctaagcttttctgcaggggatctgcttgccccaggagcaccttagtcctcattgaggcagccattctgccataaaaacgatcatgtctcaagctgttcctgccgtcctacacaactatgttagtagatggttagataaatatatgaaccatcttttgtactttgatgatgcccttttcctttattataatccttaatttctactttccatagtaggatttgacttttctccattagtttaagctaccctggataagtgactctgtttatgtcctccctatatttcttactcattttcacactaacataacacgtaacaaaattaaacataagctaaattgaagaagcaagtgagacagctaagagttttgtgtacttggacaacaaagctcaaagccactgtggttatctgtcctgttgggagcccctttcaaccatttttttagttgcctgtaagatttatttttaatgtttgcctgcataatgcaaaatacataagtgggaatccctacgccctttacagttaagtggattatggaaataataaggaaagtttatcaactaaggtaggaaatatcttctcatgtctgtatctggccttcagggacttaatgtgggtgaatatatgtcattagacaagatcctaatatagatggctgtatcctgcagatagccaattcaacattaaaattttatgtttccatacctcaatgaaaacatatttcttttatcctgttataatttaatgacattcccatccaacttaatcaagcaatgatactcagtagtcctctccttgcatttttcaagtcctgttgagtgtaactttaaaatgtctctgagatttctaccttctctccagtctccttaccattagggcctttcactacctggccttggtgtccctaggctgctcttcagctgtccacaaaccttgtttcataagcagtagcaatgcaagcttccactgccgtctgctaatgttcttccctcctagaatgttcatgatctgcgtttctacctgaaaggtctagttcaaaggtagctgaaaggttatcatccttgtcctttcttctctccctaccagtcatctatcctgaactttttaacagtagggacagtgttgcaattgtgtttgtgtccccagcacgtagcacacagtacctagtatacagtacctgtagcacataggcatttaataagtgtgtattgaattaacttggttatgcttgtatttttatcctagctttctcaaagaaacttaggtgctagctattttgaaacatatatccagaaccaccacctgagtaaaatgtataacaggaccctgctctttctatcccagagagtttgagaaaactacttttaaataaatcattaatcattcttc

SEQ ID NO: 3565 - DNA, 3515 bp, Homo sapiens
gctgccgcggcggcggcggcgcgaccgagcatcctggcggcgccgggccactgggagagtttatgtggccgaggcagacaagtggaattaggccttgctgcaggggacttcatttccttctcagtactggacccatttatgaggaggtggcttatgaaagtgtgatgttcgcgtatttcttgacaggctttgtttacacttggagccaccttggtgtgggtcaccgggacagtgtactcctctcctgccagcctccccttccccgaggtgtggtggctgcagtctcaggaagagcttggtacttgtggggacttctgttttctccctgtggagatcagtgaagactgggaggaaagctgcttcaacctgagtccggctcttcagcaggctgcacaagtggaagcaactaattctggtgctcaggctgggctctccacccaagttaggcctgctctggcctaatggatcttactgtatgagcaggacggctgcattggattgtacaactgttttgtgatgcccccagacactgtcatcctgggccgagaagaacctgctagcttgacataccccatgggcttatccttaggttttggaattggtcaacagtgaggcagtctcccttcctgaccattcttctccacccagtcacagataagggaataaccttggccatatatttgctcaataaagattgaaggaagcatggtcatagttgccctgggttcagagcataatgcatatgtgaagcatggggtgacattcctactgtcatgggtttgggatttgtaacggcaaattcctgcccgacgacagggtgtcttatgcaaaggctgacttgcctgaacgctaagaacatgacttctgtctgagctaagctggcacccatcccagggctcctctggagctaatcctttaagcaaaatgtgcttgccttttaaagatccctgaccccagctttagctttctccaccagataaccagctaatcccaggaatttgctgccccccaccagtggcttctagggaaagcaaggacctcacatgccaggtgccctagtacttgcttagtgagccatgtcatcctcctttcatttttggatggtgacagcatttttcccctctgtgctggatacagacttctcccaggatcctctctttgggagcgaagccagaggatccctacagcactcaagcttcatggtggaattaatttctgccagctctttgttgtctgtctccttaaatccttttcctggtgtgcttattatcccttttgcagtgagtacagtttattaagttgtcagccctttaatattggggaaacttaatgagtataaatagcagggagcacattgtaacagcacagtgttttgtttttttcacccggttgctgtatgagaatggctttcaatcctttgtttctatgcctacagacagaaagcaagatgtctaatattagacatacaagttgctgcctgttataacggtgaattatacctttgtgcatgcctaggatgtttgttgttttaattagctgcaatatatacggcctgtgtacacagaatttaatcacttcggcaggttgaacaactccatgtagataagagcaagtgtaggcaaaggtttagaaaatggacataaagtcaaagaatgatggcaggtaggatgaaggagagatacttaggaaatcctaaaagaggcggcaagaaggtacctccctgtgtaactcaccttcccccatgacagtgagtaagagacactcacaggctatgagggtacacccctagctgaatgttctgtgttgtttccttagacctgtggtgtccgctgcaacagctactagccacgtgtagctaattacattaaaatgaaataaaattaaaagctcagtttctcagttgcgctaatcacatttcaagtgctcagcagccacccgtgtctactactacacagtgcagacacagaacatatcatcactgcagatagttctactggacaatgttacgctagaataaacaccaaggcagtcagttaaggcagctatggtttggaaaggcatacggacagagtctgcttagaagagatacaagttgttaataaaattgatcctgttgatagtagtttgtttttgtggtgggtgctgtgaagagtaaacattactcagtggaaagctaagttcagaaggtactttgtttttcctcccttgccttaagtccttggtatttataatcaatgctgaaccttctatttcactaccgctccctgttttagatattcagatttaaaaggttttcaaagaattactttcttccatgttcaaagctagattttactaaacacatgtatcacattcatatatattgtttcttggccccactgccaaaggaagtcagtcagtaatttcacaaccgttatcagagtttggaagcagaaatagctgttaactaaaatctcccactgctcagactactttctgccctaatggccattactatccagtctgtattgctacaagggacccactggtaccccttttagattctatcaaaaggaacagggttttcctagaggcaggcagcctggtggtatggcacagcagaagcttactgctaatgaaatgggaacctccccctcccttgtggtttcagcacagaacctgaatgccaggaaaaattcctgggccaagaagctaaagctaaagaaaccttccttttttcaacgtttttttttctttcaaactgtagggtcacttttgattgaggcaaaggggtcctactgtaagtggaaaagactcactcccctaacataagttttcactgtggtgggatggtgccgcccgatatgcttgatatgcttttccttccacatgttaagctaggaaacctaacaggatgtcagcagggcagttaactctggactcagagccctcaagggcatgtggcagaacctcatggacatcacaagaccatcagtctgaatccaggtcgtgggggctgtcatagccgaactccttctgcacatccagagggtacttgctccacatccgctgtctgctgctgcctctttcctcctcactcaggctgttgtagtcagcagagcctagaatgacatcccgggagtggattctaaatgtgattttcctaggctactgcaggagccccttctcttctcagaaaggtctgtttttgttcccgattgtaatgcaaaatccttgctcaataaataaaaaagaatatagaattcttttttttttaaagaaggaatcactttcctatcatctaaaccaagttccttcacactggagtattttgtcacttctcccctccgtggagtattttgtcacttctcccctccgtataggattttttgttgttgtaagagttgtagtcatattgtaaatatttttgtacctttctccttttaacgtgttattgacaaacctccccaaaagaatatgcaattgtttgattcatttctctgttatcagacaccaataaattctttttgttgggc

SEQ ID NO: 3566 - DNA, 2572 bp, Homo sapiens
attactgttttttaagtggtagggctcacagactgtgtgaagtcctgtgtgaagtgctggtgtggccacctacccaggtgtccctcccttttgttttggaggcctgtgtccttgtccaggggcagccctccttcccaggtgtggccagaagaaccccccatcccaagacttgaaatgtctgttgctcacctctgtccctccagaactcggcttccccatcttcacttgcaaaacaagtgcagccctgcgcccatcagcaccccctccggtgtgcacacaggccagtgagcggtggccgaccagcgcaccccactcccccaacctccacaacccatcaagcggaggccgcctccgctaggggaggaccatgtgctgcaccctggcctggggacctacagggtgtgggttagacgcattcccactgggcggctcctttctgccccgaagcccacccctgtggcgaggccctaggagacctcccgtggggccgcctctacagacagcactcagcctcctgggctgcctccagccaggcccagcacatgcctgccctccagaaaaatacgttgctttccagaaggaggtgggggaccatgggcaggcactgtggacgctaacctcggcccctccacccattcctcagggcccacgtccagggggaccaagacctgcattcctagggctgcaggtggctcagtggtgcagaggcatccagaccttctgctgaactaagaaccacccagcctagagggagcctttctctgcctcttcctcccctgtcttgggcacaggtggggttggagcccccatggggcccgctgggaacctggaccaagccttcctcggagatgggaggaagccgcggggtggagcaggggcaggtaggtgaggttgagctgcacttgagttccctctggagtttccttcatctgccccacacccaaatttgcactttaatttgaccatccctgggggcctggctgctgacagaagggctctctctgccctccactccaaagtgggtgcccccccacccttggccaggacagggagggagccgctggctgctgccggaggtggtggctgcacagaggacgcctgactgctgttcaggcccgcacaatgtcccgtgccccttcctcactcgtttgtaatcgccgtctgttttgttctgggtaaggaaggcaagagctatagataaaacttaaataataataatttaatgtgaatgggttctgagctctccctgcgccccgggcgggccaggccgagcattttgcactaatgtgtcccacggtgggcgtgagtcgggagtgtctgtggacgtgcgtggctgctgagcggacctgctgtgtgctccctccacgtcctgaatgtaccgtggggcgggggcggcggcccgggctcagaggggccttccagagtgccttagcatcctttgatcatttttcccaaggaaaccaattaagaaagccggacccttccctcctttgtttacaagatgactaattctagaatccggggttgtcctgtcctgtgagtgtgaccctgactcatccagaccctgtagagagagacgagccactcagtatttatgagatgtctgcacctttatccctaagcctgactattagcaatacgcatatcctatatagaatctattacagagctacgttatctccacaccttttgaggaggacagaagggactggaccgtgttggagctgccgcctggcaggtggtgggcctgggatctagccgcctctcctgccctgccttcctcttccccaaggggatgggcccaggaggcagctgggttgcatggagaggtccaggagggaccggaggtgtgacagatactgtgagcccggcgggccgcgcctggctgggtgcctcggtacttgaattctgtcttgttttccgcattgtgtctgtccacccgagttctctgtcgtcacttaactttgcattggatttggttgttgtactttgcccctgaatgtggacaaagctgtgggcaagaggtcagcaggacccgcctgggggtgccggcgttggtgactgcgggtcggggctcctagaacataggagccggctgcctggcctcctttctcctccaggaagagtcattctttggcatttgtgtttagagccaggaggaaggcggaaggtagggagggagggctggtccccctctgagggggctctagtgcctgaccctgacctgtcctcattcgacagctgaaactgttaagcgctggcccagtccccccaccccacccagccgtgtactgcctgggctcccctcaaagggaaatttttatggaaacatcttggcagcaagtggaaaaagatctatggcccatgaaccaactgaaaactccaagaaccctctgtctgcctctgccagcagcgagtcctaagcgcagaatccagagctcgtagctgtcctcagctgtaactactgtttcagaatgttgctgctgcatacttttgtcatgtcagccagccagctccgtgggtgagagtgtgcgtgtgcgcgtgtctgtgtgtgtgtgcgtgtctgtgtgtg

SEQ ID NO: 3567 - DNA, 5123 bp, Homo sapiens
aaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatgtcctgtgcctcctgattgctgagtgttcacctggaccttctgactaccttccctgtgctattccatcagcctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccgtgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaa

SEQ ID NO: 3568 - DNA, 4051 bp, Homo sapiens
gggacagtcaggtttgggagactccggattttgtttttgtaaagtttcctctgggtggaggctgcggccggccccccgggtcccccccggccccgccgccctcgggactggggcgggggaggggggctctaggaactcctcccggagtccagccaaggagccggggggccggcgactggccaagggagaagacccccggagggggctgaggggagggggaaggtgaggaaaggacggcggcgtcggtcctgttctctccgccgccccagccgccgcttcacatcggggtccccgcccccccggccggggggtggttgccgagcttggttggggccccggttcatacactccggggcaagatgctacggccccgggcgggtggccgagtcggcggcaaggcgagggacccggccggctccgctcggcgccgcccccgctcccggctcccgcatgtgtcgctgcggctgggacccccctccctacaccttgggggtctcgccccacgccccacgggacgaggcagaagctctggcgcctcctcagcgttctctcaccgcggagcagctacccactcccggcccgtggtagccgcctccctgccccccaagccgccggctccggctcaggctcgggctccggctctggctccggctccggcgtgtgcagccgccgctgccggccgggaaggtgagggggggaaaggagtgcggccgcggctcccgctggcccaggtgagagcgaaggtctcggcggcggccagtgcagggggactggatctctcggatgctccttcgctctcagtctcagcggcggcggcggcggcagcggcagcggcagcgcccggagctcagctcgctgtctccctcgctctgtgcggggctctcgcctcactccagagagaggggcgggaggagagcggcgcctgccgatgacgcaagtcacctagcaaccgctctcttccccctccctcttctttccgctctgaggcttcctccgctggcctttttcccccttccagccaccccgccctgggcgcctctggcgcgctctgatgacgctccaagggaagaggaagtggggatcggcgagcgggtgggtgcgcctcgggccgcgggactcgcagccgccaccgccgctgccgcctctacggccgcgtcagaactgaagagaggaaggggaggagccgagtcgagcctaagctgccgcccgatcttacccctgacccgagggcggcctggagagcttggtctgtagcggtttccttcggggcaggtggggactgctcctttgggaggaaggaggaggcccaggccgcgtcttcaggcagctgcgcgcaccacccgaaggtgaggcatttggccccaaacagaccctcgaaaagccggactgatcgaggagttaccctacagcctgatctgcacctgctccagggagagagcgccccacccttcccgtggcgtggggtgagacccagcgttggataacgtgtggtcgggccgagcaaatgtttgatgaatgaatgaatgaatgaatgcctctctcacgtggcactcgtgaagctcagaggatatggtggaagtgcaagcgctttgtaaactgcagtgcattgtaaaaatgagttgtaatacattcctcccctccccctagccatgaaaggaaacaggggtgcggcttgagtacagagtcacaacctgagtctttagtggaaaaggagacgaaatgccgagcaagggaagggacccatcctcgcgcagattgttagggcggcgggaagggaggattggaagggagccatcctctgggagattgctgaaggatttttgactgtcaggggaagaatttaatagtccctcacttttacgaatggttctttcttacggtttggagctttcgagagcttctggtcttggttcatcagtgtacgttgtcatcaagaaatgttggcctgtttcaggtctgactcaaaggttattttctttctaaaataagtgttattactattatgcagcttttcctacagatgttatcctggaaaggaaagttaagtagaaactcatgaagtttaaagtgtagttctctaggaaaacaaatttaagataaaaggaccagaatcctcagaaatctgtcttcagtgaatagtatgagaaaaagattaaagcagcagcaatgatgaaagcagattccacaattctgtccctggaccctagtacactctacctccttgggaagcagtagtaatggattttacaagtctttccacctggaggagggggtaaggtaggagcaagtgtattatagacaaatgtgggaagctctgggtttctcccactactgccactaccatctgcaaacagtaaactaaggaaacttttaactgggtaaatccaagggctcgtgttcattaaaatgctgcgggaaaggtggtgagaggggcaaaggaggatgtggcaaaaccaaggagagactcacagactagcacctgaccctactgcccttgacctgaagttccaagagccaggttaaatatcctgcttaaattaccctggatttttctgtctttacgtgaccaatcccctgctacagccttccaaataagactcacaggtaatcagaccaacaagtgatggtctcacatggctacaaaataaatattttttgtttttccccctcttcctatcttacaacaggggaatggtggaaattaaaggagtaaaacacacagatttaggggattttgtgaagctaaacacctcagagagtttaacctttgtaggctttgaaggaaaagagtgcaaacatcagagttctgcagcccagcagagaacacctccagttaagtgtgtaccacatagggtttttcagcagcgtgatcttctgttttcattgtcagtggctccaccttacaacctcagtgctgaggaacagaagggcactcaggagagcctgagccacttacttagaaagtatttaataacagcacactaagcttactgggctagatacccacctcagcacccagcttgataacaggaggaaacagctggaactggagactggagagaaggaagttcatacatttccaacttggtctgcatctctttagttccttgtattgcttattaatccagaggagaaaacagctagttaattaaaaattccaaaaaatctgaagttttagctaatagttacttccctggttcatcaatttaagataaggatctaaatactgtgttaaaatatagaaaaacggagactcttataaggtttttgacctctacacttgaaagtgagctcttacaagaaactaatcagtgtttcgttattccatatcagtggcttttactgtcaaagattgtgtaagctaaattatctggcaaaattttgctttccagaaatactatctatattaattttaacatttttattgtgaaatatagtttaaatacataaagcaattatatagtataagtgattataaaggaaaccaccatgtaaccaatcaaccaggtcaagaaatggaatatttccagcaactcagaagttcccctccctgccatgaccttcccgaacacaactctttccctccctcctaagtgtagtcattattctaacatttgtgataatcatttccctgcttttctttgtcgctttgtcgcaagcatgcatccctaaacaatatattgtttagtctcactctttcttttgaactttatgtaactggaacaatataatatgtaatctgttgttcttgctgcttttgctcaacattgtttttaattcatatgttgttcaggttgttcctatagctgtaatttgtgcattttcattgctgcatattacagtgtcccattataacaatatgtgacaatatgtttagccattctattgctgatggacatctgggttgtttccagtttaggattgttataaatgctaatgtgaacattcttcatatatgtattccatcacatctacgtcagtttctgtataacatatacctgggagtgtaatatgtatcataaacttgaataaataatgccaagttcttttc

SEQ ID NO: 3569 - DNA, 6902 bp, Homo sapiens
gtcaccacaaacccattcaccggctctgtctgggtagtcggtccggctccccttcctctcctcttcccttacttcctccctccaaatgggctgctggcggcgggggagggaccctgggggcagctcagagcgcgctggtgctcgggaggcggagggagaaagaaggaagggaggctgtgagtgagaggcggcgcgcagggagggagcgagggagggaggaaggcggagggatattcggaccggacctctccgcggaggcgccgcgctccacgacgattggccgttgtcctggccacgcggaatccctaactggccaggcgctcagcgtcgaagggccgtctcgcgcccattcgcctgctggtttcaaggcccgggttggctgggcgggcagcggaatggagcgcgcggattggccgaggggagggagattgggatggggtaggagagagcccgccgttgattgggtgggcttggtaaaggccttgagctcagaccggctgagcgctgggaggagggtggaccggaggcacgactcggatcctgcgcgattggctgggatagtaggcgttgataggatagggtgcccgggagaactaaggagaggagttcggggtcggggcgcgggaaggcgggaggtgcccggcaaccctaggagcccggcgcggggcacgatgggacgcccccgggaagaggcggagctgggttcgagcgctggggctgcggttgggaaactactggaggatgtggtgcaccagaataagagaataaaccaagaaacaggaagacgtgatccaggcaacaggatattccagtatagtgttggaaacagaagcccagtagtgaaagctacagctgccatatacttgcagtggaatcacaggagcaatcacaggtctttaatttaattctggagtgtgagcaggaaccagttaactacattcattgtccaacccccactggtttgaaagaagactccaaattcttggcatatgaatcagctgttcggtagctccaccttatccctgcagcgaagcagcagaaccgccaatggcggcacctcaggattcacactgtgggtggtgaggccttccgctgaaggaggtactggtggatgctctcagcatctcgctttagccaggcagcattcagcagaatattttcacaacactgctggatggtacgctcagctgaaggagctgggtgactctcgaagaaagcctggtataaaacaacccagaatgcaggatcattactagcaataagaagttaatattacaggttatgaaaaaatacccactggtctatatgaaggatgcataatcttcaggcatgagaatttaccactgccaccctcaggctaaaagaaaacaagcaactccttggacctgcatataggaattctccccttaattatatgcttaacaacctaatcaaaagttaataaagagacagaacctactgcctttcttttaggctaattgtgtagtggtaaatatagtctttggaatgaagacttggaacctgaatccaggcttagtcatgtactagcttgtgactgtgagaaaattaactgctctaagtctcagttttctcaactatgagaaaatatctactccagaagattaaagagacaatccatataaacatttgacaaaatacctagcacagagtacttaaggattcaacacattttggctgcttcaaataaagattaatttgtaagggatgataatacaaagaagtttaaattgctgctatgccctaataatttaacaccccatggtcttttttttttttttttttttgagacagggtctcactctgttgcccaggctagagtgcaatgaaacgatcatggctcatcacagcctcaaccttctgggctcaagtaaacctcccaccttaacttcctgggtagctgggaccacaagcgtgcactcccaggccaaattgttttttcctttttgtagagatggggtcctaccatgttgcccagactggtcttgaactcttgaactcaagcaatcctcccacctcagcctcccaaaatgctggaattacaggaatccaacatttttaatacagtaaaccaaacaatttctaagtttacaatttatcacaatgcttaatgattaaaagttgaataaacttttctaatgcagtacacctggtttcacagaaaacaaagcaactcttaaacaccagctggcaaaatgatagggcttttcctttgaattagtcaccacaggtgtgaaagacagaatgactaatccatctgattaaacatagaccttttagaaatcaataaccttatttacacagatgacaattgctactgttccaaggctcctaatcatggttcagttctcagggcctcaagtctttttccattccatcgcagagtagtaccaacatttatacaccagaaacctggggattatcctggcttgtttttcttcctctcccagatatgctcacaacagagaagccaatcaataaatattgttgaactaaatggttaacaaattcaagcccctgaatctccattattccatctcctccactactgccactaccctactgtaagctattctatcattcttgctaggagagttagcttcccaacatcttctcttccccattccaaactattatccacattgcagccagactgaaatttttataacacaaatcagatcaaggcactgccttgtttataaaccattcgaaggctttccatttttaggacttttttttttttttttttttttgagacaggagtctcgctctgtcacccaggctggagtgcaatggcacgatctcagctcactgcaacctccacctcccgggctcaagcaattctcctgcctcagcctcccgagtagctgggattagaggcgtgcaccaccatgtccagctaatttggggtttcaccatgttgcccgggctggtcttgaagtcctgacctcaggtgatccacccacctcggcctcccaaagtgctgagattacagatgtgagctaccatgcctggccatttttaggaaattcttaatatggcctatacagccctgcatgatgtctttctctaaacaaaaacacagagatgctacagtacattatcccaacactataattacaaccaggttattgtttttacttactagactgaaaagtgaagagtaaacagtattttccttaccttaacctctccagccattttatcaactgcaaatccctcaactgatagctgcaaaacaatggttttaaacagtaagtgaaaccaagaggctgagaacaaacttccatttaccctaaaaataaatcattctgttctctgccaacttcagtctgttataaaggatgtgtgatgggagatggagaagtccttaaataaagccagtaactatttaaggaaacttttttttttttgagacggagtttcacacttgttgcccaggctggagtgcaatgacctcatctcggctcaccacaacctctgcctcccaggttcaagcgattctcctgcctcagcctcccaagtagctgggattacaggcacacaccaccacgctcagctaatttttgtatttttagtagggacaggatttcaccatgttggccaggatagtctcgaactcccgacctcaggtgatctgcccacctcggcgtcccaaagtgctggtattacaggcgtgagccactgcacctggccacaggaaacatttaaagagcaaagaccacaatgtatgggtgtagtgaatcatggatgtcactaaataatatccatgattagcaagctactcaaagtttttcacatacctttattagtctggatattaagaatcctccctggtatcggttataaagttcttcccagttgtcctttatgaatttccaagcagctttcctaccatgcttgctgcctccagctactccaccaattaccgatacagtgtcctgtggacgtacctcttcctaaaaaaagaaagagagctaaaagtctagtgtatcaaaaacatattctggtaccagaaagtgcaccatactgtgacactgaagtaatcacactgaagacacttattccttgttttaggaataactggaaccagaagttctcagcaaagaagataatgtttaagctaaagataaccaaaatgagaatgaggtactgagacaggttcagacagacagactgctcaacagatacttgcttaggagcctataggtttaagaaaggaagagacacaaagtaagcaaaggcataagccagtttcccagttttcaagagtccctgtcctcatagtttccattctggagagacaatttgtttactctcccaactattctgattctcgccactagtgggagaaaaacagaagtcagtaacaaaaactcaagccagttactctggaaaaggaagctttagttagggttaaggcagctcaagaggatcagagctgaatcagagacacttctcagagatgggtaacgattcacttctaaatgcagttttcaccgtaacttactgaaagtgcaaacgtgaggactttttgaatcaggtcaggcaaaagagtagcgccaaggactctttcgattcggtttttctcttcttgcatatctgcttgtttatgaagctacaggaaaaaagataaagataggaatagttaactctcccttggatgttctgcatatgattatatgagcttcttccccagtaaggtaaaacttaggttctatattctcactaggtaagaatggcagggcattatattaaagaaagagaatacttttcaagatgctttgggccaggtgcggtggttcacacctgtaatcccagcactttgggaggccgaggcgggtggatcacctgaggtcaagagttcgagatcagcctggccaacatggtgaaaccctgtttctactaaaaatacaaaaaaaaaaaattagccgggcgtggtggtgcccacctgtaatcccagctacttgggaggccgaggcgggagaatcgcttgaacctgggaggttgcagtgagctgagatcgtgccactgcactccagtttgggcaagagagcgagactctgtctcaaaaataaaagaaaaaaaaaatgatgctttggcactaaatttgtcatctgctgttacagtaagtaaatcactagatgtaaatgctaccagatgaacagcctgtcattagttcagaccagtttaacatcaagatctaagaggtaaaatctatcatagccaaattctttacatcattgatatctggctaatgttctgttttagaagaacaaactaatcattagtgttcttataccagatcatcaaattaatttataatagtgaaaaattgaaaatgaatactgtacttataaaaatgcattattgaaagttatattttaagaatatatcataaacatgttcttatatttaagtgaagaaagcagacaaagcagaattatcctaaaaaatatatatatatatatggctgggcacagtggttcacgcctgtaatcctagcactttggaaggctgaggtggaggttgcagtgagcccatatcgtaccactgcactccagtctggacaacagagcaagactgtgtttccaaaaaaagggggtgggggagaacccctggaaatacatcaaaatggtagtattaattaatgatggtttctgatcagtgggattatgcatcttcacactttttaactgcaaaagcagcacatactgaatgcagaatatctgaaagacagagaagcataaagaaaaaaataaaattactactatatgtacattaacaaatctggaaagagagcatgttatacatgctgtttttgctacctgctttctaaactataggtaagttttattttcctctttatacttttctagtctctaaatcttccatagtatatatgtatataaaatcttttcatagaaacaaaatgttgtaattcttaaaaattagaactataaatgtataagagctatgtctccaagacaatttagactcttttgatcttttctaccccttaagatttaacactgaccagagtgtctggagacctcatcaaagctctcagtttcctcttcctttcgacacttttttttttttcaataaacaattttaatttataagaagtagagatggggtctcgctgtgttgaccaggctggtctcttttttttttttttttgagatggagtctcgctctgttgcccatgctggagtgcaatggtgttacctcagctcactacaaccacgcctagctaatttttcttttctttttttttttttgagacggagtcttactctgtcacccaggctggagtgcaatggcacaatatcggctcaccacaacctccacctcccaggttcaagcaatgctcctgcctcagcctcctgagtagctgggactacaggcgcccgccaccacacccggcgaatttttgtatatttagtagagacagggtttcaccatttgggccaggctggtcttgaactcctgaccttgtgatccacacccgcctcggcctcccaaagtgctgggattgcaggcgtgagccaccgcgcctggcctaatttttctatttttagtagagccggagtttctccatgttgcccaggctggtcttgaactcctggcctcaagtgatcctcccatccaaagtgctgggattacaggcatgaaccaccacgcctggcccctttggactctaagcagcagtgcagtaaaatagacaggaccttgggagatctgggttctagtcccagttttgcctctaactagctgtgtgatcttgactaagtccttcatccctctgggtctcagtttccccatgtgtaaaatgagatgggtggacagataatttctaaggcccttttcagctccaatat

SEQ ID NO: 3570 - DNA, 2227 bp, Homo sapiens
aaaaaaacaaaaaaaaattttatttgacaaaagacaaaaaagttatttacagtagtttttgctcaaataattcaatgggacaactgtgcttctcctccaggtttatcttacaaccaaacccaagcagagtctgccctacccaacaccccattttacataatggggaaatgccaaccagaattcagcagcatggctccctcaccaccctccattgctcagtgcactgtggggagggaaaatcccacctcagcccaatacacttccagagttccctactacaggcatcctgcagcagttgcaccagacctgggctcactgacagggctgggatggaagaggctgaggcaaataattgcttgaacccgggaggcggaggttacagtgagctgagatcgcaccactgcactccagcccgggtgacagagcatgactctgtctcaaaaaaacaaacaaacaaacaaaaaacaaaaaacaaaacagcaaaagaaaaaatgggggaaagggaggagcataagaccaatcgttatctgttcactgggcaggggcttctgtaattctaatttaaagaaaggtgaaacaaagacaatcccagctaggaggcttctaacccttttccagccccaccttctctgaaggcagttcctccgcagcagtggacaccattcctgctttccccaaagtttcctgccaccattgtgggaaaagctgcctctctggaggacttcctgaccagcagatggctcacttttctcccaagtaggaggtgctgggagcttctgacatatgggcccctctaatccaagttgctaaaagaattcaaaactgaggctgcagggcaaaagtgttcaagaacaaagggaaaaacactaaagaaaaaaaagaaaaaaaaaatccatcgcttcagtctagtttacttcccccacccacccaaaaaaactacaataaaaattaaaagaaaaaccaaacaccttttgatcttatctttctctgctaggtgcctagaaagttgagtcagagtctgctggactgccccctgctgtggctttctacccttctgtgcctgcggcagacaagccaatgcgctcatacggttgttttttttttttttccctgccttttttttggtaaaccaaaccaatgataaaacaaccatttggaatttcacactactgcagagacttagctggtccccaagataaaaatattcctttcttccaaaacaatcctcagtggcagtggtgggtccttcccagctcaccagaacgctatcatgcagtgcactctcgttccccacacctgggctaactactgccgtgaatgcaaaccacagcaaaaaagggaaaaagaaaacagtttagcaaaaatctaaacattcaactggagtcggttctgttacatccactgggttcctcttttcttttgttcacgcatatgaacttggaatgtccacacctggcttgacagaaacagcacaggggcagcttggacccaacataggactgaatttggcagctttcctgagcccagcccaggaaaccaggctggaacaaaggtgtcccagggattttctggagaagcagcagaagcagcagcaccatgcttgtctccgatctcttggtctcatcactgagcggaggcctggagaaacggcagagtcagcagaggagagggcccccatcacagtgcagtggtgccagctggcatcttcctgttgaagacctctggacagaggagatgatcccaatgtttggcagtgatccatagaaaaccctctgtatgaaagggaaccaaaacggaaacccaggacagctggctggagccttcagcacccttcttggcagatgcctactggggattttcagagactaaagggatgggagtgtgcagtaatgggagtgatgggtcctgctgcttctgaagctccatctcagcagccctctgtagcgccacctccaccagcagctggaagctgctgaagtcctctttgtcctgctctgggggtgtgggtggtggcgtgttgaagagtccacctgtggggcttccagcctcagccctggtcagcagagtaagtgtgctaccaggggtcaccaggggcttgggagactccagctccccacgtgggaaaggggctgctggcttttccccctggcctgagtgaagcggcatggagcacacagacagggagagcacattggtgggggctgggacagacacagccagcactgag

SEQ ID NO: 3571 - DNA, 377 bp, Homo sapiens
gctccttccttgccctcgccaactctggtctcaggccccgctgcagctgcggactcggggctcccccgaccgtgccgtttggccgctcagctgatccctccgcgagggggtgcggctaggggtgggaggaggacacggcagctgcggtgacggcgggcgggtactggaggatcgtcttccgcggcagcagcggctttagcgcggaggtcggcaacggcctcgggcgccccgccgcttcggatatttccgccgcctgcccgctttggctcttcccgcccggcctgcgttgtgcgcctgcgcagccgccgcaaacccgcgttgctcagcgatggagtttggggttcggcctccttcggctggactcgggcatttccgtt

SEQ ID NO: 3572 - DNA, 15214 bp, Homo sapiens
tttttccaaaaaaagtaaaaccagagtttcaggaactctttatccacagaggctaatagaaatagaatttggaaatatctatctgagacatttttaaatctgaggaatccgtaaaatggtggctcttgggtatccagccctcaggatctccatttacctgttaaagtgaggatttggtgcctttcttctttagttgggccatcaagaaaacttcagaaatcaggcattctgtcttcctatacaataaatattttcagatcatattttcagataagagtcttcagcttccctcagctattcaacccaatgcatggaaagcctcagttgaataaacttttccaccatcccaggtgcctgaaactagtgtccttcttcacttctacattcaggacaaaatgaagtcaggtttttaaaacctcagtataaaagaccccctcacactggtccaatatgaagacttctcagcgtgaacactggggaattccttcctttcatctttcctaatagattgttgttttctaatcccatcccattctgctgtacctctccagcaagtcccttttcaccttagccaagctccctgcaatgctcttcagttgtgaagccttgtattcactaaggaactacgtactcttagtctgctttgaaagggctaatgtctagtgtaatggcaaaattaccaatctgttctccaaagtgttccagcagatatatttctactagacaaacataattgtgaattgactgttagtgaggctgtttcttctctaatgatcacataatatccaaattatatcaacttcattatttccctctttccttttcctaaccctttccctttatttcttgtttctcttgaagactacttcaaattacctatttgtcttcattactgcccccaaaactctaataattgtgacccctaactgttcatttctcttcctttctccaccccattctgaacatccttctttaagttttatttaatgaaagaacactaaagtgagtgagttcataaacttgagactcgtaggcagagtgaagcatgtcttcattttagcttcagagtttaaaagttatcaatattcttttgagagtgggaggacctgagtcacagttttaaatgtcaactgtactagctgaggtcattaattccccttaccttcacgtttggccaaaaatgaagagaaaaatattttctgttttttttttaaataccacagtgttcaggttcttcatatgagtaaatcacttttgacggagaaaaaaagaatcattaatgttgactgtttccactagtcaaattacttgtttatcagactttagattataggaatctaaagaaaagagtaacatttcaaaataattttgataactgttcaagccttagtgagctcttctcaaacaagaaaagccacatccacttgaacacattgtaggaaaaattaggaagagtttttttatttattgcctttttgaaaaaaaaatcattgatttgtttagaactttgagcagtaacttactaatggatgaaaagatccataaagttttgaaagtgtctgtttttgcaaccagagattgcctaaacataaacttaatatatacttaaataaaataataacagagctaaatggatacctaaagagccatgcagtgcactccccagcacctaaatacgccccatataatttggttgtcatgctagatctccctgcagtggattacaactgtctggtcaccagagcattgcccaaaagactgactgataccattctgggtgtatccttttcaggatgcttataatatcacattcacaacaacttcgtaacacagtctttcctgacttctggtccaatattcttgccatgataccacatcgcctctcagctttaatgaagacaagtcctgtgacatttagagtactatgtggttttgagtgcataggcggtatgctttcagttcttgctttaccctttgacaaaaagaatcaacatttaatatcagaaatgtatttttatttgacttgagatttgacccagcttttatcttaatcaaaccagtttataacatcaactcacaccatagagaacaatgaaataaatagcagttttgaaagcctttatgaggcatgcatctagtaggaaaacaacatctcttaaaggcaatatttacattgcttaggactatgatcttcacttggaatgttctcccaatcaatcctatatccttctttttctttgtccattctaactcctggtattttttttttcttaaagtactctttatctaaagtaatcctctccttaggcactggcttccaaaggaagaaagactcttttaaatcctaaaatgctgtcatttaaagtataatatggaggaggagaggctctggttctgatagatcttacttggtcctcaatctgggatgccttcttgatgctgttctttctagttccccaagaagtattccaaccccaagacccagaatttctcaccacaacctctgtgttagtctcagattaatgtctaaatcctgtttgatattctagagactccagggtgtgaatttattattgcttatgagcctcctgtctttccaagctgacacctgtcaggagcatcaatagccctaacagtaactaatgcatcaaaataatagacagaaacactatagtatatattcgtgaggataggaagatttttttttcttcttttctccaggaaaagcttgctttgctcccctctccctctgcaacacacacacatacaatgcatttcagaaagtctgcatcttattttacagatatgtagctctagaatttacaaatatagcttaggaaatgttctgagattgaggctggtagcaaacaagtttattttctgcactggacttcaggataagtgtgcatagatgcaattccttcaaagaaagtgaaacatggtagagcaaagggataatactttcacacattcaaacagttgtttgctatctataaaccttgatttaagcataattattactttttagaaatctgaaactggaggaatgtgtattttagtaaggtttttttgttgatttatttgtttccctttctttcttctcaagatagtaaaggatttttatttcttaatttgttactgtccatggacagtcaaataactgctcacccttactgtattattttccccttagaaagaaaagccttccatcctaccatgaaggaatttttcctccaaaaaatcttatcttccatttcaaatagcactcatgagcttttaagagagaaattctctctttactttgaggatagaacagttaaaacaaaaacctgttccttgagaaagaaaccgtatttacctaaactaacaggtctggggccaaagaatagatttttttattgattgcagatgaagaccatgcattttgtactacaaatccttattgcctcctcaaatcctttttggaataaggctgggaataaattagtttaattaaattctttgggtatttctaattaatatctactgcaagatacccaggaaagaaaaggaaggggtgctgccgaaatgccaaaatcaattgatctgttgatttttatcattgtagttgttgcttttctagccatttcaagactgtatgtgttcatgaagtcttaagtagagaaacacctgtttccccattgcttctctctccttccccacacccctgcacctgccccaaccccaggcactagagggaacagtaacagagggagattggcactgcattgccagtacttcacccatctatacccctccaccacaaaagaaggaaaaaacaaattagaaactatttttttaaaaaaggaaattgtagtacttcatttgaaagcatactgttttcaactcaactcgattaacagatagcctgacaacgtttttgtaacctttcttttgtgctataattgacattcttggctcaatctttaaaataattgcaatttcaattaagtgaacagagaaaaacaaagagagggaacaggacaatgtgatgggaccaaatttgatacaggtctggattcctaaagccagttgtcaaggttaccggagaaagttagcactactcaccccttgttgttcttgcctatctctcattattacaattcaaagaattagtaagttaactatacttctttgtgattaaagatttctcttcatgctgccaaacacttctagagaaattgtagaaactcctgacttctatacctaatgtgctatccgggcccgagaggagtgtacagagagatcactgaaaataaaataatagttcaaatttgagataagattttcctgtagttcaaagtgctttatgcatgttcacaactaggggaatctttgaaaacaaaggctagttactctgctcttgctctccttgggacaaactttaatttggaaccagctgtagatttacaggagaaaattctcaaaggtattttcagctgctaaacttcttctttaggcccgttgatttgaacctcagttttcctgaggagcctattgagatataaattaagggtaatttgcatatatctaattaaaattgttcctacactattgttgaaagaattatggttttcagagtagatgaaagcagggtgtcttagtaatcttcatcatggcaaacaaaggtgagaagctgatatgatagagaaaatctatggtaacttgatattttaaggtaatttgagtgtgctgaccccactatgcttaattcctttcccacaatctattttaaactacactttgattctcttgagacttacagcatgcatgtgtgggtatgagcagacaagcagacttacctttggagggtgaagacccagacaaactgaagaaacggattcctgaggatgatcaaatacaaatcatttttccagaatcactcaatattgccacatcccaaactaattctagactaatctttagaaagaagtaagctccttaagaaatcctactatgaatgttttttcttcttatggaataacacaagaagaggtacaatgcagactcttaattttgctgtaataattcacttttgtatttaataattgtacttctgtgtgagtgtgtcactgagctatttgtaccaattttcaattgatcattctgagaggggccttgagaatttctgtgtatgtgtatgtatatctgtatttatgtgtagtcagaaaaaaaaaagaataggagactaatgaggtgagggaaaaagtgatcaatgtagaaaagtgagtgctcctagtgtacctatttatgttatgttaggtggctgctgcctgtagcccttgaggaatagctgattgcactattcaaaaataaaagcccagcactgttaaatttaggaccgtgtttcaagaaacaggaaagctttatctttttctgaacccattccccttagcattagagccatctgacatgatgaaaactattaagtaaaaaccactactgacctttacattaaatagctgttttcctcttctaaataatacccttgattttaactagactacttccttttattttctgcctattggcttaatgttttacagaaaatacataggtgcatgctagtttctctactttgagctgaaacaaacaggagcaacaaaagagatgactcacataagtgtgagatagactgaatttcccaccttcgtagcactggtaacctttgtaagagctgtttagagttgagctttgggttataatagggcttttttttgcactaaatatgactgcactgcattgcactactgaaatgtacttacttgtgctgggagagagtgtgttacgtatgggaaagaaaaaggcaaattatggaagtaggagcatcactaaaatgcagagttattttcatcatgcttgatcttagcagggttggcgagaatctgtggaatctctgtcaactcttgatcaggcctaggaaccaccatgctgataggatctgttttcttactgtaaagaagctgagttagtacagcaattaagaacatttaagaaaaagtttacccaatcttgtttctgactgagctctcagtaagagttttaacagtgaagaagccaattgatatgatgtagaagtctttgccttggcctcctccacaaagccccttgcttgtgcacattttagtgtggcagagggcagtaggatgtgctcctttcaaaaacacatagccttgtccatattggaattacttttcagcctgattatgcttctccatccctgggtgaaacctagatcaggctaaccaaagaggaaggctatgcatgtggtaaagtcctttaagatgacagatagggaacagtgcaataaacactgaaaaccagtgaagtgaaaggtttattttgaaacaagctaggccaacttggacattggaggatggattagaacatactagctgctccatcatagactatccttactaagcagaagaccttaatagtgcctaaaagtttagttttgaaattggttttttcctaacttttctttgttaaatttatttttattatcttttttaatcttagaagtaatcagagtttgacagctctttagtaactgttaataaaagaatctttcatcacaggataagcaatagattgtgtgggaaataataacacaagagtaaagatgctgaaggactcttctggaactcaaagtgacagttttgaaggttctggcacagtaggaaaggatcacaacccatataaatggctaatgttgaatttctctgaacactgtcacatatggggcatcaatttggaaaattctcaattgaggccccttccctaagattacaacattgataacctgtctttttctctctcttctttactatccgtccaagtctactattccaagtttaaatattgttcagaaagttgtcagccttgttagtcagaaaaactccatttagagccatccaaactagcataagaaattccttaagcactcaaagcattatctctgttttaagtaagaaactaaatccagagcttttaacaggtacttagaaataagtattgggtaatcactaagaggacattgactgcaccaaaccaaagctatagaaagaaatgattgactttttaaaatatattcacattaactgtcctaggatacttctcttgaggctttggaaaacttcttccttgaaatttgcatatccactccagttctgtcaccaaagattttaatcttcagatcgcaatttcctctctcccagaaaaaagtactacaacaggctcaagggatatgctttggtggtcaagggattacactatggttttccttctgttcacaatggtatttacaggagaccttgtcatcagaggacgtactgaactatctttatgactttggatttgatcagaggtttaaaaaatagaaaaaaataaacaacactacttgacactgtaaatgatctttaatagagtcatgacctggagactgatggagagaaagaaacttccatggaagagagtgagctaaatcatttagaaccaaacaaaggtcactggtgaaacatagggcagcatgtacacagtgcagatcagggttctgtatggccagagccaacagcagtgaccggtgggagagtcagacaactggccaatgaattcaagtgttgaaaaagccacagtctggattttgttgtgatttctggagtggttgaaacgcccatgcccatggcaaggaaaatgcttggaggctgatctgttgtgatagtgcctttcttgtcgtagtgagtactagattaataatttattcagttacgcttttctgtaccattgcctccagtcttctgaggaggtttgaagggacagtatccacttaggatgaagggacaggatattgctctggaatgctgtgatttgatgatatttgcactagattctaaactctcctttaaactggagcaactgactgagagaaaaaccaaggacagctcaaagttaaaagaaaccaaaagcagtattttctgacagataccatttctttttctccttctttttttcctggaagaaaacttcacactagttggctaccgagctcaactcttaccagttctttctctttattttttgtttccatatggaaccatctgtgtgaattagtcatcagttaggtatagttaacgtaaagagcccctgccattgaaactttgcacaccttctctgctttattgaaggcaagggccagtgggcagtgatagcaggggagggaccctccagaaccacccagccctccaggaggccaataagcatggatatcatgtcaggagctgagctgacatatatttactcagaggacattggggtctgtagctaatcctaaagaatgctccgcaacagaaggaaaccaatgcattgtagaaaacaaagggagatggtgcccgaagtctgcctgtttctcttctcttttctttcccatctcaccaccatgtcctctctaacagaattatatttcatctcatatattatatgttactagaaaagtcatttggttccttggtttctctctttatcagtgggctggaaattcctccaaattaaatataaataccagtagcagctcccctgtgtccagccagtttctcaaatgctgtccacctggtcttactgtccacctaacataacttggaggctttggctggctcaaccacctgttcactttattttgttttcatttccatttgaacttgaagtgaggctatggaaaggtggaaatcatgggcaaggtttggaggctgcaattctagggcatagcttgtcaggagtttatattatctaaaatatatctttctataccccttttcattttaatctgttgccctgattataatttctttatatttgtggttatttttataagaatagagtccatttgctatgtctatttgagtactttttttctattgtccccacatggatgcagtaccaacctgttaatgaaatatctttttattatattattaatatgtaattctactgtagaccaaaaatataaaaacaaatttgttcattttaaagatataaagaactagggagtaaaagattaaaagttgaaggaaaagacagaagagcagtggttaactatgttgagttagaaatctaagagtagccttacctgttttttaaccagtgcttgccaatcataccatagttggaattatgtaatcttggctccttcatacttatgttctataattcttgtttgtctatttgttttctttgatataattgaggttgcacatcatgctattcttggcaatgcctgattctattgtattgtacttttgttagtcatttcctttagaaagatggggggaaacgtttatttcttcttttaatttaaaatttgtttaatgcactggaaataaaattggacatatttcactgtttaaaaaatcagaaacaaaacaaagcaaaaccatgagggaaaaaaacagcaaataagcaacaggggaaaacagctatgaaaaaaatatatttgtactgaatacacatacaaactacatcccacatgaaagattaatatcatcaagtaagaaaaatacatagtttaaactacaatgctgaaaatataaaaggaacctggtagttcaatggggatggagaaaacagagcattcctctgagagcagagatcttgtcattattgcaattaatgcccaaacaggttaaatgtggaagaaagtatggaggaaataaccccagccttcctcataccactggatttccacatcaccttttaacttatgcttgagctcccttttgagaaaaaatatttaaaaacaaattggctatgtaacaaatttgtgtgtgtgtgtgtatatatatatgtatatgcttatatatatatatatatgtatatgcttgagaaagtggtttttcaagatgtatgtgtacagtacacacatggacacgcttcagtcctctgacttcccatgtgctacctcatgtgtttctcttctcatgaggatttgcaatggatagttgtacaacctggggactgtcagtgactcattggtatcagcatatgctaaagaagctcttgaatccaatcttgaaacctgatctcccttcgtcaacattccccaataccaaactggcccgtttacccatacaaatgcacagtaaagggaagaacagcggtatttttcctagccaactgactctatcatttgtttaatgtttgctggtttttttctggttttgttttgttttagagcaggggtgggagtggctgtaacttcacaatcctaatacagtaaatgttttgcatcttccatgttttatgcaaaaacagacatttaaatcaataaataattgtgccctagactgaaggttaatgtttaggagaggaaaaaaattgttggaattttttctacatttttttgtgaagaatcttttttggaaaggaaggatacatatttttgttgtgtaatattttctatttttgaatgcattttattggtacaagactgtttttttggtgaagacattatttaaaaaaaaaaaaagaaaaaaactaatcgaaaagtttgcccttaaggatatgctgcagttttgaggttaaaaaaaaattactgattcaagatgcgtgttaaaagttgggattatattgttgttttttgtaattgttacaagaagaagtttgtacccactgctgtttattttgtttcagatgagtaagtaaagggattgttcttgttttattctttttttagagaaaaaaagctatttatgaaatgtcaaaaacactggactgtgagtttaagtgtggaagcattttaccaccctgtgtcttcaaccaattatgggaaaccccttttctcttccccctaccccctgccttagccttgccaaatgagaaaaatataacagctgtcagattatcaaagccaccgaagccctgctttaatttttatggtttgaaaaagttggaaaaccaaagttaaatttgtttctgaaatcctgctgtgcgttgcccttttttgtatgacacagccgggctctgcctctctatctcaaatcattgccttcttagggactgggggccaacctgatgcaaagagaggcataaaggtggtgagcctgagagttgaggtctcacgaagtaaaatgtgagtgggacttcaccctctcagtgggcaaccacactttcccatcctgagatgaggctgccaagagagcacactgctaacactgcctgaggagagcacgcctcctgtctccttcaccctctgcttctgagaccctcctgttactgttatcatcgttccctagcctggctctgcctttctcagcagcccacattccatggatgggagcaggggggcagggacccaaaggagggaaatggctgtgggtggtgtgaaggccccccagccctcaggaaggtggggcaagagaccactgagcacaagggatcttgcccacctcctctttgactctgtggattatccatccatctgctcactgtgaagatggagaggcagtgccctaaggctgttcaatagcttttccatattttttcaacattgaaaaaataatttttaaaaactgtgatttttttaaaaaatcatttggctggagggaagggaaaagggaaacaccaaaagctgtaccatgatgaactggagatatttaactggggcactttccagaccaagacaaacaaattcctttctggactctaaagcagccgaatcttgagactgtcaatgacagaaagctgaagagaggcctctatttcttcctttttcctttcttctgtctaaaaactctctcttgttccccttttccagcttcccttggactactgccccaatggccccttggactcgcgtttcatgtatgcgagcacacacacacacaaacttgcaaaataccgtttttcttaaggattgtgggaccgaataatatcacgtgccttcatcttttccttttatagttagatgaacctcttcctctttacaatttttttaaaaagtgataggggaggttgatgtgttagtggaagatttgggcatcgtttgagaagtaacttttgtttaacacattccccctaaacattgaacacaaacatttcaaccccttcatgacactctttggacatttaaagcattgagtaaccatgtacatgacagcctaaatccgtttgatttcagagcatttcctgaacattgtatttcatagacttctctgattttttcaaaaatgaggtgagcaatggcaagcagccttgttctcccaatttggtgcttttgcttttggtgtggggtgggcatggggggttgggggtggtgtgggtgtgtttagaaaaaagatgcattcctgaagatctctggtgctgaagggcctcgagttcctttcagagactgtatttgacacactttaggtacacacaaacgaatggtatcacatgcaatattttaatggagcaatgggagaggctctttgaaatggggtttgcatctttttgtaacattttgatttctctggtgccttattcctacttgatgctggcactcacatacccacaagaagctgacacagaagtcagccttaggcgtggggacatatgggtgatgtttgagcatgcaggggccatggggagtttggtgtcagttggtggagaagggactagatggcatctcttagccgaggccaacaggaactgcacaagtccattatagtcaaagttagcaattttgatacgtaaacacaatacttcattcttcctcatctgagctttccttccttcttccttttctatctctaccttctcataaaggtgctgctgctgctgctaaggtgcccggagtccagaatgtccattaatcactcaggcacgagcctggcactgccacgtcagcccccagcatgaccaaacccaggtttctcttgcttggggctgagaactgtcagatttttctcatcaaaaatgttttccaaggaatcagtggattacagtttttctgcattgaaaatgcactttaaaaaataaattaaagctccagactgtttaaaatatacagagggagcaggggaaagttaagcatgtgctagtgtctgaacccagttcagtttatctccagttgaaacgatatacactatattatgtataaatgtatacacacttcctatatgtatccacatatatatagtgtatatattatacatgtataggtgtgtatatgtgcatatatacacacatgcacataacaaaatcagatgctcattacaaatccagatgctcattacaaaaccagatgctacacaaacagcagcagaggaaacaaggttggactcttgcaacagatcacaaaaaataaaaacagctacttgcagtgactttggtcatttctgtatgttcataaagaatggattgtaacaaggaaaaaaaggaacagtgttagtgaaaaaggaaaaatgggcgaaaccatcttgatccgatgcgaatgcagtaatgttctatataccatttcatcagttatttcttttagtcatgttgatttgatttcagtttctggctatgaaaaacatttttaaactcgtcacccacaacaaactgaacaaaactactacagtgaaagcccttttcagtgaaagatgtcagaaacctcaaaacctttggcctgactcagaactaccatgtgaaaatcagtactctcttaatgtttgaaataaaaactgaaaaaaaaaacaaaaaaacaaaaaaccttttttgaagcaccttaacgtggccatccatttgagaagtgggtgccacttttttctttgagcaccttattgatgtgtttgctatctgctgtctttctgttacctgttggctgaatggctagctgttaacatatacatgtgcacagaagagatatctgggcatgtatgttctcaatgaagtttactgtggtgactgctgaaaggtgaacccatttcctgattttcccgccgcagtgttgtgataagattcgaagaaacctttttccctgcacagaaatgtttcttatcacattgtatcttagtatggaaaggaatatggtcccttttttgcaattgctactgtgtacacacacacacacacacacacacacacacacacacactgtatgtttagacctaaaatacacacacccacgcacacactgtatgtttatgtgacctaaaacatacacacatgcacacacacatacatatccattcattcattcattcaagtggtgtttccagtgtctgtgtgtcactgtttatgcagtttccatttcccagtgaattatgagtggagggcaacttttctaaccagattgtcttttcagaacaaagacctgggaattgaggaagagtttggaaagagggagaggcaaggaaagagagctttaaattgaaaggttaatttcctaagaggaacctgggctgaatgactgcagtgttataccctccaatctttgcaggtgggcatggaacactgcttgtatcactctgtgcacggtataaatccatatatccacaaaaacacacatccatccatcaacatatacatggtttgggatgagcaggtcaatagttttgagagggagtttgttcctttttttttctcattatactcttaaattgttgtcagttatcaaacaaacaaacagaaaaattgtttggaaaaaccttgcatacgccttttctatcaagtgctttaaaatatagactaaatacacacatcctgccagttttttcttacagtgacagtatccttacctgccatttaatattagcctcgtatttttctcacgtatatttacctgtgacttgtatttgttatttaaacaggaaaaaaaacattcaaaaaaagaaaaattaactgtagcgcttcattatactattatattattattattattgtgacattttggaatactgtgaagttttatctcttgcatatactttatacggaagtattacgccttaaaaatacgaaaataaattttacaaggtttctgttttgtgtggaagagtaattgatgttgctaagaatgatgtttgtttttttggggtttttgttgttttttttttaaatgttaccagcactttttttgtaagtttcactttccgaggtattgtacaagttcacactgtttgtgaagtttgaatatgaaggaataattaaaaaaaaaaaaactctt

SEQ ID NO: 3573 - DNA, 4042 bp, Homo sapiens
ctcgcgttggaggagcttgctctgagctgctgccacctgctgggctggagctggagctggagctgcgaattcggagtcccggttccctgtgccacctggcgagctcagcaaactaaaagtctctttgtcttcatcgtttccggcactgatgtgagcacatcataagcacaagacctggacacctttacaatcagagggcctaggactggagctctggatctgaccggagcaaagaggaagcacgcaaatccggacatgacgacgaggaggcagtagagacccatcctcaactaccccctgagtgccgatcccacctgtgaaaggggaggagcagatctggggaagggatatgcccagaggaaatcaacaagaccaaagagacgtcagagtcctgatggccaaaatcagacaccagctttcctgagaaggcagaagagagagccccatagaagcagtgggggctcagaaggttcagtgggttcacaggggagcagaggctcctgagggcttactcagacaggaagcagccccccaaaacatacttccccttctcctcccacagaaacagaacagataaagttcagaattctaggcccaaaagggtgcaacacccttcaaccagtttcagtgaagagcttgctggcctgggaagtaaagaaggggtttccaaatacagcagtttataaaacagtcctggtgagctatgaagtgaaagagggggagtcacagagctgctcccagttcacctgcttgtgctaagaaacaataaaatacaaattgcttccccaccccaaccctcagtacaaagcaaacttcacaccagagccaccatcagtgacaggcccagtggcggtggatgaggaagagaatacaaaagggaacgtctttaaaatctcttcaaaatcattttgtatagagaagtaaaagcaactcaggcgatatgaattcaaacctcagtgtagaaatctatcaaagtcggtacagtgtccaggcacgccgtcccggagacggaggaagtgactagaaaacattattgctggagaggcttttctcagtagaacaagagcaggtataaaaggggagggcgggtctaaaaggcaggggcagtcgccaggcctagggcactggaagggtaggaggagcacagagaaccttccatggcccctttggttctctgcctttggatggatggatttatgctggcattgtctggagggagccgggtgtcccccaataatcacagaacaaagacaattaggtcgggggaggaataaggataaaaagagaccccaacagaccctgcctgcccttccctgccccccggctgcactgctgaaatatgaggaagagatggctccagtgtggggtgctggccaggccagttcgtggggacgtacatgggctggggtggagcccccagcctctacccctggggaggatggagagtgggcagcctagggagagctacaggagggaggagggggcccagaggctctggcaggggtgaagacaagcagggggacccctcacggccctctgtccatcccgcaccagcggaggacaagggttccagtttcagtcgggtttaccccttcacccccgggtgaagtctctaggtcacagtcgcagttggggatgctggctggggaaggggggcagagacaggggcagggcacctagcagaagagcttgaggaagcagttctgacagtaaggcttgtcgttctgctccttgaaggtgcccttgttgagctgcttgaggcagaaggcacagacgaagtgctcggggtggaacttcttggccatggcggtgatgcagcggccggtgatgggcttctggcagccagaacacagcgagccgcgccgctcgtggtagtgcacctcacagtagggctgcccgtcgtgctcgaagaagctgccgttcacgaatggcgtgaagcattcctgccaggcggagagaggggctcagggagctgcccctcgggctagagctgcaccctgtgtgatggggccgaggtgggcatagtcggcacgctcggagtgactcctacttgctaggcgtttcccatgtgccgtgttgtcctaaacgctcatttttcatttttattttattaaataaattttttttgtagagatgggggtctcactatattgcccatgctggtcaaatgtggcctcctgcaatcctcccacctcggcctcccacagggctgggattatttagttctcccaacaggggaggcaactgaagcacacaggtgaagtaacttgcccagggtcatgcagctactgaggtcacagcctggattcatacacaggtctgactcctgagcacttagccaggtggctgtaacagtgttcccagaaacacaggtgtgacactggtctgtagtcaaactctgcctcctagattctcattggagattcacatcacatataggtagaaaaggctctgagaggggccgggtgaggtggctcacacttgtaatcccagcactttgggaggccaagggaggcggatcacctgaggtcaggagttcaagaccagcttggccaacatggtgaaaccccgtctctactgaaaatacaaaaaattagccaggcatgggggcgtgtgcctgtaatctcagctacttgggaggctgaggcgggagaatcactggaactcagcaggcagaggttgcagtcagccaagatcgtgccactgcacaccagtctgggcaacagagtgagactccgtctcaaaaaaagaaaagaaaagaaaaggctctgagaagtcctgcagggaacagtgtttcccaaactcatttggtcagagagcccttgttgaatcattaataacccctgtggggcccccagaatgcagtggttttggaaaccactgcccatttctgttgagtctgctaaatacttgcattatctcatttagttctcacacactctcctcccaaataggaatggcccagggccgctgcacagggctggactgggggacatgtctaccttgctcctggtttgtcccagcctcagtacaaaccctggcccaggacctactggactggaggaaggagatcccctgcctgctcccccaattaataaccccaaatgaggcctctgagttggatccagacagcacaatgaggaagacccctctctccccactgcctgctcctcgcccctccagatgtggtcaggggctccttacccggcacacaaagcactcaggatgccacagcgtgttgagggctgagatatagttctccaggatggcccgggcgcagccgccacacttgggtgcgaacatgtcgaagtagtccttgcgacagtaggccttgccgtccttctcgtggaaccctggggagcgggggttttggaggcacagttcattccggcttccagaagtggagccactctgactccaacctcagcagcgtctcccacccccacctccccggccctcctaagaggcggtgggtcagtccgccggtccagcccgtaccttcgggaccaaagaaggctccacactgtgcacagaagaagtgttcagggtgccacgtccggtcaagggctgtcaccactttctgtgaaagcaaaatgtgggatcaaggctgagctctgggcagatctcacaactgagacgcccagcaaggccgtccttccacccgcagctcatagccatagacagagcaaaacactcccaagatgggggtctctcctaattgtgctgtgaatgcctctaagaattcagagttactcaggatgggacaagccagacacataccctctcctctactcctcaccccaagtagagggcacaagttctatgactcccattttataagtgaagaaacataggctcagagaggccaggcatttcctaagttcacagagagggagagtgaggccgctggcatccaactccatttatctcctcagggctcctgagtcctgggagtctccacagaaaggaatcgagatgggaggtgaagggaggtggggctgcccgatgcacatcgggacaggctgtggttcaggtgtggctg

SEQ ID NO: 3574 - DNA, 446 bp, Homo sapiens
gcttgtcggcgccattttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaaggtgagcatttgtacagtgaaacattttgctacacaaaagtgatgtttaggaatactaacaaattattttcaagaataagactgattttatgggaaaattaagcagatgctccagtttgagaaacctggatctgcgatctgtttgtgaggtgaagaagaaagaaaatgaaacatactcaagatttaagaaagagggaacgagcagtaccattcactgatttggcaagtcaagaaaagccactgagtggtattcagttaagagaacaat

SEQ ID NO: 3575 - DNA, 942 bp, Homo sapiens
ttttttttttttttttttgaggcagggtctctgttgtccaggctggagtgcagtggtgcattcttggctcactgcgacctctgcctcccaggctcatccttccacctcagcctcctgagtagctgggactacaggtgtgtgccaccttgcccagctaattaaaaagatttttttttttttttttttgtagagatgaggttttgccatgttacccaggctggtcttcaactcctggactcaagcgatccacctgcctcggcctcctaaagtgctgggatttcaggtgtgagccactgtgcccagcccgaagaagctttatctgatctgaacctgatttagataaggaggtcctggactttgttccaatgctgcagagagtgagacttctgtggggagaggagtgtcctttgcatttgggaaagatgtgaactactgtggccagagggtgaactatggtagattgcttctaaagatgggagcagcaatgtttcttcccaagcaacattctcctttgaaatgtgactttgccacccatcgcatcaagagggtcttagatacatgatggcactgttggcttcctgaagacctcttcatcctgcagaaggtgcaactccacagcatcctgagaggttggacacaaggcttggaaagaatgaatggtgcctctcggtgaattactacaacctgaatcctgtgaccccacctgtgatggcccaatgttattgaaattactgactccatccacttagcaagtggtaaatactctgcaggcatagatttgactaatgtgttctgttcagcgcctatttcaacagatctcagctgcaggttgctttcacccccgaagggacacaatagaccgttatctggctaccacggggtacctcgacagttctgccaccatacacaatctttgcaggcaggatttgaactgcatctgac

SEQ ID NO: 3576 - DNA, 604 bp, Homo sapiens
cgcgctccacctcgacgcgggctttgtcgttggttagctggtccacctgccggcgcagctcccgcatctcctcctcgtagaggtcccccaggcgcgacttgccttggcccttgagctgctcgagctcggccagcaggatcttattctgctgctccaggaagcgcaccttgtcgatgtagttggcgaagcggtcattcagctcctgcagctccaccttctcgttggtgcgggtgttcttgaactcggtgttgatggcgtcggccagcgagaagtccaccgagtcctgcaggagccgcaccccgggcacgctgctccgcaggcgcacggcagaggagcgcgtggcatacacgccgcccggggacgaggcgtagaggctgcggctggtgctggggcgcagcgcgctgcccaggctgtaggtgcgggtggacgtagtcacgtagctccggctggagctcggccggctcgcggtgcccgggccgccgaacatcctgcggtaggaggacgaggacacggacctggtggacatggctgcggagggtggcgatggcctgggcggcggcggtggcgcggactggctcccggagaagaggcgaacgagggcgcg

SEQ ID NO: 3577 - DNA, 1539 bp, Homo sapiens
attggctacggccggggaccccttcccgcagcagactccccattggctgaagccggggaccgcgagacccttcgtggtaatggaaccggggaccccgatcagctccttgcccccccccaactccccgttccgacggcgccggcgggatgcgccccgcctcccctgaaggccggggctgcgagccctgactaggccccgagagccgagcgcggcccctcagtgctccggtggccgcccggggaccctttccgtccgacctgttcggacctgagggggccctcccccagcttcacggggactccccacccagccggtgcccctgacggtgccgggtcggggtccgccccaccggaaccgagccacagcctctgggtggccgcggctccctcgcccggagcccacccttctcacctggcgctgccgatggcggctgcccccggcctctcctggtgttgctgcggcggcggcggctgcggcgccaagatgccttcggctccccggcggagcccgctcccggcagcggccacaggccccaggcagggggaggcggccgctggaggcccgggaggagccgcagaggtggccagcggccccgggaggccgccgttgggagggctggtgcccccggggggccgacgggccacggcctgttgcgtggggggcggctgctggggctgggagggctgttgtagcggctgaggcttcaacatgatggcagcgtccggaaggggaattagagagaagggagggagagagggggccggggctggggccccgctggagagcgcgggaagcgagggggatcgggcagccggggcccgccgtgggcgggcggggggagccccgcggtgtcgggggtggagagagaagaccgcggcgcgaggaagcgccgcgaggcggaaggggagggggtctcgcggctggaggaaagcgagagggcgcgagccgggctggcgcgcgtgcgcgtcgccggggagcggagagggaggagcgcgcgggtgggagctcccggggggggggggggggggggggggccaggagcgagcagtggcgcgaggtgccgcgcacaccggcgcggttagctcccggcgggaaagtgggagagaatcaagtcggtgaacctcgcacccctagccctgggagtgggtaaggagcggcgcgggcgctcacgcgcgccaaggatttagggtcttaaggtctcaaaccgccttagaagccggcggccgctgtcgcttcacaatgagcgtgtgaggcgcagggggaggagccgaaggcgccagaggaagggccggcctctccgcccacgccgtcgctgcgtcgcgatgcctccgcgggagtgtgaggcggcacgtcgtgcgtgaggctcttccgccacttggcggcccgtgggcagagccttaagtgccaagaaagtctccgggactggaccacccgagccactgcgcttttaggcaggtggtaggtttcgcaaggagctaccctccaccttgtttgctttaagtaaaagactgatgagcattagtgattcgtttgagcgtg

SEQ ID NO: 3578 - DNA, 2243 bp, Homo sapiens
ctgagatccaggtgccggcagggccacaccccctctgagggctcggggtaagaagcgtcctggcctcttccagctccctgtggctccaggatcctgggcttgtggctgcgtcgctcctgcctctgcctctgtcttcacgtggcctgtccccatgtatcttttcctctcctcctcaggacatttgtcattggatttagggcccacccagaatccaggaggggctcatcttcagatccttaatgacatctacaaagattccagggcaggtaactgcagagctcccccgagtcctgtgcacgcctcggctcacactgcagctcagcagcagcaacgcgggtgacagaaaccagctctgtgtctgtgagcctctgcctcaccttctgggggatggcacagtattgctttaattcagatgttacagtcacatccagtgctaagggctgtcctagctagaaagtgggaaggtgcccgggctgcaagcacagccttgggggaggatgaggccacataattctctctgcccacactctcagaatgccccaagaagttagtagctacacaaagccaagccttgggggaaaacctggtccgtggtgtggactctccaaaatgcagacccaaccggaggccgggcccgcctttccatctggaggcactgcagggcttctgaaagcggcccatcccaggagcctggcaaacacccccagagaccctcaggatgcgccagccccggggctttgtcctgagaagctggagctccgtggcccagcttgtggatgggtgcccagggggcaggccccatgccctcagcacgtgctgacacgctccctccggctccaacaaccacaccagaaccttccgtagaacatttaagtaatgaagtctcaacattacagtaaaaaggtgcaaagggtctcttttacaaatatttatgtacagccaagatcttgttgagttcagtatagcatgctgcgcgtacacatacgcagtgtgcacacggattcagggaactgagcggtgagcggcacgctggaagacgagatcacacatgatgctattttacttttgatcccatgtgctttcctgggcatgatattttagatggaactttttctggtctgtgatctttggtagaaaaaaggtctctaggattattataaaaatgttgcatctattaaaaagaaaagggaaaaaagacagcttgcctcagctggcccaacccctgtcgcaaacacctgatcgcagggtggtcccctccacctgggtaggccctgtccaccttctgtgatgggagagagcccacagtggttacccgaaccacccttctcaggcctcgctggaggccccggggctccaggctccctgtcatgtgctcagcccagtgttcctcggtgattcgtaaggactgggtgagtgaatgaatgaagtaaggaaaggtaaaaccagagacgtgagggccacgggtcacctgtgactcggccaagctgctggctccagtgccagcccctggttgtggattccagaactttctaggcaacaaagtaacctcccagcagaggttatcaccaacaagacgcagctgcctgcctgagacacaccccaacaggaaacacccttggtgcagtttaaccagggggcccgaaggcctgagagaaggtgcgtggccatgggtctcgcggctggccacacggtaagtgggctccatgctgagcctgggctgctctgccctgccacccctccaggcttctgctcctggcaggctctagggggcagccagtccccacacatagggcacagttccacttggcagactcagccacgtttattcgcctttccaaatggcgactttcccctcctccctgcccgacccactcagcacgtatctgtcctcagccgagcacagcgtcctcacggtgtccatgtgcgccaccagctccttctccacggtcttcctctcggcgtcaatcacgtagattttccccttgggtgttccctgccccagccctcggctgcccacccagacctgccagggagaaacgggaggggtcagcagggaaagaagcccctcccaagagcaccagggctttgcccggctacccagaattgacgcgtgtgcctccaaatctatgtccttcctggacagggcctctgccgcctgagggtcagggccgcctggcaggtgcacaggacccttctcgggcttagaacctaatggccgaggggcctctggggaagaagactgc

SEQ ID NO: 3579 - DNA, 459 bp, Homo sapiens
aattcatcaacacagacaatgggtccacgtcttgcagctacagctgctgcagctactcctgctgtccgcaccgttccacagtataaatatgctgcgggagtttgcaatcctcagcaacatcttaatgcacagccacaagttacagtgcaacagcctgctattcatgtacaaggtcaggaacctttgactgtttccatgttggcatctgcccctcaagagcaaaagcaaatgttgggtgaatggctgtttcctcttattcaagccatgcaccctactcttgccggtaaaatcactggcgtgttgttggagattgataattcagaacttcttcatatgctcaagtctccagagtcactccattctaaggttgatgaagctgtagctgtactacaagcccaccaagctaaagagactgcccagaaagcagttaacagtgccaccggtgttccaactgtttaa

SEQ ID NO: 3580 - DNA, 2343 bp, Homo sapiens
acctctgcaatcctccctatagcaagatgggtcaaagcctgatccctacccccgaaaatgggtgtcaagtgtctccgtcaaggacagacttaagactcacccgaaagaaaacgagacttctggtaaagccctagagacctgatctggcatcaccggctttgctctatttgctttgaggaagccatccttccctggtcgtcttcactgcatctgctctgtgtacagaatccttctcattctaatccaccttggtggcagtaagtgcttagataagcaaacttggctcaccaataccatgaggttctttggtgggtgaagagatgtttccttttcccaggtccccttacttcctctccatccccccactaaactcccatcttctctctgtacttctctcaccttgtactcctgcaccacctcctccaatggcaccacgctgtgctgtttgtggctcctggattctcggcacaccacacagatggcctcttcgtctacctcgcagaagagcttcagggcttcttggtgtttgggacagatgccctgatcggtcacgcggctccctcgaccaggggttgggtgcatctgccgaatcacctggaccatattggccagctgcaggttggggcggaagctccgccgaggaaagctctttcggcactgagggcatgtgaagcacctccgaggggctggaggcgggggcagtggggtgacggggtctagatcctcttcctcaacctcctccagcacttcctcctcgtcctcctcatcctcccccctcaggtcctcctcctccatgtcccccaagtagtagtccaggtcttcctcctcgtcctcctcctcccacacatagtccatgttgtcccagctggacctgctcatgccactggtccagaacacaccctcttcttcctcctcgacctcctcctccatgtcaccctcgtagtcttcatcccgcatgggggtgtcccaccccgcgccagcccccacagcctccacttcctcctcctctccgtcctcctcctcctcctcccgatctaactcatctctgtcctcctcatcctccccaccccacaactgggttacacaaactcggcagaagttgtgcccgcagccgatggacacggggtccgtgaagtaatcgaggcagatggcgcacaccgcctcctcctgaagggtctgcacagggttgggtgtcatggcaacggcagccatcttagtgtccagccagccagtgtagaggttcggtgggggggcgaggggcgggggtcttccctaccgacgccctggcgacccggctccacccccagccctgcccctccacacctcgccccaagagcagccagagagatgtcctgccgacaacccaccccaacacagtgttccctactcccaaacgacaaccgtgtctctacgaggggaggggacagtgctgggcgccaccgccaagtccctcaggtggctctgagtacaagtctgccccaatgctcccttggactcctcataaacccccgcccctcctcacttcctggccccgcccctagcttccggcctccttcccaacacttccggcgtctacacaccacctaagctcgcgacttccctccgctgtcctgctactccccctttttccccgcggggccccagggcgacaggaaatggcgaggagacgctctagtccgcactagagaacagggcgggagggctaggacggtggaggcccgcgtctctgtggtaagaggccgcggggaacgcagaaagaacagaggaaccgcctacccccatcccccgccgctggggagaaacttcggggggtagggggagcgcctggcggccgtctgctttcggtgctatcaccgcatcggccagacgccatcctaccctcccggcacagccgactgcagccggtactccccacagccgatgccggaagcgagggggtgggtccgcggcgcgccctgaagtacttccggcccttctaggcagacgacttcgttgtggaggactcagagggtcgtccgggtcggaccgggggcggggcctgagaaagcgcttcgcgggttagggcagcagacgccccacccttccccaactgtagtcggcgtttcgcatccgaggtagaaactgccaaccggacactgtctcatggtttagatgaacttccctaactgcccagcagtgaagaagtggtgacgaatcattacatctacattctcacagcatctctgcaaaaatagatgctttgtgcggtagaaataatacttgatgcttaaatagctctttaaattttatttttatagagatttgatgtcgatacataaataaataaatgttgtttgatgcgag

SEQ ID NO: 3581 - DNA, 6352 bp, Homo sapiens
gctccttccttgccctcgccaactctggtctcaggccccgctgcagctgcggactcggggctcccccgaccgtgccgtttggccgctcagctgatccctccgcgagggggtgcggctaggggtgggaggaggacacggcagctgcggtgacggcgggcgggtactggaggatcgtcttccgcggcagcagcggctttagcgcggaggtcggcaacggcctcgggcgccccgccgcttcggatatttccgccgcctgcccgctttggctcttcccgcccggcctgcgttgtgcgcctgcgcagccgccgcaaacccgcgttgctcagcgatggagtttggggttcggcctccttcggctggactcgggcatttccgttcatggagatgacgcttcggcggccttgcaggtcacttccggcgactttcgcggggccgggcaggaagcggagttagtcgccatctttgagtggggcagacgtgggccgcttttgctcgcggtcacttcatcttaagttgtatatatgtgcagagcgcggcgcgggtggtcacctccgctgctgccgccacccgcccggcctgcctttgaccctatgggtcacagacaaggcagggtgatcgcggcaagaccctgagtgagactagatgcgttacccagagggtgcgaggtcgagtaccttccctgtcccatcgcaaacccaaagatccccgttcctggagattctgattgaggtaaactaacaaaacatgtattgtgccagagagtggtaagcactgtggagggttacagtggtgtaggggaagacctgtcggggtggacacttggggaacgcgacgtgggggcggaatcgggccgctattggcgtgggcctcaagttccagcggacacgcactgcagcctctgcgcttcccccactatctggaaaaggggatggaggcgggggtcagcttcccatccaatcacagctcagcgtgcctcggagggcgggaggaaacggaactctgccggtcagcgacttccggccgtcaccacggaaactgccagccccgtgagcgcatggtgtggcacttgcctgcggaggggcccaggcgccactcctctgattctgcagatgctcccccaggagtggcttctggccaaggccaagccccttctttgaaactgcctttcagcctgtgttacctgcacccaagtcacccactggagggttgggggagaggggctgtgtgaaggacctggacaatgggatggaaggggaagatggctagggcaaaacaggcaatggcactgggtcctggagacgctgccctgaagcctgcagtatgctgaacttatgctctcagcatctgtccactttcacctaagctgcgtttccactggtttgctgctgaatctactcctgactgaaaccttccaatgtgcatggggccagggtgggagaagccttcagctctagcgatgggaatgatcaccacagggcagggaaactggcccagggcctgcagcctttgcttctcagactggctggggttccatctgcagggtcctacaccctcatcacctgctgcttgtgaacacgagaacaggaaagtcttgaaaaatctgaatttccaggtgaaatcttctagttttaaaactaggaaatggtttcctaggtgtaaaggagttttacaaagacatcctgaggcagaatctggatcaccaggtgtcagtttgctcctgctggatcgcataatcttggttggctagggagattctggcctgtctgggtcctttcctggggtttggcttggcccatggcccaggggacagccgtgacagggtgtggaggggagcatgcaggttgcaggcatcaagtttaggcacagtaccacccacaaacctgggggttggcagatccaagtgggatccttggctcccagctgtaagaagtgctgtgaccccactgcttccctttgttcctctagtactaagggtgagatgctgaatgtccccatgagtacaactcttcagcgggtactcctactgataggtagataaaggtagaaagctttggccgctcaggaccactttagggagtagggtgctgttagggtaagggtagctgtacagctgagctggggtgggagaggtagtatcatgggaatgaatcattaacgctgacttggagcaaggaggactggtgctcaggaggctggtaacctccctgaggattgagtgttctcccagcccttggaggccctggtctcagtgtcaagggaaaatcccatgggatttcatcaccagacaaggctgggctccagacctacccacctaggcatcactgtgcagggcagagactacaaacacctctcttcacttgcagatctgttaagggcaggctggaacaggggttggaaagggagaagagactaggccagcaccacctcttccccttggcaacagcaggtccttccaggagcaacagtttttacatacctcccagaaccaggctcactgggccccttggagacacccacaccagtgccccctcaggagtctcctaggcctatggggcaccctcttgagaacagagacctccagaccagctgagcagtaccccctcaggcccacagggcttccctgccagctaagagaccccaggactggctcagcagtgccctcttctcaggggcctgagttccagctccatgggaaactcattggagcttctaagttgcaatgcttccctttgttcctctagtcctaagggtctagctgcttcctgcaggaactttcccatttctaagacagattgacttaaccttctcactctcccatcaatcacctaacacctagttagctgtgctctgtctcttgatgggactcaatcagatcaggcatggcaccatgctatgcacatatgtactcttggtggatgctcacagagaacatttcttcctctctgggtttgagaaaccgaggtccattgcccagggagagctgaagctggactgcccagggcagttctgccccacctgctgctggtccattccctctgtaaactagaagctgggtatagcggccatcccacacgcggggtaggtgatgctaggagccacctctctcagggtgaagaggggtgttgtggaggtgaaccctcacaggaaccacgtggttacagagggagcacaccagcccagcactcggggggctggagggtggggagtgaaggacgcacaggtagggaggcactgagtgggtggagacccagtttccatctactgtttattggacacctacagtagccaagccctgggcggacctgcttatacttatgtaatcgccagcctcacaataaccaggggaggtaggtgttctgaccatggcggacacagtgcgtcccggctggagctactcggcgctgtggacgcgctggtgctgaatgagcttggtgctctggtggaagcggcggccacagtcctggcaggcgaagggcttctctcgtcggtgggtgcgcagatgctgcgtgagcgtgggccgctggcggaaggccttgccacactcagggcatgcgtagggccgttcacccgtgtggatgcgccggtgctgggtgaggttggcgtgctgccgaaagctctggccgcactcggggcaggcgaagggccgttcgcccgtgtggatgcgctggtgctcggtgagccgcgagacctgcgtgaagcccaggccgcactcaccgcagtggtagggcttttcgccggtgtgtgtcctctgatgacgcgtgagcttgaggcgctggctgaagcgctggccacactcggggcaggcaaagggtttctcgcccgtgtgtacgcggagatgctgcgtgagcgtaggccgctggcggaaggccttgccacactcggcgcaggcgaagggccgctccccggtgtggatgcgccggtgctgcgtcaggttggagcgctgccggaagctctggccgcactcggcacaggcgaagggccgctcgccactgtgcacgcgccggtgctgcagcagcactgagcggcggccgaagcgctcgccgcactcgacgcagccaaaggacttgtcgcccgtgtgtaccgcctggtgctccagcagcacggcgcgccgcgcgaagctctcgcggcactcgctgcacggaaaggggccgggaggctcgggcgcaccaggaggggccgggggcttagcgccagggcccgggggatcgccgtggatgcgctggtgctgcagcagattggagcgctgccggaagctctggccgcactcagcgcaacggaaaggctgttcgcccgtgtgcactctccgatgctcttccaggcgcgcgctgcgcacgaagccctggccacagtcgccgcacacgaacggccgctcctcggtgtgcgtaagctggtggcgcagcaggtgcgagctgcggctgaagctgcggccgcactcgctgcacacgaatggtcgctcacccgtgtggatcttctggtgcctcagcaggttgctgcgttggctgaacaccttgccacatacatcgcaacggccgcccctaaccaccccgcccccagtgctggggcggccccggctccggcccctgggggagcgccagcgggtggtgatcagagcagggcccacaccccggcagggatcctcgtccgtggggtcctgttcactcctcagatcgctggggagcagaagcgcatgcgcaaagccaccttcgcgggagggtgattggatctggccagaaaggccagccatgccgaggtcccaggggacgtggaggtgagggcttacactacctggacctgcggagatgctgcctagctgcagcgcgaaccctgcatacacaaggggaccattcattcatgacagaatgcccaccgtgccgggacccacttcatccctggggacacagtgtgaactacagggacctgaaactgaccaaagaggcagacggaggcgacaaatgcaggggtagggattctatctgtacagacttccctgatgaggtgataatgagacagaacccagcacaaggaggaagactgggctatgtgaaaaagctttctaggtctgatttaggttggaaaaaatcgtttttggaagggctgtagggcaagcgtgggggcattgtctaggtggaaaatgatggtctcagcaaatgcagggaagtgggtgggtctcggaggctggaggtggagccaacagaaagagggtgcaggctcctggatagtggtctggggtttggatgtgccttgcttgtgatgtctgtggggcatctgaggaacacagacttcatgaaggctgtggggaaacgtgagcaagggctctagggcatacacatggcacacagaacccgggcctgcaagtgatcaacacaggggtgggtatctacagaggagagaagtgggtcccagccacactgtgagcactccagcgtcagacgctgggtgaaggaggaggcaccagcaactccaactgagaatcagggcctggagaaggcggaagcctggaggaggttaaatcaagaagactgagagagcagtgagggcttttagtggtgagagaaagtccataagtcgccaaagaaaagtcagataaactagaatacatcaaaggaaatcagcaaaaaccacatcagagtcaaaagacaaatggccaaaaaacaaaaaaaattaaaaaaggacaaatggcaaaccaaaaaactctccacaggcaaaaggctaattaacctcctaagtaaagagctacaataaatcagtaagaaagatcaataacctcatagacacatgggcaaaggatgtgaacaggacaggaaatgtagctaatgcttatatcccataaaatacactccatctcctcctagtaagaaaaatgcaccttagggctgaactcatctgccatttccacaccctgactgcagggacccaagtgttcctatgtattgctggtaagcataaatgggaagacagtgtggtaaaatccatcaaaacagcaaatgtcccacactttgttcaagtaattcaatttttaggtacttcttcaacagttgtgttcctccttgtactaagtgacctacatacaaggttttcaatggtgtgtccacagtgagccacagtggggttctgtgtagctacccaaagatgtagagcacttgctgctgtgtacttaagttggaagatgcacaaaaaatgccagatgtggaacagggtggagaataagcatccatgtgtgtgttttttttttttttttttttttttttttttttttttgagactgagtcttgctgtgtcgcccaggctggagtgcagtggtgtgatctcggctcaccgcaacctctgcctcccgggttcaagcgattctgct

SEQ ID NO: 3582 - DNA, 300 bp, Homo sapiens
agttgttatacggcttttgtcttaacgaagccacccattacggtatgatgatgtcaaacgtgatgctgatgctacagttacagcccctgctggcgcagcctctctgattctctctccctctccgcgtccagtgctgggctttttcagacaagtgcatctcctaaccaggtcacatttcagccgcgacccactctccgccagtcaccggaggcagaccgcgggaggagagctgaggacagccgcgtgcgcttcgccagcagcggggtgggaggaaggacattaaaatactgcagaagtcaa

SEQ ID NO: 3583 - DNA, 1098 bp, Homo sapiens
ctttgctcttcttcttctttcgtctttttttcttggctgcttcctcagccgtagaggcagctccttcttccctgtcgtctggatccaggtcgccattcaggtggctcccggaggccgctacctcctccacacccgccatgttgcccgagagagcgcgagggaatgagacagagcggcgagggccccgatccttctccacccgcctacaccagccacgccggaagctgctctcgatggtagggacgcagggaatgctgggacggcggaggactcagctgagggtgtcgggctagcttcgggccgggcgtgcaggagtctcggcttggagccccgcctggctggagtcgactggggccagacccgactgcttcgtccggtgcctcgggcattcccgaagcaaatcggcaagcgcagggtgaagtttaaaggggaagttgagctctagagtcagccggagatacctgtggagacgggcaacccgccgtagcaagcggcgtctctgctggaacggaaatattttatatttgcgtttttataaatcacacaggcagtggggaaacgggctaagaaatgtgttcacttgtacacatttctattgtcatgactccacatatctcttaaatctaagagatttaatcaaatctgcgttgacattcacaatcacagctctccgcgaggctctgtaggcactggagagaattttggaagctggagttccgtgttagtttattgtactactcaaccccggacggttcaagatgggaacccgtcacactccgctcactttccaattcaggacaagaatgacaggttttaacacacggggacacggtctctctcattaatgcaaaagatcacactccgttttctctatttctggtcacctttcttttggatttaggacgtttcaccagaaactaattgaattttgcccatttctttacttcttatgttttgagcctcatgttcaaaccgcagtttgagatttagtttgtggcgtaagtggattgtgattggctgcctgcaccaactccttctcaatttctcctgaatatggctttgtccacctggagagtttaggtgttttcattagtttta

SEQ ID NO: 3584 - DNA, 1670 bp, Homo sapiens
cgtcagctcctgctcgattttcttctccaggaactcctgtttcttgcttaacatctcttccgtgtcccgcagccgctggatggcctcctggggggtcgggccgcccttgccggccttaccccctccagccccgaacagcttcccgaacaccgacatggttgctgctcgccgcgccggccttcgccgcccgctccggctcggctcggctcggctcggctcgggtcggctccggcgcccgctcccagtcccgccgctccctgccgccgcaggcctctcctccgcctccgcctccgccccgcagctgggcccggccgcgccacctcccacaggcccccacgcccggcccggcaggcgtcagggcaacgcgccactgactacaactcccagtgggcaacgcgccggccgcgcctcaaatctaatagggggaagcgtgctgcatgccgggaagctatagtcttccggcttcaggcgctccccggcgcgtcttttgctgtagctggggtcaaagggcgtgtggcattctgggaaatgtagtctccttggcctgcgctctgtaggagtggcagaacagtaagagaaatgacaaagcaagaggaacctaatactcttcctcattggccttcctgtctccatctttattccttccagctcattctctacatgacactgtgaatgccaaactgtctggaggctgccatgagcggccaatttgtgatctctgctttacctgaattatttccgtgaattgtgacatcaacctcgccagataagaaagaagactgaagttcagagaggtgaagggactggctcaggggctacccctatggttgcgggagctaagattccagcccagcagcgtgatccagagcccatctgagctacccagatcttcctgctgttaaacccgtcctggggcagctcttgcctgatgggctacctgaggaacccacaggaaatcaagggaggtgcctgcaaagttgccgtggggtcacagcctgccctttggaaggggctgtttctgggctgctgtgacttcctgccattatttcctctctgttctccctctggaatgaataaagtacttctgaaaaaccatcaacccagtcgatacggaaatgctggtccctacaatagaatgctctgtggtcattaaaaagattaaaaaggtcaatctgtgtttcctgatctggaaagatctcctggacatactgctagtggggaaagaaagcagtagaacagcttaacacaatctcgtctttcttagaaaaaaatataatccctactggatatgtaagctccaacaaaaaaaaaagaaagaaaaaatacaacctgcacaccccaaaaaagccctggccatgtgtctctgtaaataaactgaagatgcaggaagaaagatggggaggtgtagggaaaggacagaccaaagtgtcagtggcaactacaacttgaaggggaaatttaacattttactttatgtactcctatattgtttccatttttataataaccatgtattatttgtgtggttttttttgttttgttttgtttcgttttttgtatttttttttttttttttgaaacagagtcttgctctgttgcccaggctggagtgcagtggtttgatcttggctcactgcaacctccatctcctgggttcaggcaattctcct

SEQ ID NO: 3585 - DNA, 812 bp, Homo sapiens
ttcccgtctccctccacaccttgcctcctccaggcccaaccccattccaccagcaccccgccccaggcgcactggctaggactggaaggcaaggactaaggtgaaagctgactgcccgcaccgccccaggcgcactgggtaggactgaaaggcagggactaaggtgacagctgactctgccggggcggagtgcgtgtcctcccaccgtgctggcgctgaactgactgtccgctgccaagggaagtgacagccgcagccgggctctcagccagcggccaggcgccccgcggaccatgctctccagtacgcagaacgcgggcggctcctatcagcgggtccgcggggcgcttgatacacagaaatgcagtccagagaaaagtgcctcatttttcagtaaagtgacatattcctggtttagcagagtaattactttaggctataagagacctttggaaagagaggatctttttgaactaaaggaaagtgattccttctgcactgcgtgtcccatctttgaaaaacaatggagaaaggaagttttaaggaatcaagagaggcaaaaagtaaaggtatcttgttataaagaggcacatatcaagaaaccatctctactctatgcattgtggaacacctttaaatccatcctgattcaagttgccttattcaaagtgtttgctgatattttgtccttcactagcccactcataatgaattataccagaaaagttaattatttgatgggcctgccatgtgaaaaccagaaaataacctcgtactcacaagccagtggaagggattcctgattttactaa

SEQ ID NO: 3586 - DNA, 12429 bp, Homo sapiens
ctttatttgccttgtacagcatcaattttcttacattctcagttaattggccattaaagtgctggaaattttcttaatcatgataacatttgttaaaaagaaatcagaactaatatcaggaacatggcggcatgaaggaaacagttcccttacaaaacacagaaaatggaagcccctcatgttgagggggtgggttggacaatttgcaaacagattctaatttcctctcaccgtcagcaccaaactggctgggaccaccacccctgggtgaaagaaacaacactaaagaaccctaaaaacacccacacaccctgactaccaccacctctgggccatctgtgggcgtttgctgtttgaacagatccagtctcaggaaagaggaagacctgacctccgtctgcaacccatcaccccacccacccttactaacaaaagcccccaaagtcattacaatgaaaaagtgggtttccattaccccaaaactaacaatgttcagtaaaaatgaggataataaacacaaaagcttgcttagtaaacaggagctctcagcagtcaatgcaaaaaaatatatatatatgaaatcttaaggcaaatactgttgactttgcacatgggctggacgaacttggaactctttacctatctgtatagttccaggagcctacaggcggtcggtttttcagcgcttgccaccgggccaggcaaggtctttgcatgattgctgaggcagtcggtgtgtttccctttggagtttatataggaacacaccacccaaggctgatgttttgttatatatatatatatgtacacacatacaaaggcctgctactctttctttgtggaaactgacagctccacctcgggaagctggatgccaaccttattcccactgtcattgctagaagaggaggacagtcgggacttcttagaggccagggacaccccactcccctgtaacttgcctgtctcatcatcgctcccagtcacctcataatgacctttgctctttgaccccaatccaccaaaggtaccgaatttcagcttcccgtgtttccctttaactttcccaccttccagagacacttccccaccttcaaactccagcgtccccgtcggggtggaaggtccagagaactctctttcatcactgaatgaatttgagcggtgccgtggcttcttacttttaaataaggagaatttgcctttcggtgaagaggcttcggcctctgcctctccttccagagagcccaggctggcctttgaacttttcaggtcacctttggacccagaaattgatgcttctggtgagccagtgacaccacctttccctttaggtttggaaaaattaaacttgggcattttgatcttggactttttcagtttgacttcagactcttcccactcgccgtctccagcaccagcttggatgctggcctctgctttagggaagtgaacatccacccccatttctctgccaaccagctcacggccagagaaggtaaatttggggatcttcattttagggaatgttacttttccagatccactttccaagtgaccttgaggcccagacacactcagcccaggagcctggagtccaatctgacctcctttcacacctccttccacctttggtcctgagaaatgaaggcccccagcaaacttagatgtgtccaagttgagagcagaggagacttggggtcccttccactcacccccggaacctttaacactcaaatgcccttcaccaaggctgatgtctggggcactgacaccccctgaaacatccgcacctcctttgatttttgggcccttcaagttgatgccaaaatctgactcaggagatgccatattaaaggcaggccccttcacactgatatcaggagcagccccatggaaacctacttctgaacctttcagaccacctttgatttcaggcccagaaatctgcccagttgggagtttcacattcacgcctggcaggttcacatcacatccagaggacttaattccaggcatctggaggtttccttctaggccttgaacaccaatgcctggaagacctcctccgacagtggggcctttgatctcaccagtggccccaaggctccctttcacttttggtccttccaagttaaagtccacattcggtgctgaaatccgaggccctttcaggttcacatccacacctggccccttcagttcgccagaaacctgtggccccttggcattgacgtgcaagtcggaccccggagtagagatgccaaattggggcagcttcattttgggaagtttaatgctgccttcggatgcctccaagcttagatcaggagctcctacggatactttagggcatttgatgtcaccagagacagccagatctccctgcaggcttggtcccctcagtgtcacatctggtgccccaacgttaagctttgttgtggcatcgatccctggcactttcacaccgtctcctcccacctgcattttgccaccgacaccactgaggttgagccctggagcatgcaccttcatgctgggaacagatgcatccaggtctcccttcaaacttggtcctttcaagttcagatcaaggtcaggcccagagacttttggcatagagaggttcactgaaggcaagtctactcctggcccctttagagaaacatcgggcccttcgagcttaacatctggtcctctcaagtctccttcaagagagggtagctgggcatggacctcggctcccccaccctccattttcacacctgggatgccgatcttgggcatggaaaacttggggaacttaatttttgcttctggaccttgcagatctacatctggtccttccagtcccacgctggggacatcaccctttatctttggtcctttcaagtttacattcacatcagggatggagacttgaggggcagaaatgccgaaggacggtgttttgactttagcatctaggccttcgatgttgatgtcaggtgcacccaagtttgcctgcactttggggcctttcaggtcaccctctatttttggcactgagatgtccacatctggcatcttgaccttgggagccttcgccttgatgtcaagaccttcgacgtgaatcgctggcaaagaaagttccagatcaggtgcctggagttcaccctccagtttggggctagggagaggggcctcagctttaaatttaggtgatttaatgtcaaactctacatctgggaagtacatttttccaaacatcgttttcttggttttgggcgatttcacgtcgactttgagtgcagcatccggccctgcgatgttgacatctacatccggagccttgaggctggcatcaatttcacccccaggaacattcaggtcaaatccctgttttttggccttaatcttaggaccactcatatgaattttaggcattttaaacttacttttcttgcccttgccaccaacactaatttcaggagtctcaaggttcagctctgcctcaggaacagtgacatccagtgaaggtgacttgatgtcagctttggggctttttgccccaaatccaaacttgggtttcttaaatttggggattttaacatctggcccttcgatgttaatatctgggctgtccatgtgtacatctaagcttggagcttcaactttgggtcccttgaggtccacttcaccaccttctaacttcggacctgaaaatccaatttttggtgccttgagatgcaaatcaacatcaggagcagttactttaggagcagatatctccagcgatggcatcttcaaagatgggccactgagtttggcatcagggccttcgaaatccagacgtggacctttaagatctacttctgggcctttcaaagtcccttcaaccttagggacagacacatcaaaatctccttttactttgggtcctttcaaatccaggtcaacatcaggtatggagatcttgggagctttgatatttatttcaggcatcttgaacttggggcccttcagttttgcgtctggaccttcgatattcacatctggaatatcaacgtccaccttgggtcccgagacatcgatgtcggccttgggcaggctcacatccacatctggaccttctcctttgaagccaggcatgctgaatttgggcattttcaccttgggcatcttcaggtgccagtctgggccatgaacatccacatcaggggtgttgatgtccacttttgggcccttgatgtcagcttctgggcccttgaggtcaccttccactttaggaagggtaacatccacatcgcccttcactttgggtcctttcaggtttaagtcaatatcaggcatggagatcttgggggctttgatgctcatctcaggcatcttgaacttggggccctttagtttcgcatctggaccttcgatattcacatcaggaacatcaacgtccactttgggtcctgagacatcaatgtcagccttgggcaggttcacatccacatctgggccctctcctttgaagccaggcatgctgaacttgggcattttcactttgggcatttttaggtgccagtctgggccttgaacgtccacatctgggacatcaatgtccactttggggtccctgatgtcaacttcggggcccttgaggtcgccttccactttgggcagagaaatgtccatgtcgcccttcacctttggacctttcagattcaggtcaacttcaggcatagagatcttcggtgccttgaggtgtaagtcaggcattttaaatttggggcccttcagtttcccttctggaccatgaatgtcaatatcaggagtgtcaatgcccactttagggcctttgacatccactttgggacctttcagatctccctccagtttaggaacggaaatgtccatatctccttttatcttaggtcctttcaaattcaaatcaatgtcactcatggagatttgtgggcttttgaaatgtacatcaggcatcttaaacttgggacctttgagcttcccttcaggaccttcaatgtctacctctggccctttcagatcactttccaccttaggtagtgaaacatccacatcacccttcaccttgggacctttcaggtgcaaatcaaagtcaggcatagagattttgggagctttgatgttcatctcaggcatcttaaatttgggccccttcaattttccttccggaccttcaatattgacatcaggtgtgtcaatgtccaaactggggccttttatgtcaatttcagggcccttgagatcaccttccactttgggcagagagacatccacatcacctttcactttgggacccttcaagttaaagtcaatgtcaggcatggagattttgggggccttgatgttcatctctggcatcttgaactttggacccttgagttttgcatctggaccttcgatactgacatcaggggcatcaatgtccactttggggccagaaatctcaatgtcagccttaggaagggtaacatccacatctgggccctctcctttgaatcctggcatgctgaatttgggcattttcaccttgggcatcttcaggtgccagtctgggccatgaacatctacatcaggggcatcgatgtccactttggggcccttgatgtcaacttctgggcccttgaggtcaccttccactttaggaagggaaacatccacatcacccttcaccttgggacctttcagatgcaaatcaaagtcaggcatggagatcttgggggctttgatgttcatctcaggcatcttgaatttagggccctttagtttcgcatctggaccttcgatattcacatcaggaacatcaatgtccaccttgggtcctgagacgtcaaggtcagccttgggcaggttcacatccacatctgggccctctcctttgaagccaggcatgctgaacttgggcattttcactttgggcatttttaagtgccagtctgggccttgaacgtccacatctgggacatcaatgtccactttggggcccttgatgtcaacttcagggcccttgaggtcgccttccactttgggcagagaaacgtccacgtcgcccttcatctttggacctttcagattcaggtcaacttcaggcatagagatcttcggtgccttgaggtgcaggtcaggcattttaaatttggggcccttcagtttcccttctggaccatgaatatcaatatcaggagtgtcaatgtccactttgggtcctgagacatcaatgtcagctttgggcaaattaacatccacttctgggccctctcctttaaatcctggcatgctgaatttgggcattttcaccttgggcatcttcaggtgccagtctgggccatgaacatccacatctggggcatcaatgtccactttggggcccttgatgtcaacttcaggggcctttagatcaccttccatcttaggcagagaaacatccacatctcctttcaccttagggcctttcagatgcaaatcaaagtcaggcatggagatcttgggggctttgatgttcatctctggcatcttgaatttagggcccttcagtttcgcatctggaccttcaatattcacatctggaacatcaacgtccaccttgggtcctgagacgtcaaggtcagccttgggcaggttcacatccacttctggaccttctcctttgaagccaggcatgctgatcttgggcatttttatcttaggcatcttcaggtgccagtctgggcctcgaacatccacatctggggcattaatatccactttggggcctttaatatccaagtcaggaacttgcatgtcaccttccacttttggcagagacacatccatatcacccttcactttgggtcctttcaggttaagatcaatgtcaggcatggagatcttgggggctttgatgttcatctcaggcatcttgaatttgggacctttcaactttccctctgggccttcgatattcacatctggaacatcaatgtccaccttgggtcctgagacatcaaggtcagccttgggcaggttcacatccacatctgggccctctcctttgaagccaggcatgctgaacttgggcattttcaccttgggcatcttcaggtgccagtctgggccttgaacatcaacatctggagcattaatgtccactttggggcccttgatgtcaacttcaggacccttgaggtcaccttccattttgggcagagaaacatccacatcgcccttgactttggggcccttcaggtttaaatcaatgtcaggcatcgatattttgggagccttcaggtgcatctctggtatcttaaatttgggtcccttgaatttaccctctgagccttcgatgttaatgtcaggagtgtcaatgtccactttggggcccttgatgtccacctcagggccttttagatcaccttccactttgggcaaagacacaaccacatcacccttcattttgggtcccttcaagttcaggtcaaagtcaggcatggagatcttgggggctttgatgttcatctcaggcatcttgaacttggggcccttcagctttgcatctggaccttcaatattcacgtctggaacatcaacgtctacattgggaccagaaatgtcaatgtcagctttagggagggtaacatcgacttcagggccttctcctttgaagccaggcatgctgaacttgggcattttcactttgggcatcttcagatgccagtctggaccatgaacatccacatctggggcattgatgtccactttagggcctttgatatcaacctctggccctttcagatccccttcaagtttgggaagagaaatatccacatcacctttcaccttggggcctttcaagtttaagtcaatgtcaggcatggagatcttgggagctttgatattcatgtcaggcatcttgaatttgggacctttcaagcctccctccggaccttccacattgagatctgggccctcaatgttcatacttgggccctctatgttgatgtctccttttggtagatccacagctacatctggcccttctgcttttaagccagacacactgaatttgggcattttcatcttgggcattttcagattccagtctggaccatgaacatccacatcaggtgcattaagattgacttctggtgccttaatatccactttggggcctttaaagtcaccttctaaattgggacctgcaatatctaagtctcctttgactttgggacttttcaaatttagctccacgtcaggcatagaaactttgggagatgaaatactcaggaaaggcattttaaacttggatcctttcacttttccttggacctcgacatcaggagcattaatatcaacttttggacctgttatgtcaatatctggctttttacctttgacatccacttcaggtgtctgaactttagagcccgaaaaattaaatttgggaagcttaaaacgagatttctttgacttgccttcgatattaagcttaggaccggaaacgtccacttctgggccctttatatccaaactgggagctttaatgtcaccttccaacttgggcccagagacatcaacatctcccttaagctttgagcctttcaaattcaagtcaatttctggcatggagatcttgggcatgtttacatgcatgtcaggcatcttcagttttggaccttttaatttggcatctgggccatgaatgtcaatatctggagcatctacatctatctttgggccttttatgtcaagagcaggtcctttcaaatcaccttctacatttgcaagtgaaacatccacctctcctttcattttagggcctttaagattgaggtccaaatcaggcattgatattttaggagctttgatgttcatctctggcatcttgaatttagggcccttcagtttcgcatctggaccttcaatattcacatctggaacatcaacgtccaccttgggtcctgagacgtcaaggtcagccttgggcaggttcacgtccacttctggaccttctcctttgaagccaggcatgctgatcttgggcatttttattttaggcatcttcaggtgccagtctgggccttgaacatccacatctggggcattaatatccactttggggcctttaatatccacgtcaggaactttcatgtcaccttccacttttggcagagacacatccatgtcacccttcactttgggacctttcaggttaagatcaatgtcaggcatggagatcttgggggctttgatgttcatctcaggcattttgaatttgggacctttcaactttccctctgggccttcgatattcacatctggaacatcaatgtccaccttgggtcctgagacatcaaggtcagccttgggcaggttcacatccacatctgggccctctcctttgaagccaggcatgctgaatttgggcattttcactttgggcatttttaggtgccagtctgggccttgaacgcccacatccgggacatcaatgtccacttggggacccctgatgtcaacttcagggcccttgaggtcaccttccactttgggcagagaaatatccacatcgcccttcaccttgggacctttcagatgcaaatcaaagtcaggcatggggatcttgggggctttgatattcatctctggcatcttgaacttgggccctttcaactttccctctggtccttcaatgttaacatcagggccttcaacgtccactttggggcctgagacatcaacgtcagccttgggcaggttcacatccacttcagggccctctgctttgaagccaggcatgctgaacttgggcattttcatcttgggcatcttcaggtgccagtctggaccctgaacattaacatctgggacatcaatgtccactttggggcctttgaggtcaacttcaggacctttcagatctccctctaccttagggcctgtaacatccacatctccttttatttttggacctgtgagattcaggtcaatatctggcatggatatctttggagtcttaaaatgcatctctggcatcttaaactttggacttttccactttccttcaggtccttcgatattcacatcgggacattcaacatccactttcggtcctgagacatcaatgtcagccttgggcaggttcacgtccacatctggaccttctcctttgaagccaggcatgctgatcttgggcatttttatcttgggcatctttaggtgccagtctgggccatgaacatcaacatcaggtgcgtcaatgtccacttttgggcccttgatgtcaacttctgggcccttgaggtcaccttccactttaggaagggaaacatccacatcacccttcactttgggtcctttcaggtttaagtcaatatcaggcatggagatcttgggggctttgatattcatctctggcatcttgaacttaggccctttcaactttccctctggtccttcaatgttaacatcagggccttcaatgtccactttgggtcctgagacaacaacgtcagccttaggcaagttcacatccacttctgggccctcgcctttgaggctgggcatgctgaacttgggcattttcatcttgggtattttcaggctccagtccaggccttggccttccacatctggtgctttaatatctaccttgggacctctgatgtccacatctggaacctgcatttcaccctctatctttggtgcagagatatctacatttcctttcattttgggtcctttaagatccaggtcaacatctggcaaagacatcttaggagctctgaagtgcatctcaggcatcttaaacttcgggcctttcaacttcccttcaggtccttcaaggctcagatctggagcattagtatctacttttggtgcagaaatgtccacattcgctttggacaggttcacatcaaattctggcccctctcctttgaggctgggcatgctaaatttgggcattttaatctttggcatcttcaagttccagtcaggaccctgcatttcaacatctggggcactgacatctacttttgggcctttcaggtccccttccagctttggcactgtcatatcatattctccctttactttaggacctttcatatgcaagtccacatcaggcatggagatcttgggggccttgatattcatctctggcatcttgaacttggggcccttcagctttccttcaggtccttcaatattcacatctggaacttcaacacccaccttgggtcctgagatgtccacatcagccttgggcaggttcacatccacttctgggccctctgctttgaagccaggcatgctgaacttgggcattttcatcttgggcatcttcaggtgccagtctgggccttgaacctccacatctgggacatcaatgtccattttggcacttttaagttcaacatcaggaactttaatctcactttcaacctttggcattgtgacatcatattctccctttacgttagggcctttcagatgtaagtccacatcaggcatggagatcttggggactttgatgttcatctcaggcatcttaaacttgggccctttcaatttcccttctggttcctcaatgctcacatcaggagcagtaacatctatcttgggcccggaaatgtccacatcagccttgggcaggttcacatccacttctgggccctctgctttgaaccctggcacactgaatttgggcattttcatcttgggcatcttcaagtgccagtctgggccatgaacatccacatctggggcatcaatgtccacttttgggcctttgagttctccttccagctttggtacagttacatcatactctcccttcacctttgtacctttcacgtgcaaatctacatcaggcatggagatctttggtgtcttgacactcatatcaggcagcttaacatcggggcctttaagttttccccccagaccctccaagttgacatctggggcttccacattgaccttgggccctgaaatactgatatctcctttgggtagagtcatatgaacatctggaccttcccctttggctcctggagtgctgaacgtgggcattttcatcttgggcattttcaggttccattctgggccatgcgcttcgacatctggggcactgacatccactttggggcctctgacatcaacttcagggactttgactttcccttctactctggggagtgtgacatctacaccccctttcactttaggtgcggccacatttaagtctacttctgacatagagatcctacaggttccggttttcccggaaggactgccaagcctagggcctgtcaaggttccctctaggtttggtgtctctatgtccactctggagcctttaagtgccacttgagggcctttaacatcaccttgcaccccaggagcagaaaccttaatatctcctttcagtttagg

SEQ ID NO: 3587 - DNA, 573 bp, Homo sapiens
gggacataggtgattcttcaggtggtggggacatagacgagatgcctccggtggtggagacatgggtgactcttcaggtggaggggacatgggtgactcctcaggtggtggagacaggcgagatgcttcaggtggcggggaagtgggcaattcctcaggtggcggggacaaaggagattcttcaaatggtggggacaggggcgatgcttcaggtggtggggatagaggcgtctcaagtgcaggagatgggggtgactcttccggtggagacaagggcgactcctccagtggagaaaaaggtgatgattcaggtgggggagacagaggagactcctcaggcggcggagagaggggcgattcctccagcggccgggacaggtgcaatgcctcaggaagtggggatgcgggcaattcctcaggtggtggtgacaggcgtgatgcctcaggtggtggggacgtgggtgattcctcaggtggtggggacaggggtgactcctcaggtgggggcagcagtggcatctcctcgtttaggggggcctccaactggggctcaagttggacccctgctttccc

SEQ ID NO: 3588 - DNA, 1190 bp, Homo sapiens
ggagctcagaagttgggcaaaggtcacagcagacttcctgaaaagcagacactgaggaacacagtggagagcgggagttcacagcgacgcagctgaggacgacgcaggacctctcccaaaggtgctgcagctccagcaccaggggccagggctgcggcgacagcagctcagcaacccttgctgtgctcaagttcttggggattcagagctaagttcaaaatttagaaacagtgccttaaagacgggcaagaaaacccggtgtgggagtctgctcatctatggtttgttactgctctcgcttcgatattcttaaattcctaggtaccaatgaaaaagccaagtgaacgtggcagagtgaggaggagacaggagcgtgtgcaccttccatctgtgagaggcacacttcagtctgggttcaagatgcagaatggtgcctacggcaaaaaaaaaaaaaaaaaacaccctcctcccttctttaccatttgaatggacattttccttacctgtgatcccaacagaaacagatccagacctatcatgtgaagtccacgttccaggatcagaagtaaccagtttatggactgagcttacacgggaaagtctacccccgactccttctggatagtaacatacacagctgcataaaaacgtctccaaggggacatacgatgcatttgcttggtgtcccagccaagctccccaccggcgacctcactgttccttagagctcaagagctcgtctcctatcaatcagagaaccccatcagctgtgaccaacagagctggagccctctgtggagggagctgaccccacacacaggacagagcagaatcctgattattttacaaactgcaaaccttctgagtaagaagacaaaaatatacattccaaggtatctgtaaagtgcttggaagatgcagacagctgcaccgaggggctctgatccatccacacgctgcgctttgctgcggtcacacacacggtctcagtcacgtgatggttttgcttttatttcttaaacggctgagtgataatccagctagtgtgcagtcatttcatacctttcaatgggcgtcaccgcagtgacgctgccccagccccatgctgagggccgacacaattcacggaacagattcatcatatttggtctttatgtaaataataaatgttttaaaattgcctaaatata

SEQ ID NO: 3589 - DNA, 13316 bp, Homo sapiens; identical to SEQ ID NO: 3521

SEQ ID NO: 3590 - DNA, 1889 bp, Homo sapiens
tacactcccaagagtgccttcgggaacccctctccccactacccaaccagagagacagccccacgcccggcaagacgcaactccgggccacggagggcgccgcccggacagcccggccgggtcagggggcttcgccgccgagcaccctccggcagccgccctcgggcctccgcggccgggcgggagggcgcctccccgaccacacttcggccgcttggcacccacagccgggagggcgtgaggaaggactcggtctaactccggggaaccctcggagttccggcgcagacacccgagggggtgtcctgggaactccttcgcccgcgacacccgttcttctccgtctcccgaccaccagcgacgcagcagggcggctgccggcccggcccggcccgccttgcgggctgtgcgcggcgcagctcttcctccgcggggccgtgaaggccaccggccgcccccgcgcgcccagctgcccggccccgccgcctaagccgccgcgttgctggcgggtagccgcgggcctccggtgcgcgggccccggcgcgtccccgagcgcgcgcctggccgcggccccgcgcgagttgcactaactttccggggcgggggaggggtgggcgccgcgggcccggctcccaggccttacctgtgctcaagttgtcgttgattttcaaaggcacccgcaggatgtagaccaggaatagcacgatgaagaaccacacggtccacagatacgtccaagaccaaactatgcaggacttgagctgctccagaaagcccgtggccgcttcagccatgtttcagcgctcctctctgctgccgcggctcttggtgtctgccgggatgattcaccggcccggaggcgcagctcgcgccgccgccgccgccgcggcccgggcgcccccggagcccgcccgccgccggggacgcgggctcggcgggaaatcgcgcgggccgcgggcgcgccggcttttccttctccagccttattgctaactctctaaaggtccctacaagtggctttcgtggagcgatcacgtggcccctgccccctcgcgttctgggtccatttatatttattatgctaatatttagaaagagaaggccaagtggcgcgccgaaggaaacgcctcaggcagttacaacccgcataagttgagcgtttaccacacgccaggcgctgctccacgatccgtacaatctcatttaacccctgcaacaattccccactacgatcctctttctataggtagggaaactgaggctcacagcagctgcgtagtttaccttaaggtggaaccaaaattcaattgcagtggtgtattctggggtccgaggtcttaaaccctactctgctcccttatcaggattcaggctcagggaatgaataaacccgggacagctaggagaagggaggaggtgcgctcctgtcgccggctagtaggcctgaagataaatcactctattcagcaagatttgggtggcagatgctatttacctttgttctgtctctttgaagcagcgcagggattttccagagaaatcttgacagatgaatgtttatcctccaggttttttggtgatcagaggtcaaactattctcagcctgtttttaatataaacaattctctgggataattttgactgtgaaacggccacctctaacagaaagtccattttaaacattgttttgttgtttttgttttgttttgactgtgctgaataaaatgtttcttttattctaaaatgttttctcagctgaaattttcaagtctgtttctgtccgtaagtgatttgactttctatgtattagatggtaatgaggaaattgcaggttttccagtctacatctatttttaaaattctgagcataaagaatattttattataaa

SEQ ID NO: 3591 - DNA, 2747 bp, Homo sapiens
ttaaaaacctagggtgggaaatgctcagagtgagatggtttgacttcattaggcatataacccatttttattataaaaagaaatgcacatataagtaaaaagaccattttagttagtcccaccattcgttggtaaccagttcactaagtgtacatctttgcagatttctgtgcatacatacaaatatttttacaagaataggatcataccatgaataccacctataatggtatgtctgttgtcaatataggtgttataattaagactgtgtagccttcctctgtggatgtaccaaaatttatttaattccctgtcactggacacttttgtttcactaataagtagacactgtgtaagcaatctgtcaacatctctgcacctctatttttggtataagtatttccttaggataaaatcccagaaatggaattgcaaggtataaaagattattaacatttttcaaggctttaagatgcctttacggtgtatctgttacatcctgcttccacacaaattcttctgtatagccagtacccaagctgcagctctcagcacaggtgaagacagccaggatgccccagtcaatgctcttgcccagtctgtcagccttcaggtagtttaggagctgaggcatgacctgagaagagggtgacacacagttagaaagctgcttcacagcagggagcacgagaccttctcagccaggatgattatagggatcttggtctttcaatcctcatactacaaagcaggattatagacattatacaattaacatgtttaacaatctaaaacttccttatgacttcaaagcccctctcaccttctgtttggtcttttccatttgagaaagaagttcacaagtggctgttaatgaattattttcattactaatatgccactcaaaagggctgaggcttctatttgggcaacttttactttgtatcattgcagatgttgttactcttgactcaagaaacactaattactagtaatgaatacagaaaggacatctatcaatgtagttatagagaccagagaggaatcttagaagtagtctaactcaaagagtgaataggcagaatagccacctgatatggaatcactttatacaaatcctgtcacctcaatttggacattgagagctttggcactaagaaccaagcagagttttgtgtatggtcctcataattccttttttacccaaagaaacaaaccaatattagctatgactttggtaaggttagtgaatccatagctcaagagcatttccaccctacccaaatggattttgatgctaacaaatccttttgggcagggaaggacatttatctttaatgcttatatccattttttctaacaaatccacaaaccaagattaaacagtaaagactcctctcataaagtatatagtcaaagactttaattactagaacaagaaaggaaggtatacattatttaaaataacaaaagttaacagaggcactaataataatgacataaccacactggaggtggagagcagtgtagatatcctcattgtcacagaagtcagtcaatagaccgtgtctgaaaactaggaaacagaaaaaaacaagacagttccttccagggaactagccccaaggtgaggcaggaaactgatgattttcattatagggtacccttccatactgccatgttgacccatgtgcacaaattaccttggtgaagtttttaatgtttaaaaacaatcatggtgattacacactaaatggtccttatttaaggtcatacctggaattccaatattctcttggcaccacaggggcaatctggaatatccttttcttgaggaatattttcaccagaaatccagatgggggcaatacctctgccatatctaagaatctaaaatcaatgaagatcatgttcaaataatcaataccttacctataagttgccaatggtaacatgctatctactccatgaatgttcctactcttgatgtagcactgacccaaaaggcatgtcacagttcccccatcagacctggctgtaccagtgtgccactaatgccttctcaatcacctcaaagtgattatttcagtttatctgactcagagggcatcaaaatatatctcccagatgatgcttttactacctaatgttggcaacttaatcctatgaatatattgtgaagggactaagaatgagcctctgctctaattgcagaattctgcccagagtctgtgcctaccttcatagttaaaaaattttaggagggacaaataccaagtgaaacatagtgttttgaaaactactacaaacataagtaaatttcactgtaataagcttcctacagcaactgagtggttttctgtattttgtctaaaagcatatgcattgctaaaaactgccttagtgtttaagacctagatctattcttcctgtgtatttatttgaaccagtgactggtttatgggagtttagttttctttcgtgatttacgtttatggtaggggaggttaaggagaaaaatgttaacatgtcacattttacaagccaaagttacctgttggaaatgggcaaaaataaccttttttctttctggcgggggggccaatggtgcctaaacctcatgtaccttaggcaacatctcattcatctcccatccctgatgcttgctttagaaaatgaaccctgtatgataaacagtataacctttagtcttttagtaactattaaatggatcagcactgcaaaac

SEQ ID NO: 3592 - DNA, 2751 bp, Homo sapiens
caagatgttaggtaatatatttaaagagaggagtgctctacctaaatgaagaggacatgccagttaagctgacataaacatactaaattactttattgttattgctgttgtaaagtgaaaaattcagactccttgagcttgtttaaatagactactgtcagagaaatggatgtatactccaaatcaggaaacagaagctcaaagaagttcagtagcttgctcagggtcatttctgtaagtaaatgacagagccaggatgggaacccagattggtctgactctaaagcacaaactcttcttccctttacaccaaggatataacgaatctgtcagtacttgaaacaattccgaaagattcttactgacaaaaaatgattactttttagaaagatggaacataattcttgctaaagctttgacaaaaacaattcataattcctctaattcagaaaatactttgatttatgaatacacaaattcaagtgaacatacacacatacacaaaaataacataactaagcctagactgaacccccctgccactcttttttctaaacatttaccaggacatgaaagaaaaatagactaaaatctgtaaaaacattaagtaagatatcatcaattcattttccactgtactgaaagaaacaccaaccttattaatggcacatgcggtcttctcccggctggtgccactacttgtcctaatgatcttggatagatcttcacgagcagcaagtagatgtgccattgtaatcgttgtcttgggtgacaaagcataacgcttaggctgataaattcttgctatatcatctgtttttacctaaatgacaagagttaaggaaaaaaggaacaaaagtacattttaatgaaagagcaaaaacaatcataatctttagaaataaagaaaaggagataatgcataagcaaggagttagaaaagagcaaaaacacccaaatatctgagaatttatgaataatttagaacaaataaaatagaccaacaggtgttaaaaatatgtaactaccagcaacaactcgctaaaaaataataacaaaaaaatttctatacatattaacaaaaaatacctaaaaaatagttttaccaaaaccacatacaggacatttaaaagggaaacatcagtaaatcttgcaaaaacaaaaggaaaacttgtataaatggtaagaaataccaagtttctgtatgggaacattaagtattattgtcagttttcccccaaattaacttataatcctatataaatagtttttgagagaatgaaaaaaaaatctaaagttaaatccagaaactcaatatgtaagaataactaaaagcattttgaaatataatcctacaagtgaccccaactgatccagcatggggcagaagaactgcccagttaattcaaaaaatgtaaaaataataatacctgaaattccactttcagtcaagatacagtaatcggcaccagattaactctcccacctgaaacaactaaaaaactggataacccatgtgatgtgaaccaatgatggtcagacactggacatcaaggaacacaggacaatgatccctaaatgaggagaagccctataattatctcagcttactgcctggagagtttccaggcaatgatgcagggtagggagagcgggggtgaggagtgatcccagactaagcatgggtacagattaaaggcataaaatgggaatgatgggagacagctctttagaaagctatctgaagagattcaaatttggaaatgccctcacctcccaaccccctcttcaactgaaacacattctatattcatccagccttaagatacttttaaggcctgttggcatcagtactacctgcaactattcttatatcctgctttcttcttacactgctcactgtatctatctcattatctcatatgatgccccttcttttatgcatatcctggcataaatcacaatatctatgagtttaaaataaatgtcaaaaatgtggggagaaattaagttatatgcaacagggatttatacaagaccaggatcatcttgtaagaccagtagttggcctgggcatgtagttgagatggtgatgaagtacaaatgtggcatggttacataacagacaagcaagccagaagagctgttataggctaccacctacaggacacatatgggaaaacagccttacctttgctctatcagaccatccaaaggactgtacagtcacatctaatcgtttcattaacattcgtcggcggcactcatattcacaggaaagagcatcattgattctttccagttgttcctaaaaaatttggaaacaaaaataataaactttagattctttcattctgcaaagaaaagaaatctgaaaattgtgctaagtacttcctactgagtcaaaagatgtacttactgaccattttctgttcccatgagactttatggtaaattatttaaatactaaagcataattgaaagaacatttatgatatccagaagacattaaacatacaaattaaactccacccgttggtagagtatactatctataatcaaatttgttaatttaagtaaaacatttacctgctaagcagtctggaccaacaaggaaagaaaataccaataactcatcttgctggctttgagcctctgttcttttcaaatcacaactgtgctagcacattgagcactatcaatatcctcagccaggtatttttaaaaattaataatttaactaaagaaatg

SEQ ID NO: 3593 - DNA, 723 bp, Homo sapiens
ggatcggtctcttctgttccgcgtcctccacctcggtagcccctggtgactctgttacagcctctgttgacctatgatctgcagggagacgcacagccaggacatcctggaacctgggaaagggtatatgccctcattttgcttaagacctctggccagagcagggcatggaagattccttttaaaaagtaatactgagaagacatgaaaaatgtggacatgataatttactgttgagaaatggctgtaaaagtgtggatgagtgtcaggtgcacaaagaaggttataatggacttaacaagtgtttcacaactactcagagcaaagtatttcaatgtggtaaatgtttgaaagtcctttataaatttttaaattcaaacaaaaaataagatatactggaagaaaacctttcaaatgtcaaaaatgtgtcaaatcattttgcatgctttcacacaaaacccaacataaaagcatttatactagagagaagtcctacaaatgtaaaaaatgtggaaaaacctttaattggtcctcaatccttactaataataagaaaattcatactgaacagaaaccttacaaatgtgaagaatgtggcaaagcttttaagcaacactcaacccttactacacataaaataatttgtgctgaagaaaaactttacagatgtgaagaatgtggcaaagcattttgccagccctcaaccctaactagatataagag

SEQ ID NO: 3594 - DNA, 7422 bp, Homo sapiens
cgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctaggctgtgtggttggtggtgaataggcttctttttacatggtgctgccagcccagctaattaatggtgcacgtggacttttagcaagcgggctcactggaagagactgaacctggcatggaattcctgaagatgtttggggtttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatgtcctgtgcctcctgattgctgagtgttcacctggaccttctgactaccttccctgtgctattccatcagcctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccgtgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaaggtagaacctctatgcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaagttactttgagttgggtttctgttacttgaaattgaatccacactaatatatctaccaacattgagacttgacagatccaagtatttattaagctagaggtcatggtcactgaaattactttccaaagtggaagacaaaatgaaacaggaactgagggaatatttaagatcccacagaagcgtaaaaatgacatggtagaaagtaatagaaaacctaaatgtctgtcattaaaggataggttaaggtgtggttcagccatataggaatatctcgtatctgttaaaatgaataaagtacattcattgtgtatggaaaaatggccatgatacattaggtgaaacaagttattaatagaaaagtgtacagtgtgaactcattttaaaatgtgtgtgcttatgtttataaatgcatagaaaggtctattcacagctttctttgaacagtgtagatcacatgaaactttcaactttatacatttctgtattaatattttac

SEQ ID NO: 3595 - DNA, 1876 bp, Homo sapiens
cgccgcgtgcacagccggcgctcgttccagcggcctcgcgcgcgccgccgccccgcgctgctgaagctggcgtcgctgccgccctcgtgccacgcaccgccgcacgcgctggagcaggaggagacgccgctgtgacgccgccggcgggaagggtccgcgcgccatggctggccgctcgcgccctttcccaccgctgccgggaaaccgaggctcgccccaaacggatttgcgtgaaaccagcccaaggttccgggcccccccaaccgagccccgcgcccggggactgactcggggaccgactcagggacctcccgagcgccaggactcagggcccgacctgcagcggctgcaggcccagcgcccgcaagcggcctgggccgagcgccgtttccaggccctcgccaggtctttgaactgcagatcaagtgttgacagtcaccagtcaggaggagttcttaaagagttttatgttgactgaatattgcacattgagtccccattgagtccctggtgggaaaagtccacaatttcccattgatagctttttactgttgtgaaaaagggaagcgtcagccacacaaaagcctgcatgaccgctgcttcggagaagctctcgaccctaactgcagtcactgttacttggatcagatcaagcgcagtgactttttgggattcagtggttattctccacacttcgtagccatttcaaccaactctgagcacaaaatgcagccatcctctatgcagcaagccctgcccagtcagtgaccctactggacagatccaaggccagccctggttccctgctgcagccaccgtcctgacgttcatcggagcaggccggggcctggccttcccggcacaagtggctgttctgacaggcccccagtttgtcccatctgaactgctgggaggtttccgggtggccagaggagcaaagctgccttccaagtgcctgtctgtgcctgggagaacagagcaggagcgtcgtgcggtccaccgcgcaatgcatggcgattccaggcgctgaacaactcccctggacccttgggcctgcatctgactcccagctgcagagtcagaagctgagtccaggcaactgcttggccactcccgatcgctcctccctggacacccggttaccaaagtcagcaaagaagatgcggtaatcgccgcctgatctccacatggtgaacacaacactcccaccaacacctccttgactggtcggtcttcagcaccgggggtgggcaggcaggtgttctgtgttgacgagaattgcacaggctaaacacaaacacggaaccagagtgagaacacctcactcacggcagcccaggctgctccctaccaggtgacggagcgcgccggggctgtgggtgccaggggctgagtgctagggactcgtcatgagtggggatccccacgttcctgtcactgctgtcaaacagaaggtaaacagtcttatgaatgtatttccttaggaaaacttgtaaaaacttttattaggatatctatttaatactgaactttggcctactttgtgatagactataaacaaattgaggaaatcactatttctcacttctgtattttctcaaaaataattttgttacagagttcaatatactgtgtaccattgatcttctattgtgaaagcaaagaatttcatcaaaatattttaaattatgagtgaaaattgtgtatgttaattttgcagctataatattaatcaaatttcgtgtaattctaatcacaaaatgacgtgccttaagtgcccctccagctgtgggttggcagtgtccagacagggagggcccatcaccgaaatcctgaacgattactagaccaattctattaaaaacatttcaaggca

SEQ ID NO: 3596 - DNA, 1409 bp, Homo sapiens
cattaagtgagatgattctagttacagacttagaacaatttccagcacatagttaaatatccaggaaattctggtactgttatgtgtgggtgagctgacctggatgtagatgttttcctctctcttgctgacccctccgccagttttgtcttgtgatgccattaacacatctctccctttctgacctggctcctgcccattggtgtcccaagaaatcgtgagaatagttagccccccgtctccccagcctgttgctttctcgtgtagttgttcacagtagttgagaagttgaagagcttttgcctattgaaggtgcactgagaataaactctttcctgccaccagaattgcagtggttcacggcctgcactcattcccatgaatgcagttaatagccacagaaatgtcacattaagcaaagcagccagggtctcatcgtgttgagactcgagtctctcagaccttggattcattccctggtgtctttgagcctcagtttcctcattggtaaaagagaagtgaagcagtgtctcacagggtcattacagagattaaatgaaataaatgaaataacatagaccaggagggcgtggtgtttaaaagtcacagatggggcaccctcgggccatccagcccagtgttttctttagcccctatgatgttcattttttgttatatcccattaggtgcccatatttaaaaattgggagatttcacataaaattaaaaggtctgcattttcttttttcttttctttttttttttttttgagacacagtctcactctgtcaccaggctagagtgcagtggcacgatctcagctcactgcaacctctgcctcccaggttcaagtaattctcctgcctcagcctcccaagtagctgggactacaggcacgtgccaccacgcccagctaatttttgtatttttagcagagatggggtttcaccacattggccaggatggtctcgatctcaacctcgtgatccacccacctcggtctcccaaagcgctgggattacaggcgtgagccaccgcgccaagccaaggtctgcatttttctttagaactcagaacacccaatagtcctaggcccccatcctcgcatggcagcaagctaaataagcatcttcccactgcgagttggggcatgacccagcctatggtttgccatactccctctttttctccgttttttcattaattgtgaacctgacctgcatcaccctttcatgtcagtgctctccaaacctgcttgcttgcacccctctagtcgaaatattttgtgcttaccccaatatatgtgtgtgactattgaactctattcgtagactgcttgtactaatgtcatttgcatcataaaatattcatatccaataaacatattaaaaggatgagataagaaaccg

SEQ ID NO: 3597 - DNA, 247 bp, Homo sapiens
aaaattaacttgtttccttcaacttcagtatattattgaacatttgaatacatctttatgagaaaatagtgtgcacccagctagcagctgctgagaaattcaaatttcaaggtgaagctgtgtcaaagttcaaggtgaagctgtctcaaacattcaagaaaacacacagactccaactgtacaagaggagagtgaagaggaagaggttgatgaaacaggtgtagaagttaaggacatagaattggtc

SEQ ID NO: 3598 - DNA, 1174 bp, Homo sapiens
tcaggtacatcaaggaaacaaacaccaaaaatgacccaaatgaactcaacaatcttatcaagaaaaactctgatgtgataacatggacccctcgaccgggagccacccttgatctgggaagaatgctgaaggatcgaacagacagcaagggcatcatagagcctccagaggggacaaaaatttacaaggattcctgggattttgaaccttatttggaaatcttgaatgctgctctaggagatgaaatatttcttcactcatcctggataaaagaatacttcacttgggctggatttaaagattacaaccttgtggtcagggtatgctattgtttgtctttgctttcttgtataatggaaatacatgaacacccctttgtcagatccatagccgggtggatgtcatcagacacgtggtgaagaatggtctactctgggatgagttgtatataggattccaaacacggctccagcgggatcctgacatataccatcacctgttttggaatcattttcaaataaaactccccctcacaccacccaactggaagtcattcctgatgtgctgtgagcagaatgggcctgtgattttgcaagtaaggaatatcctgtgggtttgggagctgtcctaccgtgcatcccgtgacactctctttgaccaggaatgcaaaaccacatgaaaatttcaagaattcactgatctgatgcaaaataaaaatttatcattacatcttgaacccaggaagcttacagcaaagagactatgctttatgacgtcagcaatagataattccacgttgcctttgtgatttgtatatatagcttacatttgtggatcactacatagccagattcaaaaatattttacttgttccatccacagttctctacagaaagaaccaatgaacccaataggaacaaattctctgtggaaaacaaagcatagctgtagtagatacgaatccaatcacagaggaaacaggaagagaaaaacatccaagactacagtgaaaactggaaatggtctgttttcgtgatattcgtatgattaagatgcaaattttttcttaggaaaatgtgattgttaactagcattctgttttacatgttgacatttctaacacacacaccactgatttgaacttcaaaatttattttctgattatatatgctag

SEQ ID NO: 3599 - DNA, 538 bp, Homo sapiens
tgtccagagcagacgcccatcccaaggacttccatggagtggggggaaggctgggtaggtttgagttttatcgtcaatataataaattaatcagaagctttcacaaaacaaacaccgcggctccgctgaagataaaatggggctgggaaaaaccaaacaccaagtagaaaccagctgaccagtgtgaggtgttgtagtccagtctcccgggcccagcagttcagtggccacgtagagattcaagggcctcttgttggctgttctccaggtttccaagaaccggtcagtaaagctggtttttcaattggtgcaggacgccaatcacaatctcccgcagggctgaggcttacagtgctcctcgatccagctgaagacacacgctgacagctcctggaagctggccactgagatggaggcattgaaggactggaacagggaatccatgatgccttgaaacacgttgaacttgacctggtcagagacctggtcctccccttcatgggggttgtcctggtgtgccttcacaatctgctcatag

SEQ ID NO: 3600 - DNA, 1467 bp, Homo sapiens
acacacgcacgtaccggctgctccgcagggacgtagagagccgcaggcccaaggaggggccgcccccgccgagcccgcccctccgccccagcgcggcctgtcaccgcggccccaggtcgggggctgccgcagggcccccggggaccggaggggcgcgcgaggagtcgggcgcgggccttggggccaggcccgtccctctttcacatgaagcccgggccgggcggggtggcgggcgcgtgaatcctcgcagccggccgggtcctcctggcgctcctcggcacttctagccgctgcaaccccgaggcccgcgggaactgggcaggaaaggaggaagccgcgggcccgcgtcgctagagaccggagaagaggcgggagtggcgactctgcggacaggggcgccgagcgtcctggtcgttgttttcgtcgccgccgcgggccgtgcaacccccgaacgctgcgcccagcggccgcggcaccctcgtcaggcgccgccgctgagggcaggcagcccggcagccactacacacggacccgtgacgtcgggcgtagcgcggcgcacgtcacggccgctcgctcgtgcgcgcgcacccctccgcccggcggtagcggaacccgccgcgggcgcgcgcccggcccaggggagtgggtcggcgcctgcgcagaggcccgccacgcccacacacaggccaccgcccccaccggccggacggcgcggggattcccagtcctggctccgccccggcctcggccccgcccccgcccctgccccggggcagcctgtgctgttccgtgtgcgcggcgcatacgcacctgggttgtctcgagcctgcggtagtggccagatcccagacatccgagtagatcccgtgaaaagcttcttcttggtttcttcgtacattctggatccacccctttcatgcatattccagaccacatttccactggagcagttgaaatgagagagatgggaatgggactcacccgaaccagaggaatttttattacagacccattaacagaggtgtcaaagtcacaggaacaaggatgtgcacctcagaaacacagaggtcagtggaaaatcagtttgcttctatttgtttaaaaaatgggggacttatgcataaatctaagaccttcttgaatctaacattctaagacctgtatgccacagaaaggagggtctcagaacgccggaggatagtatttaaatcttaaatatctatattgttctccacagttactgggtcaccacatagcaggcattcaataaaaacgtgtttgtttactaagtaatctagagataaattttttcccctcatagtgctgctcatttctccactcccttccctcacttaccaccccggggacttcattcacctctgggttcctcagaaacatcccgtgggtatagttatagtagctattctttctttttcgccattctccttttatattggtgacttttcc

SEQ ID NO: 3601 - DNA, 1204 bp, Homo sapiens
ctgacgtcgggggcgagccgggcctgcgcggtagtgggacccgaccctgtctccagtgggcgtcttgggccccggctctattctgggctgcgggcctgggaagggctcgccgggtgccaaatgagctgtcctaactctgcggggctgcagcttcctgcatgatgctggggagcttggcgcctgacccaggatctagaaggcactctgggcaggccgcgctccgcccacgaaggtacccaaccctctgggatagatgcaggaagcgatggttaagacccattttcacccaacttctcgccgcaggtctggcttaccacacgctcctccccattcccagtgagccgctttttgcagcaccaggcgaacacttacaccagtgctttgtaaaggaatcttattgtccaccccgtgtcttggcaaaagaacagtgatcacacagattcctacttgggctctttcctttaatcttcggaggctgagtttgcccaactcaggtttaaccaccaaggactctgagagctggcaggtctgagtaaccctggtaacaattctcttcaccttatcaaaacctgagctaaaaccaatgcatcagctgatgatgacagcagagagtggcagggctgaggacccaaagtcatttcccaggctggcggagagtgagtaaatgagattctaaaactaaacaagggaggtcagagactctttccaaccttacctgatggcttctggccaaagcaaggaagtgtcttggaaggtgttggttggtgatggtgcgaaaagacacttgagaaggagggaagaaaaagcagcgccccttgataaaggtgggggagagaagatatggggaaagccctgaattcctcatcaaaggccaatctcagagagtagcagggggttacaatctatgctttggccaagggcgggagtggaggagtgggggttaggatgatggcttggagcgggcatcatttaagacttaaagaaaccatgggtgcaggcaaagcaccccacacactaagcagtagtcccacaggctgcgacctgaaaccttcacatctactcttaacaagcccccatggctagagggctgttgcaaggggagaaggcagagaccccagaccatgtaatcaacagcaaggtgattgtgtgatgtgtcttttcccatatttaggagggtgagttttatgaatgactttaaatatta

SEQ ID NO: 3602 - DNA, 3160 bp, Homo sapiens
cctgtgatgatcacccaagccccaggctgtcttagcccctggagttcagaagtcctctctgtaaagcctgcctcccactaggtcaagaggaactagagtacctttggatttatcaggaccctcatgtttaaatggttatttccctttgggaaaacttcagaaactgatgtatcaaatgaggccctgtgccctcgatctatttccttcttccttctgacctcctcccaggcactcttacttctagccgaactcttagctctgggcagatctccaagcgcctggagtgctttttagcagagacacctcgttaagctccgggatgaccttgtaggagatctgtctccctgtgcctggagagttacagccagcaaggtgcccccatcttagagtgtggtgtccaaacgtgaggtggcttcctagttacatgaggatgtgatccaggaaatccagtttggaggcttgatgtgggttttgacctggcctcagccttggggctgtttttccttgttgccccgctctagacttttagcagatctgcagcccacaggcttttttggaaggagtggcttcctgcaggtgttccacctgccttcggagcctgccacccaggccctcagaactgagccacaggctgctctggccaggagagaaacagctctgttgttctgcattgggggaggtacattcctgcatcttctcaccccctcaaccaggaactggggatttgggatgagatatggtcagacttgtagataaccccaaagatgtgaagatcgcttgtgaaaccattttgaatgaatagattggtttcctgtggctccctccaaacctggccaagcccagcttccgaagcaggaaccagcactgtctctgtgcctgactcacagcatataggtcaggaaagaatggagacggcattcttggacttcactggggctgctggattggatgggaaaccttctggaagaggcagatgggggtcaaaccactgccttggccccaggaaggggccataggtaggtctgaacaactgccgcaagaccactacatgacttagggaacttgaaaccaactggctcatggagaaaacaaatttgacttgggaaagggattatgtaggaataatgtttggacttgatttccccacgtcataatgaagaatggaagtttggatctgctcctcgtcaggcgcagcatctctgaagcttggaaagctgtcttccagcagcctccgtggcctcgggttcctaccggcttctctgcatttggtctgctgatcatgttgccataatgtgtatggaaagtgtaacacattcttactggttaaagacgactaccaggtatctaacttgtttaacattgagtttgtgtgtgtgtgtgtatgtttgtgtgttttgtatattgtttacattttgagaggtagcattctgtttcaaatgctttttgtttttctgacagtattgttgactgggtcataacattttgagctgtggtttggtggattttcaatttttttttttaaaggtcattcgctgtgctatcttcaaaaccttgagtttggcccccaatttttggcattcaaatgtttaaaagctatttatcttggtttatacaagtttcctttctcttctttttgtcatggtattctatttggtctgcagtttgaatgtagagaaagtggactgatcccccaagcgttgtctgcccccactctttcctccttgggtcccgccattcttttactgggcagtcgagggcattggaggggaagtgactgccctcagcctcactccctggggccatgaagaaaagctaaacagtctcatggcatctcagaataatgttgggtctcccaagaagaaaggtgtaagaataacgacatggctgattaggcgaggccaggatagggctaaggccaggattcctggctggcatccagtcaccccttctcccatccttccccctcttcttccacaagtccgcagccgagacactgtagtctcccagccacagtgatgagtgccctggagactccactgacctctagatgaaggcccctggccctggttcctgttaattaacctctgggtctttgagtcccccagcacaaacttctttcctgtaccctgcggcttggggtcacagggcatgccgggaagccacagctgaggggcgcagactgaagcagtgctccacctctccttctttagctcaggggttgctggtctgtggcaggcgccacgagtggcccctgtggctgttctcagtggcagtctcttaagttcccaccacaggcagctctttatcccctctccctacttgactctttctcttgcctgtgcttttggcctcaaacaggcctgctggtagcgctcagggcgtgaggctacactcctgccctgcctttcctgtcttcatggtctgccagggcataccttggggaggtggaccaaagacccaggactttttgcagtagccagtcctaccccccagttgtctttttaccaattcagggtgggagagaaaactgcagcaccccagcatgtgagttactcaggtgttgggggctagaagggacagtgcgtttaaacaacactcagagctctggccttaaacctgtggccccccaagtctaggagcctcatctcttcctggcagtcatgcgggcaggaggtcctgaaagggaaaacccattcagacaactgttccccaatctaccagccatctgcaggggtcagtgaccgtggccctctccctcctctagaatgtgccacttatgaagagtgccccatggggaaaaggagactcagctgtcccttggcagcttgtgccagtatcccagggcagaagtttccacaggagcctcttgcccttgcgcagagccactgtgagaggcggtgggagccaacacccttgggggagggggcagtactgctcggcacatcccagcatcaggtcagatcattgaaattaaaaaatgtgaattaagttcatatccaccttttggggaagcaggacaaaccaccaccccaccaagtgtgtgacttctccatatcccactgcagtttccattttttaaatgggaattttcaatcccctgtgcttgtctaacgtctgctttaaaaagtttgagaccctgttactgtttgaaaatgcatgc

SEQ ID NO: 3603 - DNA, 921 bp, Homo sapiens
ccggccgccttccgcggccaccgccgggcccgctcccgccgccgacgcccaggtgcgccaggtgcgggccgggcgggggtcgcgctcacctttctggccgctgagtgccgcgtaccaggacagcgagaggaaggcgcacaggcagaagagcagcagcgtcaggaaggtgccattgcggagcctcatctcctcggtgtctgcgagattaatctctcatggccgctgcacaagaacctggcttttagctgaactaaggagaaagtcctacaacagtttggcgtgcaacatggggcttgagaaagggttttcagcagcttccggaggccgcctggactgcagaaggcgccctgggcgtgtgtacttccacctccgcaggcgctggcatctccaggctgcttcaggccgctttggacctcaccatcggtagcatctgcgtcttcttgaggtgactggagcccgtctatggtttcagccattgacttctggacatggaagtgtcgaggccatttttggcccctctcatatccgggaagggctccgtgcccagtagaggtgcagtgcagcagccagctcgcagcagtgctcccgtagagctgatggcattggcaggagtggcggctcagcacagggaagttctccagtgcccaggcccaggcttgctctcggtttaggtcccatggcacgtggggctctggacctgcctgcctccaagacagctcttccaaggttgagggttggaactccacagcctcagcctcccaaagcttgaccaggcccagccatagctagtctaggaaaagagcaaatggccgtgtttttatattttgacttttgcatttcaatattaatttttttggtaatgtaatgcattcaaaacatggtccccccccccccaaaaaaaaaagaaaagaaaaagaaaaa

SEQ ID NO: 3604 - DNA, 7435 bp, Homo sapiens
gacgcagccgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctaggctgtgtggttggtggtgaataggcttctttttacatggtgctgccagcccagctaattaatggtgcacgtggacttttagcaagcgggctcactggaagagactgaacctggcatggaattcctgaagatgtttggggtttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatgtcctgtgcctcctgattgctgagtgttcacctggaccttctgactaccttccctgtgctattccatcagcctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccgtgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaagttactttgagttgggtttctgttacttgaaattgaatccacactaatatatctaccaacattgagacttgacagatccaagtatttattaagctagaggtcatggtcactgaaattactttccaaagtggaagacaaaatgaaacaggaactgagggaatatttaagatcccacagaagcgtaaaaatgacatggtagaaagtaatagaaaacctaaatgtctgtcattaaaggataggttaaggtgtggttcagccatataggaatatctcgtatctgttaaaatgaataaagtacattcattgtgtatggaaaaatggccatgatacattaggtgaaacaagttattaatagaaaagtgtacagtgtgaactcattttaaaatgtgtgtgcttatgtttataaatgcatagaaaggtctattcacagctttctttgaacagtgtagatcacatgaaactttcaactttatacatttctgtattaatattttacactacccacattatttttaaactttattttaaataaagaatttttaaaattaaatttagtgcttactgtttgaccttggcaagttattcaacactgagcctgttttatc

SEQ ID NO: 3605 - DNA, 5570 bp, Homo sapiens
aggcatgagcccttgggcccagccggctgtttaatgttcttaaatagcacaagggacttctatgaactttcctagatgaaatatttattaactactaggtaaaacacttgtttgatactgcaaagggttatttctgaaacttaaacctcatgattggccaaccaagaactttttctccacagcatgctttaataatgaaatgcggattaagagtccaatattataaaacatttccacaaaagaaagaatccatctgattctcaactctgaatgcacatttgaattccctcggggagcttttaaaagtctaatgccccagtgtaccccccccagttaattaattaaataattctctggggatgagaactgactgacagcaacacttaagcttcgagactgcagtgtgcagccgaggcccactcctccagcgtcaccacctcgtctttatctgccactgtgtctcctcattgcccacagctttagcaacagcaaaagtagaattcaaaccttggtaaacaaggcttaaattattactgttcatgaccttaattaattgaaaatgattactggtgaccacagcactccatgctcttccttatggaaaaagggttgcctagaagatttaggcaatactgggagttcttatttgaagtcacagaaaggagaaacttttctcaagccgtttttattacacttagtgtattaagacaagtacaaaataaccttgtaattaagatactgtatcagtcaaaaaagaagtcactattgtatgaagagatttacaaatgactaaaatatacaggctgtgacagaattaacagtttgaaagagggttgcttttttcttttagaaatgctaaattttcttaacaagacaaaaatacagtgctctaaatatgcattaccatgaaaacgttaaagaaaagcagtcttaacacttaactactattaacagcctttgccaacacatgcctgcctactccctttcctaactttaaagaactgtttcctctaaggaatactagtgcagcataacccttaaataatttcatttatttttaaagttacaacctacagagaaattaacatcttgtcaatctaataacagtggcaaccattcttcacatgcacttctcttagaataaatccccttggctggcaggataaggcttatgctgtagaaccttctcccccacagccacaaatccccttctataagtccctcctaccctcatccccccgcatccccactggcattcacctttcccaccccaaaaagtgcagctcatggtagccttctagaaaatggttttaatgggtatcccagcatacacgcttttttaaaagccccctctgaacaccagaggtggtgaaaatgaattgtgttcttggatttttttttttttaagcctccactgggtcaaaaatatgtgctcttaatacttgagtttttgctttgtgtgtgggttttctttctttttcatttagatatcgtgggataaagtggagaggacatctccattttcccatacaaactgagggtgagaagagaaagagaagcaagctgttgcccccactttggcctggcttcccagccatcttcccagctctggttctttcataggaactagttattgcttccacaatgccgttatacggaatgttccacaaaggctgtgaacctagtcacagtctacccacaacaagaactctgctctgaaaaaccagcccaagagctcttacccagaagaacaatctttagccctcaaggtcactgaaacttcattagagcagtttagagtagacgtgtaagatttggcatatattaaatgattattggcacaatgttctccagttccatgtataaatgttgatatgcacatcggccagggcccaggatgaatcagccaatctgcaccatttttatgtcagcaataattccatctcttccctttgagcactgtagggagagctgcttcatccggttctccaaggcctggccctcaggggaggtgctgctttggctcttactgctgccaccactgccactgctactgctgaggccccggttgttgttggctttgtcacttgttttattctctgccccttctgccctgtctcctatagaaatacaaggattatcaaaagtgagtattgacaattctgccctgtctcctatagaaatacaaagattatcaaaagtgagtattgacaattctaagtcacttgagctcaaaccagtcagctaactcagccctgtagaagtcccactgttacctaccgtgcctatcagagaggttctcagtacataatcatttactgcttttattccttgtgatgttttatatattccttagctatagagatgaaatttgccatattcactttattgctgagaaacaaacctctctactatgtgcttgccaaggagactgttctgatgtgagacataggacctaagctctactttatagaagctgagtggagccaggagcccccccagaacagcacttggaaacaacctcagtgatcaatactgacagcacaaccacagagacctggtaatgcagcatgggggccctgagacctggcagaggtatggaatggcacaacagtcaggctacagaggcagtgtggcatctgggacggggtgagaaggctgctactcacctcgttctacttcacattcaggggaggaggccccgctgcattcacttcgagggcccaacactgggaacatcatcccaaactctgacagggacacagggctgggcagatccaggctgccaggcctcacaaccgcagggaactggtcaggcatctcagacgggcttgttggtcctgaactaaagctggacacggactgggtttccgagtcatcttcagacacaaagttgctacagctgtcatcttcaaaggcctccgaggccactaagttgagagagaacaccagtcacatgggttctgtcacctcctcaaacaccacaagtgcttgctgctggcaggcagctagacacagcatgggggactaaagagtctctacctctgtgagtgcctaatgaaggaatgtgacttcccaagcctgaatgaccagcctctaaagcagctggaagggaagcagctggcagcaggatcccatggatattaagcgcccttccaataaccttataaccctgccaagaaatcagtgtcaccagacaccacctaaaaatggaagattaattcagccacaaattaggacctttactccacctcagtcccccaaatacatcctcatgtgcacaggaagaggttctagtcctctgtaacatatcccaaacaaagccagctggactcaggcttctttcttagggcaatagaagcaagagctgctagaagaaacaggccagcatggaacatctgttgggacctttgttatctccagaatcctgactttgaggaacacttagtaccttcttaatgaacacagtgttccataaaacatgggaacccaccagaaatagccctcaggcctgcccaactctgagacctttcactgatggccagagaaagtgaggaccttgggaaacaaatcacacagtctgatatctccccacatacccagtggagcccctgacttaccagaaatggcatcaggctcaggtttgctccctggcagatcctccacagatgtgctgctgccctcagcaccaacaccgcatccccgaggccccatggcactggagcgccgccgctcgtggatctcatctgagatcatctccaggttcttcagggccatcttgtactcgccttttgccagggtcagtttggcctgcaggtcatccacagtctttttcagttgctgatcaagagaacaggagactaagtgaagactaccctgctagccttaagatgctttctgaatgacaggttcaagtacattttctgcccatcattctacttcaaggaattttccaagacatgactgaagacctaattaccattgtaactgctattcattcaccagacaaaatcagccaccaccatccccagatcccatccaggtgacaacctctaatatccaaaaactctcactggtggaacaaaccccatcagggaagcaaaaatgggcatcagacacaccaaagtcccacagtctagacatctggttcccagtacagtggttctcaaagttgagcttgcatcaaaatccccttgggtgttaagactcagctcactagactccaacctcagagtttctaattcagtcggtctagagtgggacctggtctatcaggtctccaggtgatgctgatgctgctggtcctaagagcatgctgtgagaaccactggcctagtacaacagagaaggtgactgaatggcagttacagaggttcagagaccactgaagacccaaccgagacaattttgaggtctgaaaactcagtaaagcctgtctctccactttccccttatagcaagtggcccatgtgatactctgctaccccagaaaagtgaagctttgagtgcagaaaaatctcatcagtgacgaagcccaaagctacacatacctcgagctgcacatagtactttgccttgagttcaaaataaggcctgcagaagacaggaaggaaagccatcagagtaatataatacagtgaccacagtcaactccacaagatgaacaagaggcatcagctaccactggccaggtcgtccttccaatatttagtaaactcttaacaaggccgtgacatgtcagtgatgctcctagctctggagactgacagacaccagatggaacgactgggctcacccagggctatattaacaggaggcccatctcaagacacggggaacccacacacacatatcttggggactctgcaacttagctcatgttcctcctctgtgggaaggctgttcagagcctcacaggttatacccagcagtaagggtggcctggatctgctctcctaatgaagttggctccccagggatgaagagcagctgaggctggagaaggggctgcttaaacctcctcctctactgaagtcaactggggaagagagagaagcaccactcctccctcacagcacagcaaggccaccactaggagggggtctcaggttggtcctcccaaaccttgtccaaagactggagttattagttggctgactcagccacataatgggcccaagaaatgccagcgtcctagcagttcccttggttctgggtcagctgaaagagcttggctcttttttaggaactttggtgcctgaacattaagagtagatcactgctttattcttgagctgttcaccctccatgaagctctcaagtcctgcatcctgaggatccagatggatgacaaggacacaggactgccattgagaaatgaagatgaactgtgtcacagatgcagtggattactgactgcccttgtaatagtccattttgcatctgttggtaattcattgaggcactcttggttttctatgagtttgtattttttgaattcaagaattgtaacatcactgttagatccctccttatttaatgagagaaataaaatatttgacacgagaaaa

SEQ ID NO: 3606 - DNA, 10802 bp, Homo sapiens
agttctgcagcaccctctgtggcagctgagagcaggccctctgcagaagagagccaggggcatggagagttcaggcctccagcagagggagtgcagatatggggaaagctgacccctggagtcagcaggcccagccctaggagggggcagtcccacagcaggctcacaccctgcccttcagagttgcagcagctaatgctgatgccaggaccttgtcctgccaggaagcctctgattagggctgtgaaccaacttccttttcacatctgcaaggacacttggaggcaactgcccaaggccactctgaggagggttgaatgttctttattaaaaggactgaggatcatgtgtgttggtgggccttggactctgctctaagctcaaattttgcagtttctgctgtcatcacagctgggaatgagaaagggaaggggctccagttggtctccctctgcctctggagcacacgtggaggacatgaggcttccgcaggaacagctctgaaagctgagttctcgggtccctgtgaaggagggaagcttgcctgccttggagcgtgaaaaagtcttgctggacagaagtctcacggtttaaaactgggaagggagaggattgagatcacactagaatgcacagaaaattcttaaaacaaaaaaatgagagaaacttcatcagaatgtgaaaagaactataaagctacagtgctgaagagagggcaatactggcactagaatgagaagattcatggaacacagtggaaaatgcagtaagagagctgcatacacatggaggcaaccactcaaggccactctgagaagggttgaacgtgctttaaattaaaaggactgaggatcatgtgtgttggtgtgtcttggactctgctctaagactcatggaggcaaccactcaaggccactctgagaagggttgaacgtgctttaaattaaaaggactgaggatcatgtgtgttggtgtgtcctggactctgctctaaggccctgtggctgcctggtgccctgggaatggtccggtcatgggcctcagcccaggatgagcagccaacaatgcaatcccacgaagagtgtgcggaagggagaggttacttctcaagatggagctgccaaatagggacactttggagagtctggcctgagaacttttagtttcaagaatgtattgctttggaaaagacagaataaaagtccaagcactgccacttagaggttgtatgtccttgggaaagtcactgtacttggcaattataacctttaccctggatacaccattcatctcctggggccaggggttgtgccaccttgttcatttctaaactaaatgatatctaagctagtctttaccacagtttaattcttacaataatactccaaaggagatataatcaaccacatttcacagatgagagagttggaatcttaaaaaggttaaactcttcgaggtcatttgacgaataaataatggagcctggatttcaactgaagtctaacaaattccaaaatcctggctaccggccatttatattcgtgtgtgtgtgtatatatatatatataaattatataacatatatacatatatcatatgtatatatattatatatatttctttttaagttataaagtataagagaccatgaagaaaatttcagaaagattttagaaactcaagggtcactctcagctgccagtaagaaaacaacctaagatactgttgaatagtattcattcagttaattatggtggacctcaaaaagtcataggaatttcctctagcactgttaagtaaatagttaatggccttttattaaaagactaatttttaaagtcatagcagaaattcttgatccattaaatgatagcaaataccctttgagtgtcaaacattgtatatatttattcttttcttgcaagcagaaaataggtgttacttatccccatttttcagatgaaattgaagcttacagagaggttaaataactcctcgaggtcacctagctaataaacagcacaccaagaatttgaaccaaacagacaagtctccagagcctgtaccataagggaactgcttggctgtttatgattcagggattaatttctgtcttcatgaagctgctgcattttgatacaaaatgttatatttccgatttgatttcaactcccagcttcatgctttaaaagaagtagtgttttgactgcatttagttatttgtacaaacctgtagcaccccctcctggccattcgaggtataccatacatgttatattaccccaatattagaccccaacgaatggcaaagacttcgtataacgaatggaaaggtccccaaatgcaaggcaggttccaactgcacaccttatgtgcttgatagttttaggcaagagactccttcttgcagggctgtcatttcccccgcctcaaaatcagaggagtgggtgatgtttttggtctcttctagttctaattgtgattctgaattgaattgataaactggatattgaaggaataggtgtggtgaaatgaaaaatggaagcttctagtttttattttgatccaacaataatgcatgttatttgcttcctcttgactcaacattgctctaggaaaagcctattctatatagactccttaacaaaaacattgattcctaaaggtcttctgaatgtttggatagccaatggctttgcagcccagcctggccactacatgaggccgatgactttaacaaacttatttcaggccagtgtaaatgcagtgttcaaaaatcccacctaagaaggatgggaacacggaggtttgtgtaggtaacatgcaggtgtgtgcacatgtacccaagaatgcacacacacatacatggacacaactgcaattgatacaaaaggctgaactgtgctgattcttacaggtacttggttctggcccagtctggaaaaaaagaaaagatccttagtctaaacatgcatacaaaatagaattcccaccatgctttgatgttatctatttataattttcaatgtttcaatgttttgtggtcttaaaaattacaaggattattatcaataatccttgtacctaatgtgccttgactctgaaggacatggtaactgcctgtggtttagaaaatgttttggctaaaagacaagttctcctccctcctctcatttttatatcacagagctgcacgggggcttggatcaatgcctgaatccagtgttcctgagtgcagagcatctttgctctgggtgagctttgaccatcctggagaagaaggctgctgcgggggtgggacaaagccaagaccaatgcccagcggccaaggccagccagatggctctgtgctggcagccagtgtacacggattttacctgaaggaaaatgtcacattttccacagacaactgaagaaagagagctctttggattaccctaattgtgatttactcattggaaccactgttttggattgtccaaaattaagtctcaaagcttaaatatgaggcttcagggagttatcctgaaatcagtgcttggtatcttcttgttttttgcttgttttttaaaaccttaattctcatatttttctgtcatatttctcagtgcctggtacattatcaccattaatccatgccagttatgtacagttttgcatgtttgttttttattttactcttttctctccttcattccctattcctgttcccccataggtgcccagtctaatgtatttgatatctgtccttagagcctccgtatctgtgaagactagagtcatgcacttcatcacatttcagtaacgatgggccgcatgtaccacagtcccatgagatgatagaggtgcagaaaaattcctgtcatctagtgacatcgtagccatcataacatcacaacacgactctcatttgtggtgaccctggtgtacacaaacctactgtactgccagttgtataaaagtctagcacatccagctacgcacagtacatacttgaaaattataataaatgaccatgttactggtttatgtaattactatattatactttttaatcattattttagagtgtacaacttctacttgtaaaaaaaaaaaaagttaactgtaaaacagcctcaggcaggcccttcagtaggaattccagaagaaggcactgttgtcctaggagatgacagctccatgtgtgttactgccctgatgaccctccgtgggtacaagatgtggagctggactacagtgatattgaagatctcgaccctgtaggcctaggctaatgtgtggctgtgtcttgatttttagcaaaaatgttttaaaagtgaaaatgttaaaaatagaaaacagtttatagaataaggatataaagaaaatattttgtacagctgtataatttttttttgtttttcttttcctttttcttttttttttttgagacggagtcttgctctgtcgcccagctggagtgcagtggtgtgatctcggctcactgcaacctctgcctcctggggtcaagcgactcttctgcctcagcctcctgagtggctgggactaccggcaagtgccaccatgcctggctaatttttgtattttttgtggagattttcaccatcttggccaggctggtcttgaactcctgacctggtgatccacccgccttggcctcccaaagtggtggggttacaggcgtgaactacagggcctggcctgtttgtgttttaagctaagtgttgttaggagtcaaaaagttaaaaaataaaagttgctaaagtaaaaaagttacagtcagcaaaagctaatttattaatgaagaaagaaatgtatgttttgatcaatttagtgtagcctaagtgtccagtgtttatagtctacaggagtgtacaggaacgtcctaggtcttcacatcctctcaccactcactcattgactcactcacccagagtagcttccagacctgcaagctccattcatggtaactcccctatacaggtgttacagtacttaaaattttatatcctatttttactgtaggttgtctctgtctagatatatttggatacacacatacttaccaatgtgttacagttgcctgcagcactcagtacagtaacatgctgcacagctttgtaacctagaaacaacaggctacacctatagcctctgtgtagtaggctgtgccatctgggtttgtgttctacaacgttgcattctacaatgttcacacaaggatgaaatcgcctaaggacacatttctcagaatgcttcctcattgtcaagcaatgcatgactgtatatagaattgttcataaatactgtgtttttcatccatgtaaatggcatgccatttctacctatccacgtctgcacaccagctcatgcccctcattcatgctcctttctgctgctcaccgctccacagctggcagcccctgcattccatccatccattcccccaaacatgggcatgttgctatcagcagggagctgtgatggacccctcacagggtcctcttattcctcgtgcaagcctttccctgggaagttcctcccagcattgctggtcagggggaacacacactcacatcttcactaaatgctaccagtgctatggtgttatcagaaactttatttatttattttttgccaatatgatagctatcaagctaccccatctctactaaaaatacaaaattaggcctttagtagaaaccctgtctctagtaaaaatacaaaaattagctgggcatggtggcacacacctgtaataccagctacttggtggctgaggcaggagaattgcttgaacccaggaggcagaagctgcagtgagccaagatcgcaccactgcactctagcctgggcaacagagaacctgtcttaaaaacaaaaacaaaaaaaatggcacaggtctgattattaggaagctgaggttcttttttatacttagtattcactgaagtgtgaattacctttcatgtcctctaaacataccaacaaggaggctggagttaggacttatgttagagccagcctgcctggggcacagcctggccctgccatttattgactgtgtgactttgagaaagcttcctcatgtaactctatcttagcttccctgcctgtaataagtaaaaacagcaactacctcatagatttgtaaagattacataaaataatacatgcaatgcatggcaaacgacagtcaacgaatgttattattatattaactattgccatattataaatataaataaatataaatgatataaacaaactaataatagtaattattcatttattcttgacttgaatgagatccttgtgtactttagacatttatcctttgtgaatttgggatggtacaaatatcttaggcaagtctatcatctgtctaccaactaactatctcaaatatcttttcattaaatataaattcttaattttggagtcaaactctttttttttttttttttttgcccatatactttgggtgtttccgagtctcatttaagaaaactttcccctctccaatatcacagaagtattttgcattttcttctcacactcagtttcaaattttattccatgttgatcctgggattagggtttctggacttccctgaactaatcgttcaatcagcctcttgttcgttcactcagcacacaagtatacaagatccagaagtgaatacagcatgcagagaaggttggagacagtgtgcctcttggtaggggaaatgaagggctagggagtatcatatttactctaaatgtggaaagaatgtagaaggatgagaggacgggggattttgaggatacagggcttggactacgcctgggggatgggattagaggccaacaggagaggggaaggcatcccaggagaggggttttgcaaaacggcaagaaaggtgtatagctgagggggagaaggcgggtggggtgctgaggagacgcctctgaagcaggcagtggatgaatactggggaagaggtgaagttcagctctgaagaccaagcagaggctcctggatctggtatgacatgcagcagatattcatcatttgtgtatgtgtttctgagagggagaggcgaggagggagtggggacctgttgggtacttaaaatgggtgggcagtagggtacgaggaagacaagaagtcaggtggcaagggagacaacaaggatccaatttgtcttctctgtcagtgtgaagaacagaaccccgactagattaaagtgcaaggttgtatgttttgcagggaaatcatagcaggtgccccaaatctggaaaatgatgcacaaaggaagctcccaagtcttcaggcccaagattctgaagaatggaggagcccctcagtgacgcaccatggaggggtttggaaggaagtccctcaagcgtgaagtctaaatcttatgaatgcggtccccatgtacagtaactgacacttagctggtgcttgatatattttaatgaacaaatgaacatgtggacttggaagcaataattggacactccaaaggcaacattccttggacaactggaacacaaattgaaggacaggtcgctattgccccaccccacttccagcaaccacaggaaggaggaaaaaaaattaggaacagtaacagagaaggaacaacaagagaggtaagaaaacaaggaaagttcgtatcttggaatcttgggggagaattggaagtttggtggcatctccaaatgccacagacagcactttgtgatcactggtagggttttggagagcagagcataatgacacagagtttaatatttactggtgggagagggtgtagggtatcagccatgtggcaaggtgcgtatggacaaggcactcctgggctggactggttttacagggcatcagagtgcagcagggagggaaataagcatgcaattctgacccaaccctcaagaatcaaacaacctgagtgtttgacctgagatcggggggactgggaattaactggattttaggaaacaaagataaaatttagatttctttggaaagagcttcagggtacctacctggccttcctctcaatttgcatagatgtaagggttatgtctcaaatatcttttaagtggaaaaagtcactatttgctgctgcttgttaagtgatccttaaaaggtattaccaatgagtcacaaaatatttggatggaatattaagcttattcgcgcatggtttatttggctttatgaacaacttatcaaccccctactgtgtgccttgaagaacgctgcccgtgaacatccaggcggtctcctcctggtgattcaggacaggatcatcatcaaacagggatgcacctgcagggctcaaagatgaacaaaaccacctggatctccattttctaagtcttccaagagaatattggtcattgtcttctctgtgctgttaccaaatgtccgattccatttactgaagtcctaggaaagtctcacaccaggaagacggtagctacagcactgtgtagaaaagctgtgcgatctgctcatctccaagttctgacacgtttgtaaggtttttagttgagttccaagtaaaaaccagaaggcagctgttagttgggctcctttgaaaagaggagtagagtcctatcaaggccaatccattggccagtctatttctaaggcttcaaggtgttcagccatgcaattttgcatggaataaagcactgagcttccgccatctttaaactcattgagttctcataacttttgtagtttcccgaaggcattttctttaatgggccatctgaatgggccatggggtcatgctgggattgttccaatgacctggttagaggcttctttatgtaagaaaagagggctcagaattctaaacgtgcacactccactgggcagcctaagatgtgatggatatggttttctggctgactccaaagccaccccagctttgtcaggaagagcaggcgtggtggaagcaatgcaacagcatggtatgggagcttttacctgtcccaggggccctggctaccctgagatagtgttaaaaattgaaattgctggccaggtgcggtggctcacacctgtaatcctagcactttgggaggctgaggccgatggatcactaggtcaagttatcaagaccatcctggccaacatggtgaaaccctgtctctactaaaaatacaaaaatcagccaggcatggtggcacgcacccgtagtcccagctatttgggaggctgaggcaggagaattgcttgaacctgggaggcagaggttgcagtaggctgagatcattctactgcactccagtctggcgacagagcgagactctgtctcaaaaaaaaaaaattcaaattgccaggcaattttactttgcaattatatgcatcacacaggtttacatgagtgactatttgtcatattggtaggaatgccaggtaggtgtatgtttaataagaactactggctttctttccaaacagttctgactcataactatttgaaggtctgcatgagccaccctgcccagcagattattgttatataaatttccaatctattttattgtggtagagactgcttgacccaacacctgatgtatcttggtaagtgtgttgtcaaaagaaagaacaaaatgttgaacatattaagtcttaacctcaaaggcagtgatgcttgaatttattttttaaggggagagctcataaatctctttgagaatagtatggaagttagagtttttctctccagaaaaatatgtttacagatgcatttacttgctctgcataccatttcaagggctcacatattttatgaatgagaacaagatgggagttctcagtaccttacatcagaccactcttttaggaagtgatatttttaaagaatctctttaagttgaggtataacttaaatactgtgtaatgcagagatgattaggtatatatagttcaatgagttttgacaaatacatgcagacatccctctcaagatacaaagcatttccatcactccagagggttccccaggttctttcctcatcaatatccacacacccagaggcaaccacttttgaaggggtcttttagttcacattcatagtgtctgcatttcctgaagacaggtgttacagagataacattcccagaaagtggttacgtgataagaaacagtcaactgtttgtattatataaaaaaagaatgcaacagcatcccaaaagggtgtcctagaaacctcgttaatgatctatgctgtcacaagcccttaagcccttttcagatggcttgtagcatctcagaaaatagaaacatctttaggaagtgattgtgtccaacagaccctcagaaaaaaatcaacgtagcccaaagcatcttcctatcttttcttttacctgatcagcttctgaatctgaggggaccaccagcaccacatcacccctttgtaagccagatttcaagcagacactcttacaagtcactctccaacctggatgaaaagaggaagatatttgccatatcccaaggaggaagaaggcctctaaagccagaagggaagtcctattctctgatatgaggccattcatatgtatatttattaatagtaatgcaatgccctctacaacagggaaaagcactatattaatcaaattttaattcatcttatttttgttagagatttgcattttattatcgctgatgctttattactgtttgttgtttaactggaacccaaaatgtctaaagctcctctaaccccagcttctgtcaaataataataaggaaaaccaccacttgcaggttatacagtaa

SEQ ID NO: 3607 - DNA, 2770 bp, Homo sapiens
gtttctctgaatagcagaggcatcaaattttggtggggaatgagaggagtattaggggaaagtttgaaaatagctctcctggagatggagggcacacagagtggtcctcaggctcaccttgactgagttgattcacagttatcctgcatcagaccattagatttctttagtgctatgattataatagggatttttgaatcaccaaaaacagtttttagatgtttatgttctttgttttactatcaatgttgtgctggttaagggagagaaaagttcaagaagatcttacatatttgaaaggaaattggtactcttgaaggctatgcaacatgagtctttgaacaagaattccttgctactttgattcattcatcaaatactgagtgcctgtgtgccaggcacaggtgaactctggggattcaggggtaactaaaacagattggaaccctgcccttgtgaagctttcagtctagaagggagacgtgaaacaaattttagcttcaaaagcaacatctatttttgcctgttagcatgcatttattttaaaagtcatattagagttacctggttccacttcagagcagactgggaaaatcaggcttacaatggaatcagatgctgtgggcctaaaacagctctttaaaaatctatttttttaggccaggtgcgttggctcacacctgtaatcccagcactttgggaggccaaggtgggtggatatgaggtcaggaggtcgagaccagcctggccaatatgatgaaaccttacctctactaaaaataaaaaattagccgggcatggtggcacatgcctgtagtcccagctactcgggaaactgaggcagaagaatcgcttgaacccgggaggcggaggttgcagtgagccgggatcacgtcactgtactccagcctgggcaagagtgagacaccgtctcaaaaaaaaaaaaaatttttttttaaatggaatcagagaaaccaacaaaatatgtaacatgtataaatgcctgaggagatcagttattgagaaatccatttacaatgctggaggagaggggatggccaggaaagaagtgcaacaaataaatggaagatgaccctaaaaatgcaccagtgacagtcagtcaatccatcagaccacctcacatgcagggtagaaacatggagtgtgcggcagcatcctcctcacatccctttgtgagcacggctgctccggaatactgaccatctgggctagcacgacttagcagagggttctgcaggatgtgctattttaaagcagctgggtgcaacttgtgaaaacgggaatctagagcagaacatgtaatcagcgatggctgggattggtggacaggattgacaggagtatttgaggctctaccaggcctgtctacaggacagcttcatcaaagggacattttttaacctgttattttaaatgccacatatatgttgtaatgctgaagcatacaggtagaatttctggatcgtaactactagtgacttctgaggtttacagttagaaaatgttctcaaaggtttatcagttatgtattgatgattggtaatctagaccctctggaggctgtagaatgtgaaaagatacagctgagctgacaagttttagggcactatcttctggaatgaaatcggccaagaaaatggttcaagggcatgggggttagagaatgtttcttttacctaaaaatgttaagccaactatggaagattggggtcgtgggggcatgaaatacaaaattatgataatttatacagaactaggtttctttatgttctgcaagaaggtttttattagctaatttggggaggggggcatgctgcagtattttttttcctgggaacatgcatttctgatgggaagttattttgtttacaagagttggttttacacacaaccctgaatgaatgtgtctatggcctaaaaatggtagacctgtatttccttcccgaggcaggctgattcgtttcctgattccttctgtctgagattacctgatgctgaccagacttatttttcctttcctgaatcttcacagctgagtttatggcacccatccaagaccttcccatttgaatgactagatttctattctatccccgatcatccttttgaaatagttctagtgataaactcagagaaattcaatatattgattgaattttattttttcgctttgtatctacaacagaaattgatttgttcatttttatttcaaatctcttcatggcaagttgggctaatggactttgcactcaagaaaggtttgtttaccagttttgtagccatgtttggcaaatcttagcaactagaaaccccgtcctttcttttccttctttatatgttcttgcagttactcttgtattgcaagattttctgactttaagctttgagactactgcatcttaaaagaagaactaggctgactggcaaaaagtcttgccagtggccctgtcactcccatgatgctttggttttgagagttgggaaaactctgagaacttaagggaaccaaactcaggaatcccaaaattggtggcattgtgccattcgtttaggggctgaacataggacctgtctgaaactgagtgagctagatgcatttgggtttgaatttttgtcacatactgaaatgtaagtcagccctaaataatcaaaacactttattttatttttctttttttaaataggaactttctgaagaaaaagtggtgtgtaaaacatttgatatttaagacaataaagtttttatcat

SEQ ID NO: 3608 - DNA, 2864 bp, Homo sapiens
ctcacctgcctgtcgcccggtctcgctcgggcttcgcgaaggggctgcggatcctaccctcgtcactggagtggcccggaccgacgcctgcacgtgaggagcccggggtcccaggcccgcgactggagcaggggtgctgatgccggcagctgtccgcgggtcaggccccgcggccccggggctcaggaagtagaaggggttgtaatagcccagctgcgggggcggcggcgccgcggcctgggggactgcagcgccgcccgaagggaagctctgcggggagggctgggggctgcagtaggctgggaaggcggccaggccgctgtgccaggtgaggtagccgcagtaggactgccacagccactcgtgcacttgccgggagtactcgcgggcgctcagccgagctggtctctctcgtggcgccgcggcttcgggcgcctcgcagcccgcctgctcctgcagctctgcaccggagccggaggccgcctccccgcgcttcctgagctcgcgcggcggctccaatttgtcggctgcggcggcagccgcgaggcccggggctgtgggccggcccggggcctggggttcggcctgggggtcgtcgcgggggcatgggacggcggtggtaggagggcctctcagggaagggacgggctcgtggtcccctccgccatcgtcctgcccgggagggtggcctcgggcttcctcgggcccctcggccatcgtcgcctcagcagcaccctctgggatacctgtcactgctccgtttccctcccccaatggcccctccccaacagccccgtcaccaccgcagcaaccgcaggcgtcaacaatcccccgccggaagcggaagccccgcccctcaggagcaacgcccgccgccaggcggagctgggaagggagggcggggaggtgcgtctgcagtcccgggttcgggccctagtagtcggtggctggtcggtgactgggaccagaccgtcgcctcctcccttttacagctttaagtctgtgacccgaggcctctctgtatattcccgtggggttgggcctagttgtcctgggagaaactagatggatgaggagtatttccgagacaggtcccagggccagcgcagccttttctgttgcagaaccgcgactgttgttttgggatccaggccggagggtttgttgcttgtgttcattccagttaaccattagtactcgagaaggtggtacagaacgcatctatccccttagaagaaaagaaattaaaagccaaactaaactgggatatatattaatataggaaactaccactgagacataggaaagtgtattaaaatataactagtgaggtgctatgtataattcagaggaaggggaaattatgcatgggccagactactaacaaaaggctccaaagcctgggatacgctgagggcctttccataacagaaaatgaaaaggaacctaaatttgagactagatttgaggaaaggcacagttgcgctggagtagaaagcgtctgtctaccgcagtggaaacgatatgttattgtatccccagcaccatacaaaggacatacaagggccaaatactgtgggaatatttattaatgatattaatgatgatgctgtccgggccaaaggaaaacttccgcttcaccttctgaagtttcgctgaaagtcactgacaggaggcagttaataggagaaaagacatagacattgatttgaccatcgttttatgtgacacgggagccttcagaatgaagacccaaagataacaagggaaatcgtgtatttgtatgcttaggttcaacaaagcatggacagccgtataaaaaaatgactggacaaggccgggcgcggtggctcacgcctgtaatctcagcactttgggaggctgaggcgggcggatcacaaggtcaggagatcgagaccatcctggctaacacagtgaaaccccgtctctactaaaaatactaaaaattagccaggcgtggtggcgggcgcctgtagtcccagctactcaggaggctgaggcaggagaatggcgtgaacccgggaggcggagcttgcagtgagccgagattgcgtcaccgcactccagcctgggcgacagagcgagactccgtctcaaaaaaaatgactggacaaaaaacactctgatgcaaacaggcaagaaacccagcaaggcctatctggattctccttggcctgtctgcagcattcattccttctgggtatggaacaggaccctctggaatgggggctgtggcctacaacagttaaacaagtgaactaaagggctcccaaaatctctcctgcagcattttccttgagaaggaggaaggtttgcatctctaaatctctctctgggaacagtgtggaagatggattgaaatggtgtaaaattgaagatgtggactccggttgggagactacaccctagataagatgaagagaacttgaagcaagacaatagcaatgggaatataaaggagaggagacatttgagtgaaattaaggaagcacaatctgcagactgttttcttttttttaagagtcagggtctccctattttgcccaggctggtctcaaagtcctaggctcaagcgacccacccacctcagccttccaaaatgctggaattacaggggtgaactgcctcaccatgcctcagtctgcagaatttgatgactgaatgtatttggagagagtctgtggcttggatgactggagacggagtttctccattttggccagtttggtgtcgacctcccgggcttaagcgatccacccacctcagcctcccaaagtgttgggattacaggcgtgagccactgtatccagcttgtgatatacttttaataaatttctcttaaa

SEQ ID NO: 3609 - DNA, 5027 bp, Homo sapiens
agaaggtggtcattagatgcagtcttttcctttttaatcccctcttagcacttctgtgagtggagaggacattaagtaaaatttggaatcataagttgcaatgcagtaaaatggtgctggggaaggagccagttagtgtttctgtgagtttgtgttgtgatgcaataagagataagtaatgcagagagaaatgaaccatggaaagtaagaacactgatggtgattcctctgcaaagatgataagaaaaagaaccaataaatcacacaatctttatgtgctttctatatgtatttcttagtagtgataccattgatcctcttactttttttactccattaatactaataattatatactttgctgaggatcaaaacagccaagaaaggaattactgctaaagcatctaagattctcctgaactgtaaaatcaacaggaaatggccactgggagagaaggatttggtattgggtgaggggctttctccctttacctgcctcttcttgcttgctaatagtaagttctttgtgcaccttccaccacttctgagccactactattcaagtagagatttgccccaacacattaactttttccttggagatttatatggtcctgcattttgtcctgtgctcacaatgtgaagtgtcttctgtattcaaatcaaaaaataatatatttaaggtatataagtgtgaatctcctataatgatggaagaagaggttctcttgtcttagatagaaaagagccttctccaagagcaatgtcaaaacttgggctgtcatctttgagctgtttaccaaaatacagaccattattgaagaaaaacaaattatctattttgttttcccccatctaacatgatagtgcccccaaccaggttgtagcattgccttttaaaagagactcactcactcttagtttttaagaactggaaatttcccatcctcagatcccttaaaggatgaagagttggctgtacacttagcggacttgcctcttgtatgcaaggactactgattgaagtctgttttgctgtgtctggttatgttgtctgcacttttatgaaatcactacaataggtctgcattggaaatgactattaatttgtaaagaagtaagttttattaaacactgtctagaaaaagaaagtgaagctgagaactcttcctttattgtgcatttatattttctgctgaattccggtagttccctttaaagtcatgttgactaatgttttcctccttgtttgtattcagatttccaaaatttcactcatacaagggaagagactccatttagcttaacggtagtctttagatcataagaaatatataaattagtatgcaccttatctgcctgttgtgggtttcttaaacttgcacttcctacccacccaaagatagatatcctttaaagaaaataaaggcagagaattaaaactggggagccatttactatgtcaccatcactgttaactgtttcccagcaatctaaactttttgaagtttcagaggtgtattttttttttgtatatatgtctgtgtgattgtattgttttgtttctaaatatacaaggaattctttaaatagagaaaaaggttaatcctcactgaaacaccaggatgcccactggatatactaatctgaacatctgtaggtagtttgtcatgaaaaagtggagagaagatgagacttttgaatgaatgaaaaagggtatcttgatacccagaattccccccaaagtacgggtaattcaacctgcacagttttctttcactcaaagtgttcagcacttgtgagtgaaaaatcatgtaattatctgtaaatatgtagctaacaaattgacctagtttctgtatttttttgtttttgtactaaagtttataggtctgtgccagctagagagaagttgctgtcattaccagttgtggtcctagcatctaaccctgaaaccatcctaggtgacatttttagaattaatacttaaatgttaaacagggggaaatgaagcttaatcatggtcaggtttgagatcttttgcagtgaaataattttatttaatataaatgatcacatgtcctcaatcatgaatgaggtagggagcctctctcccccagtggccatgtttacaaaagtgtgttttgtctataaagtgcaagtgttttaatgtttatgtaaattatgcaggtgataacatggtttggaactgtttattgggctctttaactgaattttcaaatgaaatgaactatgcttattgctggcacattgatcccatttctggaacatttttcctatttccagagttacatatgttcttttgtcattacccaatttaacctccctttctctgatatgccttgtagccaaagtattaaaggctgatgaacatagacaagggaaatgcatttcttagaaatccgtgaaccctcagttgtatgctttcagtactcgtgttaatatgtttctatggcaactctgaggtcagtggtttagaaatgagataccagtgttaatgaaaagtgtgtgctctttgcttttgcatggcttggcttagtatccaaggtatattagggccacttgaaagcatgaagaccagttatatagggaacaggtttctctcagtggcacattttgctttttctgagccccaaatacattgcctgggcatgaacattgttaccgtaaattgcacatggtcatggactgaattatgtgactttaaaggatgtaactgcccaacatttgcagattctgggtggtctatgtgaccatttgtctcgtatccaaaaaccccggggctattggaacccttccaacactttttcctttgtcatagacaagtttatatataacttaccaagatgttggctgtcctggtgtattgccagacagctctcttttggttcccattccaaatgtgctgctgtccttctttgcatttcacaatatcaaagaaaccaccacccttcttcctaacagcattttatgccttttattccacattaaatgggaattgtgcctacttaggagtgcccctccaattaattacatgtgtccaagaataatccaagctagagacacaaggtgggaaaacatttcaaaaaaaaaaagtcctcttaaggccagtaatttatctgaaaaggtattttatcacaccttgacaccttatatatgagcctattaggagctgcaggtggtttcatagggtaaaatccaagaaaagagaaggatgtgtggggtttctattagaagataattttgttctcattttaccttttcttttatgatccttctctgctagaacaggttaattctccaaatttgttttgttttgttttgttattttttagggaactcttttgcaaaagcaatggtcggatgtaaataacatttaaagtatagtgcacataacttccccggactgttccaatctgataatttgtaaatgctttagagtttttttaattaacacttgtgttgctaaattctatttatgtaagtctgctaaagttttttagcccacttaaaacttaagacaaccatttaaaataatggatgggttactatgagcaatttcgctttcagaacccccttgttttagtatatgaaaaagcctaatgcgcattaatgaggttgaagagactatgagaaatatgtatagtgtatattttaaaacagctttgcttgtattgtgaagatttaaaaacaaacttgagatttttaacgtaactattaacacagttttaacataagttatcccactgggtttaagagcatcttgaatgtataatcctttttgtaacccaggttggtttctacttttaccagtcacccaaacatatttatgtttttagttttatgtactcatttccctttgttttcctcaaacagcatgatttttttgcacatgtagaaattttttaaaagaaagaaattagtacatcattttctctggattttcttcacttccctcttcctttctactaactccttccttaaaggccatatcactccatttgcattatttgtgcaaatgccagggttggtttttatttttatttttgctatttacctaaaaaaagaaaatgcttcagtcaattgcttttttatttaaaaaaaaaaagaaaaaaagctgtaaccttatcatttctgagtagaccattgagcgatgaatgcacacctgtagtagcccaggaccagctgtggtggctaaagggaatatgttaattaagcaagaggttcttttctaaaagtggtatctgttatccacaatgtattttagttattcccacaagtcaggggtccagataaaatgagggttatcagctaactgatatgctatcattgaggttcatcaatgaatttgtacatttctagttccctttggtgaagggaaaaatgatgattttgcaagacctagattttggcttggtttcttgcctccttttttggcagccttcatcttctcatctcccaaaccccctgagcccgtagggttttcatagtggacaaagaacttgtggtcttttaaaactgggactgatacttttttgagagagtatcgtgtcgaaagtgtgatgttctaccactttaccaataactaattttaaatacacattgtcctctcgatttttggaccaaacagacgctcacagtggaggcttatcaagggttgcattggggaagaagcctctccctctctgtcagcaccagctggtaaaggtgactgtacagatgtgcattttccttttggtataaatggtccacagcactaactggtaaggcttattgtacagtatattgtcagtattcttctggttcagcataccttatagttcatatataacctgtattaattgtatagattgtgcattaaaagctgttaccaagttgtcagaacataagagcgaaaacaaggtcatatgtaatattttgtttgtaagtatcctttgtatcatagcaaaggaaatgtttaaaaaaatcaactgtaataaagtaattttagcaaaaaaaaaaaaaaa

SEQ ID NO: 3610 - DNA, 398 bp, Homo sapiens
atggccaaggaaggcattgctgctggaggtgtaatggacgttaatactgctttacaagaggtgctgaagaccgccctcatccacgatggcctagcacgtggaattcacgaagctgccgaagccttagacaagtgccaagcccatctttgtgtgcttgtacccaactgtgatgagcccatgtatgtcaagtcgtggaggccctttgccatgaacaccaaatcaacctaattaaggttgatgacaacaagaaactaggggaaaggataggcctctgtaaaattaacagagaagggaaaccctgtaaagtggttggttgcagttgtgtagtagttaaggactatggcaaggagtctcaggccaaggatgtcatccaagagtacttcaaatgcaagaaatga

SEQ ID NO: 3611 - DNA, 729 bp, Homo sapiens
ggactgcgttttttccgaacgccagcagcagggtcagaagggaggtagtcgccctccgtcgtggcctggcgtggattccgagcgttggtgtctggcggtttccgaccgttggtgtctggcacgcgccaccccgatgtaccagacaagaagacaagaaaatgatttgaggacagcttcaatcgcggtgtgaagaagaaagcaacaaaacgaccactgaaaacaatgccggtggcaaaacatccaaagaaagggtcccaagtggtacatcgtcatagctggaaacagtcagagccaccagccaatgatcttttcaatgctgcgaaagctgccaaaagtgacatgcaggatttctgacaggactctgggcccctccccagctccactccctacctcaagaatgtgaccatttggaaaaggcaaagagaaaaggagcaaaatgaagcattcccccaggcttcagccctgggctctgaggggaaagagtggggcattgtttttctaacctaacctttccctctggtgatgttggggtagagaagccgagagaccctgtcctccctaatgcactgtggcccagtccccttgcctttttcctgttctgtttggagtggagaagggcagcacctctgtgtttaatggaagtagcccatagtctcctggatttttggaacatctttttcagcctattttgtgtcctaatgattcactcaataaacatgtttgaatcca

SEQ ID NO: 3612 - DNA, 1620 bp, Homo sapiens
atcaacacaacttaaagttttgtccaagatgttcctgacacatgaagcttccagttgaatttcagaaatgttaacaaaagtatcttccttttttgcctgtgaatgtttgagtattgctgtattgttggcttatatccactacagatactggttctaggccagcccaaggatcttcaagcattgaaggcttgaaataattttccaactcattagacattcttttttctctaacacgccctgatccaaatggtgtagatgtccttggagaaccctttagaaaaaaaatcagttaaaaaaacacttagtaaagataattggtacttcttcctttagctaaaggttagcgggaatcacattgctgcttaaaagttgtgacttgaacctaaataatgttcaattacaaagtccatgcttcctttaatcaagtgttcctattttttaaaaaaagtacttaaagcaattcgttattctcatttatttataattccatgaccactgtcatctcaaatacttttgtgtctaatgtagtaactttgcagtaattaaatacaagcagtgatgaaatcaagtaattatattcaattttccctcgaaattttcacttttttcaggagaaaacaatactatagttttaaagtttctagaacctttctagctcatgaacattttctttactccttagctccaggctcaaaaggggtagggggttggtgtagaatacagcaagttggaaaaccacgtagttgcaagttgtaaaccacagaaatcccagacatgctagagatactctctctgtcttttgtatttactctcactaaaggaatggaaaacttccactaccaccgattttcttttcagggaagttggagcagaagccagtgtagctcgaaagaaagataaaaaaaaaaaaaaaaaaaagaaaaagaactatttcttgaaacaaactggcaaggcctttggcaaacaggaggaaatggagaattaggaaaatctgtgtacgggtggcagtgtattggttaaaagcacgagggctcgaaaacagaacgtacggctctgccactctttcggataatcttccggaagtcactcaacttctctaagcctcagttcgctcatctgcaaaattgggctaacaatagtacctcagagaggattagacaaaataatccacgtaaagggaatattagtaccgtgcctgccataaagtaagagctcggcaaacgctggctattattattacctgggggtgggtctgctgctgccctggggagtagccgaattgctgctgggaccccgcgggggacctggagtaggagccagggtagccgccaggggacggagacccgaaccggccccccgggaagctgccgccgtgtcgcggagagtgactgctcccgtacggcctagaccggggcccgtacggcggcgtgtggtgcggactcccgtacccgtctcgaggggagggcggccgtggtccgcccccgcccggggttccccggaagctgcttccgctaccccaacctcctccacccggaccagggtaaggaggagttgggggccgaaaattctgtcgctgcatatcaggagccaaagccgaaaacctcgcagccgcgttctccc

SEQ ID NO: 3613 - DNA, 668 bp, Homo sapiens
ttttttttttttttttgcatcagaaagccttatttccatttggtccaaggcttgttagggtagttaagaaagctgcctattggctggagggagaggcttaggcagaagccctattactttgcaaggggcccttcagaaggcatgaagatccaaaagggcctggttcagctttttctccagggccatggcagctttcatggcatctggggttttaccccactcatcttcagctggcttcttgatgtcctggaagagagcgcggccgccacgctggttttgcatcttcaggagacgctcgtagccctcgcgcttctcctcggtcaattcgcggaagaagtggctcacgccttccagagccgcatcatcgcggtcgaaatagaagcccagagagaggtaggtgtaggaggcctgcaggtacaaattgaccaggctgttgacggctgcctccacgtcggtggaataattttgacgaatctgggagctcatggttggtcgccaagaaggagctaacgacaaaaacggtgctggcaggtcccagaagcaggagatagccgagaagatggtcccggaggttgcaagtggagaggaaattggagggcggtcggaggctggaagaccgtccccggatctgttccgtccaaacactgttgaagcaagagacagaccca

SEQ ID NO: 3614 - DNA, 474 bp, Homo sapiens
atggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggagtcagctgcaagctcgatcgacatgcctacgttgcccaccccaagcttgggaagcgtgctcttgcccgtattgccaaggggctcaggctgtgccggccaaaggccaaggccaaggccaaggatcaaaccaaggcccaggctgcagctccagcttcagttccagctcaggctcccaaaggtacccaggcccctacaaaggcttcagagtag

SEQ ID NO: 3615 - DNA, 1643 bp, Homo sapiens
cgtcagctcctgctcgattttcttctccaggaactcctgtttcttgcttaacatctcttccgtgtcccgcagccgctggatggcctcctggggggtcgggccgcccttgccggccttaccccctccagccccgaacagcttcccgaacaccgacatggttgctgctcgccgcgccggccttcgccgcccgctccggctcggctcggctcggctcggctcgggtcggctccggcgcccgctcccagtcccgccgctccctgccgccgcaggcctctcctccgcctccgcctccgccccgcagctgggcccggccgcgccacctcccacaggcccccacgcccggcccggcaggcgtcagggcaacgcgccactgactacaactcccagtgggcaacgcgccggccgcgcctcaaatctaatagggggaagcgtgctgcatgccgggaagctatagtcttccggcttcaggcgctccccggcgcgtcttttgctgtagctggggtcaaagggcgtgtggcattctgggaaatgtagtctccttggcctgcgctctgtaggagtggcagaacagtaagagaaatgacagtaagtgtgcaacactgctcaaaaatttattgctagtatgggatactgccatgcttgaacttcacatgtatattcatgtgaagttgtcttaaaagcgtgaaggcaacagttgtttccaatttcaacctgtcaattctgtggtcacagaagcaaagcagtatcttctccagttaagtacggtagtgtcccccttatctgagattttactttgagtagtttcacttggccagctaaggtctgacagtattaaatagaaaattccagaaataaacagttcataagtttttaatttccattggcctaatgaaatctcgtgctatcctgttccatcctacctgcaatgtgaatcatccctttgtccaacatacctctaccatctgttagttacttaccagcttaggagttatcagatggactgccacggtgttgcagtgctttggttcgagtaaccctcattttactatataatggccccaaagtgcaagagtagtaatgctggcagtttggatatgccaaaatgaagctgtaaagtgcttcctttaaatgtaaatgtggaagttctgagcttaagaaaaaaaatcgtatgctgagcttactgaggtctgcagtaagaacgaatcttctagccctagaattgtgaaagaggaaaaagaaattcatgctggttttgctgtcgtacctcaaactgcaaaagttacagccacagtgtgtgataagtgcttagttaagatagaaaaggcattaagttgtatccttacttacaggggaaaaaaagaaaataaatttttttacaaaagaaaagaaaaagcattaagcttatacgtggaagacacgaacaaaaaatgtgttccaactgacagcaacctgttaccccccagaaagcattgagcctgtataaaggcttcagcaaggaatctcctaaaaccagtggcaccaagccacttactgaaagtaatggatggttgcactgacttaggaataggtttagactgcaaaatataaaaattactggatgggctgggcacagtggctcacacctgtaatctcagcactctggc

SEQ ID NO: 3616 - DNA, 1945 bp, Homo sapiens
ctccctcccgcgtcttcctcgggcggcaggacctcttacccgccttcagcctccccggaactgggctcaactgtcggagcagcagagatcccctctccaggaggagcggctgctcccgctgccaccggcttcatctccccctcttctgcccctgttgcatttgcgaccgctcctgggccaggcccggcacccgcttcctggccaggtcctgctcctgccgccgccatcacggccacccctggacttctcgcgagaatactctcttctctcgcgcgcgttgctgtgtgacgctgtagtcttcaaacagaaaaagcccgcggtgcgtccaccgcctgcctgaggaagcataattccacgaccgctttaaggccaggcgcgcgggcagaggtgggccggcctcccgcgccggcggtggccgcgggcctggcaggctgaaggtggaggaagctagatggttagtgcggctctctggaggacttcctttcgagtcagggactgacgcggcgtattttcgtggctacgactggatattctgcgcagaagagggtccttgagagcgctggccgtgccgtgccgccaaacactcctcaccaccgaatgtgggaaacgtcttccttggagtctagcactccctgcccgccccggatggaatttggttttctgcgcagggtcgccccttggagcccgtttccaaatgattttaagagggaagggaatctagggaggccgattccaggggcgagggtggaaaacccaggccgggcagccgaggagcggcgtgggcactagaagcggctcgccgcttcctactgtgagaggcggaaagcgaagccccggggtgtgccggggcactcggaatgtagacaagtttggtgcccagcgaaaggaagaggtgtggactgaaagtacgaacttgggaagtcatcaacagtagctggtggctggcatcagtggagtgagttgagtctttcagagccatggtctccaaactcgagaatgcaaacctctgagagtgttgcggccaggaacgttttcaggacaccagtgtttatcctatatcctaaaatgttgcctaacgataatacactcttctcccgctttacacaagaacggcgcacccctcgccaatcctcagtctaatcttactgtgatgtgtccaccgatagtgtaggaatctctgggccactggacgccatgggaaatacgtagatattgatttcccaattggttctcaattattggttttcaacaaaattgaagaaagacctaactgagttgccaggttacatttttaaaattgatgataaatacttaaatcaggggttggtactccaaagagaagcaggatgcttgatctaagtatctcctcccaaatacgtagtattgtagcagttttaacatatggtcgcagaattttgtgttttcttgttgttgtttgtttgagacagagtctcgctctgtcgcccaggctggagcgcagtggcccgatcacggctcactgcaacctccaccccaggttcaagcgattctcctacctcagcctcccgagtagctgagattacaggtatctgtcaccacgcccggctaatttttgttagtagaggcggggtttcaccatgttggccaggctggtgtcgatctcctgacctcaagtgatccacccacctgggcctcccaaagtgctgggattacaggtgtgagccaccgcgcacggctttttttttttttttttgaaacggagtctcggtttgtcgcccaggctgagtgcagtagcgcgatctcagctcactgcaacctccacctcgcggtttcgggttcaagcgattctcttgcctcagcctcccgagttgctgggattacaggcacgcgccatgacgcctggctaatttttgtatctttagtagagacggggtttcacctgtgtgttttttttttttttttctga

SEQ ID NO: 3617 - DNA, 5004 bp, Homo sapiens
aggccacttatcgctggctctggccttggcaacctccacccccgtcccggtcctctcagcctatctctggaaaccactcttttcactccgaatctcaacttgaagtttggggaaacttgacgcagccaaagcccatcctctgctctgcacctggcaggagactaatagtcagggaagatgggcatgttgtgggtgggggtggagaacggtgtgtccctgacctgccctgacatgctaacctggatgcgctgttgtcttggccttcagcgccacgtattttccctcgacagtaacttggcaagcttttcatgtcactctggcatcgctcagattatcagctacccttcagaaaaagagccctgcgtttcgatggctaaggaactctgacaggaagaggagaggtcccgactagaggagggggcagcattcatcttttggcaccggtgagtcagtttgcgaagttggcggcagcgagaccccgaggcatctgggagaccccggagttctgactgccctactccgctttcgtttccttccccccacccctggcttcccgggtattggaagccagctgggtccccggggtcgcaggccgcccagaggttcgagccgcgcgccggggtggggcagcgcggggcaccgcctccctccataccttctctccccgtggagcacataggagctgcggaagaagcccaggagctcattctcgatgagcgcgttgtagataatcttcagattgtaattcctctgcgcgtccagtgtcctattcagcaccaccactaagacctgggtttgcgggtagaggaaaaaaccggctacagggacagccccgaacgcccggtcctcggccagctgcactttctccaccgccactcgggaagcgtgcagcactacgtagcgggtggcgttccggcacgcgatctccacgttgacctccccggagaaggtgaagttctccatgaaggcggtgagcatcagattgtagtgcagcggcttcaggtggcccgacaggcgcagctgcgtccacggctcccacggctcccgctcctcctccgacggcggctgggccgacgtggtccccggactggccaccccacccgcctcgggctgccaggagtccccgcctgcgtggtggttgcgccgggccgatccagggaggctcccgttgccgccgcgctccggaaagcctgaggggccaccgtcggcgcctggcgtggcactcgccccgcactcgtcgaagcgcaggctgagcagcacagcgagcattgtgaccgcgagcaatgccacgagggacacagcgaaggccagcacaagccgcttgtgtacggcgatgtggcgctccgtggtgcggggtcgcactcccactgagtctgcccacgggtcggagagccccctgctgccagcccgaagcgcggcgtcgtcttcccccatcgcggctgcgaagggtgagctgctcttctcggccccctcctcctcctcctcctcctccttcttcttcttcctcttctttttcttcttctttttcttctcctcctcttgctcccccagctcgccgtccagggccatcacaccgcctcctcctcctcccccgccccctctggcaccccccgcgggcgggccacccgggccacagccagagcaggcatcggagagctcacgcgggccgagggcgcgcgactggggatgctggcccgggttcttttaagacgggttctggacacaagcgacggcagcttccgcgacccccatcagccccgcctcactctggacaccgggctgtgagctctgggacgcgcccaacttggaaagcgtcttgcttgcccagcgcgcgctacttctcggacgagcacccggcggcggggcacatgctgcccccgcccctgcgcgcctgcggctcccggctctccctcccctgcgccgcgctctcgcctcgctttccgcgggagccttccaaccggttctcggctagggagaaggacgggagcggtgggaagagcgagggtgtagagagggaagttagggctttcgctttctccccccactccagcggcggcgttcggtcctctgggtggaatgtgctcgcagcagcagtgacggcggccacagcacgggaggcacccgagccatacaccctgcagctggagagaaaaggatggccgaggtgggagagactagagtgaaccagcaggaggaagtcccagggccgcgaagctacgacggagatccgtcctggaaaagccttctccaccctgggcactttaagcggcggtggcggcaaacggcaggaggttgcagacccgacagcgagactccctcattccagtcttgctctgccctccggagatgacaagtgagaaagaagtgtccggccgggccatccccttcaggtagatgaagctctgggtttgctccatatcccaagggggagagccgaagtgcgtatgtccgagcgcgtgtgcatgtgtgtgcgcgtgtgtgcgtgtgtgtatatacacaggcttcgggtttagattgccagggctactccagctgcattgagggactgaaactcccagagaaaggcaaaggagagggagcgcgcgaggaggcaggaaaggcgggagggaggggagcgactgagcggcagaggcaggcactgggagattagagagcttttctccgctctgtcacaccagacacccacagccacagagggggttgctgagccgcctgcaagaagtacattgtaaatcttcagcgcaacaagccccgcagtcacccctcttcctgactccttagccccaccgcgctccagggagagatccttggagcctttggctattaacatagagagcaaaagaagatcctgctagggagatgtggctgtgtcagatttcacatcaagctcgccagaggatttggaggattgtatgtaaattgaaataaattctccaaaacctgactacatatattacattatactgtgcgatgtgtccaggtgtgcagtactaaaataatgttagcaatgaagcattaaaatcctccggaagtaaaggccaaagcaaggtgatgttttccccataggataattcccatctttagattggagaaacgattaacacacaatgtctacagtgtaacattcaggaccaaaaccctgagactgagaaaagctgggcttattagaacggtgaacgaatacattccatgattggtcagtttttcatttcacctagccataattactttcttgcagctttccagtgttaccatgaacattgttttaactttgttaggatagttatcaatagaccagtttgctgacagcaggcagcatcaaaataggttcatagcccattggctggttatggactcttgtctgagtatattggagtttaaaattatactgcagagtatgtataagtatgtgggatatccaaccttcagaatttgtgcgaagaactctaattggaacaatattcagaaaacagccaccccaaaggtgacatctaggaagcaggagtctccagtgtttagtaaaacaaagtgtgattggcttctgggttaattaaaaaagtgaataatagaaaattaggtaattcctttttacatgtttctttcatgtcttcaaatcttgaaggcattttacaaatcatgtccatagctattttcttacaaaaagaactggttaatgcttctggctttggagtactgaaaatagacaattaaaatattgtgtttggctttaaaagcatgaccaaagagaagagaccaattacacattaaccttagcttgataaccactaaaaacacagccctgctcgaggaagccctttttcatttatccccagatgggatacatgctcaatgccatgcattctaaatgtccatttgaatcatttttaaatgatgatgaaaataagtgccagggtgggattttttaagcatgttgtatgtgggccgttagcaacagaccaagggaaatgccacattctgttcaagttacttttttctgctctgtttttaaatgtctgtactcttgctgtccatatgtatctggctgtatgcattttaagagttgaggagttggggttcattggtttgttttcacagaatcaggaactatagtgcaagcaagtaagaggagccctgcgatcctcagcaggtcaccagacttctctgactttagggttttaaactggtaatttagtattactgatccaatatccatggattgagtacatttgattatcagaggcttctggaatcatcccggggagtctaagacccactgcctaaaggaagaggttacccactaagggatctttaagactttctctttctaaaacattagtcaagaaaagattcaaagaaggctttttctgtttgtctttttttaaaaatgtgtacaaatttgtgggatacatgagaaattttgttacatgcacataatatgtagtgatcaaaatcagggtatttaaggtgtccatcacctgagtacaatacatttttgcaaggtatagtcaccctactgtgctctcaaacagtgaacagccagattccttctgtcttgctgtgtgtttgtaccctttaacccagttctcttcatctttcccctttccctcactcacggttctcagtctgttatctctttcctctctttacctccatctgttcttctttgtatttcactaatgtgtttatgtacttctgaaaattactacaaggaaagtctcaaatatttcagaattaaataatacatttaccaattaataaagtctctactaactgtgattaaattagtaaatggattattttttcagacccaagtggagtggacataagattattaatatagaatggacacaacttactagctcatggattccccttaaatgtaactttgcataataaaacttactatcaagatcaagtaggtaaatatttcttcctttcatatcagtgttacaaaggtcttcagtgagttttatttttttaatttctgaaaatatatagcacgct

SEQ ID NO: 3618 - DNA, 12508 bp, Homo sapiens
acgccctctacaccgcccgcccgcgctgtcatgccctgggccagcagtccccgcagcttttttgtttttaaattacagattgggggagggggtctcgctatgttgcccagactggtctcgaactccaggactctagcgatcgtcctccttagacctcccaaagtgcttggattacaggcctcagccaccgcgtccggcccccaaaggctttcattcgcagcttgagccctgcgggcgccaggaggtgggaggactgcgggctagaggggcagggggcgagaggagggcggggcctccgttcgtggcggtagcggaaccaggggtgcaggggcggagccagcgccgctggccgtggcgtccgggagctgtggggccgtcccctcatcgtccgtttccattttccttctgcgttaggagagactggggtagcattagtgtactgagcacccgctccaaatttcgactgcccaggtaggtggcggcgcggtggtactgagggcccccgtagccaggcgcgccctcagacagcgggcacgggcggacgcaagggcagcaagaaatacagcgcttcgtggtggtataaaaacgagacctttactctggcaataggaattcacatttcaaaagctgatgattgtcaaggcgatttaaaaaacatttttatgagtgtaaaaaatagtgttttaaagttggccattttctaatacaaaatgtttctttttaaatagcctttaataagcagaatgtgtgattgttctttaattggttctctttaaaatgtgctggaagacaaagttcgaggagcactgtttcaagcaagagaaaaaggggacataatttaaatgaaaatgaaaatatgcagtaatgcaatgaaaaaaccgtttcctagatttagttgtaccgaaatacatgacatcgcctgcattttgtgactttgtcagtagtcacgaaggtaagtactactttggggtcagagagagcctgttgagataaaatctcaaagctgttagaaacattttaagatgtggaaagataatcaacaaaatcatttacataaaattagtacttagcagatgtacacatctgcaaaaataaagtgagtttggaagcaaaatttgaacatttagcaataaaattaagacgaaattgctagccagtaagagcttaggaaactggatatccttagtgagatagaataaacaagatcaccacaatgatgttttaaaacattaggactcctgggttaactggtctattatgatgatggaactgcagaataaaaaggttgtttgggcaccacttgtcttagtccttttgttaatttgtcatttttaccagtaagatcttcaatttgatttcacagttccatgatgaagaaatattttctgcaaagcaaattactgtaaatagggtaatagtaatacatttggccatgatttaaattctgcacacatttcagagagaacaattttacaatgttaagttttaagcaaatgcttatttcatgcagttacaataagtttaggccaagcactttttaaaaaggcaaatatgttcgaattaaatacttagccaaaaaaggatttcattatgcaagactgataatacaatctcaaatactgacagaaattaaccccaccacagcaaattataaattcaaagcttaaattctttcattacactgaaattgctaaaaaaaaaaaaaaaaaaaaaaaaaaactttgcataaaatagtcttcaccgagttaagtatttcattttatagttacttgttgaggacataatatactcaataaatattataaattaagtgtaaaatttgaactggaaagaagtttaagcatttcattagagctcaaaaatcaaaccccatgcacctaaaagtaatagcagtttattaggaattcttccctttctcacctgtgtatcaacatattggggatcagtaatttagatgaaagtatactacaaaaggagcaaaggacacagacttagtaggttagaatattctggcttatgctaaaaaacaaaaagccttttttttaaaacagacatgcaaccacaaatttctcaagtattttagacacttggttcatctgtataacaaaaaaaaaaaaatgcatttgacttaaaaaagaaatagaaaaccctaggtttctgtagtttagtttttcagatttacacatgcaaatcatatattcagatatttttaaatgggaaaacaacttactttcaacaacttaatttttccagtaacacgttactatgttaaaaagatgcgacagtatattcatttaatctggcaattttaatttcaacaaatacatattaacaacaaattaaatcctattgtaaatacacttctttgttataccacgaccaaattttctaatcctagtacaggccacaatgaaataggccaaacatgctaccattaaagtttgttgggatgagattgtagtaagtttactcaaagtattcaagttctaatttttaaggtgctgtagagaaacataaaagatttcactgtatctaaaaatatgactgttttgatcttaagctatacattttatttttatctaactgattaagacctgcctcttaatgaggcacatttttggcatttctgtaaatgctgctacatacaagtaaaaataaggaaaagccgtgatagtaacattcatagctttcatagaaaaatatatattccctgaattagtcatatcaagtggtcattcagtatgaactgcaatattataaacaaaatgacatcaatggactttctctaattgcctatttccaacactctacttcagaactcaataatcagtatctccagctgaaattcccaggtcctcctagtttgtttttgacctttggggatgtgaattgtagggaatggatctgggtagtttttgcttcactcagaagtcaaataggcccattagcacttcctttggaaaaatgcctgattttttttcctcatgacaccatagttgtcgtggtctgaatttttacactgtaatggagaaccctgaaaattagcatcaggttaagattttgaaatttgttcacttcaagttcttcctagcctgtacacttcccattatattcttcctctaaggaatcatgtcttcaaggccttgcattctggaaaggaatagtagtcttatagcaggccatttgtcttttctttccacctctccacctacagactctgcaatttatttcctcctcagaattccccagagcacatgtctgtacaagagctgactgggaggaacccactggattatggcttttagaaaattcctccaaagatgccaataagggagtaattttagagctgggagcagaatgtaactgccagtttacttgtgtaccaattgttttcagatgccacttctacattctcatagtcactattgtgcattttctttccaggatctgaacccccttaaaaaaagcatttttctattaatatcttctagctctttttcactttcagaatttatggttgtatcatcctctttataaacattcagtaattttttcttagccgcagcagaagcatttcgatggggcagttttctgctactcttcctaatccagacattttctggtcctgagatcgtttcttttagattactcattatctttattttatttgcagcaacagtagcacatctgcggggaactttctcaggtaccatttttgctttcagagtttcactaggcatctgcactgcatccttctgattatgcatacatgttctcacttttgtattgggttctctgtctctaggaacaaattctgaaaaatgagtgaaagttcatgtaaatgcaaaaatcttgtaacacaagattttactactgctaacattcctcaacaacactcattcggaaacaataaatttaaaagtcatattgctaaatgataaattttaaaatgtgatactaagggcttcttcacattgatataaccttacatttgcttatctacaactataaggatgtcacttaaaacagtagcagacttgtaagaatggggtgaaaagttccttcagcatcggcatcataaagctgctaatctaaaaacatatatatgagcattttacataatttgaattactaaatcttaacttcattgttccagtattttctgacctaggtatgtgacacacgagattcagattaaaattctaaaaaataacacagagttgctttaaggaaccaaaaagtgcagagtgctatgagaacacagactggaaacctaacctagcctaagggatcaaggaaggcttcctttaaggaagcttttagacgagaggtgaaaattgtgaagggatttgccagacaaaaagcactttggagagttaactacttcatgcagactaaggcagtttttagagggggcttgaaatcacactggagctctacacagccacatgatgccagagctactactccgtgctgaccaaacttaggagggctcagatatgtttgttaccagtgtctcaaagccaaattttcaaatttcacaaacaagtctaattagtactcttctagaacagaagtgatattccttttacgtatctgaagttcacgggcccttgaattttaggtctttcttgcagccatgaacagtcaaactatctaaaactgccttcatggtacacaccaatcttgatggcagtttgttttgtaggaccctgcctgaagtttccagacatttagcattcaaaaggtaaggctgtagatcactgaaataaccagttgatatcctccacccacactagacatctggaggactccaccacattctttttactactaagtactagaaaatgagagctcttttagtcagatactatcaagtaacactattattctgtagcaatgaaaccaccaatgccaaccttctgaactttttcttctgtgaagatgtttgcccttctgtcacaaagctgactgaagggcagatgagtacaggtaaaaactgcttctgtggactgacatgttcatacagctagactaatgaggcaggcctctgccctcacagtgcaagcacttcagatttttccctaagtctatgaaactgatttcacacttctctaagatcagttgagcgttctccccagaataggttaggaaatactttattcaaagcaaccccaccacatacacatcagttccttttgccaactaacttatgtgattcacatgtttttccagtgaaattctaagggcactatgttttgttcagtgttcagtctccaggcattgtaaatggcattttaccagagtaagacactcatcacggcattactctcatgcagcatgcccttacctccttcagctggactctgtgggaagagaagtggcttaaagtgcactgtgtttaccacttcaaagacacttctcttgggaattttaaaattatgaactagtatctccaacaagtcaaccctatatccaaaatgaatctttaacacattaaatcaatgttagcaaatgctaaaatgtaaatatgctacaaagggtaaacaaaaattttaaaatatgcaaaattaaggtgaaatttgcactttatagtaggatgagaatatactattatcaactagctgcaccatttgcatttggaagaaaagaacagataactggttcattcccaacaacctattcatccagacaaatagataaaattctatttcaactacaatttgtaacaaaatgctttaagttgcagaaattccattttgatgtgtgatcaaagtacctatactgacaatttaggaacctagtaaatactaattctaacacattttaataaatgtttatttgtcatccagaataatggaaaagttaagattctgcaggaaaaaaaaaactaaaatcaggtttttaaaaaatacttaaggaaatttgaacttcagtaactatgcccaagggagggagaatttgaattacactgtactctaacttgataaagctgaatctcttaagtcttagacaataaaacaggaatttcagagaataaggataaaaacaatctgaggaagacaaaactgtggagaatttttttaaatacattcaagtcagtgttaattttattactgaaaactgagtaaattataaagtgctttttctcaagaaaactacaaacagttttagaaatatatataggatatttcagggttagaagtcaaatttgtgtgttagggtacaagcttaagaactctggatgttgctgctctaacaatgcatttgtgatggtgccatgtgatactaagaagtcagtagaatcccaccagtcctactgcctcagatgagtcttgtttcagtcatgggtttacaaagtcattgagtgcttgaggacttgttttcctggaagtgattccctacttgggtatggcaagaacacatcagtagtgtaaaactgtacatctgtagtagcactccatgatcatttccctggatgaccactttaaattataactcacagatatgtgtgtattctaagatggtatatgtggtgaatagaaacctggatacaaacataacagttctgactcaacacaatctctagtttctacatttcaaggattaatcatattctaattagacttttttttaatttttaagctaccttatttacagattctgcacaatatttcatcatacaaaactgttttcctaaattcaaagtaaactgcatatggttactacagaagcattataaaattttcattggcatttttaaaattggagcatttaaaacagatttgagaatgagaaaagaatgtctgactcaaaatgaaaacatactagcctctttcataaactcctagaatcttgacattattggttgctgtggttggtggataaatcaaatccacaaagtgggtaaaccctctaggtgcaagttataagctccctcaagcaagccttttatcagaaaagacttgagatattctctcctctgtctgcccttcattgataagcaatgaaatgaccccaaaactcagaaagcaaataacatttatcaatgatcttcatccctcccaaagcagaagtttccaaaaacatcccataaactgaagtaccccaatggctgtagaataaaatggtttctgtaacttgctgtgtttttaaacagttccgttttctagggggagctggtaacactgcagtatggcagcatcaggtcaaaagaccatcagaaataattccatgaactagttcattagcttattcatttttagggttcatttactcaatgatgggcaccacacaactctgaatttttgttcttattctggaactacaactaatctagctcatcacaatacagttttctctcacccctagaaaaactcagatttgtgatggctattgcaatttttaataaaaatctcataaaagccttattttgaaatatgaattcagggactttatacttaactgcttaatttgctttttagaagcaataccttaagagcatttcacactaaatgcaggcagaatcagaagtaaatacttgttttcaatctaccctattactgtactactggaaagaaaccaggccacagacaatccaatggcaaaccccttttccagcagggctcctgactcgcttcagttcccctatccaagctcatatgtaaaactcacagcgctcgcacccctatattctgcctgcatgaaaagaaattaccagtggaaaagaggttggggaaccacttgggacaagtctggaattaaccagctagaatgtatttggcttggagtagtgttttgttttgttttttaactcttttgcttgttaagatgaaaatgctaaatttattatatcccatttaagaactgacaaaaatcatctaaatgaatagattaatttagaacattaacgatcttatgtgaagtggaaaactaaagatctgcttgacaggctcatgtaattttttgattgggattttgtaggtgaatatatagttgcagtccaaggactgattcacatttagaaaattaacttgaatatatcaaaaattaaagatccctttaacttttacccactgatcaaaaaaggtaatttttaaaatgatttaccttgtaaaacaaaggggtagagctgctacagtccatctaggctctatatactggtcatctcatttcagttaggtcaattggactgcctcttctctttggcagtctaaaatctcatttaagggctttaataaatgaaaaaacttaccttaaaactgacataactaaaatatgaccagaaagtataccatagcattgataattaaattcaaactattggtcttgccatacttgagaaacagatgtatagtctaattatttacatgttgccaaagatagagcctgcagattggtagaatccaaatgatgtgactctccccctccctccatcaaatctagaaaagcaattcttgagcagacaccaatttaaagatatttttctaccaatttaacaatatattaggaaccagcttggcagattatgaaaaaggtaaaaatctcttacttttgagaatccccatgtatccttgggcaacatctctgtaatttaacagcctttaaaacttaaaatcgtaagaaaagacaacacagcccttagcattacatactttacttttcaatccttactattcacagtttgagctaggaattaacatttgctaatctagttggactcagtttttcccacaatgctctattttctcacctagttttgacaaatttattccttctcttcccaaatactaggataagagacagtctcaaactgttaagttgcaaatttcttggggtttctgctttattatttccttgatatccacagcagaaattcagaggtataacttcaacattaacaggtgaaaagttctacaatgacttgttgcactctatcacattaaaataattgaactataatttccatacaacataagaaaactacagtatttggtgacaactgcaagatacctgataaataaatatatcaacttactattcatgaaaagaatggagctggttatttcagctttaaaagggcaaagcaaaaagaccattttctagccatttaaaagttactcaaaaaattgatacaatggagtggaaaggaaaacaaaaaagatcgtaagcacctttaacaatgttcttgcattctactgatatacaaacctctggggtttcagttggcacaatcaagttcaacttgtactaacagaaaatattaaaattcttcctatttttaatatcaaacagggaggttagtaaattgttttctgattcttctacaaaaaaaaaagtctagaagacagagggaatgtagtgtgcaccccttattctaagtgataatttttacttacgaggtcataacgagtgcaaagggcttagtgatgcatcttattctttacttttggacagtaacaccctcagatggtatttttattggtttgttttatattccccttttccatttgcccttctgttttgaagtgctttttcttaaaacttaagttctttgcctccattttcttataaacccaatttcctctttaggtgcagctctactatttgaaaggaacctttctgttgtaatttacaagctgtgagtaactgctatatcattgtttccaaggattaataaactgagaaatgatttaatcagatatttgccacttacaaaaagggaggctgaccttaggaattatttgaatatgggataaacttttccttttattcataagttacttcacattgtaagtatacctttttaaataaggaggacacgaaaaaagaaagctttgttaacactcatctatcttgtcaatgtttgaaatcatttttcctttatatgcttggtaaagtgagtctttccaagaaagcaaaaatcaaatctgagtacttcaaagcctgtaaaaccataaatgaataaaaccataggactttggacatacacaaccaaagtagtttttgtttttcacatacaccattaagttgaacttcaagtgcagtggaaaggtacagcacttatttctggatcagttcacattcaaattataaccctttatctttttctcaagaatactacaaactgaccctaaacattaaagtacacctgtgcattaaatccctgggcattttgcataacgtagaaaaaaaaggccaaacatgttctagtgctcaatgtaaacattttaactattaatgatttattaattttccttaaaggtacttaggagtgtgtgtgtcacatattcaaagttaaccttaggaatagcaccataaccaaaaaaacccataaaaattattttctccattatctctcagttttatttcataacttgagaagctaccattgtcggctatgcttttaaagacatcaggtccattcttgctgcttctgatgaaaccaaatctgattaaaaaccaaaataccacttctgtatgcaagggtctaactattttggactgaaagaaaaaatggtaattggatggccagtcaatgaccaattaatgcagtccaaataatcagaatagttctattaatgaagcctaaactgtcaaaatattgttttataccaaaagaatgtatgtacttatgaatgtattccatatttatttatggatttttttggtacctttttgcaaatgatggtaaacatggagttaaaacctgagaacagattataaaagagaaggttaagaagagtttaaataaattaatggatttgacatctatcaccagtttttaaaattagcaaagtaaaaggcatcccattagtcttttcagtcttagtcaaggacaattatcatgaatcaatctgtttactatctacttaacacaagttctgagaagaaaagcatcatagttctgaaatggtgatagctctctaagccacaaatgagaggaggtttcccacctatctcagttgataatgtccaaaaacatccttccccatgcatcagagtagaaagaaaatgtaccttctactatgtcaaatggaatagataactacaaaataggaacacttcagaacattctctaacattaataccagtctgatgcttcgccttgtctgccacttcaaagatacacaggagaaaaggttttgtctgaaaccaaacacaattagggctaataaataacattgtctaatattgataccagtctgatgcttcaccttatctgccacttcaaagatacacaggagaaaaggttttaccttttctaactacttttgcttttcctttcgttttcctccttttggtttttgtattatcagtacagtcaatatctgattcagttacagatcccaaatctgatgatttggaactagtatcaggtctaaactttgaattcccagttgtttcagagattttcacattttccaattcaggatgcgatctcttcctttttacttccttctctgctgtttcctgtgaatcatgaatcacttttgtcttactaaaaggagcctttccataggtcctgagtcttctgccattccacctgcgcagcccataattcagttccacttcaaaattattctctgcagtagctttttgtgccaaggttgactctgaagaaaatgtcctatcagtctcactccctggaatatgactttttgaatcttctcctgaagatgtaacagaggaactttttcttttagaaggtgcatctattttgtgaatattggtatgcctgtgcttgtgttctgaattcaacatatcttcagagtctgagtctccatttagagcctgactaagcacttttgtactaccttcggagtcaggatcaggtggcttgccttcacaggcatactgttcacttggtacttcacaatgtacacttccttcacaatcactcaatttcttcttagctgtagtacaagcaagatggagaggttttttccttccatttttgcttctagtgtgcacattttctaaactgacatcttctacatcactcatgagcttgatcttattggcagccgtagctgcacatcttcgagtaatcctcaggagacctgttctggcttttgatgatttcttaaccacctgtaaactactgtctgagtcactggaacagacccttttcctggaaatttttctgcttagtccattgtcttgtgatgcagaatctaaaagttaaagagcagatttctattaatcttttgtaagtctaaaggaattatatgttcaatattaaaaacaagttcagaattcgtattaatttgaagggggtattgcagtgaatggaatggtacacacctattagtatagtcatatgttgctcaacagcaaggatacgttctgagaaatgcatcgttaggctatttcgtcttaagcaaacatcacagagtgtgcttacacaaaccttacagtacaccctactacacatctaggttatatggtatagcctattactcctaggctacaaacctgtatgacatgctactgttctgaatcctgc

SEQ ID NO: 3619 - DNA, 1369 bp, Homo sapiens
ctggagcgcccagggcatgtccgccgatcccaaggaggcaatctgtcaggcgccgcccgggcggcagtatgcctgagggggtcctccgtgttcgcgcctcccgccgcctgcactgaaaggtctgtacctgagcctggatacttgaacagaggcagacactgcggctcaaaaccccaagggtaatatcctagctctgagacaaaaattgggaacctcagcatgagtttgtcacctgaatgaaataaaaaaaatcacgttgaaggctggtgcagtaacatgtgcctgtagtcccagctactctggaggctgagtcaggaggatcacttgagaccagaagttcaggaattcaagactggcttgagcaacatagcaagacttcatttcaaaacaaacagaaaaaagccaccaccttcagtatttcttgccaaagcaaaggagccatttgttctttacgatggtcaggaaaggaagcatcaaggtcatcaaatgaaaaattttcagcatttcagcctctctgctcagggaaatatctgaatctagaatatcacaacatgagccaaaaccgccccatttctcatgccacatgtcactcttaacacaaggttactcaacctcgagcatggttggcatttggggctgaataattcttttttgtagggggctgtcctgggcattgtaggatgctcatgagctacctcagtctctaccacccactagatgccagtagcattgacccctgatctctctacccaagttgtgacaactaaaaccatctctggataatggaggaaccttaaatgcatattgctaaggaaaagccaatctgaaaggattacatattgtatgagtccaactatatggtaatctggaaaaggcaaaaccatggagacagtgaaaaggtagtggttaccagtggtccatgggaagggttggatgaataggtggagcacagaggatttttaaggcagtgaaactattctgaatgatactgtaatggtggatacatgtcatacctttgtcaaaaccaataaaatataacaaccaataaaactgcacaaagagtgaaccctaatgtaaactatggacttaataatgtatcaatattggctcaccaattttaacaaatgtaccacactaatgcaagatgttactaatagtggaaactggagggaagagggcttgaggggacatacgggaactctctgtaattcctgttcagtttttctgtaactgttaaactgtccaaaaaaagtctgtttttataaatggaggcatggttttatatggactaaaatactatgattgcctttttattttacacatggtgaaattagagcaggacatattttaaactcaaaattcacaaaat

SEQ ID NO: 3620 - DNA, 2884 bp, Homo sapiens
gcctaaataaacttgttttaagtctctatacataacaatgaagagggaaaaatgtgtcttcaaaaatgaggagagccaagaatctgttttctctttttggtcaaagatctggctgtcacattttaagaacaactgtaagataactaaatatacagcatgccactccattcctctgccccctcaaaagaggaataccgtgtatctatgaagaagcctttggctttagcacattcccggagttctgaaaagaactcctggtgtggaggagggtgctggcgcagcaaggcctgatgagggaagctctcccagatctttttggcgacccagtggttggccaggatcatgcattcagccactgtctcgtggacttccaggggctgcttggggatgaggtcgtgaatgttctttttgtcatctagctgtacgcaaacctctaccccttccagttccagggcaccacatccgtctcgtttagctctgacatggcgagctatgtcggtcagctttccaattgcccacaccaactcctccagcttggcttgtctgctcttctcatccaagtctttgaattctggaatatcatcaacaacgcttaagtttccatccagtagttcttgggctgcttcatagaacagtttgtatgctgatcgaataatggttctgccataccacactttcttaatttcataagaggctttatccagttcccacatgatgcttacagcatacctacaaaaacagtaacattgacaacatcactattcaaattcatctggctttttttgttttttgtttttttgagacaggatcttgctctgtcacccaggctggagtgcaatggcatgatcactgctcactgctgcctcaatctcctggacttgagcaattctcctgcccaaagtgctgcgattacaggtgtaagcccagctttttgggtggccaaggcggaaggatcacttgagcacaggagttcaagaccagcctgggcaacatgtgaaactctgtctcaaaaaataaaaataaaaatgaaaatgtgaaatgacttatgttcaaagttaactcagtacagctttgtttgtaataccaaaagattggaaactatccaaatttccatagatagtgcaactgttattaatacggaatgatctccaagataccattaagttcttttttaaaaggaaggtgctaaacagtatatatatataaaatgcaaccatttgtgtaaaaaagatcacatatgcatattcatgtatgtattatatctagaaaaactaatacggaactggtaagtgagggaaagtgatagggaggaacctttcattaaatacctcttgggacatatgagttcgggcctatatgattctattagctattcaaagagaaacaaagtttaaactcaacaaatgaacaaacaaaaaactccccgagttcatgatcctcatgccaaacaacttccgccagggaatgcataagcacaaagctacatacatttgttctcagattttagctgactttaaaaagccagcaacagagggagacgcagagccccactgctagcagacagaagagaggagggaaagggcagggaaggctagagaaataaagctgcctaaagataagtggtgtggggttggggtcgggggtgaggttgagaggtcagaggggagacacagggctggggtggggcatagcagagaagaaacatgaggccagaagcaggcagcatcaggagccacagaagggccaggacaagctttgaagacaaaagccataaactcacctatcaacgcctcccagaagggaacacaaatctgcactgaggacggaaggcagcatgtcatagcgacgatctgctagataataagtggtggccctgtgaatgacacacacgcggcaacgcgacctttagcagggagaagcagaactgctgactgtgtgggccgcagggaggtaaatggccaaaatctcactacagattccccaaggctgttgctgtttcataaagtgcagcagactgggtaataaaactattcccatggtcccacttttctaagtgacactgctttgggctgaatattcttccactgataagagaaagaaagagcaagtgacatgaatctttgtcgtataagaaaaactggagtgtaatgatccagtatttttaaaaaatagtatattactacatgaaaatttaacccatttcgatttagtaggaaacaatgtgtgaaaaggttatgttaaaaagcaaaggtaaattgatcaaggtactgtttttctaaaggaaaatggagagtggacctcaactttttttttctggaagggaccttcaaaattgcacaaacatgagatctttgaacacctgaaactagtacagacacaaaatatccagtcacatacacacaaccatagagctgatttcaaatagcattaccttgttctagcttcaatatcaatgtaagaatttggtgccacaaagtgtgttacatctgcgatgtggaccccaagttccaggttgccattatttaaggttctgactgagagtgtgtcatccacatcttcacaacctttggggtcaatgctgaatacgagatggcttttcctcaagtctttacgtttttgttcctcttcaggactcaccttccagggactttctggtgtgtttactggcatctcacacatctgtatgagaaaccaaatattcagcaattcatgcaccacaaatttctgtaaaaatccactcactaatattctcagtatgaccacatagaaattcattcattctcaattaccttcttcatcaacctatgttggcttcctttgatcaataattgtttactaggtgcctcagatatcccaggtactgtgctgggctctggaaagtcag

SEQ ID NO: 3621 - DNA, 3571 bp, Homo sapiens
tcactgcagccttgaacttctaggctcaagcaatcctccctcctcggccatccaaagtgccgggattacagtcctgagcaccatgcctggccttactgttgagttttaggagtaatttgcagagggcagaagaccaagagatccgagtcatcacagaaaacaaacagccttccaggatatcttcaaactcttcagctccagcccaacaggcaccgtggacatgcacagcatgaaagttgccctgggcaatgtgggtatccagctgagtccacaggagacgttcgaggctctgcggcaggcagacttggatggtgatggaatcgtaagcttcattgacttcctgggtgtcttcgatgacaaccaccgcttggctcagtgcatgggcacccgccccaggtgcgcgcagcccgtactctcagattcctaacctggaggggttggcgctcccggaacgcaggacacgaagcccagccccgggccccggcttccgcctgatccagccctactagcccggccgccccaagatcccgcccagcccggggcgtgtctcggcctagggatactgggccagccacgaaagcctccgccccctcgaagcgggctccctcgccgccaactctagtgaagaagcagcccttctccccggcgcccgctggtttgcagaggcctgctatgaagagcttgtgcaagtaaagcgtttgctgagcggaaacaggctgcgggtggctgcggcaggcatggagccgacgcggatcttttgcaaacatctttattaatctcatataaaaataaggtccatggacggtcctcggggctggggcttgcgggggcgaggtgcactttataagttacaggccaggctcctgctgaggctaagtatggctatttggagggggctttagggtgggtgctgcaagcagcatttgggggaaggggcgggcgatgctgccctctgtggccaagaggaggatgcaccagcccgtttgaggcgggccacagcggaggaggggctgcccggccagccgagctgaggaccaccttccttgagcctcagcctgtccacggccccacacccctgcagaatccacctgcagaaatagcggctacagcgagaggtcggaggtgacctgcagtggggggcccgggggacgccgacgggcactgcggcggcctgtgtctgcgcggatgtagggctggttccgcagatctggcagccgaaggagacacatttaccattcaggagtccgcccagagctgggagcatggctccagggcacaaagcttagcctcctaaggactcagattgtgtgcacatggcaggggtaccgtttatgtttgccagacccctccaccccacaaatcacatcccagccatccactggcccaggagaaggcagcatgcctcagttctcccaagggtcccaggggctgtgggcagcgtggtatcagaggccaggtcatctgggtacctgaggggctagaggggcatctcttctcccaggctggcctcacagaggagccgggatgtccgcttgccggtgcgggccgtgaagggcaccgtcttgatcactgagtgggggtggggcaggtgaaggggagtagagaaaggaaaaaggaaagaaaaacagaaaaggtagcaagaagcagtgtggcagccagtcccccagaggatagcgcattgggtcagaagaaagcatagaaggacagactgaggataagaccaaggcctggccaagcccttacctgtgatgatgtcttcaatggccccatcacggtcgctctcataaatgagtggctccttctgctgcctccgtttcagctcagagatgaggtccatctgtggccgccgggcctttggcggtgactagggggaatttatagctccagctccaggatgcctccccatcaccaaaaccctggaatatctgcctggtcccccacagcaaggacagctggcttgagcagaaagaaccctttcccatcccaggctcctggggcagggtcagtctgtaacagtgagggtgtgggggtggcaccagagggtgatgagatgccatgcatccctgcagcccagtaccaagcccaggagcagttgcctaccttgggtgctgggggctcccctttgcccggggtatcagcgcctgcctcctgggcagcggcttcttttttccactgttccacctcctgctcagctttctgtgggccaaggcagtctccatgagggtggccctccctactgccctacccaccccctaaacagaagcagccccacccctccgctgcccagtagaaaggcttcagtgccctacagggctcccagcctgccccagacccgaataccttgtaggccttaatgaagcggctaaagagggagaagaacaggcctggggatgtggtcttggggttctctccgaagtactccaccacagactcaaaggcctcctgtgggcacagcctgtcagccccccagcttagacctctcacagcctgtacccctcaggacactggccacctgatctgagctcctcccaggcagggtggcccctcattcctgctgcatccccccaaggggtcccagctacggccacacccctccaggctgtgctatctagtgctcctacatgccccacctccaggtgaggccagccctggcgcacctgagccgtcttgctgtctgccagcagcttgtccatggtgggcgagttggccctcaggaactccttgagcaccatgcagtcatcctgccgcacaaactctctctgtgtcaactctaggcctcgctgcagggagcgcacgtccgccaggacactgtccagggacactgggccagggatggggcagtatcaggtcagtgaatcggagaggcagccctcccaccaattatatactgtggccccctagctttctcccaacctaccccagcccacggcccctccccacacccaaggatctgtgtgtctcctacctgagcccgccttgtccaggaagtgcaggtcgctgtggaagcctgtgagttgcgggtacttctcagcaatgaccttcaccaggtagtgcagcagcgtctgcttgcgatcagtcgacttcatctccaacagctgcacaaggacccattgtaagccacaggccaccagccagtccccagccccagtccccaagccaggggcccctcctcaccgcatccaggctctggagccggaagccataggctgccccacgcttgctactgttcatgtagttgccaaaggccaggacaatctgggagaggcaggagaaaggctcagcagaatgccagagctgaggacaccgcttaagcatattgcacaaggaggagaagaggtggcaaggagcaggccccacacactcagcccctactgtactcctgcacaggcccctcagatccacagcacatgtacatgtgtgtacacacaggtctcacacatgtgcacggttaacaccatgggcacaccaaattttgtcctctgctagtccaacccacaacttgttgccagcatcccctcctagtctgtgtggtcactgcctgtccaccagccatttctactggttcccgggc

SEQ ID NO: 3622 - DNA, 908 bp, Homo sapiens
atgggtgaagcagatcgcctaggaaagtttttcattggtgggcttaatacggaaacaaataagaaagctcttgaagcagtatttggcaaatatggacaaatagtggaagtacacttgatgaaagactgtgaaaccaacaaatcaagaggatttgcttttatcacctttgaaagaccagcagacgctaaggatgcagccagagacatgaatggaaagtcattagatggaaaagccatcaaggtggaacaagccaccaaaccgtcatttgaaagtggtagacgtggaccgcctccacctccaagaagtagaggccctccaagagttcttagaggtggaagaggaggaagtggaggaaccagggaacctccctcacggggaggacacatggatgactggtggatattccatgaattttaacatgagttcttccaggggaccactcccagtaaaaagaggaccaccaccaagaagtgggggtcttcctcctaagagatctgcaccttcaggaccagttcgcagtagcagtggaatgggaggaagagctcctgtatcacgtggaagagatagttaccgaggtccacctcgaagggaatcgctgccctcttgtagagagctccacctacacgagggcgcccccatcttatggtggaagcagtcgctatgatgattacagcagctcacgtgacggatatggtggaagtcgagacagttactcaagcagtcgaagtgatctctactcaagtggtcgtgatcaggttggcagacaagaaagagggcttcccccttctatggaaagggggtaccctcctccacgtgattcctacagcagttcaagccgtggaacaccaagaggtggtggccgtggaggaagccgatctgatagagggggaggcagaagcagatactag

SEQ ID NO: 3623 - DNA, 516 bp, Homo sapiens
gcaagccgcccgctcgcgggggagccatggcgagaggccgcgcggcggcgcccgcaacagtgcccgcgtccgcagcagcgcccccgcccgccgccccggggcccacccggccgccgcccccgcgcgccccgagcccttgacgcccgcgcgcctcaagcgaggcgtcccccagagtggggccgcgcgcgggagagccggagcgcagccttagcgtccccgagagtctcgaacgccccgacgacccccgcgtctcggaaccccggactccgagcccaggagcgccagagcggcaggcgggcagcaggaggcggcggcgccagagcggagcccccgcgagtgcccccgtgccgcccggccggctgcagcggagggaaccgaagccgccgggcggccggggccgggccgagaacgacgcggaggaagcccccaccgaggccccccggcaccgcgcctgctgccgggttgcgctccgtgcacctcttgcggactctctgcctcattccttgaagactggga

SEQ ID NO: 3624 - DNA, 505 bp, Homo sapiens
ggctccgcgcgcctgccaggccggggccggcggcggaacagcttgggacccgaaacgcctcggcttttctgcggacccgcgcccggccgctgccgccggacgcttgaaaagaggcagagtcttgctttgttgtccaggctggtcttgaacttctgagctcaagtgatcctcccgccttggcctcccaaagtgctgagactacagagagagaatgctaacgagctgtgaaatgaccaaagatctggcagcagaagggaaaagaaaaaataatggaatattttctgtctacaattggttgaatctgtggatgtggaaactgcagatacagatggagagccgactatactagctttttgtttcatttttcacttctggtgtgtgtgtgtgtgtgtgtgtgtgtgtgtgtgtgtgtgtatctgtgtgtgtgttttattaatctctgtgcctgcatgttagtttcttcctctttatttggattttcactaacattcttttcagcttcttc

SEQ ID NO: 3625 - DNA, 3004 bp, Homo sapiens
gccgccgcagcctctgccccactcgtgagggatccgagggctccgtccttgtgctgtcttcgccccggctcccaggggtcaaacgagggtcgggggtggggacacgcagcctagccactgtcctgcctgggatccggtctcccccgccccccggctgcagggtggataaagaggaagatgtgaagaggaggcagacaaaagcaaaaggacatcctgtcagtaggaaacggccgaattacaattcagatgtgcaatgtttgcataagtaaactgacacgggactattatatgcagaaatccacgtgcaaaaattttcagacacacctttgtacctcttcctaatcctgccctggtaaaatggcggttatcagtgcaagtttgaggatacatacagctggaaaatggacatcaccaaactggactccagaaagttctgtctaggattttattagactgctttttttctcaatatacctgtattggaagattgagacaaaaaggcacaaactcacattaaataaacaaggtaatctaatcaattctacaaagtgtagtttgtaaaacaagtagcactaggaaccaaccaaagtaagtcagggagtcccagcagggactgtaaaagaacttgggaagctatacacatgcccacgatactgaccctgtcccggacctctctgcatgagaaggccagagcccagcacccctcctacagaggcactgctgcttctgttggggctgtgaccctggaattctgatggaagcagctggtctgaaggggcatggcacacactcaggtactacccctggagctgaacctttatcataagtccctctgagtgctagtcagtttggaggtgggtgaggaggaaagggggtacttaaaagaagccaacactgttgcccagcagcaacaccatccgtggggatggaacagaccagggacatcctcctttatgtttatgtgggctgcaattccagatccaggctgacctcagctcataatggatgcttttcaactggggcaacaggtggaggtgggaggagcccttgttagggctaaagtgatatgtgtgggtctcaagagccaaaggaaggagactaacagctgctgaccctcagaccacatagacaactgtctgcctagaatgtcagtttgtttctttcaagataacccgcatctggacttcccctagttgatgaatgaaggaacatctttaagcacaaatataatgaatagctaacacagagcttataggaaaacactgacatttttctccagtaggaatgcctcttctccaactttccaagtcagataaatgctaccagcagttgagatgctacccagatgcattactaaagacccctcaaggtgaggagacttacacagaggaaggtgtctgtaacaagacatctggttccaaagggacctcaatgaaggtcagcgctaaccatgctgggggtctgagtctgtccacccttgccccaggagggccacagggaagcatccatcaggatgtcacaggtgcaatcctgtgagacactcccttattgcacttagaaatgagtaaggcaaacaaactgacaaaaacaggatacattctcccacccacttcttgcttcccggacaaagatttggtctcccattagcagatgcacccaggctagtgtgggctgggatcacggcacacttaggccaacgtgcttcacaaggtttggggaatgtcaggtgacactacagctctctctcattctcccactaagaggcaaactcaggctctgtcaagttgcaggaagctatgaacactgggcagcgtctgttcccctggagcctggacttcctcaccagcctactttggtcgggttctgtactatgatcactacttgctttgggttttccagggcagaactcaacatgggggtaggacgagctaagttcttgatccccaaattcctttccggcaactggagacgagggaacatgttctgctggaaaaagctttttgcatgctcatattgtgcagcatgaaagatcaggactcttgcttcctaaccagcctcaaagacagaggacagggacctaagaaagcacagagaaaagaggattattgctgagtggcagcaccagccccaaagggaagaggaggagcagggacttacagagctcctcggggtcagacagttggtatctagggggtgactcaattctaggggccacactggacaattccctccaagtggagagttgactggggcgattttgtagactgcagagagattcagagcgggcaacaggagggccaagaagccacaggtgtttctaagagtagtaactagagattcagtgattgggacagggttactcgtatttgttaaattttcttaaatagagactggctgagccttgggtacctccatagtgctagagtgccctaacgatgggttactgggagcagaagtcagagctgcaaaaccacattgctattttgtggaagcggtgcggggcagggaaacattgtatctttagctcatccccgctccccacaggagcactcaaaattgcgaagatcttcccaggaagcaaaatacctcagtttaccccaaggttgagaacaaatgaacttaaatcatttaaatcaccacatcacaaaaggcagctatttgaaagactgaaaatgtcacttggaaataaaggttgggggaacacacagaaatggatcggaacacaatggagagagacggaggcgctgtaactacagcaacctacacgccacgtatctcggaggagcaggctcctgcacacgcgggctctgtgacaccagacggtctatttgttcacaatactgaagggcatctagaattagctacagtaaggaatcgaaagttgcctgaagaatgggcacagaacggctgcgtccgaaaatggcctgtcacttgggagggtggagctgctgggtcttcctgttgaccactgtcttgcaaaactagaagaaaaatgaaagtatta

SEQ ID NO: 3626 - DNA, 4740 bp, Homo sapiens
atttgaaaaaaaaattagaaactgcgcaaccacaggaaaaccgcctggcaaagattcaaagtgtaggcaaaaacctgcagagagtgaacagagtcctcatgggcccaaggagcatccaggaaaggcacttcaaaaaggtgggaaagcacagcactaggaaagaacaggatgcccaggcatttgtggacaatgctgccaaaggaaaaaggcttgagggtccagccccaagggagctggaacagcctcacatagtgcaggggcctgagaaggtagtgggaaacaccatctacaccaagccttcattcacccaagagcataaggcagcagtctcctctgtgctgaaacccttctccatgggcgtgccttctgcctctagccctgcaaaagccctacctcaggtcagagacagatcgaaagacttagcctacaccattttaattttagaaatggcaatggctagagtgaaaaacatgaaggctgctaaaccaatcacacattccagaaaaaaatagcgcttttataaaactcactccattgtggcccacagaacacccaaggccaaaaagattagaaagtttagaaagggcagttatctcaacagaccgatgctcgcaaagaggccgctgttctctgcagcaaagagcctcatacattcgcaagggattttttcatccttaggagacctgagtcctcaagaaaaccctcttctggaagtagttgctccttcagaacgttttacagaaaacactaatgtaaaagacacaactaatgtaaaagacacaaaagagatgtgttcaaagacacatctctgaaaacacaaactacaatcatcctcctgaggcagtttccgctgggactgcattcaacttagaaccaactgttaaacaaactgagacaaaatgggaatacaacaatgtgggcattgacttgtcccctgagcccaaaagcttcaattacccattgctctcgtccccaggtgatcagcttgaaattcagctaaccgagcagctacggtccctcatccccaacgaggatgtgagaaagttcatgtctcatgttatctggaccttgaaaatggaatgttcagaaacacatgtgcaagggagctgtgccaagctcatgtcgcgaacaggcctcctgatgaagcttctcagcgagcagcaggaagcaaaggcattgaatgtagaatgggatacggaccaacaaaaaacaaattatattaatgagaacatggaacagaatgaacagaaagagcagaagtcaagtgagctcatgaaagaagttccaggatatgactataagaacaaactcatcttcgcaatatctgtgactgtcatactaataattttgattataattttttgttttatagaggtaaagacaataattaattcaggttttcaaaatacaatcctgtgtttgtgtggattcagaatccacaaactgaaaaccaacgtcactttcccacttgacattcttcttctgtcatttaaggctgaggtgtgctttgttcttttactgcaatgtatattccaggattgttaaaggatcctcgcttccaggaggtctctgtgaaataaaaccaagttaatcccactagactattttaagaagttaagttgatataatagcaaaatttctcccacccaaaactatgtcaacaattggatgtactcactgagtcaccccttactctgccactaatttatttccttgttgcttaaatgatgagagacatataatctccaccctcacggagttgtcatcaccctggagaggaagaagacagccaaaagagagaagtattgtcttgtagacttactagattcacatagtatcatccttctccagtgtgtaaggtgttgtctaaataggtccagttaaagaactacagggtagccatttttaaaaaaaaattttggccacgttttcaaattcacaggggagggggaatgtctcatactccagccctcctgagcctaggccctctgtgagatgtgtcaccatttcttggacaccatatgagacattccccctcggattagagatgctcaacctgcatcaacaaatctaaagcctgcatctggctaccctggggcgagtcctgtttacagtgcctattcctggagctcgcctctttttgccttttgtttgattatgtgatgtattacttttcccagcaggccagtgctagcatactggaagagggatttaataagctggcacccttgatgctatgctcctaatccaaccttatttgcctcattggccatttccattatggtggcagccctccattccagccacagcagcccctcagcgtcccccagtcacactgtccccattgctgctcatctgtgcctttgtccatctacaatgcccttatttcactctgcctgtgggagtcctgtgaatctctccaaagccaactcagttcatctttctgcttgaaaccttccctgaataggccaggtgcggtggctcacgcctgtaatcccagcactttgggaggccaaggcaggcggatcacaaggtcaggagatcgagaccatcctggctaacacagaccattctctactaaaaatgcaaaaaattagctgggtgtggtggcgggcgtgtgtcgtcccagctacttgtgaggctgaagcaggaaaatggcatgaacctgggaggtggagcatgcagccagccaagatcgggccgctgcactccagcctgggggacagagcgagactctgcctcaaaaaaaaaaaaaaaaagaaacttccctgaatattccagccctcctgagcctagtccctttgtgagatttgtccccatttcttggacaccatataagagacttcagaggctgaagtgggaggattgcttgagcctgggaggtcgaggatgcagtgagctgtggtcataccactgcactctagcctgggcaacagagcgagaccttgtctcaaaaacagccaccaccaaaaactatcttgggatttgaataggattaccttaaatttgtagattaatttgagaattgacatctgtacgacattctagaacatggtatttcatgtcatgtattcatttcttgttaatgtctttcagaagagttttagggtttccatcatatagatcttacacgtcttttgttagataacagatctttgtatttttgttcctaaatacttcagacatttgtattgccattgtaaatgggatctttcttccattttctagttagttattggtggtacatctgaaaagcatttgaggtttgtgtgctgctctcttgattttgtttctagccaccgtactgaattctcatattacttccagtaaaatcttagttgattctcttaggcttctttggctaacatttattattttatatgcaaataattatagttttgtctcttccttttcaatacttacactctttccttcctttcctttcttttttttttctttctcagggccttgttgtcacccagactggagagcaatggtgtgatctagctcactgtaacctcaaactcctgggcttaagggatcctcctgcctcagcttcctgagtggctgggactacaggcaggcagtgaattttaaaacttttggtgtagagacaagatcttgctatgttgcccaggctggttttcctgccactttagagcaggtttcctttttttcatacttttaagaggtttttattaggaattgtccattgaatgttagctaaaacagtcaataaaatgcgttaagtaccagctacatgcaagaccctaagttagatacagtcagccctcttcatcagcaggtccacatcttcagattcaactagataaggctgaatatttgaagaaaaaaacaataaaaatacaattagaaagtacagtataacaactgttgccatgatacaatatctatacattttattagtgatgacctaaagttcatgggaccaggcacggtgactcacacttgtaatcccaacactttgggaggccaacctgggcagcatagtgagaccttgtctttaataaaaataaaaataaaaaaattagctagtgtggtggtatgcacctgtagtcccagctactcaagaggctgaggtgggcagatcactggagcccaggaggttgcggctgctgtgagctgtgattgtgacactgctctccagcctgagtgacagagggtgatcctgtctctaagtaagtaaataaataaagtatatgggggggatgtgtgttggttatatgcaaacactgcaccattatacgtaagggattgagcatccacagattctggtatggtgtggaggcgatatcctagaaccagtcgtctgcaaggtagcaaggatgactgaactgtggaagaatcaaagcactgttaaacagcatacaattcctgtcttcaaaaaagttatctcatcgggtagatgagacttaaaatgaataaaaggaatgaatacacattggagatagtggttgttgtgatagataaccttaattgtgttttcttccaaaacgggtgaattcacataaaagggcatcagaaaaatacaaagacaacccatcaatatcaggagcctgagcatgagttaaagcatgtggatggcctagagccatgtttttaaaattgttattaaatattggttttttacttaaatcaatgaaaactttctttactttgtggttgtgttcctcaaaatgagaatttttaacaataataaaaataaagcttattagatca

SEQ ID NO: 3627 - DNA, 1676 bp, Homo sapiens
ctcattaaacttttttaatgggtctcaaaattctgtgacaaatttttggtcaagttgtttccattaaaaagtactgattttaaaaactaataacttaaaactgccacatgcaaaaaagaaaaccaaagtggtccacaaaacattctcctttccttctgaaggttttacgatgcattgttatcattaaccagtcttttactactaaacttaaatggccaattgaaacaaacagttctgagaccgttcttccaccactgattaagagtggggtggcaggtattagggataatattcatttagccatctgagctttctgggcagagttggtgaccttgccagctccagcagccttcttgtccactgctttgatgacacccaccgcaactgtgtgtctcatatcacgaacagcaaagcgacccaaaggtggatagtctgagaagctctcagcacacatgggcttgccaggaaccatatcaacaatggcagcatcaccggacttcaagaatttagggccatcttccagctttttaccagaacggcgatcaatcttttccttcagctcagcaaacttgcatgcaatatgagccgtgtggcaatccaatacaggggcatagccagcgcttatttggcctggatggttcaggataatcacctgagcagtgaagccagctgcttccattggtgggtcatttttgctgtcaccagcaacgttgccacgacgaacatccttgacagacacattcttgacatggaagcccacactgtccccaggaagagcttcacccaaagcttcatggtgcatttcgacagattttacttctgttgtaacgttgactggagcaaaggtgaccaccataccgggtttgagaataccagtctccactcggccaacaggaacactaccaataccaccaattttgtagacatcctggagaggcaggcgcaagggcttgtcagttggacgagttggtggtaggatgcagtccagagcctcaagcagcatggttccactggcattgccatccttacgggtgactttccatcccttgaaccaaggcatgttagcacttggctccagcatgttgttaccattccaaccagaaattggcacaaatgctactgtgtcggggttgtagccaattttcttaatgtaagtgctgacttccttaacaatttcctcatatctcttctggctgtagggtggctcagtggaatccattttgttaacaccaacaattagttgtttcacacccagtgtgtaagccagaagggcatgctctcgggtctgcccattcttagagataccagcttcaaattcaccaacaccagcagcaacaatcgggacagcacagtcagcctgagatgtccctgtaatcatgtttttgatgaagtctctgtgtcctggagcatcagtgatagtcacatagtacttgctggtctcaaatttccacaaggagatatcaatggtgataccacgttcacgctcagctttcagtttatccaatggttcttttgtcgatgctactgcatttatagatcagatggccagtagtggtggacttgcccgaatctacgtgtccaatgacgacaatgttgatatgagtcttttcctttcccattttggcttttaggggtagttttcatgacacctgtgttctggcggcaaacccgttgcg

SEQ ID NO: 3628 - DNA, 8881 bp, Homo sapiens
actttaggtgagcatttgtacagtgaaacattttgctacacaaaagtgatgtttaggaatactaacaaattattttcaagaataagactgattttatgggaaaattaagcagatgctccagtttgagaaacctggatctgcgatctgtttgtggtctctatgaataaagaaaagcaaatagaatcttatcagataagtgcttttataagtctaaatatattctttggaatctctaaagcaaaacttttaaacttttttttttttttttttttttttaggtaccagcatcaagatgatttatggtaataaggtactcagtctttgcttaaaataaattttacgtttatcaaagtaaaatttaccagctttttttcctaaagaggctagtcatatctcatcagtggttacaaagtatccttacaattgaacctacatttgttaatcctgttcagtgtgtatgaaaatcacttggtggccgggcatggtggctcacgcctgtaatcccagcactttgggaggccaaggcgggcagatcacaaggtcaggagttcgagaccagcctggctaatatagtgaaaccccatttctactaaaaatgcaaacattagtcaggcatggtggcaggtgcctgtagtcccagctacttgggaggctgaggcaggagactctcttcaacccgtgaggcagaggttgcagtgagtcgagatcatgtcactgcacttcagcttaagcaacagagcgagactccatctcaaaaaaagaaaagcacgtcactcgatgttctttctttcataagagttgaagaactaggtatatctgcttatattatggcatctatagtagcttagctgctcatatttgggtctctttagaaccagtgtctttcaaagagggttttaactatgctggtgtaaattttaagaatagatacattcaaagaagaattcaacattcatgtgacattcatactttggaactttgggaaagtataggaatgaccatagattggcttagggatagtcaatttacctgtctgtaaatggatccaatttagtattgttcctgtatttttctaagaccaacacttgtgtcattcacagttaaatatatgagttgtggccaggcccggtggctcatgcctgtaatttcagcattttaggaggctgaggtgaacagattgctcaagtccaggagttcaagaccagcctgggcaacatagtgagatgcggtctctacaaaaaatttttaaaagttagccaagcatggtggtgcttgcctgtggtcccagctacttgggaggctgaggtgggaggattgcttgagccatatgctctaatatattttaaaatacatattttaaatatattttgagtggtaaaatgtagcagataatgttacataaaagaagccatggtaatgacatgacattactggttttgagttgtttgtgtagtagttagctattaatactcaggtataatgatttgctatttaaactacacaaatgctcaaagtccagcgataccctgcacccaaattcagtggctagattaccttcttaggaaagcacaacacttcaatggagtgacactggcatgagtccactagagggtgtgtatacatggcctgagttcaaattgttcctgctgtgagtactgcttttcagcttcaagttattcttatcggccacagtactgtttattccacttagtaacagttctgtttacagagcactttaacataaattctgatttttaacatgaaagctgtctgatgttggtatttttattttaatctttagagatcaagaaatttttttagtgacagaatagggactttattgatccttaaatccgcccctcaccacaataaaggaaaaaagcaaaaacatccttgactcatgtattgaagggtcttttttgagaagggtcagtttttgaaaaattatccaaaactgaaacatctgtcatctgtatcacatctaaagattaacagtgactgatgaccaccagttacttcatatgaaagtgggaaaccgtatcagttatttgtccactaagttggtaggtgctttttgtacaaaagcccaggagaatatgatctgtaaattctagttgagtgatgaagatggggctttgaattaatctacagtcttggaattaattctgcagcattttaaccagggaatttttcagtagtcataaatctatattttaatactgagtaaatgtcctcatttacccccaccaattttgtaaagcagatattaaccaaacttcaatagttataagacaaaaatttaatgaaaattggacagtatgtataatccagggctaaatagttacattggactggagtagaaatttaaaatacaatagatgctggagtaaatgttacatattatcatcatctgattcatcttcttccttcagagattcctgttaagagaaaacaggtgtttaaaattgatttttaaaattgttatatcccacacctgtgggcaagttaagctacaacaacctgaattaagtggttaaattcctctacttgtaactgaatgaacagtttcagaataagatacccaagcaaagttaattaagcaaatgttgctctaacatgcaatgactgtatctttgatagaatatatacttaagaggcctggtgcagtgttcatgcctgtaatcccagcactttacgggggccaaagtaggcagatcacgtgagttcaagagtttgaaactagcctggtgaaaacccgtctctgtattattggtgaagccaaaaatacaaaagtagccaggtatggtggcatgttcctgtaatcccagctacttgggaggcggaggcaggaggatcgcttgaaccctggaggcagaggttgcagtgagcagagatggtgccactgccctccagcctgggtgacagagcaagactccgtctcaaaaaaaaaaaaaaaaaaaagaacaaatatttaaagtattaaaagtcctaaaaaactctttgcagtctaaacctcccaagttttttttttttggaaccaaggcaactttacccactagagataacctagaaaatttctatctttagttcaactgaactctcagtgttatttcatagaaaccaccccagtctatttatattattcaacacataattttggttagagaatttttttttttttaaattagggatgggggtcttgctgtgctgctcaggctggtctcaaactcctgggctaagtgattccctgactgtacctggccaagagaagtttttgtgctgtggcttaccttagcatatttctctgcttcttctcttatatcttttggaacaatttcatgtcttccattagttactgtaaattaagccacatgtgtaaatgaattttaaattgagtaccatattgtaacttgcagtataccataggatctacccaatccacatatctgactcacctaaggttgcaaagttgtactatgagtaatactcgaatatttttgtgtgctgcttctacatgagattatatgtgcctacatattaagttcttatggaaatgaaagtaaattatgctatttataaatcctgagcattaatttatagcatagtatcttaaaaccatgaaatggatgtttcaaaaaataacgtgttcacaacttaagtcaattattaagcagaactttcccttcattagacaacctagtaaatttgctttagctttcattatattagaaaggacactcagttgtaaattagctgtggtacagatcattcctaaggcaaataaatgtacaaaaataacttacattcaccaacccagctgagttctagttcaaaagctttatccttaacttcgtcatgtactatgtaaattctagaatagaaaagggaaaggtaagattttggtaacctccaaacattgaagtagttcacagacccaaagtcagtacaaattagaatgtccatccataataaaagtatctataaaattacacagacacattctacatagtatttaacattagagaagacaaattacacagggactgaaataaaatgaaacatctactctcccgacaaatgttgaatatacctaatcaacccaagttcagtttatttttgcacattgctttagagatataacttggctgggcacagtggctcacacctgtaatcccaacactttgggagaccaaggcggatggatcacttgaggtcagttcgagactagcctggccaacatggtgaaaccctgtctctactaagaaacaaaaatcagccaggtgtggtggtgggcgcctgtaatctcagctactcaggaggctaaggcaggagaattccttgaacccgggaggcaggggttgcagtgagccaagatcacactactgcactccatcctgggctacagtagagcgagactccatctcagaaaaaaaaaaagatacaactataaaagatacctcataaagaacacggattcactaggaagaggcgtcattaactgtgcccttttagaatattttgtccattaacttaaatatatttaaaaccaactaattggctggacatggtggctcgtgcctgtaatcctagcactttggggaggcagaggcgggtggatcatgaggtcaggagttcgagaccatcctggccaacatggtgaacccacgtctctactaaaaatacaaaaattagccaggtgaggtggccataggcctgtagtcccaactactcgggaaactgaggcaggagacttgcttgaacccaggaggtaggggctgcagtgagctgagatcacgacactgcactccagcctgggcaacagagtgagactctgtttcaaaaaaataaaaaaaaaaaaactaatttatgtgcttgcaattattagtggtctcttcaacctatagcttcttggcagtagtctttttaagctccttgtccattttataatggcatatatgccacataacctggccttcacattgtagtaccttacaaattacagcaaagaaggaggcactgtcatgcaacatattaaagtaacataaaaagtatcaagaggccaggtgcggtggttcacatctgtaatcccagcactttgggaggccaaggtgggtggatcacaaggtcaggagttcaagaccagcctggccaagatggtaaagcctgtctctactaaaaatacaaaaattagccaggtgtggtggtgggcgcctgtaatcccagctacttgagaggctgatgcaggagaattgcttgaacacgggaggcggaggttgcagtgagccaagatcgtgccactgccctccagtctggacgacagagtgagactccatctcaaaaaaaaaaaagtatcaaattaagtacagtagcagagtatagctttatctaatactatgcactgagttacataccttactttttggagggtcttctaaaaccttgctataatatgagaggatcttgattttctacaactaagtaaaagataacatgctgctccattttcttaaatgatgaagggatggctttcctaacatggaacacttaacagatgactaccattatacctaaatataaaagatggtaagaactgatttccagaaggacttcaaaggattggttcggtgaaggaaacagagtatatcatgataacatactatacaattcaaggaagatatctgacttcctttcttagcagctctgctgcatgttggttcctagtgttgccattattaactgacaatcatagaatggcttctgcttgcttcacaactgaaactaggagggcggaggggaggaggtggcaagaggggtaaaggcagtagcagtaatgatggaccggttaataagagactctgagtgtgatgtaaatagtatgtttattaaacaatagagcccattggaatttttttcttccacgtattgttagatgtaaaacctgatacactaccatacagacaggtgattgactagaccttgtttatgtagttctaatgtggaatacttagagttgttatgaattacgattatccataacttttgaatctaaaaagctggctacacaacgtattttgttggaatctttttgtaataccaaatgtctacactctttgatctagagaatcacaaaattttagaaacatcactacccaggttaattgacttttttattgtttactgtccaaatacctgttacatattaatagtattctactttatatacctgtaataaactattcagggtttcttaagctggttgttgaaatgttttgtaatactgctcttcttaccttgttataggaacttttataataaacctgaaaaagtgaaacatatctttcccaaataaatagcagattatataaatgagccagcttcatggatcatgtattgaaataattagttgtaacctataaagtttgtaagcattcttacaatagaggcaatcttaagattactattattaggacttaagagatttgagaagttgggagctaacaaattaagaccctaatggtatatgtccttaacctgtaacaggagtttattttgtcaagctatttttcccatcctattcattactactaaaaaatattgcttaaaaacattttcttccttcgtgaggcttcttagaatgttaaatttaccttctaaaaattatacactaagttattttacaggaaaacagcttcttaggattaatgtaatatatatatgcaaaggtcaaatgaaatatttttgtggatggtaagaaaaatttcaacttacatttttgcaacttctttaacgatatcacggcaggtcatttctttcatctatagaaaataaaatgtatactgttcatcagaagaacattttccacttgtgtaataactattttcacttttatactcagatataaaaccaaggaaaataacctaaagtctgaaaaagaccagaatcgaagtttcctgattcatattttaatgttttgaaatttatactccaggctgggtgcagtggcttgtgcctgtaatcccagcactttgggaggccgaggcggccggattgcctgaagtcagaagttcgagaccagcctgaccaacatggtgaaaccctgtctctacttaaaaatacaaaagagctgggcatggaggtggtgcgcgcctgtaaccctagctactcgggaggctgaggcctaagaatctcttgaacccaggaggcagaggttgtagtgagccgggatcacgccactgcactctagcctgggcgacagagagagagactgtctaaaaaaggaaaagaaaaaaatttatacgccaaaaaagatattctgagataacctgtagttaccactaactttgtgacaaaattataaaaatccacagccatctatgaatctgtaggcagacctgaagtttgaacgactggtgaagacatctgattttctttatagccaagttaggataacaaaatgcaaacaagtcattaatatttactatatgcaagatacagaaagatgaaggaaggagtaagaagttatccttcgtggaactattcaaagcaaaaatgcaaaataccagggaaagctttgaagaaccaagatttgagcaggttcttagaatatagattggattggatttgatttcaagaaagatgaacgtgtaaagcagaagtgggaagccaaaaacttttttccaaattagaattaagcattctttcaatgaacatttggaaatcaaggtagaaaaatatccctagggcctagctgaggagtctgtatgttgttgggttttgatagtaaccagtccaagattttgttattagacgtgggtttctgaatagacaggcatttctgaacagacatgacaggatcaaaacaatgtttgagcaaactgcccttcatctactgtggatatgttgggggatgatggaatatagtgaaagataatgggtgctcatacagcagtctagacttaaggtgattcaactactatatattaaactagattatcttttattttttaattttgaaatctggatgctcaagctctgcctgcacaaccacatgaggaagaaggaacaatgacaacaaaaataacactaaatttaaatttaagagtactacttttaggaaatagacaaaccattatttgggtacaactaaaggcaactggcatggactcaaatattttggggaagaaaaagactaaaagttctaaggaagaaaatgcgaaccttgatagtttgaaatagttaaaaagacagtgtagaaactgcttaggcagtttgattatggactattagatgatacttgggtctgataatggtataaggagaataaagtatttagggatccaatattacgcctgcagctttttccaaatagttcatgggggagggggatgtgtaagtggttaactgaagtctaactagataggtttgttgtaagcttaggatgtttacagttcttcatgttaagttgagcgtgatgggaagggaaagaatgctgatctttaaatttttgtccttagttaagttctgtatttagtgaattaattgcatcctaaaaagtcaaacttgaaaagcacattttaaatggcaaatctattttttacatgtttgtgaagtttttattttttagtaaacagaccatcagaagagaacaatggtacagagcaggggtcagcagatggattttgtaaagcatcaacttgtaaatattttcaagtttattagctgtatggctctggtttctgttccctgttccaaatgttaaagtctactgttgtattctaaaagcagccatggactgaatgtagctgtgttccaataaaacttacacaaaagcaggcagtgggccataatttgcaacacctgattcacagcataattttgtcac

SEQ ID NO: 3629 - DNA, 2724 bp, Homo sapiens
ctcgcctgtggccccagttagctgggactacaggcatgcgccaccgtgtctggcctctattcttgcaattgaatgagatgctatgaggcgctgagcgacccacaggaaagtacttatcaaaagctttgtgtcatgagaagatgcggctgtggaaggaggttcaaagcttgcacacacgcacacacacacatgcacatgatttggcttccataaagctcgagtagaatattaaatattgagtactgagtttttaattgtaaacttaagatctcatccttaactttacatatacatagataacagggtggtcatgaaaagcactttaacatcaggacagatgttaagttctgaggttctgttttcaactgctctacatacaaaatgccctacaagcaaagaaaggcttaaataaatagatggggatgaacatgatgcacgccgtggtgacatgagtggtgtgcaggggtcggacagtgcggaacccgggtgggcaggagcacattgtggagacacaagtggtggcatctctgggatgtaggggaggatgtggggggctccttcaaggtggagctagcagaggccatggctcgggaggaagacaggacagggacagtttgtgggccagtgccacacgctctcctattggcttcatgggcctgggggcagccctgggtagcaaaggacagggccaggctctccccctggagacccagagatggcggtggtcctcttaggacaaaccctcaccagccccgccctctgaccagcctgtcactggtgctgatgtcaggtggtggccagtgaggaagggggttattgacagccctgcctgtggctaaggcacacccagcctgggagccccaagcagctgacctgagcaatccagcgtccctttagtcacagacgccaaagctcccagaggcagttccactgagtgagggtgacaagacctaaaaccaccacctaccctgctgagcaggacccccaccccctgtagcagggagaggctcctgggccccagaagctggagggggtggtgtcttgagccctgacacctgctgctgctatcttgacccgaccacccgccccaactcggaatgccacactgtgaccactggggcacctcctgattatccaagaaaagtggataaaaccaaacgctgctgtctgggcccagcggaggctccctggggcctggctagggtgcgggtttcacactgtgccccagagacccagcagggaaggtgaggcggtggagggagtggggggaccaagaggctgagcagggaaggccacagatctgccaggaagaaagtccctgggctccagatctcgggggcggggggcccgtgccacgcactctaagctagctgaggaggtgatcttaaatttaggagacgagcccactcccccgcttcctgcccctcagcagccacaagatgggggaaggtggctggtgcaacaggagcctcagctcccagctccatctccacagatcttcaccgcacacccgtgtgcatccacatgcacacccgtgtttacaatcacctgcacccccacggcgggatggcgagtccggtcaaggtgcagatgtttggaagctgagttcctgggtccctgagggttcctgaccagaggccccagctgctgcagggactgatgctggagagaaagctgggaaaagtgctgggatctgtgcttcgtcccacactagcgccattacttcttccctccaaattcaggccagaaactggcatccgggctctggaaattgccttgagcagaggaaacactctactcccgctcggcatcaaggcctgggtgatggagagtcaggcgtggtgcccctggggcactgcctgccctggcacacaggattaggacctgctggaggcctgcaccctactcctggccgacgtgacccagatgctgaggcaggactggcactgaggtccactctgaaggatggctctggagagacagcgcctgtgtgccacctgtgagcctctgcactgggggtcctgctgcgaggtgggaacggctaccacccctcctgggagggcagggactggccccgcacattcccaggacttggaagctctagagacaatcaggaaggaagcacgcctcgggggcaggcttgagtgccgtctgggtggaagccggagacgcgcaggccctgcggagctggatggccccatcaaggcctcacaggaggctggccaggctggtgttgggtccattctgagcttggaactgcacggggggtggaccgtctgtccactgtggggaggagaggacatgcgagtgaggcactgtggaccgttcccagggaagaagaggttggaatgctgccttccttgggctgctcacacagccgggactctgttctccatgccccagtccaatgggccccgaggagacacctgggtcccttgcttgggtgggggtgcccatggccatctcccccatcaagggatcacctgaggctgagttagggtttgttggacaaaagagaaatacagccaaggtgccccttcctcttgcaggtggggagcccgctagtcctgatcccgtcccctaacacccacacccgtaccgtgatgaggttgtgttcggggaggctgcaggcctcaatgtggtcctggagcagctgctgcgagaagttctggtgcatctgggcggcttcatgggcatccatggcgttcccacaggctttattca

SEQ ID NO: 3630 - DNA, 622 bp, Homo sapiens
ggaagcggcggcgggagcttccgggagggcggctcgcaggcaccatgactcctgtgaggatgcagcactccctggcaggtcagacctatgccgtgcccttcatccagccagacctgcggcgagaggaggccgtccagcagatggcggatgccctgcagtacctgcagaaggtctctggagacatcttcagcaggtgggtgctgccactcacccccacctgatgagagggccatccctgtcctgggcaatcccagcaacacaccctctgggagcagcccccttggggaatcccggtcctggggaacccatctggcttccctgtgtgggaggggctgaagtgagagcccaacttggaagcttttactcctgggagtccaagagctcactcccttccaccccacttagcctcctggtttcctgtggtggctctgctctcacaactcatgcttttcctcccattggagggcctattccttcacgttttcctgcagccaacaaatatttacccagcagtgctcgtgtgcaaggcagtgtgggaatctctatatatccagccacggataaggcaacatacctctccacctggagcgcacattctggcaggagagaaagacctaaataa

SEQ ID NO: 3631 - DNA, 3730 bp, Homo sapiens
agaattttaaaaatctattctaattcaacaagtttttaaaatcaactttgtaatttgaggggaaaatttggggggaagaggtgggtgggccactaagttacctctctttcatttggtggcccttccaggccattgaaaataaagacgttggctccagtttgcacattgggaagaaagcatagaaatttgacttgtatattaaaaataatagaaatgtaatatgtatattaagaatgcataggtctgtattctgtaaggggctctgaagaacaatatggcactgctgtgttcagtgtgaattcactgcctgggagaactgcaggaatgcttgtcttcaccattgtgttcttacaacgaattcaactttccatggtttatcttgacaaaatttacatgtgtttaggttacttgtatattgatatatttttttaatcttcagtttttgtcttccttttgcctttgtgttttcagaagtaacacatgaacactttttaaagtacattacagagaagaaaactgtgagctattatatagtgtttcttttttaacacaaatcttttaactttaaaaaaaggcaaaaattttttttttctacttcccacccagcttaccaccttgatctctttaacttatgttctaaactttggtgttaatggtggtgtctagcatgctagtagttagattttatttagatgccataactggtaatacagcttttattttgactatattaatttagttttttgaggggaagtttgtttattctgtgactctcaaagcacacagaggttttaaaatatatattattaagactgagagaagaggaaatgggagggagtaacatcacagaagtgctgttgttcaactgttcttcaatatagttgctagtaggtttgtatttactcagtaaggaagtcagtgacctgaactacctataaaaattcagcagtgctgcagtgttgcttaagtgaaaccctttggctatctagtagtttttatgctactgaaacttggattactgtatgatattcagcttgtcttgggccctctatgtagacaaacattcatattcatagtagtgttgtatactggcctgtttttataactttatttttcaaatattaacaaccactgctttcagagtggttattttgttatttttgaagcaggaaataaccatttgtatttgcacctgcgtattgcatatgaattatggtatacttggcaaatgcttttcttttacctgtgaaaattctgaaagctggtccaagctacattgcataccaaattgtgctcttatatattatttgcatcgtgtcctttttaatcaaatagcatgttttagttttattatagtagcttttgctgtaagaatgtcacttgcttatcttttattgtacttgaattcttaatcatgcttttaacattgtatttaacaaatcatttcgtattaggttccattaaaatgtcattcctttgaaaaggcaagggatttccactttcagaatttgaaaatgaaagtagcatgtttatctaaaggcagaaaatagttcggacttggtattatgaaaataagtaatggtttctggagaggatttgtttagatttgcacagatggcgatggcaccttttacttaaattaacattaatcaacagtgctaaggaaaatttacacaaaattacaagataaaacatggaaatgtgtgcctttcagtatacaaactcttgcttggtggccatttgggtaatcagaccatttgaatgcctgagagcatgtttaatttctgtggagtgccacatatggctaaaacaactctttaatgtgcaattaatttctagagtaaaatgtctgttatgtgagggggatctttatgttgggcttttctattttttaaatgttcacatttctttctgttaattaaaatgccatcataatgtcacatttacactgttgcctcttttaaaagcaaagccactttcttgttctaagattacatcaagacttgagcagtgtgtagtaattaaaatgtgtgcttaatgagcataatagattctggttttaggaaataacatatagcttttatatgaatattttcttttgctataatgaaagtcacagattttttttttcctggcttttatggaggaatgaaaagagttgtctccctctaagagtatactatttttgattctcatagcaataatgtcaccattcttatcagagggtaaataccccttgtataggaaaacagacataatttcctcttgggagttctctttatgacttagcattttcttctacttgagaaaattcctgtttttccgattatttcatcttgaactttcttttttttaagcttttgtgcaatgtaatagtttgttgatccatctttgtacattttcattttatttcatgtctttctctcacctacctgtcagaatcagctatagcagattttgaattctttagttaaaaaatagttgctttacttgtttcctcatgagtttgttaaatagctttgcattttagtcctctattatgctatgaaaattattacgaagtttatattgttccctttttaagcctgccttactcttgtcttttgtcattgtctatggtttaatgaagaacacaccaaactaacatttttgtttattttgaggaacaaaaaaacttttctcttttaagggaagttactacacattgagttagtaactactctttcagtcaaggttccttaatcagtccagtctacatcaggactatgacttggggggcggggctaatcctttttgctgttctgagctactattgtcaactgctgttgtacatactgttatgtgtaatggcgtaaatatatttattatgtttgtaaaattcattgcagatcaaggttgctcttctgtgatatatgggatattatgttttaaagaccatcttggaatacaattagagaacttagtattttgatgtactaagacctattttaagtttaatattctactttgcaaaaactttaattaaagatgttatttaaaaaaaaatgttgcttgctttgcttactagtatatggcattgttatagataattgaataaaatacaatttagaaaggaaaatgctttacattgttaatgagaattccatttaacaacaacaaaaagatgctaaattctgtaccttaaagataagtagattgagatgtcaatttgaattagtaaactgtgttacaaatgattaatactagcttttaaaaagttgtattttccaggcacacaggaatttaggttgggcgaattcacactaacaaattataactaaaaattggtataattaacattgtttttcaaaataaagattactccttgtgaaatattaataattaacatattgtattaaataagtatttctactccaaagtatagattacttaggataaaaacattgttatttctctgtttagtcaaaccacttcctcttagttcagaggttataaataattgcatattaggagaattggattactgaggtttgtattgcgtattgaatatattttgtgttattttagaagataataattagcaggtattttaattttatagttaattcagctgaatcattaagaagctcgcctttttgtatttttttatcctgttaacagactatctagaaaacatgcaaattttaactattaacataatcataataaagatatcttatttattgccagc

SEQ ID NO: 3632 - DNA, 9158 bp, Homo sapiens
ctgcgcttccgttcgcttgactggctgcgcttgttttcagggttttggtctgaaaacggatcttacctgcgcagagcaaaatcggttgtagattatatccacgaaaattccttctattaaaatgaatttcaagtcccacctaccctggaagcagaaagagagagaagagagagagtaaagagaaagagaaaagaaagagaagttgaaaaagagaaagaaaaccaagaaagaaagagaaaaaaaccgaaaataaatggacaagaaagaaaaacggtgaaggtcaaccctgtgctcaattccagagactttcctagggacatcgtgttgggcatggaggactaaggccagtgtgaagataagtcaccgattctttaaaaaaaaaaagccagtaacttataaaaatagccataaacgacgtagttttttgttgttgttgttgttttgagacagcgtctccctctgtcccccaggcgggagtacagtggcaggcactcagctcactgtaacctccgcctcctgggttcaagtgattctcttgccccagcctccagagtagccaccacgcccggtccaacttagttttttaatactttttaaaattttaagacagggtctctgccaccgaggctgaaatgcagtggcgcaatcatagctcactgcaaccttgacttcctggggtcctgggcaggtgaccccctgtctcagcctgccgagtagctgtgagtaaaggcctgtgcctctccactgtgctaattttctactgtttgttgctttgtttttaatagagatgtagtctggttttgttgcccaggctggtctccagcttctagcctcaagcagtcttcccatctgctcctaccaaagtgctcggattataggcatgaatcaccttgcatgggagataaggacccccacatcaagccctcaggttatttttgaaacacaaatacataaggcccacaagcaggcccattggctgcagacagtggggtcacctgaagaacttttctttgatctgagtaccaacttctcacctaggtcactgggatcctggactacggcactgctccaggcaggcctggttatcctgcttgaggcagcaatcctcttgagcctagtgaaatgcaactggctgtacctcaatgatgttgccctgagattctgccagtcgaggtattacttcaatctcctgagaccagcctctacctccagatccagggaggtcagtgcacatgtaaatggactagctttattaaaggggatatctgggccaggcgtggtggctcacgcctgtaatcccaatactttgggaggccgaggagggcagatcacctgaggtcgggaattagagaccagcctggttaacatggtgaaacgaagtctctactaaaaatacaaaaaaaaaaaaaaaaaaaattagccaggcatggtggcacacgcctgtagtcccagctactcgagaggctgagacacaagaattgcttgaatctgggaggtggaggtgcagtaagccaagattgcgccactgcactccagcctgggagacagagcgagactccgtctcaaaaaatataaaaataaaagggatatctggattggcggagagactgcaggacagcattcaagtggggttgaattggcccagttgcatctgacttctcacttgtagttcccaagaatgaatatagaatgtgctggaaaagcaacatcctgagaggaagggaccggtgagaaaaggacaggatgtgttccagatccccagaacaggatcccctttgttgctttaggccaacgtgccatgcatccctggagcatgaaacccaggatgggccgccttccagcctcccacagctgtgatgcaagttgaacacatacagagagactgcatctgcactgggtggttttcctgagccttggggagcagaatgcatgaatcccagatggaggaagtggaccatgagtcaaaggatgtaagtggcctctggaacctacaaagggtaaggaaacaaattctcccctggagattaatgaagaatcacagaactatggacccatattagatatgtgacttacagaattataaaagaataaatttttcttgttttaagccaatcactgtgtatagcaataggaaactgatgaaatgattttatgtagaaaattccaaaaaaatctacaaaaatctctagaacaagaaaaatgtaaaggtagcaaagtataaggtcaacctacaaaaatatcgtatatttcatcagccaggcatggtggctcgtgcctgtaatcccagcactttgggaggccaaggcaggcagatcactcaagctcaggagtttgagaccaggctgggtaacatggtgaaaccccatctctacaaaacacaaaaatttaacaggccatggtggcacatgcctgcagtgccagctactggggaagctgaggtgggaggatgacttaagcctgcaggacacaggttgcagtagctgagattgctccactgcactccagccaggatgacagagtaaggccctgtctcaaaataataataataataatcttgtatatttctatacactagcaatttgcacatgaaacctgatattaaaaataaaatactatgtatgattgctccattaagaaaaaggtcaaagaggccgggtgcagtggcttacacctgtaatcccagcactttgggaggccaaggcaggtggactacgaggtcaggagatcgagactatcctggctaacacggtgaaaccccatctctactaagaaaatacaaaaaaattagccaggtgtggtggcgggtgcctgtagtcccagctactggggaggccgaggcaggagaatggcgtgaactcaggaggcggagcttgcagtgagctgagatcgcgccactgcactccagcctgggcgacagagcaagactccgtctcaaaaaaaaaaaaaaaaaaagggggggggcaaagaaatacatgtgaaacaaaacattcatagaactgttatgttacaactaccaaatgctgataaaagaaatcaaagacagcaaatagagacatataccatatacatttattggaagactccatgtaaagcaatatgaattatacaaatctgacacatagggttaatacctttcctaattaaggcattctgcagatactaacaaggttagcagttatgtagaaagacaaaaaacccaaacacctaaaatagctaaaacatctgaccaacaacaacaaaagattggtatcacttcatgtgatttcaagtcttctaatacaataaaagtattttttccctttctcatatttacagtaaacctagtttgtatttgtcattgtctcgaagcaagaatctgtcccagaaaaaaaaaaaagaaagaaagaaaatttccattcaaaactaacaggatttaggccaggcatggtggctcacacctgtaatcccagccctttgggaggctgaggcgggcagatcaaatgaggacagcagttcgagaccagcctggccaacttggtgaaaccctctctctactaaaaatacagaaattagccaaggatggtggcaggcaccagtaatcccagctactcaggaggctgaggcaggagactagcttaaacctgggaggcagaggttgcagtgagccgagattgcgccactgtactccagcctgggcaacagagtgagactctgtctcagaaaagaaaaaaaaaaaaaaaactaacaggatttatactattggttttccacagaattctcccagttgcagagtttcccaaacactatttattagtgtggctttgcagggtgcagtggctcacacctgtaatcccaccagtttgggaggcagaggaaggaggatgacttgagcccaggagttccaggctgcagtgagctatgattgccactgcactccaacctggctaacagagcaagaccctgtctctcaaaaaatatatatatatatacagcttccactctgcccatctgagctcttacctgtgttcacacctttgatccattccctcccatctggatttttttgctattttcccttcactctccagagtccagggctctctcctttgctcccacatagagataatactcaggtcaggaagacagattcctgtttataaaaaaagagaaccaaggtgtactgtggcacctttaaaactcaagccctgggctgggtgcagtggcccaggcctgtaatcccagcactttgggatgccgaggcaggcagatcacttgaggtcaggagttcgagaccagcctggccaacgtggcaatatgctgtctctactaaaaatataaaaattagccaggtttggtggtggacgcctgtaatcccagctccctgggagtctgaggcaggagaatcacttgaacccgggaggtggcggttgcaatgagctgagatagcaccactgcactctagcctgggtgacagagcgaggctccgtcaaagtgaaagaaaagaaagagagagagaaagggaggaaggaaagagagaaagagaaagaaagtcagtccatggtttccaaaacatacttctgtttccattaatttattaggaatgctcttccatctggctgttgatctgtgtcctgtgtaacatcctttataacaaatggtacacctcagtaaattgtttctccaagttgtgtaaatcactctagcaatagcaaattctgggggcagttttgtgcaactgagccctcagcctcctgtgagatctaatgctaactccctataaatggtgtcaaattgagttcaattagagaacacccagtttttatctgatgaaaaatagcttgttggtgggaagtaatccccacacattttgatgaccggagatgaggcattctgtgttgagcattcactattgtgttgattgtgagtagaaaaaacactttggtttttcctcctatcttatacactcacacaccctaccccatcccagaagtgaagatagtgacccatacctgaatgagtcaagtcactgcctgccgtctggcagaataaggacagcaaatggaagctaacctctgataccaagaattaggaaatgcacatgccttatagacagttttccaattctcatcttcatctgtatattttaaacaaatgtgatgtttattatagagaaattaatcataatatccaatcaattcatcattcatctggattgagtgtccccctctttcctcattactgtgtgtttctctacctacctctcattctcaccttcttttcctagctttttttttctctttatttttcccctaggattctcctcatttcaagcccttcttccttctcctgctcttccctctattccttctcttccacttgttctgctcctttctcacttctttcacctcttattcttctttctgcccaatatttgtctccaattttcatatagttctgcctctttcttccccccgtctctgctgccccctagcttcccctgttaaatcccctcttccctgctatatccacctgtcccctctctggcatccccagatcccagttctccccaggctgtggttctccctgtgctctccttatcactggctgcccctcttgctctcccagcaccatgctgctctgtctgccctggctccaaatccctccttctctccccaactctccatctgaggagcctccccttttctgcccctctccctatcttgctgaactttatctctctagaaacccagtttttctctaaatttctctagttgcttttctccccctgctcctttctcagcatcttcatgcactgtctctgcaaatccctcatccaccatctactttgccatctgttttgttttgttttttgttttttgagatggagttttgctcgtcgcccaggctggagtgcaatggtgcgatcttggctcaccgcaacctccgcctcccgggtaaaagcgattctcctgcctcagtctccagagtagctgggattacaggcattcgccaccatgcctggctaattttgtattttttagagacagggtttctccatgttggtcaggctggtctcaaaactcctgacctcaggtgatctgcccgcctcagcctcccaaagtgctggaattacaggcgtgagccatcgcacccagctgccgtctgtttatgggtctccttcattcttctttcccatttcaccatttttctatttcctctcctccacacattcatagggaggggactgcagtcagatccccacctcaagagcccatttcctgtgggatggaatttgggacaagagaaaccttaacgtcctgagatagaagtcacgtccccacactcgatatcaggagaaggggaggcctggggagcagaagggcccccgatcaaggaggaaaaaggcaggagaaagtcaggagaggggcagggtctgcaggatcccaggaccaggaagagttcacggcctccctgggactggggctgcgtcgctgcgctccaggagctgacgagggagcggagcagatgggaagctcccagggcgggaatcaaccttgcggtgaggactttaaaaaaggtgcgggccagtgcaggggacactgaaggatttgaggcaggaaaactccgcgataagagctgtctatatggccctgtggcagaagcacgggggacacgaccccatggaactgtgtccattaaacctctttgtcttcataaattacccagtctcgggtatttctttattagcagcgtgagaacagactaatacagtaaattggtaatggtatagagtggggtgctgctataaggatacctcaaaatgtggaagcaaattttgaactgggtaacaggcaaaggctggaacagtttggagggctcaaaagaagacaggaagacgtgggaaagtttggagcttcctagaaaatggttgttgaatggttctgaccaaaaagtccaggctgaaggtggtctcagatggagatgaggaactttattggaactggagcagaggtgagctgcaggggcggagccctcatggagaacctctgctagagcagtgcagaagtaaaatgtggggttggagcccccacacagactactcactactcgcctagtgcagccgtgagaaaagggccaccctcctatagaccccagaatggtagattcaccgacagcttgcaccatgtgcctggaaaagtagcagacacaacaccagcctgtgaaagcagccaggagaggagctgtaccctgcaaagtcacaggggcagacatgggttccctgcaagaccactggaaccaacctcttgcataagtgtgacctggatgtgagacacggagtcaaaagagatcattttggagctttgactgccctgctggatttcagactggcatggggcctgtgacctgttttggccaatttctcccatttgcaacgggcgttatttatccaatacctgtgcctccattgtacctaggaaataactaacttgctttttattttacaggctcataaacagaagagacttgcttgtctcagatgaaactttggactgtggacttttgagttaatgctgaaataagactttgggggactgttggggaggcatgattggttttgaaatgtgaggacatgagatttgggagggaccaggggcaaaatgatatggtttggctgtgtccccaccaaatctcatcttgaattgcagctcccatgatccccacatgtgggagggacccggggggaggtaactgaatcatgggggtgggattttcccatgctgttctcatgatagtgaataaatctcatgagatcttatggttttataaagggcagtttccctgcacgggctctctcttgcccgccaccacgtaagacatgtgtttgctcctccttcaccttctgccatgattgtgaggtctctctagccgtgtgaaactgtgagtccattaaacttctttttctttataaattacctagtcttgtgtatgtctgtattagcagcatgagaacagactaatacaacatcccaggctgctcacctatccctgttctccaatttggaccagctggggaagtccatcctgctttccccagaaagcctcatgtaaatgtttatgtagtaaacatttgcagaccatatcagtgtatggcatcatcattctcaatatataatacaaactttaggtggacttcaaacaaattccagtacagcagtcaaaagttcaaattatcggtcaagcatggtggctcacacctgtaatctcagtactttgggaggctgaggcgggtggatcacgaggtcaagagatcaagaccatcccggccaacatggtgaaaccctgtctctattaaaaatacaaaaattagctgggcgtggtggtgcacgcttgtagtcccaggtactcatgaggctgaggcagccgtttgaacccgggaggcagaggttgccatgagccaagatcgcgccactgcactccagcctggtgacagagactctgcctaaaaaaaaaaaaaaaaaaaaaaaagttcaaattgccaaaaatgttgtaaggggaagtatatgaagtttctagttaatctacaaaagcaaaaaaaactcccattctatgtgaccattcttaaaatttatgggccaggcgcagtggctcacacctgtaatccccgcactttgggagtccgaggcgggtggatcacaaggtcaggagtttgagaccagcctagccaatatggtgaaaccttgtctctactaaaaatacaaaaattagccgggcgtggtggtgcgcgcctgtagtcacagttatttgggaggctgaagcagaagaattgcttcaacctgggaggtggaggttgcagtgagccgagatcgtgccactgcactccagactctgtctcaaaaaaaaaaaaaaaaagaaaatttatgaacattaatattttccacttacgtcactgagcactactaggaaaaaaaaaaaagacatgcactactaggaaaaaaaagacattgtggtacagtattttcactcttattaacatactttctttcatttaatagtatttgtcgccaggcacagtggctcacgcctgtaatcctagcactttgggaggccgaggcaggcagattgcctgagttcaggagttcgagaacagcctgggcaacatggtgaaaccccgtctctaa

SEQ ID NO: 3633 - DNA, 1031 bp, Homo sapiens
ggaagtggcttaatgatcctgaagggatttcttctgatggtagcttttgtattatcaaacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccgaaataaatgagagatgagttgggatcaagtggattgaggaggctgtgctgtgtgccaatgtttcgtttgcctcagacaggtatctcttcgttatcagaagagttgcttcatttcatctgggagcagaaaacagcaggcagctgttaacagataagtttaacttgcatctgcagtattgcatgttagggataagtgcttatttttaagagctgtggagttcttaaatatcaaccatggcactttctcctgaccccttccctaggggatttcaggattgagaaatttttccatcgagcctttttaaaattgtaggacttgttcctgtgggcttcagtgatgggatagtacacttcactcagaggcatttgcatctttaaataatttcttaaaagcctctaaagtgatcagtgccttgatgccaactaaggaaatttgtttagcattgaatctctgaaggctctatgaaaggaatagcatgatgtgctgttagaatcagatgttactgctaaaatttacatgttgtgatgtaaattgtgtagaaaaccattaaatcattcaaaataataaa

SEQ ID NO: 3634 - DNA, 40379 bp, Homo sapiens
ggatttgccgccgcgcttgggaagccgccaccgccgccgctgctgcatggcactaggctcccggcggggcaggttccgcagccggcaccgctctggctaggcgcacggaggcgccttgcttagtctgacccttatttggccaggcgtaaaacttgtcctgcctaaaagcctactgagacctcctaactggtctaatccgcgggagacgccaaaggcggcggccgtttgtgcgcacaggatttttcttggagctgtagcagtctaggaagccagggtggaacttttgctaagctcccgttgtaagcccagagctgtaataactgctgagacacaaccagcagtatacaggctccagttggaaatcgagaactttccagggctgtcacccaggctggagtgcagtggtgccatcacagctcactgcagcctcgacctcctaggctaaagtgatcctcccaactcagcctcccgtagctgggactacaggaatgtgccacgcccaggtaatcttaattttttgtggagacgaggtcttgctatgtggcccaagcagatctcgaactcctgagctcaagggatcctcccaccttggtctcccaaagtgctgggatttgcaggcgtgaaccaccacacctggccataaaccaacttctcattgcttacctggctttccaagaaaagagagagggcagagggaaaatatttattattttgctatgtactgagtattctaagcatggacttgtatcgtctctgttctctcaacaacctctctaaaacttcaacgtagaaatttccatcttaaaattaagcgacaagaactagaaatggcaagtaattcatccagaggttactgggatttgaatactggacaggcagatccccctcatttcaaattaatactacattagctgtcttttttatttcttttttctttttgtttgtttgagacaggatctcgctttgtacgccaggctggagtgcagtggcgcgatcctgggtcacctcccagattcaagcaattctgtgcctcagccaccaagtatctgggactacaggcgtgagcccggctaatttttgtatttttagtagaaacagagtctcaccatattgcccaggctgggctcaaactcctggcctcaagtgatcctcccacttctgcctcccaaaatgctgggattagcacctgaccttacgttagcaatcctgttgacttatttaagacaaaacgtgctttaagacaaaatctgtgccaaaggttttcagataaagataaaattagcaatgtaaccataaaattcaaagttgccttgggctgagttggtagaatgtttatgcagatcaaggaactccaaaagttaaaaaacagaagtggaagtgagcattagggaatggggaaagagttggtggagagaggaaatatttgtgtaaacatttaaccatctccaaacaccagcaaagaacagttgaaacgatttgctatactcactgtccacccgtgttaactttatggtatgtgacatacagcaaaaattacatgtaatttttgactaagccttttagctctttcaatcccttcgtagtatgtcaccccctctcttcccataattaaaaattataagacacctagtaaatataatacactcatagaattaagttataagtccatcaagtacatttccaattggaagttaagagtgatgctgacccttcacagttgactgggctgaagttgggaactgattcaataaacttccaccacaaggatgtcaaattgctcctcagggtattctcagagagtcttttccctaggcttgatctccttaccctaagtgttaggacacaccattcctctcttgcttgcagtattcaatgactttacccactaataaaatgatagtaaatagtaagagtgaatatggcttgtaagtaatgctaacaaaactgtgatggcttagcaaagtaaaagatggttttatggtcagtaagtttggattaaagcttactaaagcttgatgctttgttaccagtctgctaaagaactaccttcttaatttgatttcctacttactggatacctattggaaaactagagagatatgataggctttcatttattgctgccgtaaataaatttttaaaatagagaaataacagctttgtcattagtgtagagcacagtttgcctctgctaggtcagtattgggcttgcttcgtttaagtcattaaccattaggatcacccaacttgtcctgcctaaaagcctactgaaaaaacatgcatataacttttgcatatttattttgctacttattgttgattttctataggaaactatttatactcctcagtgtatatggccaacttggaagttctacttcctataattatgtcagcagttagtgaagatgatcaaaacagccattctgaatttaataaacagatgagcctcagactctggatctccatgacccaaccctatgaggctctgcctgaagaaccaatcaagcttcccactttgatattttagtgactgtagcatcttgttcctcttctaaattaaacaccacagatgctcccatttcatggctgtgtaggcacgatggactcaccactgccttccataccaccacctggtttatacaataattttccaattctagttgtccaaaacgaagctatacaaaactcacaaatccattattgtcttccatgtagagataaaaaagcaaggaatatgcttgttaaaaagcatgcaatactttatgaatcctcggtgatgtactttttgggctcgctgctgctggagattttgctaatgcccctacacgttttaatgcagtccaccaagctctttgctagtaagctggtttccactttttttttttcctttttctttttcttttcttttcttttttttttttaaacagacaggatctccctttgttgcccaggctggagtgcagtggttattcataggcatgatgatggctcactacagtttcaaactcctggacttaaacaatcctgtctcagcctcctgagtagctgggacttacagatgcgcaccaccatacctggcatcccacatatttttctaatcattatccccttctttcctaaattttcttcaaggaaaccaaactcagtcccaacttccataagctaacacttatacaattaaaatgacatttagcttctggaatcaatgtggaaagaaatgacaacttatttgctgattatttttcactgtaataaatattaggccttttatctggaaggaaataccaaacccttgtttaatattaataacttgtaaattattgtacacgtaatttcattctctcttcccatgtcttcatttttctgcctctggcttttcaccttgttgtgaattcctagttttatagtacttttatactgtatgatactgacttcttaagcatacaaaaaacttcagaactcaagcaattccacctgtaagccttgtctagtgatgcctatggcaaaaaaggacccatacatttgatgtacttatcactcaaaaatcattcccagagaattctcaggaaactcagaacagggcctaccctgaattctgagaacaggaccatttttaagtcctttaagtccttcattgacacccttcctttctcttactttcttttctttcttatttttctctttctttcttttcttttctttttttctttttcttttctttcctttcttccttctttcctttcctttccttttttcctttcttttacttttctctttctttctttctctccctttcctttccttttccttttccttccccgtcccttccccgtcccgttccattccgttccattctgtcttgctctgttacccaggctggagggcagtggtgcaatcataactcagtgcagtcttgacctcttgggcccaagggatcctcccatctcagcctcctgcaggcatgcactatcaagtccagctgatttttttttttttttcattttattttttctaaacaccgggtttcaccatgttgcccaggctggtctggaactcctggcttcaagtgatcttcctgccttggcctcccaaagtgctgagattacaggcatgagccacagtgcccggccaacacccttacctttatgttcccagtcacattatgtcaaatatttcagaatgcttctttgtttcaaattaaatacacattcataaatttactgctttggttctttggataatcaatcagtcaggtctataggagagatgatttttgttgtttttcttgtgaaaaatgtgaagaataagttgaatggttggcatactgccacatcttatagccattgagttaaatattcatttgaattaggtttaaaacgtggttgaggctcttgaaatgctagtaatccatagattctttatcattagtgcctcacgcattagaaatagcagtacttctgctggggaatgtatcatctgggaaaagtcttggctaccctacctgcaggtcctctattcatagtgtaataaaagaaaaacaataaaaatgatcttttctacaagattatccaaaactcctacagcatccctccaggcatcagctgagggctcttattccaaagtcacttactgttgctggaattcttttattctgccaggatccaggcagtcgctgctgccatgatctagtccctaatgacctctctcttcagcttggccagctaagctctctcctgctggcgccctggccctgccccttctctgctctcaggtaacagagaaagaggagttgtggttggccctggaacctggatacagacccaggggaagtctaaagctctccactctgttcagccagaggccaccagcctctgcaccagccctaattggctctagaggtgcaactgatcggtctcctcctcttttatctctgctcagtcatcaccatgtctccaggtcagggtctgtggtcttctcagagagacacaccctcctccctatcagggctgtacctggctagaagagtttgtttaaacatctgcccctgcagtgcgcactgggtggtttcctgtctttgtgtccttctcctaaattggagccacttcatcccagtcaccttggaacctgactcaagaaatggcagttccatgcctatttctctggacacacaaaggggtcctgtctccagggtaatctcagattggatcaccccttgtttcacttagactcaggtgccccttctcccaacgaggatgcatatagaatagaattaggccctgctcccagacaagcaatctagaagtccattctcattggttgaccttctgtggtgttcctgaaattgccttgtagccaatcagacactaagtaaacccaggagccttggaacctctggacctcagttttccttgactcactgattttccactggtctggtgcctcagaagaaccagattctcctgttcagtcgtcacttcccttctgctgcttccctgctttagaaactaagccctgtcttgcttttgtcaattctgtatttatacccctacacaaaactgaatggccactggcctccagatggttctcctacacttcagtctttcactgctagcctgcctgccgaattggaaaccctggtatgaccatttccaaaattagaaaccagactgcaccatctcccaggggcactatgcctgcatctctcagcactcagtcgagccaacctctgcaagtgtcccagacacccttccttccagtctcttctactcccctcccccatatttctggctatggtgatttgggcttttgccttccactctttgcccaaccttgctgaagtcttaacacattggacctcccctgcctgaactatgccaagcagaagaaaggcgaattcaagggttacctaaaccctggatattctttcagaggcctcatcacacatcctatcaaacactggaaaatgtcctatcccacatgaaaagcacgacgttttgttatgaaaattaaaggaaatcatataattttcctcttgaaacatttattaattgcattttataatttgctttgtgttttagagccaggccattttcttgtccagctctcaaacaatttgataagactgggaaatgcttatgagctctgggcactgcacctatagtgagaacttgagccttaaaggattagaaaaatgcctctgggaggaaagcaaacacacacgtctctatgatgcagttcaagcccctcacccccatcatcacttaaatctctctcttgcccagtttctatatcctaatgggcttctttgcctgatcccctgtcttggctactcaccttctgccagcagctctcagacaaacactccccttattcccaaagcaagctggcctgcctggatttcaagagtttcaccagcccctagattccctttcaagcccttgttccacctctgaggaccctgcccccaggcgactgccactttggactatggcatttgtttgcttgaccctgtagaaatgataactgaactctcttaaggctgcagcttcatctggctctctggagccccagcccccttcaaagccctgatctgggattgcatattgggtgcttcagtctttccctgcctgctgggactgaccagcaaaggccatttgtgtcccaagtaggacagctaccagaaatcacacttcacattttcctacttaaggtgcctgcttacatttccctgtgctttgagtgtctccttctctaaaggagccttttatgagtcagttacatgtggcatccctgctacacttctctgtggcttttctgatcagttatacagattaagaacatgtacaagaaagccaaaatatccccagcaattaccccaggttacgtctcttgtaaatgttaaccattactcagttgaaatagccattaatagttggcttttgtgttccaggatttctgaggtcactgaattactagtgattctgcaatttcaatatatttcttaaaattaaattacacatattttgggtacacagtgatccagttaagagggagagtctgcaattatatatttttgtctctttagtttcctttctcatttttttcccccagaaaggaaattagactagccttttaaaaatggtgttctgctacagtctgcaattttgagaggaaaggtgatgaatgcctttattttcatgtcgtcaaaagctcagcaagaatttgcgtctattttgactgtggagcctactgtgtgcaaaacaggtgtgacaaaatcccccctattagagctgttttctttccattttctattttaaaaaaacttttctctctgtggtaatcacttaaccctaaaaggcctggatatttatacaaaaaggtaccatgcttcatttgttaaatactctttctcttctgagtttgattttaattttagttatttaattgtttggtccaagatagacttaaaacatcttattttgaaagaaaacatgattaagttcctggaatatttacttgatcacttgaaccaatccatggtgttcctccattggcattcctccgcgggacgtgtgatgactagcctgctagtcttggaaaatactcctcccctgcccttctctgtccttatctaagctggcttctacaggctgttttccagacccatgtgtcagctggcttcctactgggctaggctaacagggagcactgtcaggtgattggagggtaggagaaaccaatatatctccccatctctttctgccttaggcaccatcccctgcagctgtctccccagcggctccctctcttgctggacaggcctaccatgaaatcagccctgggatctgacaatactacctcctcctgccacctacttaaaagtgtaatagtttcctgtggttgcttctctggggaagaatttcccctggattcttctcagtttttccatcacctgtgcaacagattccttgtatcacattctttgtttgaagaaataagtgtggtttctgtttttctagttgaattcagcagatttatccattttgtgttttcgtaagggtcttaccctgcttaggggagaaggaatgattttcacaggaaagcagtcacattcagtttaggaatctgcctgtgcttcccccgatggctttagtaatgtcattattttttccacctcttactccccatgcttgctcctcacctcccatacccaacctgtgtctctcctgcttcctccattcttagagcatatgacacctatcttctggggtcacatccccagaggtacacaatgatttgtttttgtttatttttaaatttcttttcatatagtgtccttaacaagaatgtcactgctgtaggataggatagcaaaagagcactgggtttttcattcagaatgtgaatcagtgtggcttgtttgaatcctatagccttgtcctgcacaacagtgcccttgatagcagaacaggaaaaaagataatttcaccacaaatctatgaggagaaaatgagatgaaacatatgaaaggattgtgcaaaagataaaaggctaaaagaaaataaaaagaaaaggccaggtatggtgtttcatgcctataatcccagcattgtgggagcccaaggcaggaggatcacttgagcccaggagttcaatatcagcctgggcagcatagagaggtcctgtctgtatttaaaaaaaattttttttaacgataaaatgctaagcaaataagaagttattattttgaaatagtaaataagcctaaattagttgttttccttgaaacaattgtaattttaaaagttaccacaaaggtatttctcaactagaatttatacagaagcttaacaacatcacagtcttgatttaacacatgatttctcaatctcagttctattgacctttgaggttggataattctttgttgtagggagctgtcttgtgcattgtaagatttttggtggcatctctaccagtagcacccacctgtctagttataacaaaacatttctcaacattgccaaatgtcccctaggaaaaaaaaaaaaagagacaaaaccgccccaaattgaaaaccactgatttaacaaaacctacttggaaagatgtgccttctttttgatataagttgttaaaacaaacaataattaaaagaagtctggcttttcatagattatttgggaaaaatcttttaaaaatgcagttcagtcataaaatataaccttaaagatccaaaaaccctacagtgaaagtcagtggtgattgtcacagcagtagtgtgtgttactaagtatttacgttggagaagctaatcttcctgttaagtattgtggtcggactacctaaccaagatgtcctttcttcttcatacaattaataacattgttatttttactaggtgttaaaaaaaaacacactaacactttatatctgactactgtatgttgaaatcctttgatgtcctttaaaaggcaaggtaactcagattgaatattagtaggaacatatatttcactcttgactcatatattctgggtttgtacttgtatggactaccttgagtagctgcaggacttagaattttatgagcatcacagctaagtcatggtctgtagaatcattcatatttcaattcctaatatggtagtcttagctaccatttaatttctagagaactggaaaccaaagtataactatgtaaagtctagaaattattgtatttaaaatattgattccaggtctccaaatatgtctcttctagcttatatcaataggtttctaaaaccagtttttcatctccactgtgtcagttagctttcttcccagctaaagaaaatattgaccaaagcaagttgcaaaacaggtgaaactggttgtagtaaaagagttactttttgctgggaagataaaagagatgtaactactgtccttgacatgagtatattgctaagctttgtggacaaacattctgagattggtaaaatacttactgcttcaggaaaattacacttatttcctcatctatgattttgcattctcctagttaatcttcttttgggggacagtgagcctcctttgaaggacttacgggcattaataataatatcactgtacaaaaattaataatatgtattgctcttttaaagatacttttgtacaagatattttaataaaacaatcttattcagtgctgcttattgtggttggtgaaaaataaataaataaaaactatcttataactgaggcgggtggtcagagttttggatgcagacagtgggattaagttcagtcagaaagttagggcacttttatttgccgtcatgcttttgaatttgaaggactttggaccaagcctgcctctccagttcactgtcatgttctcagttcatcacatattacatctggcctacgcttcacatctgtcaagcctctgtgcagacatttggatctgtaaactctgccaggacaaagcttgggctagcatcccatactataaatgactattcctcagtggaatattttgtttccaaaaaagaaatctatttgaggtatcagtgcttgccccatctgttttttaagatctgagaaacaactatgtaaatatacatagaaatgatttgagtcaaagctctcattctcatcataaataaggaaggaaaggcactgacgatgggccatttcagagtcctccctgctatctctgatttagaaaaaatatatgatcaaggtggagtaatagaactagatttaccctcctacctgtaacaactaaacaacaacaaaaacagacaaaagacatgaaacaatggtttttatgacactagatatcaagcaatggacatggtgattcttgaaatataggaaataaaatggatgagacctactattgccccagtttactaatttgagagagttttcaggtcatgacatgtggtaggagaacagaggtgaagcccagttatgattctgaattgaggcaacattgctgagagtccaggaagatcaacgcagtgagatttcttaggaaagagtgatagaggagagagagagctacacagagtaaagcctgggggtctgcagagggatctctgttaagtattcagaagagttttgatcatgactatgaagaaactacatgaggcctagaaaaggaccatctggaggaggtagagagaacatgtggccataacatacataggaccagaagtagtgtctgttcccactaccggccagattggaaaaactcataattcatagacactggataaagtactcaagaaggtcttgcctcagtggtgggaaataattagccctagcctgagaactgctctcaacctgccaaacaaatcataaaagcaacatctgaaaagatcaaactgtttccaagtaacttaacatcatacctgaacaaaactcaagaagatttatgagagttcaaaagtatccagcacccaacaaattcacaaagtatgcatgcaatcaaagattaccgggcatgcaaagaaaaagaaaaacatatctcataatggggagagcaaccagtcaatcaaaacagacccaaaattggcacagatgatataattagcagagagagacactaaaacaattattgtgactatgttccaaatgttcagaaagctaagtagagatggaatatatttttaaaagacccaaatctggttggaatttctggtgggaatataaaatggtgcagccactttagaaaagtctggcagttcctcaaattgctaaacatatagttactacatgacatagcaattctactcctaggacgtacccaagagaaatgaaaatattttcgcacaaaaactcatacatgaatgcttatagcagccttatctttaacagccgaaaggtagaaacaacccaaatgtctatcatctgataaacagataaaatatggtatatccataaaataattgaatatatttagtcatagaaaggaataaagcatggacagacactgcaaccttgcaaactgctaagcgaaagaaccagacacaaaggcccatgtattgtatgacttcacttgcatgaaatgtccagagtaggcaaattcatagagacagaaagaagatagtgattggcagggattgggagattggaaagtgactgctaataaaggtgaggtttctttgggaagtattgaaaatgttctggaattagatggtagtgatggttgtacaatcttttgaatacactgaataccactgaattgtatactttacatgggtaaatttatggtatgttaattatatcacaacaatgatggttaaaaatagatgcaatcagaatcaatttatctttctactaccatgttagttgtataaactatcttccatttcactccttctattctgtccctaacccatcccatctttccactaataaggttacacaaggttaccaatgacctgaatgtatctaattcattgtcagcctctgttcagtttttcctaaatctctcagcagcatcaaaatctctcaacattgcatccttttagtaacagcagcatcttctatagatttcatgaaatacactcacctagttttctcttaccagactttatagctgcatactcataatcttcacttaaatgtccagtaggtacctaaagcctaacatgtatatgacagaattcggatctacttgctgtaaccacatcctacaaatacgcattaggtaggcccatacctactcctgccctagtctttcccatgagagttaacacacaatcatatatccaggtgctcaggccaaaaactagggagttgtttaccatgttttattgctctctttccctaatcctaccacatcaaatccactggcaggtcttaatagttctgcctccaaaaatctatgtggaacctatctccattctccagttatttattcagaggttaaagaggagactggaatggtgcctgagggattagattctatctggtcttgtgaactgttacatgaacattcacctttattccgaataagatacagagttttgaccaaagtaataacatgatctgatttaagtcttaaaaggatcactctgacttctgtagtgaaattagactgtgggggaaaatgaaaatagggaacccaatcaggaggctattgaaattttaaagaaggattatggttcggactagaaagttgggggcaatggaggtgcaagtggtgactgagttctatttatacttttaatataaatagagccaaaaagatttgctgataaagtaaggatgtagagtgtgaaagagaaattaaatgatgccaggactttggtctgagcaaatggaatgatgagtatgccatttcctaagtagaagattattgagtgagcatgtttggataggaggatataaatttggtttttaaaatttccagttggaactatttatcaggtaccagatagagctatcaaaaaggatagtggatatataagtctggaatttagaggtgagatcaaactggataaataaattctggaattttcattttatatgtgatattgaaagccacagaaattaacaaaatcataatgtaagcagcatagatagagaaaagttcatgggcttagccctgggggccctccaatagttagaatcaaagagacaaggcaaaactagcaaagtaggttgtggtaaagtagccagtgaagtagaataaaaaccagttgagcatattatcattttcagataggcagaattgcagcatatttgactgctatgaagagggaaaaatttgggacgcaggtagagcaagatgaattgctagaattatatccttcagtggggaggaaagtataggattagaactagaagacatgttggtctggataggcacagggtgttcatttatagtaacagaaaagaaggcagtaggtgggcacagatgcagagatacaggtaggtatttggtaggagattctggaggttctcttatgaaggacagataagatcattgaagaagagaagagagaaagtcaaggaactgagaggccatggagttgaaaggatcatccacgtgaatattacaatcaccaagaactattataggaatagtgtttgataaaatgtcaatcagctaaaggctaaatctttaaggaataaggaggagtggtcaagggaaatacagtgaatcatagcaatatggtgggaaaatatgatattaaaagctggggttttaggggaagaagagaaaatgatctggaagcagtaaggagccccccactggcctagtggtatgtggcatctgagagaagatattggctctacttgagagggctacaggaaaagctgtgtttccaggggagagagaaagacacgtggaaatatggaaatgcatgtattaagtttttggctgtcacagtaactagtggaattctgtgtccaaagaagagacatgctaaacatcctgaaaggtaatggcaagattatatgacatggacatatgctacccaaatgccagtagcacccctgttaggaatctaaaagtagaaagaacattcagagaaaaggcttggattgattgtcttagttgaatttctccagaaacaaatcttgattgtaagtaatttattcagaagtactgggaaaaccagtaaaggaagagggaagtgatccagggaaaagaaggcagtcatccaatgcagtatcgagccaaggtactgccatgggcaactggagtttaaccttatgggaagctcaaatgaggaaatctgagaaaggagaaaaacacactcctcacagttatttaacctcaagagtgaggtagctgaagtgaatacacaccagcttctgagagtcattggtagaaggctgcagatctgatgaacatgagcagagcactgacagcctctgttataggatgtagaataaaggtttatctctaggataaattacaatgaggagaatcttctgggtctaagaataagtgcttgtgtgattttgatagatacctgcaaattgtccatcacagacagtatactaatttacattcaccccagaaatgtatgagaatatttctttctaccctccccaagtttatattctattaagctctcttctttttgctaatctttagtaaatatacatttcagtgtaattttcattttcatttatcttattaagagtgaaatcgaacagcttaacatatatttagcattttttatttccttttctgcaaactgcctgttaacattccttgttcattttactttcagttaccagtctttttcttactgatctgtagaaaagcaatatgaggttcaaatattttcccagtccgttatgtctttggaatttctttttcttttttctttctttctttctttcttttttttttttttttttgagatagagtcttgctctgtcgcccaggctggagtgcagtggcatgttcttggctcaccacaacctctgcctcctgggttcaagcgattttcctgcctcagcctcctgagtagctgggagtacaggtgtgcaccaccatgctcagctaatttttgtattttagtagagatggggtttcaccatgttagccaggctggtctccaactcttgacctcaggtgatctgcccgcctcagcctcccaaagtgctgggattacaggtgtgagccactgcgcccagcctgtctttagaatttctttatggaattctgtccatttctcttcatctcctctactgatccaagcctccttctctcagctcccacttacactaaaccctcgcctcctattaaatctctccttccactctgccaccaagacactattattttctatgtacaagatagggagcaatgtgaaaaatatgaatcagttcatactacatccctacaaaaaataccccaaggactgcttcctagtacacataaatctagaccccatgttatggccattttggcctggtatgattcacaccttgcctcctcatgtcctacccctaaaatttcacattgtttactttcttcttcatttagcaatcagcatgatatcaccctctgagaaaagccaaccactgccttctgagtcaaaatggcatgcacaccacagtgtgtgagataccagtgaggtacccacatctccagctttctgatctctttctgcctctttgtattatatttctcttattatttagtatgatgccaagcacataatagactcttaatactttgtccaaaagtattcctcaaaattaaaggatattgtcttacattcacattcttgtaagtctttcacattttagagcattttctaaattactttattttgaacaaatattatttggagaacacaaactgaaataacccaaatcaatactagatttatttatttatttatttttccttcaacttttaagttccacggtacttgtgcaggatgtgcaggtttgttacacaggtaaacatgtgccatgatggtttgctgcacacatcaacccatcacctaggtagtttttatatatatatatttttattacactttaagttctagggtacatgtgcacaacctgcagttttgttaacgtatgtatacatgtgccatgttggtgtgctgcacccattaactcatcatttacattaggtatatctcctaatgctatccctccccactccccccatgccatgacaggccctggtgtgtgatgttcccctttctgtgtccaagtgttctcattgttcaattcccacctatgagtgagaacatgcggtgtttttttgtccttgcgatagtttgctgagaatgatggtttccagcttcatccatgtccctacaaaggacatgaactcatccttttttatcactgcatagtattccatggtgtatatgtgccacattttcttaatccagtctatcattgttagacatttgggttggttccaagtttttgctattgtgaatagtgccataataaacatacgtgtgcatgtgtctttatagcagcatgatttataatcctttgggtatatacccagtaatgggatggctgggtcaaatggtatttctagttctagatccctgaggaatcgccacactgtcttgcacaatggttgaactagtttacagtcccaccaacagtgtaaaagtgttcctatttctccacgtcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgttggttcatatccttcagccactttttgatggggttgtttgtttttttcttgtaaatttgttttagttcattgtagattctggatattagccctttgtcagatgagtagattgcaaacattttctcccattctgtaggttgcctgttcactctgatggtagtttcttttgctgtgcagaagctctttagtttaattagatcccatttgtcaattttggcttttgttgccattgcttttggtgttttagacataaagtccttgcccatgcctatgtcctgaatggtattgcctaggttttcttatggggtttttatggttttaggtttaacatttaagtctttaatccatcttgaattaatttttgtataaggtgtaaggaagggatctagtttcagctttctacatatggctagccagttttcccagcaccatttgttgaatagggaatcctttccccatttcttgtttttgtcaggtttgtcaaagatcagatagttgtagatgtgtggtattatttctgagggctctgttctgttccattggtctatatctgtgttttgttaccagtaccatgctgttttggttactgtagccttgtaatatagtttgaagtcaggtagcgtgatgcctccagctttgttcttttggcttaggattgacttggcaatgcaggctcttttttggttccaaatgaactttaaagtagttttttccaattctgcatcacctaggtattaagctcagtgttcattagctggtcttcctgatggcctcactccccctacctccccacatgaaaggccccagtttttgttgttcccctccctgtgtccatgtgttctcattgtttagctcccacttataagtgagagcatctagtgtttggttttctgtttctgtgttagtttgctgaagataatggattccagctccctccatatccttgcaaaggaaatgatctcattcctttgtatggctgcatactattccatggtatatattttctttatccagtctatcactgatgggcatttgggttgattccatgtctttgctattgtgaatagtgctgcaatgaacatgcaggtgcatatatctttataatagagtggtttatttatttatttattttttgagactgagccttgctctgtcaccccaggctggagtgcagtggtgcgatctcgactcactgcagcccctgccatccaggttcaagtgattcttatgcctaagcctcctgagtagctgggactaaaggcacatgacatcacacctgtctaatttttgtatttttagtagagatagggtttcactcgttggtcaggctggtctcaaactcctgacctctagtgatccgcccacctcagcctcccaaagtgctgggattacaggcatgagtcgctgcacccggactgtaatagaatgatttatattcctttgggtatatacccagtaatgagattgttggattaaatggtatttctgcctctagatctttgagaaatcacaacactatcttccacaattgaactaatttcaattgaactaatttactaatttgttgaactaatttacactcccactaacagtgtaaaagtgttcctttttctctgcatcctcaccagcatctgttgtttctggactttttaataatcgccattctgactagtgtgagatggtatcactttaaatccctatcaaggtcactggttttaaatgcttatagaactggtttaaagggagggaaaataaggcatgataatgtaaaagattcagtttttctgggaggattttacaattgcaagaataccatgtaaacacgcttttcaaatatcacttagaaagcaatgtgacaagtataaatattgtgaagatacaatgaatgaaaacaaatgaagtgagagacaaacctaccctgcaaaatacaaaataggagaaaatatttgcaaaccatatgtctgtataaagaattagtatccaaaatatataaagaacccttacagctccataccaaaaaatcctccaaaagcccgacaacaaataatctggttaaaaattggcaaaggatcacaatagatatttctccgaagaagacatgcaaatgcccaacacttatatcaaaagtgctcaacatcactaatcatcagggaaaaacaaatcaaaaccacagtgagatatttcctcatacatattaggaggagtattaataataaaaaaagttaagaagtattggccaggatgtggaaaaaaaaggagcacttgtatactgttggtgagaatgtaaactggtgcagctgctatggaaaacaataagaagattcctcaaaaaattataaataaccccaccatatgatccaataaacctacttcttggtatttatacaaaggaattaatgttaggatcttgaagagatatctgtattactaggttcacgacaatagccaagaaatggaaacaacctaaatgtctgttgatggatgtatagataaagaaaatgtggtatatacatacaatgaaatattattcagccttaaaaatgtaagaaatcctgccatttgcaacaccatggatgaacccagaagatattattctaagtgaaataaaccagacacagaaagacaaatactgcattatctcgattatatgatgaatctaaaatagtcaaattcatagaagcagagagtggaatgatggttggcaggggctggggggaggtattaatggggaagtattagtcagagtgtacaaagtatcaattatacaagatgaataaattctagagatctactgtacagtataatgcgtatagttaacaatactgtaatgtataaggtagactttttgttacatattcttatcatacacacatacaataataataagggcaggagaaaactttggaggtgatgtgtagatttatggcatagattatggtgatggtttcatgggtgtatgcctacttccaaacccatcatgttgtgtacatttaatatttatgacctttaatatatcaatcatacttcaataaagtggtttaacaaaaaaattacacacaaaaaaaatttagtaagcattgacatgaacttatttgttattctagaaacaatttcaatgtgcaaatatatataggcatcatcctccctaaaacacaaaaacagaaaacaaaaaaatatatatcctaacattatatcaatagatgcttgtggcttagaacaaaatttagaattgatagcatcatataccatttaaatgattctttaaaaaaaattttgacaaaactaaaaatgatatgctctgaaacccactggaagatgataaatgcagcatcaattttttgagtctttggatgaaggactttagcctgaagagtcaccttgtcctacaacagacttatagtaaacaagttacaaaattttgttttattaatctactaatatatgtttttcaaccaaagtataacctaccctatactgacaaatacaactgtctacagtatttccttgaattaacctagccatctgaacataaattcatacggtttttacctttgtaatgtcccttactttcttttaggaacaaaccagtatataaaataacacttatatgaataaatcagtctagacatgctctccagaaatattcttacctacaagtgtaaaatttaaaagactaccacttttgaaaaataaaaatatttctaagtatcatcaatcatatcatgtttatattaatttgcctttaaatattgttaccacagtgtttgaaaaatcaatttgtagatcttgttataaaatatctgcatttttacaagcaatataaaaaccaaaaaaattttattctaaaataagataggaatatgtatggtcacatgcacttggaattagaaatgataatttaccagatagaggtctttgtctacactgttaatgtaaaaaatcaaacctctagtttcataaaatgtatgttaaaaatatttcacagaaatatatgcttcaataactttaataacattttataacaagatgtattttgtttgtttgtttgaaatggagtctcgctgcgatgcccagactagggtgcggtgatgtgatcttggctcactgcaacctccgcttcccaggttcaagcaattcttgtgcctcagcctcccgagtagctgggactacaggtccccgccaccatgcccagctactttttgtatttttagtagagacggagtttcaccatattggccgggctggtcttgaactcctgacctcaagtgatccacctgccttggcttcccaaagtattgggattacaggcgtgagccactgggcccagcctataacaagatgtatttttgatagtaaactgtattttctatatccccactttttccattggaaataaggatttctcaaaggctggcttgagtcaccacccaaccatcttcagactatctgcagaaacaccacttctcacttcttagtgcataccatgtggtaatctgctacctcggaaaaccagggttttggcttagctatgtttggtggagaatgatggctttctctggaataagggtagcatagtgtaaagcccattattccaatttggaaatatcccattttaggtttcctatatccttctttatcaggtcttctagtcttatccaccaaggggcacagggaacacatgcaaatttttttaccacacttcaccagcatgtgctaccatatctttctgtatagtgatttcattttttttttgtttctttgattacagtcttgacttgaattttatccccaaccagaatatattcactgtgatatgaaggaattgtataattataagcattggtatgagaatattacaaattataaacaatgactctcctattatttactgctttactaagaggaaaaatgtgcattattacccacacttactctacaagacctatttaaattttaatattaaagttgtttttgagaagacactctttaatcaccttcatctagcttggaaatttcacaaaactcaattactgagttaatgtctatggcctggtttataataacacagcttaaatcagccacagatctagaagagaagcagcatggtgtggtagatcaaggctctccccatgaggtaaacatgtcctggattctctaccctcttatttgctgtgagacctgagcgtagcattgaactccataaaatgaaggcatgtgtctacttatcttttattggttagaatataggggatagggcaagataatcttttcagacctcttatagcactaaaaccattggctgttatattagggttaaattaaaagttaaaagttacagaaattacttgactctttgtaggagatctatttatctagaaatgatgtgcctgtctatccccaaaccattaactagatagaaaaagttacctatcctcttaaaaaaaaagtatcccaactactaaaggatattttaattttaatttttgttgttaaatagtagaactctgagaaatgaaataaagaaaagccactgaatgaatattctgtgaatcaggacagcctttataaggggtgacttcataatttttcccttgaaagtatatcagagggacagatgaagatgtattccaagttttccaggtccaggtttgctgtatctgtggactgaggggaaagtaattggattgggttgctgaataaagctcttttggtaggccaaggcatttttccatccactttaagtcttctcttaccaaagaaagtagaatgacagcccattcagacttggaaaagtgctgattgataccctgccattcaacatcctaccaccaacactctgtgggatcagttgggatgaagcaggaaaaaacaaaacaacaaaaacaccttcagccacttcattaaagatgtatctgtttaaaatctctttttgactggttgcttttcttgatgacttcttcagacatctgtttttgtttgtttgtttttttgagacagagtctcgctctgtcacccaggctggagtgcagtggtgcgatctcggttcactgcaaccccagcctcttgggttcaagtgattctcctgcatcagcctccacagtagctgggattacaggcttgcgccaccatgcccggctaaattctgtatttttaatagagacggggtttcgccatgttggcccggctggtcttgaactcttgatctcaggtgatccacctgccttggcctcccaaagtgctgggattacaggcgtgagccaccgcacccggcctaagacatctgcttttatttctcaagttttttcaaaggctaatgagatttttttttcacactctactggagaaataaagtatagatgtatagattatttatatccttgctttgatcatcatttccatgattgtccagtaggcttcatgaactattactgagatcaaaacataacacttcctgttaccacactgaacaaatatctgtctgagtaaatgtgcaggagtttattttcattcacctgcttagaaatgtatagcataggactcccataaccctattcattaaaaactctgattccttactgacaagggttccttggacacagcatatataatagctttgaaataggactcgcatcgcttctttttatgtagttagagatatgtgcctgttgtccttaatgaacttattttctttacttttgtattctccaggtctatccagctgaagtcaaaaatgcccctctcaggctgcccccagtgactccagtttcctagcagagcctaaccaggtcaggtagtaaaagcagttttcttagcaccacctatagacagtctagaagtattattcctgatttgtaattggtatggtcctgccaagctcctggagcatgtaaaccttctgttgcagggtttttgtttctcccctgttacccaccatattaattcagatcatgaatctgctacgctttccttgctgggcttgagatactcctcaagctgcaattcgcttggctgtgactccaactccctatgtggcttgtatcaagcctctctcctgtggatcctggctcctggcaagaagcttgctgtgacaagagttataatcaacatcagatggatttctgatgctttccctacctgactgatggggacccttagttactcagcattgggcttccatatcttttgatttttgggcattggaattcctggctagtcccccagaagctagctgttcaagattggcaggtcttatgttcttcaaagtctcagcttctgctcctttcttattgatacaaattgcgaaggtaccaggatgcctcatgtctcagtctgcctaatttgtaatactatagtgcttatccatatatacacatataaatgcatttgtttttattactgtaagacaaaatacactaaagaataaggcattgtatctccaattctttcattagaatcctcagatcatgatgtacaagaaatatctttaaagccctgaagccactgcttgtttgatccttgagagccataactactatctataacttgttcatgcacttctgcatctatgactcacctaaatgaaatttcataaacctacctgaggtctaatagaatgcactgctcttaattccttgcttaatttcattacttgatggtttctggactacccagaacttcagaaggcattcctttccctaacaatctaatttacatctaaagttgcattaaatttagtctttgactaagttgagccaaaaacatgatgctgatatctaaataacatgattttactttatagactctgatagttgagagatatcaaagttgtcactctggtacgaaagttttattctccacagcacaacctgaatagttctgaatttctttctatcaactaaacacatttttctatcaacacatgttttaattcccctttgcctcctggaaaccttttccttcctggcatatttccatgatcattttttaaatgctattcagaaaccttcattttctctaatacaagaaaccatggtgaagcgttcattgctcagactttctttaccttgggcttttgtaatggagagtagattcttctttggaatgtgaagtttatattaatagtaatctcaggcaaaagcataattatggcacatgcaaggctccagaacagtctcattgatgtccctgcttcctgggcttacagtgaactccagacagacttctgtggttccaccaatgaactgctgggcaacttttgtcttagtcactaagaattactgtcaataatgttttaaattctttctgacttttgtcttcctctcaagctactaacttccactaatctgacacgtgtgagtaaacttcactttgcaagtatctgttcctgtttaccttgtggacgttagacagcctattgaatacggttcacaagtgttgtcccagggatttttagtcagttaccatcatcgggggattccctttatcactcctttaaatttaatcctctgtttgcttgacactagtcttcctctttctttatttacttctttttgatgaagactttgcctttgtcaggcaactaatggagaagttcagtcagagttcaaccagagaaacagaactaataggcaatatacactaaggatttttttttttttttttgagtcagggtctcactctgtcacccaggctgcagttgtgggagctggttagacaagtccaaaatgtatcaagctgaagctgataggtagaatttcttcttccaggaaaccattctgctgtaaagcttttcaactgattgaattagggccactcagatgatataggattatctcttttacttaaagtcaactgactgtagatgtctattttatctattctttctttcttgaaatctgaaagattgtctcctgtctgtaagaaagcttgagatctggaatattgtcttagcaggctgtaagcttggtgaaccacccttatttattgatagaatttacctcaggtgacctagatatagtctctcttcttcttggatagtacaaatttttataaatctttagttttgataccaccttttctagcttcggtttgaattactgggcttctataaacacatcccatcctttctacagatggatttgattgattgttatattttttatttacatttgattatttgactggattttgatctcctcaggaaaaagaaaatgtctcctcaggaaaaagaaaatatctcttgaatatgaaacttctacagttggtgactttcaacttctgtattttaattctcagtggtttcattctcatattttggcctttttatgatctggcctaagcttctgagagtttataattgtagccatccagataacataagctacatgtaaatttgaacttctagtatggagattctaagaatctggacattctgttctttaatcactggaaagcaacttaaaagtttagcatccaatttcctgctactatgacaaattccacactaaacatcatgggaaaaatacattccagcttcatccacattagcaatgaatttcaattcataaccttacacagttgtctttagaagtactagcattcccttcccacgttcttatctatagctacagcctccaacccatttcctgagacatatggttctgtatttcttggaaggttcgcagcaattcattactacattcaaaatcccctgagtccagctacaatgcagggtaattactccaacgtggagaagagtcaaactgcatgtgaacgtgcttctccaataattataacccatatcttcaaaagagtgacaagcatttttgcttagcttttagaatcataaggtggaagctcagttaagtactttgcataatgctattttggacagtaatcattgggagtacataggctttattcagtattgaaccattggtaagcatttaaaaatatttgtacacacacacacacacacacacacacacacacacacacaaacaggacttgacaatatcactgcccctgctcagtagtagctttgtcaacaaacaagtagagtcactgaagtgaaatattcactgtcaattagcagctgggtcaatgttactaattgtcaaactattttttttgctataaaacacatttacacacaatcttgtgtagaaacccactatataaaacagacaagggccaggtgcagtgtctcttgcccataatcccagcactttgggaggctgaggcaggaggattgcttgaaactagatgtttgagactagcctgggcaacatagggagaccccacgtctaaaatcatacaaaaattagctgagtgtggtggcacatgcctgtagtcccagctactcaggaggctgaggcaggacgattacttgatcccaggaggtcgaggctgcagtgagctgtgatggagccactgcactccagtctagatgacagagtgagaccctgtctcaataaataaataaaaagaaaaaggattaggacagagttgctcagcttgaaggatatgggatgcgcagactgacatgagtttagctgcctcctcatatcacagtggtcagtgaagtacatctagagaatcccagagctctgcagagtatactaggaaaccacaaatttatgttatttacaagaacattttggttattcacttagcacaatggctattttcgccatataaaattgtcaaaagacaaaattacaacaaatttagttatagatagaattggtttttatctgtggctcatgaattggggcagcttctattcttcaagatagagtaaagctcccactgggcaatggcagaacagtgggttttgtaaaggggggacaaggaaaagagcaatgtaaaaataactgaggctgggcacggtggttcacacctgtaatcctaacactttgggaggctgaggtgggcggatcaggaggccaggagttcgagagcagcctggccaacatggtgaaatcccatctctactaataatacaaaaattagccaggtgtggtggtgtgcgcgtatagtcccagctactcaggaggctgaggcaagagaatcgcttgaacctgggaggcggaggttgcagtgagccaagatcacaccactgcactccagcctgggtgacagtgcaagactccatctgaaaaataaaaaaaaattagaataaaataaaataaaataaaataaataaaataaaaatctgagtggggctgggcccagtggctcatgcctataatttcagcactttgggaggatgaggcaagagaattgcttgatgtccagagtttgagagcagcctgggtaacaaagtgagacctcatctctacaaaaaacaaaataaaaaattggctgggcgtggtagtgtgtgcctgtagttagtcccagctactcaggagggtgaggggagaggatctcttgaacctagtatttctatgctgcaatgacccattattgcacctctgcaccccagcttgggtgacagagtgagaccccacataaaaaaaagaataaaaataactgattatttaatatcaggttacttttttgtgcaggttcaaagagagaggacttccttattactctgactcaggtagactggagtctcctattttcaggaaaagttggtccatttgggatctatttgatttcttaaagctttagtttgattatgtgccatttagcatgagtgaccctgttttggtttggtccaatttgttagggactagtgcaggaattccatcctaaaacaatggcctcctgtaatttttgtttcacaaaacatagccagtaagtaccagttagtggctagtttttgaggaatttattgtgcatagcattaaaataagcatcgaggggaagaaattgctatgaaaaaataaaatcttggagcctggagacaatctgaaatgaaaacaaaagaaggagtctattgtgaaaaaaaacctaaaacataaatgaatgtaatcacaggaagacgttaaactgcactaaatagagcacaactgatcttgtttgatctgggaaactaagtagagctgatcttgttatgttgacagcaaatgcctagggttaccatgagctatctagataccagatagtttcagggcaaagatgttctcgggtttagcaggaatctattcaatataatgcttcactcaccagcactttggcatagttgttttgcttttgtgagcatcaataaaacagacaaaccatgatcctaaaatacttgatgagtcaccaggagaagattatactacattcagcacaagtacccatatattattataatatgatttaatataatatgatgtaatagaatatcatgtattattattgttcgaaacctgttgaaaatgttatatggtatgtcaaaagcatatctttccagaagccagaatattgtagagctgggatattgcattccctgactgtatcatataagagaagtttctctgtataagtactaaagagtagctaaagtcattgaagagaccagaatcaaggacatgaaacaaaaaggttttgagaactttaaatgtagtaagaagatttggcagagaaacttagaagagggcatttctgttaaagaatctcctcatacttacgtagcttaaattcactttgcttgtttttcaattggtgtatttataaggcacttgtcttccaaaagtagatttgtatttcgatgataatggcaatagtgctttctttgtagaacctatctgtgtgatcttggccaaatcagactgggtgaaacatagagcacacatttgcttcttctgaatggtgcttcatctcagtggctgagccacgtggatggcattcagaaataacagttgtgcttccacacagcggtgagccaatccccagtgattctaaaggctgaatgttctggttctgcaaccaaatgaatacaattatagatacttagccgaccctgactaggtttcattctttcattaattaacacatgtattataggcacttatttgggcactgcagagctgctgtagattatctaaagtttaattcaatatggctttcccccttagaatcttgttatgattattcttatatcttcccttctgcccatctctgaaaatttctcacttcccctcttggaacaccatactatgattaaattcacttccagggactggccatggcttagaaaaatgattctcttacttgccaggatccctgtacagacgctgccgagtcaaatttagtgccaaagggaatgtgtgctttatttgatcagcgctgatttctgagctgggccctggaaaaagaaaacatggattttgtcagtatctgtggacccagaaaaaggtatccttattgcaatctgtcctgattacagctgtgctggtaccaagtgtggcactcagaatatccagtatgctctcatgtcaaccaaacttaatttctgtatgcagcaaatgctagggcctgttaaatggatgaaatgtacagcttgtaaaatatctgcttcttaagttggaagtgactttgtctttgataactttacctctccaaagaaaatcttctaccacccactcaaaatgtcaggttcctcctggtctccataatgatccataaatatctaccctgaactcatgatgatgattggattcaacattataattgcatatgcctgacttttccactctgtcaacagcctcttttctggagtatctcccagtgatcatgtcatatcctgttaggtaaattgtgaacctgtaggattgtatctcctagttttatgagtgaagatcacatttaattctctgtcattttcagaacataacacatcgttagtgctttaaaaggatgaaacatgcagggcatttgtaaactttaaaagtacttttttatctgttattttatgcaatccctacaattatcctttgagggctggcaaatcccggtttgacaaatgagaaaactgaggcataaaggctaagtgacttctctgaagtcacacagtgacagaaccagatttaggatccagttcccttgactcctagactcagacttttttttttgttaaatattgtctagtcatattactactctctgaaagctattcccaccagaagtctcattttaattagatatttcatacctttaaactctgtagtgtggctagcatttacaaaatcatgctgagtagaggcagtgaacaaggcttgggttgcccaaagcagaaaaaagatataaagatgaaaccaccagacagattttatttatgactattttagagagggtagtgcaacctctgattctccttaacaccaagttctgttgaaactcagtctttatcacaggaaccactgggtgcctttctcatggccacagcagcttggcttacaaccgtcttcaaacagccaggctgtgccccagaacttcactgggcttccttccataactatggatctgtgagcatcactttaatttcagagtgtggaagacaccttaataagaatcatgaatcacattttacaaatcaggatacacaggatgtaaggttaagtgacctgtcctatcagggccacaaagccagttaaacttctttattaactgagtcacttaaaaatcatttatttaaaaacctattttgttccaggaactattctgggtactggaaataaaacagtggagacagagagaggggaaataaaaaacaagacaaaaatgattgctttggtggagtttatatattccactggaagaaggtagataataaataaaagtgaaaaagtacattataaggtgggaggaaggcttgagcctaggaggttgaggttgcagtgggccgagattgtgccactgcactctagactgggcaacagggcaagacgttgtctcaaaaaaaaaaaaaaaaaaagaaaagtaaattatagagtatcttaaaaggtgacattacatgaaagaaaaacaaagcagaaaaaagggtaagtagttctgggcactaagtacattttaaacagggtagtcggggttattgactgagaaagtgatattttttggcaataacttaaaatggcaaagaagtaagcaatgagaatatctgaggaaagcctgtgcaaagcccctaaggcaggaacatgatgacatcattgggagaccagagctaggagtactggggcagcatgagccagatgcataatagtttgatatgaaatcttagaggtcatgaagagccagatttatgtagggtcttgtaggccatagtaaagattttggtttttaacctgagtgagtgagatgaggaaacactgaagaattttgagtaatggaatgatatctttgagcttagttttaaatggattattctgggttttgtggtaaagaatggattagagcgaggacagcatagaactagggaaaccagttagagatctatcacaatagatttagtcaagagaagatggtggctcagatcaagtggtagaggttgaaatggtgagaagaagtcagattctagatgtattttgaagaaggagccaagaagatgtgttgaaaaatcaaatttggggtgaaaaaagaaaaggagaaattaaagatgacttgaagtttatagcctgagcaattgaaaagatatatttgcagttaactaagatggcatagccttcaaaaggaccaggtttggaaagtgatgaaccattcagttttagaaatatttagtttgagatgtgtattggatatccaagcagtaatgtcaaataagcaattgggtatgaatttagagttcaggtaagagaattgaactagagaatttagctgttagcagagtatagatgatattgaaagccatgagaataccagaggattgaatgtagatagagaaaagaagagccatctaaggattaaaccctgagatacatttggtatgttagtctagaactcaatcataggttcttaacaaactgcgctctggagtattggtttaaggcttatagaattggattaaccctactttgtgctactaaagacaaaatttcataaaagcctctcaagaatccaaagtttattataaaccaagctttccttaaatgtcaagtatgttgaagtattgttcatattcatggagtaaaatgacagcaacatttcatagggttgcccccacccccaaccttttggatctggtgctagtttattcttcattgtttctgtgtactttctccatgaagactgcaaccccttgaacaattagcccccaacagactgagtaagtactagccaaacactggattcctatagctatgttaatgtattgctttggggactatggagctttcagataacgatgctctttttttcttgtagagtgagagcatttttctaggagttagttttaagatggtcgaatccatattagctttgtatccctatcctctaggcactagttcaaggatttaagtgtatgcaagaatcagaatatgcttatttaaaatgcagattctctggtctttttaaagtataatttttaaaaatttctttattattattattattaaactttaagttttagggtacatgtgcacactgtgcaggttagttacatatgtatacatgtgccatgctggtgtgctgcacccattaactcgtcttttagcattaggtatatctcctaatgctatccctcccccctccccccaccccacaacagtccccagagtgtgatgttccccttcctgtgttcatgtgttctcattgttcaattcccacctatgagtgagaacatgcggtgtttggttttttgttcttgcgatagtttactgagaatgatgatttccagtttcatccatgtccctacaaaggacatgaactcaccattttttatggctgcatagtattccatggtgtatatgtgccacattttcttaatccagtctatcattgttggacatttggattgattcccagtctttgctattgtgaatagtgccgcaataaacatacgtgtgcatgtgtctttatagcagcatgatttatagtcctttgggtatatacccagtaatgggatggctgggtcaaatggtatttctagttcaagatccctgaggaatcgccgcactgacttccacaagggttgaactagtttacagtcccactaacagtgtaaaagtgttcctatttctccacatcctctccagcacctgttgtttcctgacttaatgattgccattctaactggtgtgaggtggtatctcattgtggttttgatttgcatttctctgatggccagtgatgatgagcattttttcatgtgttttttggctgcatagatgtcttcttttgagaagtatctgttcatgtcctttgcccactttttgatggtgttgtttgtttttttcttgtaaatttgtttgagttcattgtagattctggatattagccctttgtcagatgagtaggttgctaaaattttctcccattttgtaggttgcctgttcactctgatagtagtttcttttgctgtgcagaagctctttagtttaattagatcccatttgtcaattttgtcttttgttgccattgcttttggtgttttagacatgaagtccttcctaagccaagagaacaaagctggcggcatcacgctacctgacttcaaactatactacaaggctacagtaaccaaaacagcatggtactggtaccaaaacagagatatagatcaatggaacagaacagagccctcagaaataacgccacgtatctacaactatctgatctttgacaaacctgagaaaaacaagcaacggggaaagggttccctatttaataaatagtggtgggaaaactggctagccatatgtagaaagctgaaactggatcccttccttacaccttatacaaaaattaattcaacatggattaaagacttaaacgttagacctaaaaccataaaaaccctagaagaaaacctaggcattaccattcaggacataggcatgggcaaggacttcatgtctaaaaatttctgtttctattttttttattgatatgtagtagttgtagattctctggtcttatctttagagattccgatactttaggtctgtagtggagcctatgaattggtacaacaagtgattctgatgctgattcagaatcagaagaggcaacttactgttgacagtggacaagtgattctgttaggccatttctttgatataggaagataaatttctagggttgctgggaagattatggacagattatgatcttgaaagaagtcctaaaggtggactgtattaaataaagtgtatattctaggaaagaggatgtaaatccatataggggagatttctttttctaataatcagctttatcaatggaaagatacttgtgaatgtgtttcatctttgaagaataaaagaaaatatcaatttgagatgtcatagagaaggttcctctgtgggaaataaggttttactagttgacttctaaagctgccgtaaattatttttcagaacaagacaaagaatgtataaagaagtagcctcttgggtttctaccagctcacagattctttgggtgtttttaaggcattcaaaagagaaaggactagctcatatttttatcacagtttttgcctacttccttcaacatgggggcatcctggtagagaaaaacaatttaaaactgtttccagatattttggtaaaagtttccactctactatgggtaagtagtgaattagaattagcatgactaggattgctactatctttggataagacttataaaccacatgaatgataagaaagaaactgttatatgaagagtttgccctggatgatttctaagaactctttacttctaggttctctaagttctaaaaccctataggttcacctgagttcttatccacccttatgaaaaactgctagagaactcacagaatttcatctctctacctcattccctgaacaaagtcagggaatgaggtagagagatgactccaataaccccagctccttattccatcttttaaatgattttttataaatttcagtaggtttttggggaacaggtggtgtttggttacatggataagttctttagtggtgatttctgagattttggtgcacccatcacccaagcagtatacaccgtatccaatgtatagtcttttatccctcactcccctcccacccttccccctgaatctgcaaagtccattgcatcatttttatgtctttgcatccttagagcttagctccgtctcatgagtgagaacatacaatgcatcgttttccattcctgggttacttcacttagaataatggtctccaaatccatccaggttccttcgaattacattatttcattcttttttatgactgagtagtatttcatagtatatgtatatatatatattgcattttctttatccactcgttgatcgatgagcatttgggctggttccatatttttgcaattgcgaattatgttgctataaacatgcatgtgcaagtgtcttttttatattatgacttttcctctgggtagatatccagtagcaggattcctggagcaaatggcaaatctacttttagttctttaaggaatctccatatttttttccataccagcagggtaaaagtgttcccttttcaccacagccatgccaacatctattatttttggattttttaattatgaccattcttgcagaagtaaggtggtattgcactgtggttttgatttgcatttccctgataattagtgatactgagcattttaaaaatatgtttgttggccatgtgtatatcttcttttgataattgtctatttatgtccttagccaactttttgatgtgattatttgtatttggttggatttttttttttttgtcttgtgatttgtttgattgccttgtagattctggatattattcctttgttgaatgcttcgtttgtgaagattttctcccactctgagggttctgtttactctgctgattatttcttttgcggtatagaagctttttagtttaattaagttccacctttttatttttgtttttgttgcatttgctttagggttcttggtcatgaagtctttgcctaagccaatgtttagaagggtttttctgatgttaccttctagaatgtttacagtttcaggtctcagatttaaatctttgatccatattgaattgatgtttgtataaggtgagagattaggatctagtttcattctcctacatgtgtcttgccaattatcccagcaccaattgttaaatagggtgtactttctccactttatgtttttgtttgctttgttgaagatcagctggctgtaagtatttggctttatttctgggttctctattctgttccattagtctacatgcttatttttataccagaaccatgcagttttggtgattatagccttgtagtatagtttgaagccaggtaatgtgatgcctccagatttgtttttttgctgcttagtctggctttggctatgcaggctttttttttgttttagttccatatgaattttagggttgttttttctagttgtgtgaagaattataatgatattttgatgggaattgcattaaatttttagattgcttttggcagcatggtcattttgacattattggttctgcccatccatgagtatgggatgtgtttttatttgtttgtgtcatctatgatttctttcagcagtgttttgtagtttttgttgtagaggtctttcaactccttggttaggtattgtgtaaggccatgggagcccacctcttccatcagcatgacctagatgtgagacatagaggcaaaggagaacatttcagagctttaagatttgattgccctgctggatttcagactcgcatggggcctggagccccttcattttggccaatttcgctcatttggaacagctatatttacccaatgcctttacccccattgtatctaggaagtaactaacttgcttttgatattataggctcataggtggaagagacttgccttgtctcagatgagactttggacttggacttttgggttagtgctggaatgaagcttctgaacagcaaaagaaaccgtcatcagagtgaataggcaaactacagaatggggggaaaattttgcaatctatccatctgacaaagggctaatatccagaatctacaagaaacttaaacaaatatacaagaaaaaaacaaacaaccccatgaaaaagtgggcaaaggatataaacagacacttctcaaaagaagacatttttgggaggacaaggtgggtggatcaccggaggtgaggagtttgagacaagcctggccaatatggagaaaccccgtctttactaaaaatacaaaaatttgctgggcgtgctggtgggcacttgtaatcccagctacttggaaggctgaggcaggagaattgcttgaaccccagaggcggaggttgcagtgggccaagattgtgccactgcactccagcttgggtgacaagagcaaaactctgtctcaaaaaaaaaaaaaaaaaaaccataatcccaggactttgggaggccgaggcgggcagatcatgaggtcaggagattgagaacatcctggctaacacggtgaaaccctgtctctactaaaaatacaaaaaattagccaggtgtggtggcaggtgcctgtggtcccagctacttgcgaggctgaggcaggagaatggcgtgaacccgggaggcagagcttgcagtgagctgagatcgtgccactgcaccccagcctgggcgacagagtgagaatccatctcaaaaaaaaaaaaaaaagaaacagaagacatttatgtgaccaacaaacatatgaaaaaaagctcatcatcactggtcattagatcaatgcaaatcaaaaccacaatgagataccatctcacgccagttagaatggcgaacattaaaaagtcgggaaataacagatgctggagaggatgtggagaaacaggaacgcttttacactgttgctgggacggtaaactagttcaaccattgtggaagacagtgtggcacttcctcaaggatctagaaccagtaataccgtttgacccagcaatgccattactgggtatatactcaaaggattataaatcattctgctataaagacgcatgcatacatatgtttactgcagcactgttcacaaaagcaaagacatggaaccaacccaaatgcccatcaatgatagactggattaagaaaatgtggcacatatacaccatagagtagtatgcagccatagaaaggatgagttaatgtcctttgcagggatatggatgaagctgaaaaccatcattctcagcaagcttacacaggaacagaaaaccaaacaccgcatgttctcactcgtaagtgggagttgaacaatgagaacacatggacacagggaggggaacatcacacaccggggcctgatgaggaatgggagttaggggagggatagcatcagaagaaatacctaatgtagatgacgggttgatgggtgcagcaaaccaccatggcatgtgtagacctatgtaacaaacgtgcacgttctgcacaggtatcccagaacttaaagtattaaaaaaaaaaaaagactttgggggactattgggaaggcatgatttgttttgaaatgtaaaagagacatgaggtttgggaggggcccggggcagaatgatatggttaggttttgtgcccccacccaaatctcatcttgaattgtaatccccataatccccacgtgtcaagggagagaccaggtggagataatttaatcatggggtcagttccccaatgctgacctcatgatagtgagttcttatgagatgtgatggttttatataggcctcttccctcttcactgggcacttctccttcctgccaccttgtgatgaaggtgctttgcttccccatcaccttctgccatgattgtaagtttcctgaggtctccccagtcatgccgaactgtgagtcaattaaatctttttcctgtataaattacccagtcttgggcagttctttacaacagtatgaaaatggac

SEQ ID NO: 3635 - DNA, 1175 bp, Homo sapiens
tgtttatctaaatgctattttatccaggttcaagctcttgtaataggatttatactacttgtaaggagaattctatatttgagaattgtccttttgaaaaggtgaattttatcacatactaaccttttgctgccctgcacattttctgagatacttgaaaacatattttgacatttacatgttttgccagtacccattatgttcctgctttattaaagccattttattcacctgacagattaagattagaatattttaaaagttgaattttgaaagcaaaagtttgttctactgcagtagttcgcaagtgctggtctttgtatgactgcatctgagtcacttaagaaggctttttaaactctagattcctgggctgtaatccttggagattctcatgacttaccatttttggcatccattctttagaaatagttccagcaatcctattctgcccgttttcatttaatacacacactttgtttcttcatctttattttgtggcagatgggtttgactttgccagctgtgactgattagtggttctctgtagcactgtattgagactcttagtgaagccatatttgagctggactggaaggagggaagcattttgccacgagtttctcccaaggcgtgactgaatggattggtccttgtatcatttgcagtgcttatttgccagctttaattagctattctcctgttagacgttttattaacttctacttttttacttaccacagagcaaatgttccacagcatcaagcgtggctttttctgatttataatcatttactcagattatcgtttttaaagtgattcaagagcattaatatttttatagtttttgacatgtgtagccaaaatgttttccaagaggaaaaatgtaaaagggctagattaaaacaattcaaaatgagtaatagtgttaattgaggaccaccaccaaggaagggaaatactggtttccccatgcccttgatacaggtgggtgttaattctctttaatgttcactgaataaaaaggagagagtatatttattttagcttgaatttttttaaatattaacagggctattctgtttctattattataggttctttcactcatttatctggtcttactgatctgtacatattcgttataataaagatactaattcatctttgtcata

SEQ ID NO: 3636 - DNA, 10980 bp, Homo sapiens
gcacggcacccacctcggggcagcggcttcacctccccgttctcctcccgggaggccccgccggcctctcgggccccaccgagaccgtgcctcctcctctccttctcccgcttctccttaggtctgcgcgacttggcgttagccgaggcagcggcggcggcggcgggcaggaggagatgcaagctggatttcgggaatgctcagttcagaagagaaaaaattgccgggaatcaagtccttctttttgttagtcggtagtcgattgatgggaagtgttcaaaatcattcgatgtggtgacaaggcttcaccaggtactgccttctaacgagctggccatttccacatgtcagataggaccaacttgccttttaactacccgtgtgatacttaaacactgttgccggtatcacagcttttcttcaaaacaggaagcaacgagaatgagggcattccagtagcaggagacagcatgcatagagatgctgatgaagaaagagcctagcgcacgtgggaaactgcaaaagttcagactggttggaatgctggaaatgttgtgaatgacaggagatgaggctggcgagaaaacagaggtcagattgtggaaggctgtcaagccaaagactttgattttattcttgagattgatgagatgtgtgtaatccaggagtgtgcaaaacaatctgtaagggttcagaaaacatactgcttctatatatagttacctttgtcttaacttgaaaatttcaaattgtgtaggagttacaatgtgtgtaattgttattatagtactggatccaaataatttataaataaataaatatagacataatatggtgtattacaggttaaattgtgtacctcaaaaattcatgtttaagttctaaccctcattatctcaaactgtgaccttatttggaaatactatcattgcagatgcaatagttaatgaggtcaagttaagaagcaataggaggccaggcatggtggctcacacctgtaatcgcagcactctggggaggccaaggtgggtggatcacctgaagtcaggagatcaagagcaacctgggcaacatggtgaaactccgtctctactaaaaatacacaaattaggctgggcttgatgtctcacacctgtaatcccagcactttgggaggccaaggcgggcggatcacctgaggtcaggagttcgagaccagcctggccaacatagtgaaaccccatctctactaaaaatacaaaaattattttgtattttggtggcggacacctgtaagtaatcccagctactcgggagggtgaggcaggagaatcgcttaaacctgggaggtggagtttgcagtgaaccaagatcacaccactgcactccagcttaggagacagggctagactctgtctcaaacaaacaagcaaacaaacaaaagaaagaagaaaagaaggagcgaaaaggtgggcccccaatccctaatccagtatgactaatgtccttccaagaacagaaaatttgaacagagacacacaaacgggaagaatacctatgccttttgaaggtaaaggcggacattggggtaatgcttttacaagccaaggaactccgaaggtagccagcaaactgtcagaagctaggcgagggtcctgggacagattctcctcacagccctcagaaggaatcagtcccgctgacaccttgatcttggacttgtagcctcaggaactgtgaggcaaatgtctgttgtttaaactatccagtttgtgatactttgttacagcagccctagcaaattgagctacttggtcaaaaacttcaggcaacactgatgagatgatgtaaaggctttaaagagttggtttatgtttaagagtccaaattatcaacgtcctatctttactcagtctctgtattcaagaattgaccttaggccaggtgcagtagttcacgcctgtaatcccaatactttgggatgccaaggtaggaggattgcttgaggtcaggagtttgagatcagcccttgtatattagttcgttctcatgctgctgataaagacatacccaagactgggtaatttataaggaaaaagaggtttaatggactcacggttccatgtggctggagaggcctcaatcatggcggaaggtgaaaggcatgtcttaggtggcggcagacaaaagagaaatgagagccaagtgagaagggaaaccccttataaaatcatcagatctcgtgagacttattcactaccatgagaacagtatggggaaagcgtccccatgattcagttcccaccgggtccctcccaccacatgtgggagttctgggagctacaattgaagatgagatttgagtggggacaaagccaaaccatatcaccttttctctactaaaaattaaaattaattaaaaaattaagctggcatggtactatatgtctgtagtcctagctacttgggatgccgaggtgggaggattgcttgagcccacgaggttgaggctgcagtgagtcatgatcatgccactgcactccagcctggacaacagagcaaggccctgatgcaaaaaacaaaaaataataatttaacttaaagtgatgtcttgattgcagtgtttattctactttttaaagccattgtggtgggaaaacaatttgtttacatttgtagtacagtttatgttaaaggttgaagaaattgggaaatattttatctttaactcaagacaggatggtgatatgcaacagttataggcaaaaaatatttacatttaagaaaaaaagtatcatttaatcccattaggcagaagtggagtcaaaagcaaaaatatggctggttatggatgtatgtttcccttcctgttcatatgttgaaacctaattcccaatgtgatgggttttggagatggggtctttgggaggtaataggtcatgagagtggaaccctcgtggatgggattagtgccatataagaagagtccatagagctagctcactccctttctgccatgtgaggatacaagaagtcggcctggaaaagagccctcaccagaaccctacaatggcactctgatcttggacattcggcctccggagctgtgagaaataaattgtctttaagctatccagtttatggtactttattacaccagcccaaactgactgaagatggggtcctaccaagcgaaatcatagctgtgaacagtgtaatagtatctcatcagcatggggagggctataggcaaaacatgcactagtctagctacttaatcttcaagtattaaggacaacctgtcctttttatacaagtcatacattagacatgtgcctgagattacaaaacactgtgatcgagttttcaaggctagggatacacctcaaactcagatgtacttctttggtgcctatttgtaagtcagcaaaatccagaactcagcaatatgttaattaatgtattaatacagaaaatatttttgtgcattatattttctgcattttagatatttgtgtgccatggaatatttgatgatttttggctttatttaggttaagtcaaccaaagcattttgaaatgctgctttttttttaacacatgtatttgtgggtttttgttttgttattgttgttgtttgagacagggtcttaactctgtcatgcaggctgaagtgcagtgtcacaatcacggctcaccgcagcctcaacctcccgggctcgggtgatcctcccacgtcagcctccttagcagctgggattacaggtgcccaccaccacgcccgtctcctttttgtatttttagtagagacggagtctcaccatgttgcccaggctggtctcaaactcctgggctcaagtgatctgccctcctcaacttcccaaagtgctaggattacaggtgtgagccaccacacctggcctaaatccacatgtatttgtaatagttttgccattgtttagacaggtagttttaagattttttaaagtaatagaagcctttcttcaaattaaatcttatgtggaagtccagtatgcagcaattatgttaggtagtcatagaggactggccattcgtaaaaaaaaatatacccttgttttaaatctttgtttcttgaatttagtcttgaagttccatgttttatgactatgtattccatgtttattttatagtgtgttagcaaaatgaaaggaatgtacatggatggggatgataaagatgctactgacctattattatagggcctgtgcttggagttgcttttcagtaatgggattggatttgtaagaatctgtccatcaggctgggtgcagtggctgacgccagtaatcccagcactttgggaggccgaggctcaagtagctcaatttgctcaaaaaaaaaaaaaaaaaaaaagaatccatctatcgtctggccgggcacgatggctcacgcctgtaatcccagcactttgggagactgaggcgggcggatcacgaggtcaagagatcgagaccatcctggccaacatggtcaaaccccgtgtctactaaaaatacaaaaattagatgggcgtggtggtgggcgcctgtaatccatcccagctactcaggaggctgaggcaggagaatcacttgaacccgggaggcggaccactgcactccagcagagtgagactccctcccaaaaaaaaagaatccatctatcctctttaatttagtcccctttgtggccacacagcagtctgtgtcctacaccctcttggtcaagaatataatgtctactactcacaaaaatatatttctcagtaagtgactccccttcctctcatcattgttcttttagcaatttttgtgcactattcatttaactataactttgccacctttggactctaatagactcaaaaacctgtttgtccagtttagtgtatgtttgttttattccctcacccatgacttccagtcatattactgtaagctgatatttggaactacatatatcttttgtatgtttatttttttaattttttttgcaagtttcaggatctatattttgttgtttgtttgtttgtttgtttgtttttgagacagagtctcattctgtcacccaggttggagtgcagtgacacgatctcagctcactgcaacctccgcctcctaggttcaagcgattctcctgcctcagtctcccgagtagctgggattacaggcacccgccaccacacctggctaatttttgtatttttagcggagatagggtttcacatgttggccacactagtcccaaactcctgacttcaggtgatctacctgccttggcctcccaaagcgctgggattacaggcgtgagccaccgcgcccagcctgtatatgtttaaattgtcataaaaactaacaccctttgggaggccgaggcaggcagatcatgaggtcaggagatcgagaccatcctggctaacacagtgaaaccccatctctactaaaaatatttttttaaaaattagccaggcttggtggcgggcgcctgtagtcccaacccaggaggctgaggcaggagaatggcatgaacccaggaggcagagctggcagtgagccaatatcacgccactgcactccagcctggacgacagagagagactccatctcaaaaaaaaaaaaaaaaaaagaaaaaagaaaaccaacaccatgtggggatgttgggaatagcagttgaatgtttcagaattaggttttttgtatttgtggtattctcagatggcccatttttccaagatcacgttatgtcatgtggctagtttgacagcccataagccatagttcagggacatttttacctttttctaaagggtatatataaaaagatataaagaacaaactattcagatagtttggtatcagtgaatcatttcaataaaaatatactctgagtcttccttctttcagcaaatgtttactgagctcctactatatgctagcagtcattatgctaagttttaagtatacagcagcaaactaactgaacataatccaggcctcacgggatagagaaattacaccaaaaaattatatgcataatacattcatacatgtataaaatcttcataccaattacaaaggaaatcaacagggctctacagagagttaaagaagctactctaaaaagaacagaaaaggaatgagaagtgaaaggaattccagcattctagctgggtgccgtggcatgcacctgtagccccagctactcaggaggctgaggcaggaggaccccacgatcccaggagttcaagtctagcctaggcaacatagcgagactctcatctcaaaaaaaaaagaaaaagaaaaaaactgtgttataggctgggcacagtggttcgcgcctgtaatcccagcactttgggaggctgaggcgggtggatcacgaggtcaggatttcaggaccagcctggccaagatggtgaaaccccatctctactaaaaatacagaaaaataggccgggcacagtggctcacccctgtaatcccagcactttgggaggccaaggcgggcggatcacgaggtcaagagattgaaaacatcctggtcaacatggcaaaaccctgtctctactaaaaatacaaaaattagctgggcatggtggcacacacctgtagtcccagctactcaggaggctgaggcaggagaatcaccaggaggtggaggttgtagtgagccgagattgtgccactgcactccagcccgggcgacagagtgagactttgtcttaaaaaaaaaaaaaatgagtaggatttgggggaggaatggcagagaaatgacctggttatctattgccaaagcaaaagcaaagcaaggaaaaattgttttaaaaatactttaaagaacaagtggaggccaggtgtagtggcccatgcctataatcccagaactttgagaggcggagtcgggtggatcacctgagttcaggagttcgagaccagcctgaccaacatgaccaacatggtgaatccctgtctgtactaaaaatacaaaaattagctgagcatggtggctaacacctgtagtcccagctgctcgggaggctgaggcacaagaattgctcgaactcaagaggcagaggtttcagtgagcctagatcatgccactgcacttcaccctgggcaacagagtgagactcggtctaaaaaaaaaaaaagaaagtggaatttgaaagtaaaagcataataccatttatattagcatgcccccaaaaattaaatacttaggtataaatctaataaatgtgtacaagatctgtaagaggaaaactttgaaaacctgatgaaagaaatcaaagaacaattaaacaaatattgaggtatttcatgtttttgtttaggaaaactcgatattgtcatgatgttcttcccaacttcatctatagattcaatgcagtccttttcaaaatgtcaggagatcattctgtagatataaacaaaccgattctaaagtttatatgggccaggcgaagtggctcacacctatagtcccagcactttgggaggccaaggcgggcatatcacctgtcaggagtttgagaccagcctggccaacatgacatggtaaacccctgtctctactaaaaatacaaagatcagctgggtatggttgtgggcgcctgtaatcccagctactcaggaggctgaggcaggagaatcccttgagcccaggagggagaggttgaagtgagccgagatcgtgccactgcactccagcctgggtgatggagcaagattctgtctcaccaaaaaataataataaagtatatatggaggagggaaaagaccaagaatgagcaacgcaatattgaaggagaataacaaagttagaggatggcactacccaacttcaagacttactggccaggcgtggtggctcacacctataatcccagcactttgggaggctgaggcgggtggattacctgaggtcaggagttcgagaccagcctgaccaacatggtgaaaccccgtctctactacaaatacaaaaattagccaggcatggtggtgggcgcctgtaatcccagctattcctcaggaggctgaggcatgaaaattgcttgaacctgggtggtggaggttgcagtgagccgagatctcgccattgaactctagcctgggcaacagagtgagactccatctcaaaaaaaaaaaaaaaaagactactgtaaagctacagtaagtggatgcctgtaatcccagctgctctgcaggctgaggcagagaattgcttgaacccggtaggcggaggttgcagtgagctgagatcgcaccactgcactccagcctggacaacagagtgagtctctgtctcaaaaaaaaaaaattgtcacatgtctaaatataaaatgcaatgcaaaagcatgaaaacacctaaaagataagacagaattaaatccagatgacctatggcttcgcggtgactttttaggtacaacaccaaaggcatggtacatgaaagaaagaaccaataagttggacttccttaaaattgaaaatttgtgctctgcaaaagacactgtcaagtggataaaaagagaagccacagattgggagaaaatatttgtaagacatatccgatacaagactattatctaaaatagacaaaaaattctttgagagggagtctcgctctgtcccccaggctggagagcagtggcgcgatctcgcctcactgcaagctctgcatcccaggttcatgtcattctcctgcctcagccttccgagtagctgggactacaggcacccacaccacgcccgactaatttttttgtatttttagtagagacggggtttcaccgtgttagccaggatggtctcaatctcctgaccttgtgattcacccgcctcagcctcccaaagtgctgggattacaggcgtgagccaacgcccccggctgacaaagaatcttaaaactcatcaataagaaaacacccgattaaaaaatgtaccaggctgtgcctggtggctcacgcctgtaaccccagtactttgggagtccgaggctggtatatcactggagcccaggagtttgagactagcctggccaacatggtgaaaccccgtctctactaaaaatacaaaaattagccaagcatggtggcatgccactgtagtcacagctactcactctggaggctgaggtgggaggatcacttgagcctgggaggcggaggctgcagtgagctgagaatgcaccactgcactccagcctgggcaacagtgagaccactatctcaaaaaaaaaaaaaaaaaaaaaaaaaaaaaaaaaaaagaccaaacaccttgatagacatcacaccgaagaagatattcagatgagaaataagcatatgaaaagatgcttcttgtgcaggatctggattttttctaagaaagaaaaaaagatgcttcgcatcatatgtcatcagtgaaatgcaaacacaataataccatacctcaaaaaaaactatgatgaggatgatatgttttttaaagacagaatctccttctgttgccaaggctgaagtgcagtagtatgatcatagctcactgcagtctcaacctcctggcagtcctccacctcggccttgcaaagtattgagattacaggtatgagtcacagtgcccatcctacacacctattagaatgaccaaaatccagaacactggcaacaccaaatgctggagaggatgtgtagcaacaggaactcattcgttgctagtgggaatgtaagatggaagactactttgtaaggcagtttggcagtttattaaaaaacgaaacaggccaggcacagtggctcacgcctgtaatcccaccgagatcacaccagtgcactccagcctgagtgacagagactccgtctcaaaaaaataaaaataaaaataaaataaaataaaataaaaaatgaaacatactcttaccccatgatctagcaatcacactccttggtatttaacaaggaagctttggcatttacaaaagaagttgaaagtttatgtccacacaaaagcccacgtatggattttgtttgtttttgttgttttttggttttttgtttgttttgagacagggtctcactctgtcacccagactgaagtgcaatggtgcaattatagctcattgcagcctcaaactccaggactcaggtggttctcctacctcagcctcccgagtagctaggactataggcatgtgccaccacaccaggctggtaacttctattagatatcctcttggagctattgagttttaagttgtatgaatgcattgcattacatttcaaatttaaaatacaattttaaaaataagaatgttaactagataattatgtaacaacttaaaaactttgcttaccagaattttattaaaatgttatttggctttcgatcatttaaaaaattcttcatttcttaaagatttatctaatttctctaccaagcatacacagtaataatagcaacaagaaaattaccatcagggagacataaaagcagtataatgaagctagtttagcaagaaggggtgcaaataagaaacgaatactcagaggatctcagctttttatttaaaaaaattgaaagattttgaacatgcatattagattttattaattaaatatgttacaggaccattctggagagaattatatatctcatggcggggattcctggggaatctttaatgagggataaactccaagggccagagaagctgttcaccacactttttttcctaccctttcccccaagcaatcccctactcacagaggaactgcccttattcaggagctgaaagaggataccagagctcctctctgttctagctagcctaggtcccaaagaagaccccccaaatacaccgttttttcttaaaaacatccttcacacttggtctgatgatttttacttgttaaatgcaatccgttggccgggcacagtggctcacacctgtaatcctaacactttgggatgctgaggcaggtggatcacctggggtcag

SEQ ID NO: 3637 - DNA, 4782 bp, Homo sapiens
ggcagtgacaccttgccagatacttcttttttttaaagacagagtttcgctcttgttgcccaggctggaatgcaatggcgcgatctcggctcactgcaacttccgcctcccgggttcaagagagtctcctgcctcagcctcccgggttcaagagagtctcctgcctcagcctcccgagtagccgggattacaggcatgcgccaccacgcaaaataggctaattttatatttttagtacagacggggtttctccatgttggtcaggctggtctcgaactcccgacctcagatgatccgtccgcccccccaacccaaagtgctgggattacaggcgtaagccaccgcgcccggccgccagagacatctttaaggaacttggcggtctggagccagcccgtacattaatattcaaggccacagcgctggtgagttcggcgccctctgttgtatttttgcatcccgggaaggctggcccggctctttggcccggcgtgttttgcttccgcgggggaggtaaagctctgcaggaccccgatcgccacggcctgccgcagtggcctggagtcggctgccccagggaaccacctggacagcccgagggcaagaaagcggcaccagtggccgactccactgactctgggctgaagatgccatcagttaaagaaaagacacatgaaattctggcagattcgctcagagggcgcttggagcaccaagcccagcctctcaggaaactgaggtccaagggacaaaaagaatctgcagtctcttgccggcctgtgtccccgtggccagagtccagcaccctcttcctcgaagcaaccagaagtggaaatgaaagtgctccgttaactgtagactacatgccaccgaagggtcattcctgacagtggcttctccccattatctctttattgccggaggcttcatctcgcccccctgaagctacagtccaccctgaggtcataaacttctgctcagcacccatggcaactaatgcagaggtcaccatcagaggattataactgcagatgggaaaccgggatgagaggggagttctttaaaatcctgtcttgttttcctgcaaataatgcctcttacataaaatctgcgaagaaagatgaatgcagcaaagagacttgccttagaatctcagactagattgctttttccatatagactccacttagtgatttttgttctttattttttttttaaacaaaaacctatttctgaaaatacaacgagctgctttttgcagggttcacaattcccaatagatgatgatgccatttttcaaggtctcacacacgttgtggctttggggcttatttattagctcccaagaaaagcctgcctttcagtgaggtttatatactcgagtaattgcatcaggggacacagagcaggttgctgttaaagagggttggttgtacatgcgtctgcaaggaaggccctgggccaggcagctgtcagaccagtgtgcaacgggtttaaacaaacacagggaagggtctgtggaaacagcaaggaggaaatccccttctgtaagggtgtgtggaacattattccagggccacacatactgccagggaataatgcctttcctctcctccctccaagtaaacacataactccgttatggagatggcgctgggcccacccagatcactttcaaattcaggtgtcagaaaccacggttgacatggagcaaaattgtttttaagtaaaaatcacggtgccgctttgatatgaattccaccagggactttccaaaggtatttatacacgtgcctgagattaactagaaggtgatttttttcctttcaaccttaatttcaaaaaattacccaagaattgcacttgagcctgttactgcagagaattgaaagaacacccaaatgccaggtccctgtggatgggtggaaggatagacaaataaatgtgtaactgcaagagaggttgataccaacatggtattagcaagtcacggctgaaaaaaatgcagataccggccaagcacggtagctcacgcctgtaatcacaacactttgggaggccgaggcgggtggatcacttaaggtcaggagttcgagacaagcctggccaacatggtgaaaccccgtctccactaaaaatacaaaaattagctaggcgtggtggcgcaagcccgtagattcccgggaggcagaggttgccgtgagccgagatcacaccactgcaccccagcctgggtgacagagtgagacaccctctcaaaaaaagaaaaaagaaaaaaaaatgcagatactttcagaaaataaatccccgcttcccgtgtgtgcactctaggcccccacaactgtggatttaaattgcctgggttcaaattctacttctgccacccactagctgagcaaccctgggcaagtcacttctttccatgcctcagtttgaggcttctggtagcacctacgagcagtcaattgagctgttgatcccaactcctcactctcccgtggtggttatcacacgtctgcatccttgtcacagccttccagtgcagggactgtacttccccattccttgactttggacttgctttagacaatgagataatggggaatataactggatcagaggcttggaatgtgcttgcagggccagacctgctttcctctgctctggtggtccaccatgagacgaacatgttgctgcctcttccagagaggcttcagaatgaacacacaaggaagaaacctgaacttgattcgctgtctggagccatgtcactccacatacagcaggactcagagctgctttaggcaacctacagaacatgagcaaggcagggaaaatgcttattgttgcaagccactgaatgttgcaaagtgttttgttacacagcattgttgtggctgtagctggctgatacatggcctcagtgggctagtgtcaagactgaagacaaagtattttaaaaatactcagcacaattcctaggacacagtaagagttgaaaatagtagttcttattagtaatcattattattgcaagtagttttacccatgatagtcacataattgaatgtttgttaacatgcaattacgtaatgaggttgaatccatgaataagtataacttgaataaagattctgtaagagatgctacaaggacaccagcaacctggaatgtcagggacttgccacaatccttaaaatcacattcactcactcactcattcattcattcattcagcagacactctctgaacacctgctgtgtgccactcacagggctgaatgtgggaaccactaaggtcactaagactcagccccctcctgaagaaagggaccttcaaagtcccaccttgtgacaagcactgtgctaagcactttcccatgcctatgaggccagtattacttatccctatttttcaggccgggagactgaggcttacaaaccaaacactcaaagacaaaaggccatgcctattccatgagtgtgcaccagtgcccatgaattcaaattcatagtgggcagacccattagggaagcgctgtggggcagggcaaagaacggacacaccttgtcactctctgcctcctgcatgctaggaggggctcagtaaacactgaggctcaggagccccaggtcctgctcctgccactgaaaagggctgcacctgggtgtgagggagcccttggggtcattgcggaggacttcaaattcattttggcagccttggcttcagatttctgccacctctgccaccagtaacgacctgcctcccactctgtgactttgacaaatttagactgctcaataacctgaagtgcatttcaatttcataaatttagcaatgctctggttaggcggctcccttctgcagtaatgcatccattaagtgcactttaagcccattttggtatgctaatccatcacaaatccacgtgaaatttgggttcttgtgaaaatttcctacaccccatccaaaacctctaccggatttaggacaataacaactagtggttccttagaacagcagacttcggctctgcatcaaaccttcagtgaaaaaaggaatggggcttgttttaaaccaatgtccagacttgtatattcacgagcgccgtctgctcttacagggtccccctgaggggcggttcgcttgttccaaaagtgctgctgcagctttaagatttcagaactctattccagaggaacggagtcctgtatgtctctgcatgcccctcccctagctcagagcctgtaaatgtttacgaatgacccagttggaatcacctggcttgattagcacttactcatccgtcagacttcgttagcttcatatgattttcactatgtcctgatgaagactggggatcctaaaatacaggcagaagcctccgaaggaaaatcagatgcagacccccagtgcctccagggatgaccacatcatcataatggtgcaacctgtttatcctacagcctctgaggccggaaggaatacgcagccagtaattgacaatacaaagaacctacaggtgataaaagagacataatgtcattgttatcaccacgtaagactctgttgctaccaactgttgaaggacagcacctattaagtagatgtttttagctgcataatagacatttcgccaataagataaagtttacagctggtagcgttctcacttacttgcttctgtcataagatctacaacccattcaacagcaaaaatgagctgttgacttggtaaatttagagcagcgtcgcctgccctagatgtgaaatacctc

SEQ ID NO: 3638 - DNA, 9627 bp, Homo sapiens
ccagtcctcttctggctgcatgtaatcgttggtttgctgagaatcataatggtccatgatggtgcgcgcgtgctagggtctggatttcttcctccaccttctctctgagcaacggctgctgccctggcgtggggagggagtagggctgggctgggctgggctggcggggccgggctcgctcccctgcgcccggttccgccgcggcgctgctggcgaaggctgctactggcggcgacagcggcggctgggctcgcggactgcctgcctctgggcgggcgcttggacctaatctccacgcacactgaactaggcggacacactagcgctgcgggagccgaggcgggcgggggcggggggaaggggcagagccctcccgaggctctccattggccaggccgagttgcccaaacttccccccatcgcctctcattgggaattcctggcatccgtcagccgggctgcggcgcatataggtggactgggcggccccctcccggcgcgcacacccccgcccactcccgcggtgcccgttcccccgcggctcatgtgacgccagcttaagctgaacgggaccgaagccgggagacgcctccccgagctcggggactgagtggcagcgcgcttgggaaccccaggagccgccgggattggacccgttccccgccaccgttattgcgctcccacgcgcgctccaaaccccggggtgggagggggctggagaaaggacgcgaggaaacccgaagaacattcattttctctttcccagggaacctgggtctgggcaggaacccggtttctcgccagcgaactgctctcagaggctaccgagcgttcccgcctcgccgcaggaactcttctagctcgccctcgggctctggggaccgctccacagcggggcctcccggaattccctgccggtctccgcgggcacacttggctggctgctgcgaccaaaactaccttcgcgtggcagggtcctccctcctcctcacagacaccccgacatcaccctcaaaactggaagggacaaccccgagtgatctaggcgatggtggatacctgaaagccacccatggaaaaggtgaagaaagtgccccctggttctcagaagagccactgctgctgttgtgagcagatatcggatggtgtctctggctgcatcattcgtcaaccacacatattcatatgagtgttaccctccagcactgtgccttccaaaagcccctggctgaggaagcactgcttctgagccacagagacagctgatttatggaccattttatcaccgcttctaaactgtggctctaaacctaacacagagggtaatggtagtgctgtatccattcattcacccaataaatatttgctgagcaccatctgcatatcagggaatgtactagatgtatacagagatgaaaaagccatagtccctgtcgcacacagcccagcagacagacacagaaacaaaaatatgatgtcatgagttagacgcaaggagagagatctgacaagtgtactgttggaacagatgaggggcactgaaccccgtgggaaaggaggctccaggcttaactttttggaggaggtgaaacttaagtgaacgttaaagaatgagagtcagccagataaagagtgtgggaagttactccagaaggaaggaccagcacaagctaatgcacaaggacaggaaactgcatggtatacaaaggaatgtctagcatctcaacgtggctggactagaaatccaaggccgggaggggcaagagacggggctagagaggtgcaaagcagccagaccatgaaggcctcatgtgccaggtggagtgtggatctaaggggagcaaggctggctggaagctttgacaccagttgcaaagctgttgcaataatccaggtcgaaatggaaaagtgtggatagaccagaaatacttaggggataaaactgaaagacctaggagtctggagaaaagataagtgtttttgttgagagatcccatgcactttacctatattaagttcctcctatgaggtgtttctctgtcttacagagaaaacaaactgaggctcagagaggtagtaactagtccaaaatggcaccagtacatgtgactcccagacctgtgcctttaaccccagtggttctcaactctaggatattttaacagctccccctcacaagggatatttgttgatgtctggagtcattttgggttatcacagctggtgggttcctactggcatccagtggatgcaggttgggaatgctgctaaacgttctacaatggataggacagcatccccacaacaaagaattatccaggccaggcatgatggctcatgcctgtaatcccaacactttgggaagctgaggcaggtggatcgcttgaggtcaggggttcgagaccagcctgggcaaggtggcgaaaacccgtctttaccaaaaatacaaaaattagctggccatggtggtgtgaatctgtattctcagctacttggggggctgaggcaggaggattgcttgagcccaggaggtcagggctgcagtgagccatgattgcaccattgcattccagcctgggtgacagagcaacactctgtccagaaaaaaaaaaaagaaagaaagaaagaattaaccagccaaatatgaaagaaagaaagaattaaccagcccaaaatatcaagagtgctgaggttgagcaatcctgctttaatcatgagtttatagtttagatgatctggggaatggtggcactatgaccaattaagatagaacagaaaaggaaaatatttaggaacagaatcatggattgagtttgaacacattgaatttggagtgctcttagaatgtccagattccatagaccagcaggcagtttgactgcatagccctgacctcaggcaaaacagagttgagagtcatctgcatatggatgatattaacaccaggagaccacccatgaagaatgcccaggtggacatgagaagagggcagaaccctggagaacaacacttagaaagggacagcaaagaacaagaacccctgaaggagacaaagaaaatggtcatccaggaacgaggagggcctggagtatatgacgttgaggaggtcaaaggagtaaggtttcaaagtaagaggaattggcaatatcagatatattcaaaaagtctggaaaataaggcctaaacagtgttcttggatatgacagttgaaaattcactggtgaccttggccaatggaattttggcagagtggcaaaagctgtaagtttaaagagacattaggagtgaataaatggagactgaatatagaggggaaaaagaagtagctaaaggggcaatagctagacgcaagtactgagatcaaaggaagatttcttttaaaactggaaaatgtgagctgtttgaaaagaagaattcagttaagaggaaaaagttgaaaatgtaagctaaagaaagttaagggagccaggtggagtggctcacgcctgtaatcccagaactttggacggccaaggcaggtggatcgcttgaactcaggagttcgaaaccagcctgggtgacatggtaaaaacctatctctaccaaaaatactaaaaattagccgggcgtggtggagtgcacctgtggtcccagctacttggaagactgaggtgggaagattgctagagcctgggaagtctaggctgcaatgagccacgattgggccactgcactccagcctgggtgacagagccagacactgtctagaaaaaaaaaaggaaagttgagggatagcacaaagttcttgaggagataggaccatatgggttcaaggacacaggctaagggatgggccattgaacaagaagaaagaccctcatctggctgggtgaggtggctcatgcctgtaatcccagcattttggacggccaaggcaagcggatcacttgagcccaggagttcaaaaccagcctggccaacatggtgaaaccccatctctactaaaaatacaaaaattagccagatatggtggtttacacctgttgtctcagctacttgggaggttgaggtggcagatcgcttgagcccaggaggcagaggttgcagtgagctgagatcgtaccactgcaccccagcctgggtgacagagcgagactcggtctcaaaaaaaaaagaaaagaaaaaaaaaaaaagaaaagaaagaccctcatctgagcctgaggaaagaaaagggggagttatgatgcgtgaggatgcccacagtgtgtgggaagacggtaaggaagtaagttgaaacaataactgatgaacttatcttctcaataagggaggtcctgagatggaccaaggtaacagactgacccatcttctcactcatggccaccaccctgtgaaatgatactggggactttagtctcagtataagacaacctttactaaatacaaaaaattagccaagcatggtggcgcatgcctgtaatcccagctactcgggaggctgaagcaggaaaatcacttgaacccaggaggtggaggttgtggtgagctgagatcacaccattgcactccagcctgggcaacaagagtgaaactccatctcaaaaaaaaaaaaaaaaagaactggattgacacatgaggtgacataaagaagggagagtgccagccccatgcctggcatgcagcaggccacctcaatgctcatgaatttcttttccaccctgctatgggtgactgaccatgtgaggccctgtggggagacatagacacgtaggatctgcaagattctggaaactaaaagcactatggacctcccacctagatatctggccattgccttccttgtatcctgagttcttctctaaccttacagcctaatggtgataggctcctatgagctcttcctaagagcccagggcatggtagtcattagagtgtttgtagaatgctagaaggaggtaggaaataaatcactatagttttttgggttttgggcttgggaaatcagaaacctcagttttgtccccagtcccagtagcaatatagttaatagactcctcttccccaaacgcccatagcataccatttgtaactaagagagtatactttgctttattttagtcctttgtccattttttctctcacactgcctttatgaagcctcaaccctgttctttcccccactcagtgtaacacagggcctaggacacaataagtgttccagttcaatattcatgaaatgaaaaatggcattagccaaattccatctcactgcctgtttctccatcaatccatgggaggcttggggaggccagtcctttgccatggtccacacaagcatttcccaaattcttgggcctcctgagaagctcatgaagcccatggtggtgaaattgagttggctgtccctactccgatgccccagccagcagcactcagccatcacccaccaggatgaattcctccacaccagcttctgcttcactggaacagtttgccctagggtcaattcctctctctcccaccagagaccagtgaggcagggcaggagacactcagcagtttccctcgtgcgggatctctaataagaggctggcagaaaagttcctgtgcttcccatcctctgcccagctctagggtctcaggtgagagaatatctggcctgtctggttcactcttttttttttttttttttttgatagagtttcactcttgttgcccatgctggagtgcaatggcatgatctcagctcactgcaacctctgcctcaagcaattctcctgtctcagcctcccaaatagctgggattacaggcatgtgccaccacaccagctaatttctttctttttttttttttaagtagagatggggtttcaccatattggtcaggctggtctcgaactcctgacttcaggtgatacaccctcctcggcctcccaaagtgctgggattacaagcacacaccaccgcgccaggccaggtacactcttttccctagtgatcaggcatatttatctcccccagatacccagggtaaaccaacctggaccatcagaaatctctaccttagatggctaccttgaggtcagctctgggagcagagctagtcaggcttgagagctgcccagcctgggccctccaaggagggctgggagctcttccccatctgtctcttgttcccagcaaaaatcagagcaacacacccaaatcacagctgagaatgtgaagacctaaataaacggaaagctgatttattatgttcacagattggaagaatcagtaacccccaatttgatgcctaaccctccacctcccccacaacacagcattggccttaccaattacagcagccactagctgaaaagccactctgtccagatcatttccatggaaatgatgggatagctttcaggggcagatatccttatgtgagaagcaggacaaggcaaggagacctgagctcgctgggcttcagtttacttatctgcaaaatgacagggctggattcaccagacagtctttaagctcctggtaataaagttctgagcactgttctaagaatgtctttctgcaactcctcctttttatctccagtgagaggatgatttgaatcttctgaaacaatgtttctctatcttgaatactaagcaagttccttttgaaaggatacaaatcctcacaaagttacttaatttttattttaatgttccttaaatgtgtatgaacataaaactaggcacaacacttcttaacatttggggtttacaatcaactacaaaatgaaaacaagcttacaaattctatttaaaagaaactataaaaccagtaagattcaaattagccacactaatttaaatgtaactgttgctatttgctgaaacaaaattgctactcccagcatgatttaattctgactgtgatcaagcaggtggttctttctgcgttggggatgcctatatcaccacgtgccaggcaatgactcaattctcctaccactttctctatttgaactactgcatcagggcatcatttaaccttcacttgattggaacacactgtaatgaatcaagttccctctgctgttttctcattagcactgaacaattaaagttaaaaaaaaatttttttttgatctttgtaccaacaggatcctttgctcaaatttcaatgtccttatctataacacagagagaatcacctccatcccacctacctcacaggatggctgtgcacattcattcattcagtcaactattttttattgagtatctactatgtgccagacactgttttgccacagatgatgtagcagtgaccagaatggatacaagtccctacctcatggaacttacatttcaactgggagagcctggtaagaaaataaagaagtaaaataatatgatagtgttaagctctaaggaaagaatgtatatataaagcagagaaggggaattgagaatttggggagaggtagagggaggttacatattttaaatggggtgttcagggaaggtttgttgagtaggtaacattgaagacctaaaggggtgagaaaacatgagcattccaggagcagccaagaggtcacagtagctagcaagaaataatgcacatgagacacacactgaaaagtacaatgcaaatgtgggtctaatagataactgctgttttgctgcccagcaaccatttccccctcctggcaaccataccttgatattcctctgggagggcacttcccctgctccaatccctgggcttcagggagagttgaccccacccctagtcaacagggctgggcaaatgacaggcctagccaatcagagcacacgattggcttagggcatgggacccagtctgaatgaaggacacacaatgaaacttttttttttcctttgaggcagggtctctgtcttgtctttgagggtctgtcacccaagctggagtgcagtggtgctattatggctcactgcagccttgactccctgggctcaaacaatcctaccacctcagcctcccgagtagctgggattacaggcatgcaccaccatgcccagcttatttatttatttatttatttgtttgtttgtttagagacagagtctcactccgacacccaggttagagtgcagttgtgccatctcagctcactgcaacctccacctcctgaattcaagcgattctcctgcctcagcctctgagtagctgggattacagacatgtaccaacatgcccagctaattttttgtgtgtttttagtagagacagggtttcaccatgttggccagactggtctcaaactctttattattattaatttttttttttttgagacttttctcctccaagatcctccctctcttcatgtaaggtgaaggggtggaattgctacagtcctaccaagcaatgctcagtgagatctgagatgactctagacaggaaagggcagtccaaactcctgtggggcctagtaactgttcaggagcccagagcccagggccccactccacctggcatgctgcatgcttggtgaccaaggcaggcctctgccctgaactgagtgagtgcctactctctgtggctggtccagcctctcagggtggagagtcctgcactcaaaaagatgctgagatgagcttttacaccatgggacttaccctgcacatattcaagttaaatttcagctgccatccttgcctgagtcccagaggagatcagtttcatctggagtttctcataggccgccccccacaccttggccttggccagctgaaaagtgtttagatcaatagcaagcctcatcaactcttttccacccccaacccttactaagtgcatcagacaacagaagccccagggctgacctttgcagcatccattgtcatagcagttattacagacacaaataataggtagtataataatctgtggttaaatgtcctttaaccagagggctcagagcactctgggaacattacctcatgcccctcctgacactcctgcccacatgccttttcttcaagaccctcaagtccctcttccagcctcctgccttctggaaagccctcctccacatttcctctaactccatctcagcacagcttaacagcatggttcccaggtcttacccaggagctgccctgagtgacagcctcatggaggaagttgttcaggtctcaaagatcttcttatctcccaccatggcctataatcctgagcatgtcccatcactgacctattttctatatgctcagaagcaagaattattaacagtggatgtgttgaagtgttttcaactactaaaaatgggggaaataagataaatataattttgaagctggtaaggggcttgctgcagttgtcggtcctccccatttctggttggccacaggtgcaatttgcagacatcatctgcaaataaaagctttcttacaaaattctttcccttaaggtacatgtaaacttggtttgttggatgctgctattcgtttctttcttgctttctttcttctgcttctttcttcctttctttccttcctcccttttttccatcatctaaaaatcagaattcctttgagctggagctgaaaaaaaagaatgaatgaatgaataaataaataagaaaaaagaaagaaaaatcagattacatttgct

SEQ ID NO: 3639 - DNA, 4990 bp, Homo sapiens
aaatgggtgcagagattcaggctggccaaggctggcacaaggacattcccagtggcgagagcatgagcaagggtcacggatgtgccaggaggggaggcggagagatgcctgggaccaacctctatggcaggccgcggcccaagggcaggggaggggtggacggagggaagggacagggtctcctccgggaccccagggaggctgggcccaaggaccatggagcctcgcagctgaatggagccccccaggcctgccttctgtcctgggaaccagggcctccctcgagccagagtcctgagcgccgcttgccccccgcccacagcggccccagcgagcgcgctgcagagggcgcgggtgccgtgactcagccgagcaccgcgatgtcagcggacgcgggaccggactggacacgaccgagccacctccccggaggccgcagcgccggcagtctcccaggatcagtcagccaagagacccgagattctcaaatcacggcagccgccagaggtgcccctgaaatcacagctacgccctagctcagccccgcctggaactgtgctccttttatctctgcccaaggtgagggaactcaggggaccttcctgctcctgccccgcccctgcccccacaacctttggcatcaaccactgtccccacccccatctcggggacttgctagtcctggggctgctgggaggggtacagccacaagagggatgccaagccagggcaatatgacgcccccacagcccaccccactggtctccagagaggcccagagatgtccagctgggcaggcagaggacagagaggctcgggcaggcttggcccagggcagagaaggcccaggtgcaggcaccctgagcacagatggccccccagcccccacccagctacccaggcctgggcgctgcagacagcgagtgcacttccccagagggccaggtggctcctcccacggcagtatcacccacttcccccagctcaccaccagctgggccctggtctcccaggagaatcttacacattgaagatgtactgtgctcagctctttgccggaagctaaagctcccaattgggccatcccaccccactctgccacctctgccatctaggaacccagatgcccggagaggaggtctgtcctggggcccttagtgtcttcccacaggagcccagcgcgtgcctgcaagggcctggtcccggaatgaactgtggatggaggctgctttgtccttttccccgtccagatccatgcccatagacaccgctgactataggctgggcccagggtcccttcctccagcctgcagcagaggggctttccaggctggaaagggaaggagtccttttgtccctgacgcaagcgggttgggggccagcacccgctccaggaagaggaagggatccagcctgaagtccagactccccgctccctctaagccagggcctggagcctggaggccaggttccttcttctacaccagcccacgttgggtgccagccaggctgggatggccctgcggggtcaccctgagccccagccaaccaacaccccactctcagccacagtgggaggccccatcagcctcttcacccaaccacgttgccactctgctgcacgggaccttgtgtggtcccaggcgtggccagacccagacgtcctggagatctcaatgcagacacccggcggcagttcctgcaggaaggaggctgtcctgccacgcctgcgggtgacccggcctctggtgccagagcctgccatccttcctgtttgtgctgccaggctggcagggtcccttgccaccgacctcagccgcagccacagcctgctccctccctgggtggatttgaaggagcctcccccaccctccgcccctagcttgctccttgaggaccctgggcagggtggctgccatggggcccaatcgtgcgtgggaacctgcgagctggcaaacggggctcgggggttttgcccagaaatgggtcagaacgaaagcctctcagaggaaagaaaagggcatgagtcaaagagaaagtcggggggcaggggctccccctcatctcaccccacccaggcctcctgactccctgggtttgtgcggacccaggcaggcagccaaccccagctccgtggtgtgtgagcatcgtgatgatcaggacacaagctcttccccgctgagccttcactgtgggccagcttcccggtggatgcccactgaagaggcctcaacccagtgggccccactccagaccaagagcagaccattggccagctgccccctgcagacagcggcacccggggcagcagcaaggtgaggggcacccagccccagccccaggggcgtctcagggagcgggctgagcctggctgtcttcctgagccccacctgcttcatgggttggcttgagcaaggcagtccagatgcgtgtctcgagcgctccctggcggcatgctgcaaagctacatggctccggcaacaaggaagactgcccttattctcagtaacaggtggagctgggggctggagagcccctcggacctcgccttgggaaagctgggtgggtgcacggagcctggcaggtggccaaggggacccccaagtggagggattggtcgaggggcagcacagggtggtgcagtgggtgagctcagcccctcccctccaactctcatcccattgagccccaaggcgtggggggatcacgtctgtccttgttctcctccaggtggagctgctgggtggggctctggtcctccagggacccactctgcaccccaagttttgccgggacccgctcctctgtgttgtgtggctgtaggggagggctgcagccagggactctgaacccggggccggcccacccagccacccagggtggggaacaagatcgcctcccagggccagaagctggggatgtccttgcttcctaggatgttggctaggggatcacacgccccacattctgggtcaagcatggtcctgccccagcatcttgctgggttgggggcatctctgcacagatgagtgccaccccagcgtctccgccagggtctgggcatgtcactcttgggcatctgtgctcaggaggtcaccaggtgtgggcagggcaccaagcagggaggtagccgaggctggaagatgcacatcagtgccccgctgggcttcctcaagtgggaactggtggagggggcgctaggctgccgggccagggtcagcaggctcaggccggctcagggctcagagttgagccagaaaccaaggtgaaatctgcctcttactgccgccagggcccttgggacagggacaggaacagcagaaggtaaagtggaaaggaattgagtaatgggcccccaggcaaggctgagccaggccccaagcccaggattggggtctccagagtccctgggggccccagggcagctcacccacagcctggggcctatgggagcaagggggctcctgatgggtgggggcaggagcttggacaaagttgaaggccttctgtctgaattggccaggggccaatgaaagccaaaaagctggtgtggtggcttatgcctgtaatcccactttgggaggccaaggcgggtggatcacctgaggtcaggagttcgagaccagcctggtcaacatggtgaaaccccatctccactaaaaatagctgggcgtggtggcaggcacctgtatgtaatcccaaatactcgggaggctgaggcaggagaatcacttgaacctgggagatggaggttgcagagagccaagatcatatcactgcactccagcctggctgacagagtgagaatctgtctcaaaaaaaaaaaaaacaattccaaaaaggcgagtggggagcagggtgctaggctgcatgggggcctatgcccccaccggaggacctagccccctgccaacccttccccagctcaggcccaccagctcccttctcacacagctgctctgggagggagtccttccttgccaatacctaagagaatgggcagcagggaccctgaggacaggttggggacacccagaacaagaagaagatgggacacactaggaggctcttgggcccctgcgtcaggccagcaggataggtgtgtattgtgacctgagggactgaacgtggagctccaggggaacctcccagccagtgacacgctggccttgggccagacgctgccctgcgcccttgagtgacgctcgggcctccctgcacccacccgctttccctgtggctaatggcttagagtgaaggatggtgggcgtgggcgtgccacgtgggctcagcgtccaccctgccccatgcacgcaggcacccatcacaccagggcccacacacaggctcccatcacaccctgccccatcacagcagtgcccagagggacatggggctcccagctgagggccagcccaaggtcacaggtgaggagtgagaggtgagaggcaagggggcttcctggtctgggtgggctgtggcccccaaaacatgttgcttaggtcaagccagtctcccccagcaggggtgaacaattttcccccagcctgcctggcccaccctttctccagggacggtgcccagtgggccttatcttccccatgccaggtgtgatggttaatactgtcaatttaattggattgaaggatacaaagtattgatgctgggtgtgtctgagagggtgttgccaaaagagattaacactagagtcagtgggctgcggaaggcagacccacccttcatctggtgggcaccatctaatcagctgccagcgaatgtcaaccagaaaaacgtgaaaaggagacgacaggcctcgcctcccagcctacatctttctcctgtgctggacgcttcctgccctcgaacatcggactccaagttcagctttgagactcgggctggctctccatgctcctcagcttgcagacggcctattgtgggaccttgtgatcgtgtgagttaatacttaataaactccccttcatatata

SEQ ID NO: 3640 - DNA, 1036 bp, Homo sapiens
ggtgtgatatgggtcttttctcatcgacgcctctttttccttccctctcttaggcaaaccttttagagaagtcagctgagcaaatatgtacaggtgaattcaaagcaaaagcctcacaaagttgatttgccttagagcaaaggacagttcctttcttcaattctaattagaggtgttgggtttttaattaaatatattactgctgtacttagaggagttcttaaacctccaagtaaaatcaaaaacctctttaaaatcaaaatttctgtcttgatttatttatttattattttttttttgagatggagttttgctcttgttgtccaggctggagtgcaatggcacgatctccgctcaccgcaacctccgcctcccaggttcaaatgattctcctgcctcagcctcctgagtagctgggaatacaggcatgtgcccgccaccatgcccggctaatttttctatttttggtagagacggggttttgccgtgttggtcaggctggtcttgaagtcctgacctcagtgatccactcgcctcagccgaagtgctgcgattacagacctgagccactgcgcccagccttgatcttgaggtttcctgggagaaggtggcttaaggctgagacacttatgccctgggccagccactggattcctgtgctctgcttcactcctagttaccagaaaggtggaatctggatgagtggaggccccagcggaaaggcgcagatacccggagacttcccagagagactcgacccaccaaaaagcgcaccgcggccgcgcagcccttccttcagctctggaacccagcgccccacacctcaaatgggagaactggtgacctctagtggcccatgaccagcctgcagggcctggggctggcggggattctctgacccaaactctcctgggctctaatgctgttcccctgcccaccctaccttctgccttcacactgctgaggggtccatagccgacaaggaagagctcatttctcatttgtcatgaccatctttaataaaaaataaattagt

SEQ ID NO: 3641 - DNA, 1205 bp, Homo sapiens
caaagatggaatggagacttctgcttctggccaagttggagtaatagggactagatttgtcctccaccttaaacaactaagaaactggaaaaagtattttaaactctagcttcaacattggatatagtgcagtacagtacattgatccctgagagagagaaaatagaagagatgagccctatgattgctccagtttgctgcctgagtttgtcaactgcagagcagggaaggaggacccaggcagagcctggtagtaagtttgaagaagtcagggtggctagacatcacaggacagactagagaataggttgctgcacagagagaatgccttggatatctgtgttcaatcttcagctaagtacttattagtacatgtatttgaggaaattatgcaaagcagggcaaagaacttcccaaaaggaataatctctgtagctcacacagagcttgcaacacttggtgtttccatcagctagtgtgaaaatcccttttaatagagggagcattggttagaacaggagtcccaaacccccagcactggtccatggcctgttaggaatgggaccgcacagcaggaggtgagcagccagcgagaaagcattaccgcctgagctcagcctcctgtcagatcaacgatggcattagattagcattggagcacaaaccctattgtgaactgtacatgccagggatctaggttgcatgctccttatgagactctaactagtgcctgatgatctgaggtggaacagtttcatactgaaaccacccaattcccaacccctaccaccccacccccaccttgtctgtggaaaaattgtctttcatgcaaccagtccctggtgccaaatctgtgggagatcactggcttagaatcttcaaaagagtattgcccccaatgtaaactatggactttgtgtgataatgacatgtcaatgtaagttcatcaactgtaacaaatgtgccattctggagagagatgttgatagtctaggaggctatgcatgtgtggaggcagggggtatatgggaactttctgtacttcctgctcaattttgctgtgaatctgaaactactctaaaaaataaggtctattttcttaaaggtcattttgcctccatagtgggaaagaaaatagcagttgactaatagctgctcttatcctgcctaaaaaaaattaaaaagccagcttggaaagatgaaaa

SEQ ID NO: 3642 - DNA, 914 bp, Homo sapiens
ccttgcccgtattgggtagaacagggacatctttttctttgggccgaatgattggaattgtttccgtagtcgctggagccccagcggaaatgatcagagaggacgatattattcgtaaatttaggcgaaagggtcacatttcaccccaatctggatgtgtgcttgccgtaatcgattggttgcagctattaactctgggactgggtggtttgaggcgaggctacagcccctccttcagttcagacacggctgattttagtatagtgggggtggggggtgggggatggatgtcactagggcgagatctaggcctgtcattaatcacccacaagaacgccactttggctgagtcaagacctgtttccctagcagggtcaacaacaaagaaaatgctcttcccgagtactgtaatatgatcacactataagtctagaccttgagaaatgttgaacttttaataagcatattgcattgaaaattggggctgaggagttgcttttatttggaaatgttttatttttgcccaacaaagtatgctgggggaaaacaacctagccttgagaataatgaagaaatcaacccaagattccaagggacttcagacttttgcttttcatcttgaaacatttcctgagagagactggggaatgtcttttggctgctttgtagggcatgtgtatgcccagttttttctgtactttgaaatccttgtgtgcccctggcacaatcctaggataggcttttgtggactagaagtgtaaatgtttcctttgtgtgtagcatgcaaagatttctgtgtgagcctttagtaataatatcaccctttagacaaagcctttccatagcttgatttaaatgtctcgttatcagtagcttaaaaaaccgaagtatatacctctgtatttggtgacttc

SEQ ID NO: 3643 - DNA, 1531 bp, Homo sapiens
agcgcctaggagcccgtaccgctggggacctccccttccgcgaaccccgagcgggtagacccagagcaatccgagtgtggaaacaatggagagggggcgtgttgagctggggtctccatgcctcgttggggagagggagctcacgtacccacagcagcagttgcgtgatgacgacgtgggcgagctcggccgccaggtggagtggggagcgcagctgtgggtcctctacgctggtgtcgagcggcccgtgtcgcgcatgggccaaaagcaggagaacggtagccacgtcctgggcctgcacggcggcccacagctggcggcccagcggctcctccgaggtgctcagcggcgccaggaacagtagctgctcgtacttggcgcgaatccacgactcgcgctcctccctgcaagaccagggatcaacggaaaaggctctagggacccccagccaggacttctgcccctacccacgggaccgtctcaggttcgcacaccctcagcaaccctccccccgctctgttccctcacgcttaccgcgaagagtcccgcgagggcttggcacggcctcgcgtgtcgctttcccacacgcggttggccgtgtcgttgccaatagccgtcagcaccagggtcagctcccgtggccagtcgtccaagtccagcgagcgaacgcgggacaggtgtgtgcccaggttgcggtggatgccagaacactcgatgcagatgagggcgcccaggttcaagctggcccacgtggggtctgcggaaggagcgtagaggtcggctcccagccgggcagcacaggcaccccggcattcactacactccctagcccctccgctgcctcctggcactcactgggggccccgcagtccacgcagattgaattccccttggcgttccggatcgcctggatggccacggcctcgctttggctgtctgtgcgcagctgcagagagggtttgggttggcactgactctgcctccaagccccacctccttctcagacacctctgctctcctctcacacgacttcggccgtgtcgttgccaatggccgtcagcaccagggtcagttcctgcggccagtcctccactccacctcaaactcttaccttgaccttgctgctctcacagcattgcagactggctaggatctgactctcgatggcctggacccaggcatcccgctcctcaaaactggctgcctcaaagtgccacgtctgacccgtgctggacacgatcaggaactcaaagttttcctctgagtgggggatgggatggggtcattaagggacagagttcaagcaggggctgcctttcccaagaccgtcctccctgatgtccatcccgagcccctgggagtggggcagtgggggtagggaaagcagagggtggggggcagcaggaagcccgagcacatgcaggggaaggcgggggcacccccacccttctgcaccccagctgagcgcccctcccggctccccacttgttacctgctttataaatatttcttaaactaccaaaggatttta

SEQ ID NO: 3644 - DNA, 1563 bp, Homo sapiens
ggcgggcaggcgggtgggggcacacccctcgtacctgtcactgggatgcagactctcgacatccgagtccaagcgcaggcccctcgggcgcaggcagctcacaccaggaagagactgtattgcagggtgaagagtgggctcccgtgggcccagagctgcacgccggtccacagacacactcacgcccgccacctgctccccgcaggatgtgtctgtgtgtgggaattggtatcttgcacccgtgggagtcgggacatataatggaaaggccctcgggaagttccgcgtcctctgtgggggctgccggaagacacggccccaggagtcaggcccctgtggtcaggtctagcatggggcttgttttccactcctgctgtaagcagccttcgacacctgtcctgccacggcctcccagccggtgcgggagcccctcactgccctgaccgactccgcagtccccggggaggagcatggatggtgtgtcggcagctccgtccttccagctgtcccgttgcagtgcccgtgatccgcgtctgccttagcaggggcctgcgtgagtgggcacggtgtgggaggtcgcctgcgtggggtggtgtctgtgtgtgtgcacgcacgcctgccatcaaagcagcagggctgagggggtgcagcttgctggtgttcactgggggagggcctgtgggcacacatggcagagagagtggctcacacgtcgtgaggtctcccctgtgctctggtgacccgaggaggtcgtgcagcacagcgcagaagcccctgcccacgggatccggccccccagacaccgaccccacaggccgtcccggatctcagcggacacaggcaggagcgccccatcatttgacggtgagcaggactcaggctgtgtgtcctggagctacttctcaccaactgtggtcagtgcagggggaacgaggaggtcttttgggggcctggcgaggggaagggctgctgcagtctagggagagggggtgcagcctgggggatgttggtggacatggatgtggaggtggaaggaggaggacgttgcgtggagtggtgggaggaggcgggagccgtgtgcgagagcaggtggaaagccttgaggggcaggaccaggatgcagctggcttgtagaagagctcaggagtgagcctggcactccagagggcgcggcgggtggggaggcagcaggcaccagtccaggagagcttcgtggacgtggctcctgcgcgcacacccccaggagcacagccacgggctgcaggtgtggctggcctcagcactcagtcctcacccggagcctttgcctgctcctccttccaagagcactgaggcaccagtgggcttggcactccaccttgggcttccttttcctggagagccgccttgagggtccctcctgtgactggggtctctgcagcgagagccgcgggggttgcggagcccctgcctgggggagctggcggaatgtgagccgccggccgggggccgccacataagacctgcaaggtggtgcctggggccctggctccttctcggctgcccctgcccacccagtaacag

SEQ ID NO: 3645 - DNA, 4374 bp, Homo sapiens
gaaagcacacaccatgctggaaaggagagagaaggaaaaacccactcctagccacacaatggtggatcttaatatccaatgaaaagaaaaaattctaatctaggtcacacacaataacccaatataaaatgaacaagacatgatcaagcaaatcaaagaaaaatgtacatcaataaatatgttaagacatgttcaatgttactggtgatcaaggaatttcaaatcaagaccaaaatggtataccatttacaaccatccctctggcaaaaattaaataccaagtgtcagccatgaggtggctcagagctctcctgtattgctagtgaaatgttaactggttcaacaactatgtaagtcagcaggacattatgtcctaaaattgaacattcgtgtgccctatgacctagttactccactcaggtctatataaaagagaaaaccatgcacatatggaacatgcacagcagaaaatgtgaaagaatatctcatgctcttcagaagagcaaaaacctggaaatgaccaaaggcccatcaacagaagagtggataaattaacttcagcagatccacacaaaatatcacagcagtcagaaggaataaaccacagtgaaaaacaacaatacggttgatttttagtaatattactgttatcacttaagtcccaaaaagttacacataggaagataacttagttgcaaacacacagattttttttttttggaaattagatacagtaaaaaaaaaaaaaaattaatacaagatgggagctaatgattactcctagcgaaaagtgaaagaggaaagagtaaaacagatagtggttactgccaagatcctagatttttgttggaaacagtgctcgctacattatacaaaacaactaattttttaaaaggaaaaaggttagtctatggattaacacatggctcactgtacgtgccatgagctcgggatgatagctgatccaatcccatatacacctgaagtcttggggcaggggcggaccacgagtcagcgcgcccccacagcaccaggctgatggccccgtggttcttctgcctgcaagcaaaagtcagccacgatcatccttctccatctgcaacacccagggtcttttctaaaacttttgcccagtcggctcagccaaaaggacacagaagccctgcagaggctctgaaaccaaggtcagtgcctcgtggacagctcccgcgcctggacagctcccgcgcctggacagctccgcgcctggacagctcccactgtcccgcccgcagtgggcgtgtctgggaggcactgagcaggggcgggggtgggctcagcggtgctgaggtacccgcctagggagatgcgcagctggaggcgcatgagggctggagacgcggaaggcgcatggggcgcagcaggctcacggggtatgcagggtacagggaggcgcgaaggggggaggcgcgaggggggaggcgcgtggggcgcagcaggcgcacagggcatgcagggtacagggaggcgcgaggggggaggcgcgtggggcacagcaggcacacggggcatgcagggtacagggaggcgtgaggggtgaggcgcatggggcacggaggatgccgggtggtacaggggataggcagagaggcacaggggtggggaggtatggggcgcggaggggcatgaggaggcgaggggcgcggcgaggcggcgggcagaaggcaccgggagccccatgaggcgcaaaaggtgcggggaggcacggcggccgaggaggcgctgaggaccggggaggcgcaagaggcccaggatgcgcggggtcctggggaagcgcgagaggcctaggagtcgtgggggacatggggaggtgcaggggacccagggaggctcgaggggccaaggaggcgcggaaggctgcagttggggaggggagagaatggggcgggtgggggatggggggcggccgctgcaggaaaagggatgcggtgtttcctggcaagttcagaagccaagcccccaacctcgtaacctgttcacacatagggtgacccctctgtgtcaagagcccctacgggtccctcataatgtgcgggtcacgtcctgaaaaggaggcagaaaaaggccctggaagcgggaagggagtgacccagccgcacggccacgctggcggccactgcatccctcgccggtagagccgggcggggcgcacacccactcctcgccggcttcctcgcagcccagtggccaagggcgacaccggcgagaggccgcagagaaccgcggcctcccagacaagggccaggcagggactgcgggctgccgccaccacgccaggcccccagtcagctcccaagacctgtccccaacatgccaggcctcggcctcccagcactgcagaccccaagctccaggttcacgcggctgcccgccggaacccctaagactcgccggcagagcctccttagaaccacattagaccaagctgtatcatcttttatgtacaaagctgttcgttgtttttcagctgccatggctcccagttcgacatcatgtcaccggagcctgcacagatgaaccaagcttgcaacacgggaggaacctaagcgctggactgaggagcgggactgaaataagaagcgcacaccacatggcaagatccaggatccaatcagatagagccctggtgtcatctaattgcaagatccaatcagaacacacctcattaccttatggtaataagcttatgcttataaaacccgacccagccgccagcttggggagacaggtttgacctttcctcctgtctcgtcgcagtgcagtccactctctccagcaaaaaccctgcgctttggtgtttggctttccctggtgcacaggcaggcgggtccactttggtttggtgacactctaggccatgctcacacactcaccaggcctaccaggacacattcaccaggccctccaaaccatgctcacaggaaccaccaggctgcacacaagggccctccacacaccacacttggccacacccccggggccgcaccttgaggttctccagaatccgcagggacctcggtgccagccaggccacaccacccagcactccaagctacactcactagacccacccggaaaaacaggccacacctctgagtgctccagatagcgcttgccagacccctccagaccacactggccaggctgcacctcggagccctctaggccacgctctcaagggtaccaccatgccaggctgcaccaggccctcacgtgctgctcagtcaggccaccaagtcgcattctgcaggcccaccaggtcgcacctccaagcccaagcaagcccatggtgatttggcctccttgaagccacaaagcctggtgatcctgacttcacaggcagccctcctgcctaccgcagcggccacagcaattatattattgccatggcaattagaacctacaaggcaaacagagaacccttcctgtcctacttcccgatgtgctcaagcaagtcttcctctctcccctgcaccacccacttagcgtttccttcaacatatactattcacgctattttgccaaattaaaaaaaaaaatactcatccaattttttaacctccagcttctctatttatatggatactctttttaaaagatttttattttcttgctaccaccaacacactccttggctacccttcttgtcccctgaactggctgttcccccagagagacacacagctcactccctcaactcaaggtctttacttacgtgtcacattctcagtgacacttaccctatttaatatcctcacacacacacccgagcccccagtactcctgattacccttcctttccttttctgtagcagtcatcacagtttaacatactacttagccattgcttttttcatctgtctcccaccctactaaaatgtaagctccatgaaaaaaagagattcttgcctgttgtagtgactgattcaattccagtacctaaaccggtgcctacatatgactgatagtcaaatagttattataaataaacattaactgttggctatgttttaatataatgtacacatataattttagatgatttaaccaagtaaataagaagaaaatacactataaattattgaaccatacccacacagtagattgttccagcatatttgccacaataaacaatgctaccaaaaaccttttgtacaaatatctacatatagtactacttcttctatccgtttgagtcacaaaagattatgtgaatatacgttttaaaatgttaacaggtattgccagactatcaggagagaccataaatcagataaaaacatgagttgtatccaaaactcaaccaggtatcatcttaaatatccaacagaattc

SEQ ID NO: 3646 - DNA, 2205 bp, Homo sapiens
agttccggtccggcagagatcgcggagagacgcagaacgcagcccgctcctccagggccctccaggccctccggccccgggccggcgggtgaactggggggccccgggacaggccgagccctctgccctgcagataacggaggcctctgctgtggctgcccactggctgtgcccgcccactggctgtgcccagaccttgaagccgcagcgaacctctctttcccaccccacctcggtgactaatggcggccgtggcgtctcccagcccggaccccgccggcacccgggtctcccgacccaagcctcgacgaaacccccgcagagccgccgggacgcagcgcctttgggcggcgctgggcgtggtgggccgggaagtatggcggcagctcgaacgccgcgcggcggaggccattaaggcgtggacggcccgggaaggcggcctagggacgcaagcaggctcggccgcctctttaggccacggagccgcgcagatccggttcccgggtgaccactctgtcgccattgggcgagacctacctagtcctgacgacaacggacaaaggccttaaggggcctggaaggtgagcgaagtcccgaacgacgacgggtggaacggttagcggccatcgggcggttggtcttcattctaccagactttgctgtcggaagagagaaatggtagaatgacaggccacgtttggcccgttggaaatgcccaccaccctctgggaagatttactggccgtttatggaaggcctgtgtatataatatgaaaaagctgctctcaactccaccccaaccttttaatagaaaacatttgtcacatctagcccttctagatggaaagaggttgccgacgtatgataaaatagagttagaaagttacacatcttgtaaattctcatttgtttaaaagaaatcatagaaaatacatgtcttctggagatgacttttggaaatggagttgttaagacggcctctggaagcgatacgtccacgtttgttaagtgggttagatgacatggagctggaagacctgagaaggaagagaagaaggttctatgctagactggtcatatttagaagacattttcatattctatccattgttttgtgtgcattttattcctcactactgtgtatatagttgacaatgctaagcttttttgaaatgtctcttctttttagatgttctgaagtgcctgatatgttaaaattagaggtagcaaaatcacattttgtaaatacctttttgttacaattcataggaaatatttttgggggggaatggccaaatcacctgttgagtaatactcattgtgtttgtgcagtggttcaggggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatgggaagggttctaggccagaatgttcacatttggaagactctttcaaattataactgttgttacatgtttgcagtttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcatagg

SEQ ID NO: 3647 - DNA, 10785 bp, Homo sapiens
acttgacgctgcagggcgggcggggtaaagaagggagcgagcccttctcaagcttggaaagtttccagactgctgggccagcctcctccccagagggaaactgaggtccgattgaggtttctccaagaccgcccactcctgctcctgtccccaaacccctttctgcctagggttcctggaagccaaggaaacagaacgaactgttccctgggtgggcgagccactgcagagtacaaagctttcaggccgcctgcctcattagcactaatggctgctcccttccgccctgtgtcgtcaggactgtctatgcctggtctcatcagcacaaggctggggtaaggactgcccttttgtggagatggcaggacatacaggaccctgctgcccctgccttccctcaccccactgcagagctgtttatcacacacgtgtccatctgggaaaggaatgcaggctgaatcagctttgagaggatcgcaaggccccagtgcacaaactgggttggcacaaggcagtggaaaaaagatgaagggggccaggtatggtggctcacacctgtaattccagcattttgagaggccaaggtgggaggatcacaaggccaggggtttaagaccagcctgggtatcatggtgagaccccgttgctacaaaaaataaaaaaatagctgggtgtagtggtgcatgcctgtagtagaggctgaggtgggaggatggcttgagcacagggattcaagagtgcagtgagctatgactgcatcaccacactccaggctgagcgacagagcaagatcctgtctcaaaaagaaaagaagataaagggtggccaggcacggtggctcacgcctgtaatcccagcattttgggaggccaaggtgggcggatcactggaggtcaggagttcaaaccagcttggccaatatggtgaaaccctatctctactaaaaatacaaaagttattcaggcatggtggcacatgcctgtaatcccacctacccgggaggctgaggcaggagaatcacttgtaacacgggaggcagagactgcagtgagcagagatcgcaccactgcactccaacctgggtgacagagtgagactccatcttaaaaaaaaaatgctatttaaaatgaaatgaagcaatccatactcccaacatttatatatactgggacatccaagaaattaaaatcacacctcattatgtctttttctttgagtcagggtctcactctgtcacccaggctgggcctggtcagcacccatgctatggagagctcttcatggtctggtgtggacagagtgggagtggaagatctcctcccacacaggtgctcagtgtcttacctcacctacgggcagcagctgtcttcacctgagtgtgtgcacacaggtgtatcagccccatgggcagtgatggacgagggctgaggcactcacagggcagcccatgccccggtcaggtccagtgggggagatatcaagaaaacccagcgccaaaatgcaatgagctgtgatcgcgctactgcactccagcctgggcgacaaagcaagttgccgtctcaaaaaacaaaaacaaaactaaacaaaaaaaaaaaaacggccaggtgtagtgattcacaccttcttgagcccaggagtggcaacatagtgagactctgtctctaccaaaaaaaaaaaatttaattagctgaatgtggtgatgcacacctgtagtcccagctactcaggagacagggaggaggatagcttcggcccaggagattgaggctgcagtgagccatggtggtggtggctcacgcctataatcccagcactttgggaggctgaggcaggcagatcacttgagcctaggaattcgaggccagcctgggcaacatggcgaaacccagtccccattaaaaaaaaaaaaaaaaaaggccaggtgcggtggctcacgcctgtaatcccagcactttgggaggccgaggtgggcagatcacaaggtcaggagatggagactatcctgcctagcacagcaaaaccccatctctactaaaaatacaaaaaaaaaaaaaatttagccgggcgtcatagcgggcacctgtaatcacagctacttgggaggctgaggcaggagaatggtgtgaacccaggaggcagagcttgcggtgagccgagatcgcgccactgcactccagcctgggtgactgagcgagactctctcaaaaaaaaaaaaaaaagtttcacagccggatgcagtggctcacgcctgtaatcccagcattttgggaggccaaggtgggcagatcatgaggtcaggagttcaagaccagcctggccaacatggtgaagccccatctctactaaaaatacaaaaattagctgggcatggtggcacgcacctatgatcctagatacttgggaggctgaggcaggagatttacttgaactgggacccaggaggcggaggttgcagttagctgagatcgtgccactgcactccagcctggtaacactccagcctggtaacagagtgagactccatctcaaaaaaaaaaaagtttcactatgtgggtaattttacggtaaggaaccagcctgatattcccaggacaatgcttgttggcaaaaggaccttcagaaatatgtggcatgttctgggaggaggatttgggaaaccctgggggaggcagagcctcctaagtgagggtgtgggcccggaacacagggactctgtgcagggaggagaaaggggagagtgtgcatgctcgttccagagaccacatgaggacagagaggggtgctcaaaccctctcccttctcttctttttcctcctgcagtgtactccccttcaagggccctgttcccaccttgtccaggggagagggtggggggtgcagggaaaaactgcaagcacccgtggctctgtcaatcagggttgattttgaaacccctacccagcccattgcccctgccccagagagcacagccatgtgtttcctgtgaatcatctgtaggatttcctaaggcagaggttgcctggagaggcacggtctcctcagtcattcagggagaggagaagatggatgggggttctctcgggctggtgtattgagccctgagctagagaggatctgtgattgttaattttgtgtgtcaacttgactgggccaggaatgcccagatatctggttaaatattatttctaggtgtgcctgtgagggtgtttccagaatcatccaatcctttgagggttggaataaaacaaaaagatagagaaagttggtgccgtggctcatgcctgtaatcccaccactttgggaagccgaggtgggagactgtcttgagcccaggagtttgagaccagcctgggtaacatacagagacccaatctctacaaaaaaatttaaaaatagccagacacagtggtgcacatcagtggtcccagtgactccagaggctgaggtggggaggatcgcttgatcccaggaggttaaagctgtagtgagccatgatcacactactgcattccagcttatgcacatgagaccttgtcttaaaaaaataaaaaattttaaaaaagaaagaaaactggaaacaatccaaatatccatcaacagcaaaatggataataacattatagtgatataattgggccaggcacagtggctcacacctgtaatcctggcactttggaaggccgagacgagtggatcacttgagctcaggagttccagaccagcctgagcaacatgacaaaaccctgtctcttcaaaaattacaaaaattagctagacatggtggcgcaagcctgtagtcccagcttctcgagaggctgaggtgggaggatcacttgaatccaggaggcagaggttgcagtgaaccaagattgcaccactgcactccagcatgggtgacagagtgagaccctatctcaaacaaacaaacaaaagtatgtttatataattgacaactatacagcaatgacaagagaataaactactgctacacactgcaacatgaatgaattgcacagacataaggttgaatgaaagaagcatgctgcagaagagtgaggatggaatgaatccagccctatgacattcagacccaagcaaaattataataaatggtgataaaacacaacagcggttaactctgggagggtgggaaattattgactgaggggggaaatgaggaaaacatgtgaggtgttggaaaggttttgtatcttgatctcagtggtggtcacgcaggtatataagtatgtaaaatttcatcaagctgcacatttaagacttgtgtattttgccaagtgcagtggctcacacctgtaatcccagcactttgggaggccaaagtgggcagatcacctgagatcaggagttcgagaccagcctggccaatatggcaaaacctcgtctccactaaaaataaaaaattagccagatgtggtggtgtgtgcctgtagtcccagctactcaggaggttcaggcaggagaatcacttgaacccaggaggcggaggttgcagtcagccaagattgtgccactgcactccagcctgggtgacagagtaagactccatctcaaaatatatatatatattgtattttttattggatattatgtctcaatgaaaacattttttcttttcctttattagtggctcaaaaaataatggagtgtctggctggacgctgtggctcccgcctgtaatcccagcactttgggaggccgaggcgggtggatcacaaggtcaggtcaggagttcgagaccagcctgaccaacatggtgaaactccatctctactaaaaatacaaaaattagccaggcacggtggcacgtgcctgtaattccagctactcaggaggctgaggcaggagaattgcttgaaccctggaggcggagggttgcggtgagccgagattgcatcactgcactccagcctgggtgacagagcgagactccgtctcaaaaaaaaaaaagaaaaagaaagaaagaaacttccctcatctctgtagctatttgtgtaacttcccctatctgtgtaactactgttaactgtgcagctgtgggcatgtctttaggaaagcatatgtagcttctcttgtctctgtagttgcaggtatgttttagcatcctataggagaaagtcacctttgtctccaaattccctggtcctggttttgaaaatcctgctggcacctactgctgaaggctgtggctggagaattcagtgagctactctgatctggacagggtctgatggtcctcacttgacctaagctgagctctcccaggctgtgagcatccccaaggtcagcctgtgactctcacagaagttctgacctccagagccttccccctgctgtggcctttggggtagagtaggttacatgggccagcaccatctgccaaagtcagggccagaaacctatccatgggagccagatttggcttttggcttgggctagtattgactttgggcacattctcatcccagaaagaataatttggggtatgggatttcatgttttctttagtacagccttgaaagccacgtgtacagggtgttttcttgctaagatagcagtcgggctatatttgagcagtccagagaagtttaaactacagaggcatctggatattgtcacagtcttgtctgaggtcaatagcttgcaagcggtagagctgagagtcatactggggagtctgaccctgtaatgaccccctggtcactatgctcagaaataatgacacctggagttgtatttttcagcacagattgactttgaataataaatacgtaagaatatttcttcaattacacacacacacacacacacacacacacacacacacacacacacacatacatacacaattatgccatttctcatcttccctgaagcacatggccctttggcctctcttttattttcatacttttttttttttttgagatgaagtctggctctgtcgcccaggtggagtgcagtggcacagtctcagctcactgcaacccctcctgggttcaagcagttctcctgcctcagcctcccaggtagctgggattacaggcgtgtgtcaccacacccagctaatttttgtatttttagtgtagacggggtttcaccacgttggccaggctggtcttgaacttcaggtgacttcaggtgatccacctgcctcggcctctcaaagtggtaggattacagccatgagctaccatgcccggcctgtcatactttttttcggaaacaaaagattagttctgtatttcaacattaacaatgaccacactctgactcaatattggggaagttttgaaaccaacccaatagtcccatagacagcttttttggataaacatagaaatcaacccttctgatcctaaagcttgaaacttacatttgttttatctgagttcccctctcaggaaaggatccccagtcctctcaaaaagtatcaaagaactgaaacccaccagatcatcccatccagacaatgagactcaagggccctcattcatcatgatttgcttccttaccccttgcatttgttttcccacacacaattacatttcttccctgctatataaactcctaattttagtccatcagggagatggatttgagaccgatctcccgtcttctcacctgcatcacccgattaaagccttcttccttggcaataattgtctcagtgattggctttctgtgtggtgagcagcatgacctagaccaaacctgtggtattttaataacagtttgaagagtgtgagtttggcctgaagggagaagccattgatggcaggcagagatgtaggcccaggtttgccagagcttcagacttttttttttttttaagatggaatctcgctctgttgcccaggctggagcacaatggcgtgatcttggctcactgcaacctccacctcctgggttcaggcaattctcctgcctcagtctcccgagtagctgggattacaggcatgtgccaccacacccagctaagagcttcaggtttttaaagaaaagagagaaaacagaagtttttttttttttttttgagacggagtctcactctgtcgcccaggctggagtgcagtggtgcgatctcggctcactgcaagctctgtctcccaggttcacgccattctcctgcctcagcctcccgagtagctgttctacaggcgcccaccaccacacccggctaattttttgaatttttagtagagacagggtttcaccgtgttagccaggatggtctcaatctcctgacctcatgatctgcctgccttgacctcccaaagtgctggggttacaggcgtgagccaagaaaacagaacttttaaatgatgtttacatgtctagcttcaaaaaatgccatgcaggttgtcggtttcccacttccagggtaactggatggaatttctgccttcatggtggttcaagcctgaagtgccttgagaccagaagtaaagagttccttcctcctgcagcactgctaggtttcctggaggagacggtctgtaggtggggttcctaaaggtggagagaagaggaagttacttcctaaagagaaggaagatagggggtaacttcagtgtggcttttgcagagttgttcatgacaggaatcctatcaggccctgaagtttccatcagcacagcccccaaccctcactgtcccacacccttagcttcctggttctagtctcaagggattctgctcacttctgtcctcgctttttttctccctgggaaccaagtaacagctgaagaagtcccaggagtcctcccatgtcctctcagcaacccaggctggagcctactccttggtgttggcaaaggaaaccgtctttgaagagccccagtgagtccctgctctgcaatgctcatacccattgtgctgttactgcaagtcaatgagaacgttggtggacttctctccacttcacagaagaatgaatggaggcccagaacaatggcatgaacctgtcgtttcttggccttttggctaagatcaagtgcaatggcatgaacctgaccatagtcgtagacaaacaagaggcagagacattgtcttagtttgagttcccacttcagaaaaccttgagacaaacattgtagcacaggaagtttattaagaggatacaagccaggcatggtggctcacgcctgtaatcccaacactttgggaggccagggtggacagattgcctgagcccaggagttcaaaaccagcctgggcaacatggggaaatcctgtctataaaaaatacaaaacttaggctgggcgcagtggctcacgcccgtaatcccagcactctgggaggctgacatggctggatcacttgaggtcaggagtttgagatcagcctggccaacacggtgaatgaaaccccatttctactaaaaatacaaaaattatccaggtgttgtggtgtgcacctgtaatcctagctacttgggaggctgaggcaggaggctcacttgaacctgggaggcagaggttgcagtgagctgagatcgtgccactgccactccagcctgggtgacagcgagactctgtctcaaaaaaaaaatagcctggcattgtggcatatacctgcagtcccagctattagggaggcttaggtgggaggattgcttaagcctaggaggtcaagactgcagtaagccagccgggggcggtgggtcaagcctataatcccagcactttgggaggccgaggcaggcggatcatgaggtcaggagatcaagaccatcctggctaacatggtgaaaccctgtctctgctaaaaatacaaaaaaattagccgggtgtggtggcgggcgcctgtagtcccagctactcaggaggctgaggcaggagaatggcttgaacccgggaggcagagcttacagtgagctgagattgcaccactgcactccagcctgggcgacagagcaagactccatctcaaaaaaaaaagactgcagtaagccgtgagcatgccactacactcagtctgggcgacagagcaagaccctgtctcaaaaataaataaggaaataaaagaggatacaaagaacaagcgtacaaaaatacagggagggaagacagccactataaagtgggtcataagcagggttccaccagggatgcctggtccccccggggtgtgggtggggaactctgggctgcagtgcagaatgcatgtctcagagaagttccacccaaggcaggaggaaggtgagtagatatacagcaaccctgtctcagtcccttggagggttgttgggggagagttaactcctagcacttctgaccaacttgtagagtgagctcagaaagccccagacacatcagaggcagataccagcagtggacaccaagagtctgttccacgtgtgtctaagcatacttatcccccaaaatgtggcgcccacaccaacagcatcagcctaaggtaggaacctgggaggatgttaagtctggctctgccccaacataatgaatcacaaactcctggggtagggctcagctgctagagtttgtttgtttatttgtttgtttgtttgtttgttttgaaatggagtctcactgtgtcgcccaggctggagtgcagtggctccatctcggctcactgcaacctccgcttcccaggttccagcgattctcctgcctcagcctcccgagtagctgggactacaggcacgagccaccatgcccggctaatttttgtgttttttagtagagacaagctttcactatattagccaggctggtctcgaacccctgacctcgtgatccgcccacctcggcctccccaagtgcagggattacagatgtgagccaccgcgcccggccaactgctagagttttaacagacctttcaggtggctctgatgtgactgagctttgagaatctctgccctaacccaccatttctaactccaaagcccaaggtctttctggtactagatgatggctgaggcctgcagccaattagtgggaagggctgctggggatgttagaggcagaggaataagcggcctgacactcagctccggggacaccaaataggtgctggcccttgtaacccagtgaggaggcagcgctcattcctttatcttaaaatatgtcctgagcacttactgcatgccagagcctggtgcaaatgcttagggcttactaggaacctgggggtggagggagcagggttgatgtgaaggctgggtattgaacacaaagaatttgggtcttttggggctcctgtggtctggtccactccttggagatacccaccaggagatgactcagccttcctagtccaggaaggcccccgcctctttttctgtgagcccagccatcaccttattgccttcagcatgtcctgaatggattttgtcactgttactggggcctgcaaagcacacagccctcgtggtccagctaagaccacctggccacaggccggcccacagccgtacttgcagggtgaaccaaagtcaaggaagggtccagagaagctgggtctgaatgccacccaccacttccccatgtcaggagatgacacttatgtggacaccccagggattcctatgattcctccaacccatcaccttttctagagcacccctcactcctctctccagagtctcccacctttccagcactggcttcccaagttccactctctgcagcctccatctgtggcctggaccccaggatccaaccccctaaactccttctaggcaaccatcttgggcaacttcacccaatgacaacctatgctcctcctgttattgacag

SEQ ID NO: 3648 - DNA, 1042 bp, Homo sapiens
agcctgggcttgagcgcgcgcagaagtcagcttcgtgacttccttctcaggatggaaccagcttggtggcttgagggtatgtaaaagcaatatctgagccttctgcctgcttccaatatgactaagcttaaaaggagataacccaaaaactgcaggatcatcctgattttctgatctccaaaacaataaaaccttgaatatttccctggactcccttaaacagtttaatccctaatatttaccttgctaatctctgacctttgtgacattaatttgtctgacctttgtgagtataataaccatgtgagaaagttactgtttttccaccatgaacagactactgtcaaccggtaatcctggtaattttaggggatttttttttccctttaagtactggttggcaaactagtccttccgtctaactcctcgcatcttttgcaagtaaaccccttttctaagtgaatctatctctgagtctttctttgacatgtgccagtgttacaatctgtctttagatatgctctggcttacagagaaaaaagaacgaaacttttaacactttttgcttctgcttcccgtgtgagggagtcttcgttgcaatgacaactcttaaacgaaagcaaaacaaaaataattgcagaagtccacagaagcaaacacaaacaaatgaaactttccatttaaaacaggactgtaacctcaaatatcctcaaaatccagatcggtggttctcagtcttgactgagctttggaatcacttagggagtatatacatatacacgtgtgtgtgtgtgtgtgtttgtgtctgtgtgtgtgtgtgtgtgtgtgtgtgtgtgtgtgtgtgtgtgtatactgatttctgtgtcctatcccagagattctgatgtaactagtcttgagtgaagccaatcagaattttttaaagcataggatacggctgtgcatttgaagctggaagccactaacccaggcgctgatcaatgaagaactaggctggagtgctgtcttacaaggtcatatcattagcacatccttcccattg

SEQ ID NO: 3649 - DNA, 1348 bp, Homo sapiens
gagtcttgctctgtcacccaggctggagtacagtggtgcaatctcggctcactgcaagctccgcctcctgggttcacaccattctcctgcctcagcctcccaagtagctgggactacaggtatcctccaccacgcccggctaatttttgtatttttagtagagacggggtttcaccgtgttagccaggatggtctcgatctcctgacctcgtgatctgcccccacggcctcccgaagtgctgggattacaggcgtgagccaccgcgcccggccaagccactaaaattttctttccagggggatgtgactttaaaaactagggaaatgaatagaatcttatctgctgggaatcttgcttcaacaagatctcttagacttgctttggcctcattacaactctacaaaaaaaggaattttttttaaacctcaaataattgaggtaattaatttctttcttcaattcatggcacactctttacattattcttgcaaagcccctctgtgttactttttttgttttattcttcagttcatctccactttcccctatatacaaccacttaaaatatgcctttccagtcgactacttatgtatttatttagcaatatgtttctttatataatatgaaaaatacgtatgtacacacagtggtttttagacatatcagttgtattatgctataaatcttattgtttttaaattctgtttctgtttcttttgagttgaaaaaatgtgtaactctagttcattggttttgattgctataaggtattccatcagaggcatacacaacattttacttacaaattcctctagaaatgaaaacctaggttgcctgcaactcattgtcactgcaaataatacttcagtgatttttttaatacatggacttgtgtatggaatccagtttccaaggtatccccaagtgacccttgtcttctagtattcatgcccatgtataatccctttccacattgtgtcggggttaatctttgtgaccaacctaatatggcatagtgatagctttgtgaattcccagactaagtcataaaataacactgctgcttccgccttgttctcttggattacttgttctcggcaaaaccagccattatgttatgaggatgctttagcagcccagccctatggagcagccaatagctaccaccagcttaccagccctgtgcctgaggcatcttagaagtggatcctttagcccaagttaaacattcagatgaccggagccccagccaacatctcgactgaaacttcataagcaaccctgagccagaactatccagctaagccactcctgatttcttgacccacaaaaactatgagataata

SEQ ID NO: 3650 - DNA, 586 bp, Homo sapiens
aaaaagggtaaaaagaaaaaggagggaatagtaggaaataacctatatgtgattatctattttcaattctaagtggcttggtataggtttaggcaggctacctggaaagaaagaaataaagaagcagaatgtactgagccaccccctccaccttccttctttccctttcacccagtggccaggcatctatcggtgggggccccctcatctaccccttccccactccacaaagaaatttagtttaagctagcttgcaacatagataattgtaccctttcttatcagctaagtgcagccactagagccgtaagtcaaatgtttgaaaaatcctgagagtcataatgcatcgtgtgctgcaataaaatgcagcagaaagaccctaaagaatgtacttgaagaacaatcaataggtgatgtctaggaagattgtggaaggctagtactcagcctatgaggaactgagggagggacctgtgcactagggcgtaaattgcttgttgaaactgtgctgggtgtgcctgcatgccagacacccgatcttgcaagaccgtcattaaaagtctcactttcgctgttctctgggtct

SEQ ID NO: 3651 - DNA, 10611 bp, Homo sapiens
gcacggcacccacctcggggcagcggcttcacctccccgttctcctcccgggaggccccgccggcctctcgggccccaccgagaccgtgcctcctcctctccttctcccgcttctccttaggtctgcgcgacttggcgttagccgaggcagcggcggcggcggcgggcaggaggagatggtgaggctgagcgtgcagcagcgtaggagggaccagcagtttgcgcggcaccggctgagacaaggaagcggaggctgaggagggaacggccgtgccagcggagaaagagaaactgctccgagaagaggacggggagggagcagcagacagaggggcaaagctccaagacgcggggctgccatagctctgaggcgaaggtgctgccggcggctgcagctgcctgctgttcccgccgctgcccccttctccgttcactctccgcggtgccttcttctcctcagtccggaccttcttggcggacagagaacccggagggtcccgggaggagagttgcagcttgccaaacggttctttctccgagacggtggcggtgggggccgcggcagcgacacagtgcacggggctcggcggttccgccattttgcgctcctgttgtatttactctcctccgctagccggcgcggggcagggggcgggccctccgcgaggggtagggaaggggcggagcggccaggccaccagccggcattgctccattgggcaagccacgctgagggatccacctaagagccaatcaaaggcacaaacatcagacgaaggggcgggatcgccacagggaccctcttcggaggtcagagctcggcggggtgcggctagtggcggagcgcgctgcgaggggagggctttccactgtcgctggcgtgaactcgcgtgcccggtgggtatcagggaagaacccccgccccggacccccagatctgccatggccgaggtagcgatcgtctctgcggccacgaagactgttttaacttgtaccactttcccttccatttttcctggggtgcctctcaccctgcatctgcgcgttcagcaagctggatttcgggaatgctcagttcagaagagaaaaaattgccgggaatcaagtccttctttttgttagtcggtagtcgattgatgggaagtgttcaaaatcattcgatgtggtgacaaggtacgttattattgctagatcatgtgctgtaatccattgaaggagataacttccagcaaatctagaactttagtattacttacaagcttgaaggtgagagtctccctttggagacttttgaactgttgtgactagacccttaagatttttattttatttatttatttatttattgggacggagttttgctctgttgtcgaggctggagtgccgtggcgcgatctcggctcaccgcaacctccgcctcccagattcaagcgattctcctgcctcagcctccccagtaacagggactacaggcgtccggcaccatgcttggctaatttttgtgtttattagagacggggtttcaccatgttggccaggctggactcgaactcctgatctcaggtgagcggcccacctccgcttcccaaagtgctgggattacaggcgtgagccaccatgtgcggccttaagatttgaattttataataattattatagccgggcgcggtggctcacacctgtaatcccagcactttgggagaccggggcgggcggatcacgaggtcagaagttcgagaccagcctgaccaacatggtgaaaccccgtctctactaaaaatgcaaaaattagctgggcatggaagcgcgcacctgtaatcccagctactggggaggctggggcaggagaatcgcttgaacccaggaggcggaggttgcagtgagccgagactgcgccactgcactccagcttgggcgacagggcaagactccgtctcaaaaaataataataataataataatattattattattataacgtagacttgccaggaaaaattcgttggcgattatttatggatgtttgaaaagcaagaattgtttttttaggtttctgtattttagcgtttagtaagcacactgcgtgttcgatgttttgtaagcatgtgctttgatttttgcttcgaaaataagcaatttggggagatgggttttagcttaaaagataaggaatgtggccgggcgcggtggctcatacctgtaatcccagcactttgggaggccaaggcgggcagatcacaatgtcaggagttcgagaccagcctggccaacatagtgaaaccctgcctctactaaaaatacataattagctgggcgtagtggcatgcgcctgtagtcccagctactctggaggctgaggcagaagaatcccttgaatctgtaaggcagaggttgcagtaagctgagttcgtgccattgcactccacccggggcgacagtgcctatttactcatttttttaagaatatttttaagaattttttttttttcggccaagagtggtgggtggctcacgcatgtaatcccaagactttaggaggcggtgatgggtggatcacctgaggtcaggagtttgaaaccagcctgactgacatggtgcaaccccgtctctactaaaaatacaaaaaaaattagccaggcgtggtggtgcgtgcttgtagtcccagctcctcgggaggctaagacaaaagactcgcttgacccctggaggtggaggttgcagtgagctgagatcgtgccactgcactccagcctgggtgacagagtaagactccatctcaaaaaaaaaaaaaagaatgttttggagtcaaatttaatattggtttatggacttatttttatgtgcctcaaattttttaaagtaataacagtatttaatatgtaacatgaaaactttctaattggaattgactggcagcagatgtcttcaagaaaattagcattggtgggagagtggactgagtggattaggctggaaatcatctgctaacgcactagtttcgtgaccttagtcaggctgcttcacttgttaggacctccgttttcttacctgttgagttagcatatttgattacgtgatcactaaggtcccttccacactcaacttatgccatattcaagaagcttttcaaaatcacaccgaaaccattacaattgaattcattttttaattgttggccctcctgatctagaaaagtgtctctaacatacattaatgtagtgcctggaaacttgcaccactcattctctaatctctagcacacaggtctggaaaatcggacttcttaagagcccagttaaactacacccttgcctgcatgaatttgttactccttgcattacattatactttcatgcactgttattaggcctggcacttaatttgtagagcctaagcaagagtgtggctatagaggtccacacaccatctgtctaaatatttaaaaaataaatcaagataacaaactattatataaaatacattctattctactaccttgacagatccactttcatatgatctggaagtccatgtttgaatttagagttcttagagtccccacactgaccccattctcctcccatccccaagttcacctgccacacggaaaggccatacatgcacccaacatgtccaggtgtatgtccacatccccctactccgcaaatggtgatgtacaatcggcagctcactctgccctcagatctagccagtctaaaagaggagggcaggctccaggcagacatggcccctgacctcatgggctccttgttctttacagcaagaggagggccaagtaaacagaggccccttacccagatctaaagacaggacttgtctgttattaaaacatgcgcaactatctcttttctgtgctgtgtaattagccattccctttcaactagattattcttgtcaacacttaactggcagaggttttctaccactatcaccaatttcttttagcataatctctttataatctcatataggttttccattctacagctagaaagctcttttcaaaaccttggccgggtacagtggctcatgcctgtaatcccagcactttgggaggccgaggcaggcagatcacctgaggtcaggagtttgagaccagcctagccaacatggtgaaactttgtctctactaaaaatacaaaaattagctgggcatggtggcacgtccttgtagtccagctactcgggaggctgtggtagagaatcgcttgaatctgggagacggaggttgcagcgagccaagatcacgccactgcactccagcctgggcgacagaatgagactctgtctcaaaaaaaaaaaaaaaacgaaaacgaaaaaacctggatctgaccatctctcttgccttgcttcagacctgaagtcaatggctttcattgctctcgggacaaaaaacaaaatccttaatgtgtcctgtaagacctttcatgaactatccccttcttctatttcaaactaacaggtctttaatctccagaacccaccatgttgtctttcaacatagaaacattgcatatgtgattctctctacttgacgtgctttttcctttggctgttgcctatgtgatgatttggataatgaacataagggaggcagatatcatgaataccttctatatttctaaccagcaaaacttggcagtggtaccattccctgagccaagaaacagtggaagagtgacaagtttcaggtactcttggaccttggacctgttgaacgcgacgtgccttttctcatctccattcctttttgcttttcagtcgttggtgttgttgactcactggttatctcttgcttccttttccatttcattctctgtaacagctctaccgaaagcatactaccctacctaccctacaccctgcttctccaccttttttttttcttttttcttttttttttttttttttttgaggtcaggtctcagctctatcacccaggctacagtgcagtggcagcttcacagctcgctgcagccttgacctcctgggctcaagcattccccccacctcagcctcccgagtagctgggactaaggcatttgccaccatacctagctaatttttgtatttttgtagagacagggtttcgccatgttgttgcccaggctggtcgagaactcctgggctcaaacactctgaccaccacggtctcccaaagtgctgggattacagacatgagccagcatagccagccgaaactgggtcttttataaagaacagaaatttattttgtcacaattctaggggctgggagcccaagatcacggcactggcaggttcatttgtttgatatgggccacatcctcctgaggggaggaacatattggcctcacatggtagaaggcagcaggctgaaggcttcatgaggcctctattatcttatttattttgagacagaatttttttttttttttttttttggagacggaatctgtctctgacgcccaggctggagtgcagtggtgcgatctcagctcactgcaagctccgcctcccgggttcacgccattctcctgcctcagcctcccgagtagctgggactacaggcgcccgccactacgcccggctaatttttgtatttttagtagagacagggtttcaccgtgttagccaggatggtctcgatctcctgacctcgtgatccgcccacctcggcctcccaaagtgctgggattacaggcgtgagccaccacgcccggcctgacagaatcttgttttgtcgcccaggctggagtgcagtggcgcaactgcagcctcgacctcctggactaaagtgatcctaccacctcagcctcccaggtagctaggacttcagacactcgccataactcccagctaatttttgcttatgttttgtagagatggggcctcactgtgttacccaggctggtcacaaactcctgggctcaagcgatccacttgcccatgaagcctcttgtaatcccataaacctcattcacaagagagcaacccctctggcctaaacacgtcttaaaggccccacatcttaataccattacattggccattaagtttcaacacctgaattttggaggggacacattgaaaccatagcaatgggtaaaaaataataagtcagagtcaggttgaatgtgagatcacaggaagtggagggtactatagaaaactgggaatatgatgtgttttctacaatatacatttgtgtttctcagctctcgctgctcgttcccttatggaaatagtggtcctacttgctaaatatatagattttttaatgggaagtttcctaaaacaccatgcaagccaaacaaacatctgtgagtcagttataacccacagactagcaggctgacttctgatctagaaaggagtagcttcgttttgttaagatcgttttgagagttttgtttattttaattcacaaccctgtctttgtccgttgctggaatagatgctaatcgaatatattcaaacttccagccataacaaatgtgtgttcgcagtgcttagagctgtcctctgtacaacctagaatctggtttctctgcacgtgacatccttctgcctttctgagctgaactgtattttcactctgcacatgtactatccctctggccttgtccaggttcctgatccccttgtataaagaaagcagttatttgacccttgtactttatgcagccatgtactaaccttaaagacatttctggccaggtgcagtggctcacgcctgtaatcccagcactttggaaggccgaggcaggtagatcataaggtcaggagtttgagaccagcctggccaacaaggtgaaacctcatctctcctaaaaatatgaaaaaattagccaggcgtggtggcacatgcctgtagtcccaactactccagaggctgaggcaggagaatcgcttgaacttgggaggcggaggttacagccaggcaagactgtgccattgcactctagcctgggtgacagggtgagattccgtctcaaaacaaacaaacaaaaaaggacatttcttctgtccttatggcatagatatctcaaagctctacctccaccacgttgacctgctcatctttttttttttttgagacagaatttcactcttgttgcccaggctggagtgcgatggcacgatctcggctcactgcaacctctgcctcccgggttcaactgattctcctgcgtcagcctcccgagtagctgggattacaggcatgcgccaccacactcggctaattttttgtatttttagtagagacggggcttctccatgttggtcagtcaggctggtctcgaactcccgacctcaggtgatctgcccgccttggcctcccaaagtactgggattacaggcatgagccaccacgcccagccgacctgctcatctttatgtgtctttctcatttgaatcaatcaatcactggccagttataaaggctggtactctgctttcagaaaacctgaaacctttaaactttcatgctgtcagttccagtgtagtccatactctagtacaggggccagcaaactttttctgtaaacagacgtatagtaaatattttaggctttgcagacctaaaatatttgtaaatattttaggctttgtggtctctgtggcagctgctgctcatagcacaaaagcagccatagacaagatataaaggaatgggcatggctgtgttccaaaacaactttatggaaacaggagacaggatgggtttggcctgtaggtcatagtttgctggctcctatgaattttgtgttttttgttttttgttttgttttgttttgttttttgagatggagtctcactctgtcgcccaggctggagtgcagtggtgcagtctcagctcactgcaacctccgcctcccgggttcaagcaattctcctgcctcagcctcccaagtagctgggattacaggcacccgccaccatgcccggctaatttttgtattcaataaattgtttttcaggctaggtgcagtggctcactcctgtaatcccagcactttgggaggctgaggtgggcagactgcctgaggtcaggagttcgagaccagcctggctaacatagtgaaaccccatctctactaaaaatacaaaaaattagccaggtgtggtggtgtgcacctgtaaaccctgctacttgggaggctgaggcgggggaatcacatgaacctgggaggtggagattgcattgagccattgcactccagcctgggcgacagtgtgagactccacctcaaaaataaataaataaataatttttttttttgttaatggctccccaatttatatctctaaacctgactgctcctctgtgtttgtgatctaactactccacatcttccacagatatgtcagcacttaaaactcagcatatctatgacagagactgctcatttcctgccaagtatctgtttctcccttcttccttattacctgatcccttaattcattgagattgcaaagtatctagctaagaaaaaaaaaagttgcttgcccttctttctcttagggatagcagtgacatgtcagggaaagtctttgggtgaggttttcagggaagttcctgggtgaagaggagaggaaacccctttctctctttcctgaaatttggagaaggcgatgtggggcagtaattatgaagattgtaagctttcagctcatattttgcttattcaacatttcaggtaattcaggtaaattgaattctcaactctttatttttctgagaccaagtctcactctgttgcccaggctagaatgcagtggcgtgatttcagctcactgcagcctctgccttctgggttcaagcaattctcccacctcagcctcccaagtagctgggattacaggcatgcaccaccacgcccagctaatttttgtatttttagtacagacggggtttcaccatgttggccagtctggtctcaaactcctggcctcaagtgaggcctccacccacttcagcctcccagagtactggaattacaggcgtcagccaccatgcccagccaaattctcacctcttaaccagaaaattgtctcactacaaatatagcctaaccacttgctcaaccacagtcttctttccagtttgaatgtgtacttaaggagagcaaactgggggaaaataaagttgaaaattgtagtacaggcatcagccactgcttaaaggcttcactgaagagccattagcagccacacagcaggaagcaaaaggtagagagagtaaaaggggccaaatagagtaaatagaaactatccataaatgtctctcctggggttaattatgctgccagaattttcatatggaagaacatcagctcattttgatacttattttaagaaagggataggaggcctataaaatgtgtatcaggagccttattcaataatataaatctctgaaaagaaaagcttaagttttgtggttgtttaaaaaaaaaaaaaaggtttgtggttccagtcaattctccaggaagaggaagctattttaggtaagaactggtaggtagagagtaaagtgtatttatccacaccttgaagcctaggtctggcaaagaaatgtaaggaaaaatgatagactcatagaatgtctgaattgcaaatgcagccctgtacgtaatttgttaattttctttactatcctttactttctttttgaacagtgaataacctccagaataaccattcttggcttcatagtttgagccacactgtcagaccacttgtggttaagaggatagtgtttactgagtgccttgtgtatctcttatgtttgtgggtgttatgcatcatcccagttctacaaagctttccaaggcatttttcaaaactgagctggaatttcatgtttattctgactctacaccagttttctttctaatatatcctattttgcaagaggaagcagaagtctaaagcatcaaaatgttaaatccagacattggtcagggctctttagaagtttaagttaatttaagttttatgtttagaaaataggcattcaaaaaagatgcagtgtttcttagagtgctggtagattccagtgcttttatctcatagaaaagaacaggtttgaatgtgtccccgaaagttgtgtgtcccccagagttcatgggttagaaacttaatctctaatgcaacagtgttcagaggtgggacctttaagaggtgattaggttatgagggctccgccctcatgaaaggattaatgccattatccaggagtagattagtttttacaggatcgggttcctgataactgataacccacagttagaagagtgcagttttgtacaaatactgcacatgccagtagagccaacaaagtacaaaactatgactgtcacaaagttatttcataattttaattttgcagattctgctttgaaaagcttgtctgtatgatttatgtgccttgaggtaacaatatgatgctatcctaatacatattttgcctcagattcaagtgctggctcttcttgattcccctcaaattaataactacttctataccattagtttgaaaatagatgaataattaaaacagctaaagacccatcaaggaaataacctctctctctttttttt

SEQ ID NO: 3652 - DNA, 1577 bp, Homo sapiens
gggaattgcttgaaccagggaggtggaggttgcagtgagccaagatcgcaccactgcactccagcatgggtgacagagcaagactctgcctcaaaaaaaaaaattcaaaaaaaagtttaaaaaaatagtaattcaatgtcaggaaggataaattaacaagtatcatcatatactggtatgaggtgtaaactgattcacactttctgaaaacccatttggcagtacatatcaagagactacactactcaggaagctgaggtgggaggattgcttaagcataggagatcgaggttgcagtgggctatgacaacaccactgcactccagcctggtcaacagagtgagatcctgtctcaaaacagaaagaaaatttccataataataattttctcaatgtttgccaaagtgctcagcctgggcaatagagcaagaccctgtctgaaaaataaaataaaataaaaatgtaaaaataagccaggtacagtggcacatgcctataatcccagctactcaggtggatgaagcatgagaaatgcctgaacccaggaggcagaggttgcagtgagccaagatcacgccactgccctccaacctggacgacacagcaagactgtctcaaagaaaaaagaaggccaggtgcggtggccttaccaacatggtgaaaccccatctctactaaaaatacaaaaatcagcagggcatggtggcgtgcgcctgtaattccgctactcaggaggctgaggcacaagaattgcttgaacccgggaggcagatgttgcagtgagccgagattgtgccactgcactgcagcctgggcgacagagcaagactccatctcaaaaaaaaaaaaaaaatgtaaatcactttatttgatagaaaagagttaacctaagttaagtaaataaaccatcatttcttatgatgtagccagttcataatacacaaatatgcaaaataaaaatttttttcaatccagctagtgatcagtagatttaataagtcaccattttgtaaccaccaaattcagtttgtttgcttgtttgttttaaaaaaaaacttttaaaatgttgatcctcactgagggcacatttgcactattacaggtacgtgtactgatacattgctaagaaaagagtaaattggtgcagcccttttggaaaaagttggcaccagacatcaagaattctaaaaatgtttatactctgacatgttcatgtcaccctgagaatatatcttaaagaccacaaagtgtgtataattatggcaaccttatgttccagattttctaagaaggtgttcactgtaaataattgtgttcttttcaataaaggcaaatcagtaagttagtaactaagtttgagaataatggaagtcatccttactaattaagagtgatcttgaaagcctcgggtgctaagggtcttttttctttttacccctgtcctgagtattcccttatatccttccctcaaaggccaaagctagagacagcagatacgtttttatgcaattggacctcaatgcttctcgaaatatgcgaatgaacaactttcttgaatgtcttaccccaccactctt

SEQ ID NO: 3653 - DNA, 618 bp, Homo sapiens
ggacaactcggtggtggccactgcgcagaccagacttcgctcgttctcgcatgcctcgctccgcttttcctccgcaaccatgtctgacaaacccgatatggctgagattgagaaattcgataagtcgaaactgaagaagacagagatgcaagagaaaaatccactgccttccaaagaaacgattgaacaggagaagcaagcaagcgaatcgtaatgaggcgtgcaccgccaatatgcattgtacattccacaagtattgccttcttattttacttcttttagctgtttaactttgtaagatgcaaagaggttggatcaagtttaaatgactatgctgcccctttcacatcaaagaactactgacaacgaaggctgcgcctgcctctcccatctgtctatctggctggcagggaaggaaagaacttgcttgttggtgaaggaagaagtggggtgggacgacagtgaaatctagagtaaaaccaggctggcccaaggtgtcctgcaggctgtaatgcagtttaatcagagtgccatttttttttttgttcaaatgattttaattattggaatgcacagtttttttaatatgcaaataaaaagtttaaaaacttaaaaaaa

SEQ ID NO: 3654 - DNA, 540 bp, Homo sapiens
gagaatggcccagagctgggggctgccaggcggttcctgggcccctctcagcaccagaagaaggcgggcgcaggctcgccgcgggtcggccgcacgccatacctggatcaggccctgctggaacaaggcgctgtgcacgcagccagggaccgccccgggcagctccagcgagccgttcccattgcagatgctccagttgccacgcaagctgtaactgagctccgcggcggtggtgcctgcaccgcacagcgcgagcagcaggagcaggtggaggcgcatcttgagatcccgcgccaccgagatgtggagagatcgaaaggcagcgctgcaagggaccggcggtgaagccactcaccccctcggaagtagccgaggctttaggtccccgccccggccccgcccctaggtcagctgagcgctctccgggcgcagccgcgggcgggaggggaacgaggaggctgcgcctgcacccgctgaaagccgggcgtcgcgggtgcgggagctgcagcccccgagaatagctacaggctggggggcatt

SEQ ID NO: 3655 - DNA, 1007 bp, Homo sapiens
ggaagggcaccctggggacgcacctggaggctgggtgtccagcgctgccgcccccctggtccctgtcattgagcgcagcggtataaatcctccggtagcggtcggccagggcccggcctgacagcagcagctggtagtgaccccgggagtccgcggcgggtagccccagccccagccccgcagcagccacggagccgtcgggaaccggcatgaacagcgcccccggcgccggggaggaagagaaggtggcggctgggtagaatccgtccccgccgagccccgaggaggcggcggcgggggaggcagtcgctgcgcacatcatcatcctcgccgccgccgccgccgccgccgcctcgtccccgcgggccgggcgggcagacacgcgcgcgcacacacagcccttttccaacgacgacggctccggcggcggcctctggctcccgcagcagggagactacaaagacagcgacctccttctcctcctccttcttctcctcctcccccccgcgccgccctcgccgctactggggccgctcatctaaccccgccaccccgggaatgtgaggaggaggcggtgccgccactgccgccgccaccaccgctaccaccgccaccaccgccggggctacccgcaatgggaagctgccggcctcacagagcatgcgccactcctcgcacatgctcacttgaagaagagtaaggaaagtgctggggaggctgtcagctactgacgttcgacttcaggttccctccaggtggaagaacgaggaccagaaagcaagggggaacgtgcccatcgccagaggaggagtggcacgctcttctgctacctcttctccaaggctctgctgccaacaggaagatttactgtgaattgtgctggttaattcagagtttaaggcagagaaaaccatcccaattagaagtgcctttagcgatcttattttatatggtttttgtcattaggatttacgcttgtttaacacagcttttacttacaaagacag

SEQ ID NO: 3656 - DNA, 383 bp, Homo sapiens
tttgtgcctttcgggcccccgaactccgcgggacccgggtcgggcagatcctcacagcggaaaaccggcagcggcttcgaggcgtctagcgcccgcgcccgaaacgacagtttactcatctcaggcgcagcagatacctctccgctctggggaaacggccccggccagcgggatcatggagaaccgggggttcggtccccactcgccaaccgctgccggggacttgaggggcggagcgcagagcccgccgtccgggcactaacaccagccgggagggtgggaggctgtgccgctccgctcctctctcgctcgctctcttcaatacgccatggccaacatggcggacattaaaactccactgtgcgctcttcagccaaccccag

SEQ ID NO: 3657 - DNA, 2228 bp, Homo sapiens
ctctcctcccgggtctgcgcggacgcggcctccttacctcatttgtcctcgcccctccccgtccctctacgcgttttggtccctgtttggtgctttctgtttgcagctacggcagtgagtatgtatgtgacggaccccgagtcacccgcggcctgggacccctgcctaccctccgtctcgccagccgagctgtggaactagcgcgtgccccctcgccgacctcggcgtctccggtccgcccctcacttgtggtggggcgcagctcctggtccctcagctgcgcgccgccccacgcggccgggctgcgggtctagggggtccgcatctccctggctttccaagggctaaggtcgtgattctagggcggctgggcgtccagggcctcggtgggggtggcgtgtctgccctttttatctccccgcaaggcccccagtcttctagggaagccagtcagtgaagcgcggaggtccgggcgcgccgagagagagtccagtctttgaggaccgagtagtcctgggccacctcccgcctctgctgtcagaagcagcagctgccgccgtggaatccaaaatttcgggagctgtgaccctttcctcatgtaaaacgagtagtcttggacgatctgggcataggaaccaatcagaaacaatcgcttcagcaatcaagaccattgttcatcatggaggaacccatggatacctctgagcctctatctgcattaccattcactgggcagcagtcttttgagccaagtggcaaatttggacagtatccatcgatgcagatgaaccacatccaggcactggggaagtggaggacatagaacagctcaatcagtgtttgatccaacacttccatctcattaagacaagtttgatttttctttgctttttatttcatggaatacatgagaatctcttaactgttggagtttccaaggaggcatacctcatgacttcagttaatggaaagaacaaaactaaaatgctgtatggccaaagccacaaagggaaggatccacaatttacattcttggagctatcatctgtactgtactgttgtgatctactgattggcattggcatagtagtaggggtcaagtgacagaatccgtgccagcagtctccaggttcagaagcaattcaagaccctgatgatagctctccagcaaccaacacatggtgattgtgccaacttgttgctcagttataatgcagggccagtgattggtttaagtgaagaccatggttgagatcatttgtctttggtctaatagaatttgagtctagtagaatttgagtctccagggaaagagctacttgaccaaattaaactagtagcaggtagagcatgaatgacagcatattataccatcaagatgttcttagagcagtgtatggatggatcgattgtactgccatcagttgtgactgacgttgtattcaaggagaaagagaaacttgtttagaaagcactttgaaagttttttgagtacgggggtgccctgtatcaccccgttatggttgaactttctccttcaaaattaccagacttggcagcagtggcaaattattgggctaaaagacttaatcagacatattctgggttcaaggctcctaatataatacctggtgcaaacattatacttccactcattcagatggttgcatcctgccaggcatccagtgggactgggaatatggacacttgaacattaaacatcctgaagaattttggaatgacaggttacaagtgaacataatcagttctctatattaaaaaaaaaaaaagatttgggcatagattgggctcacataatctttagagagattttttcatttttgtgaaagtacagaaattcttaactgcttatgaaatgctgattgttaaacagcatccacagctattttgtgttgtttccctgaccccaccctgaagaaaagaaaaattatggcatattgaaaacagcagtatgatgtaagagaaaagatcacaaattccttgagggtgggtcttttccatactcataagcctatttataatattcagagtaatttattgacacatattaatattccctcctatcccattaattgccaaatcatcaaacatttattgagcatctcctctatgtagggtataagtaatgctgaggtagtactcgtgacttacagtggtaaaagacttaagttttaggccgagagcagtggctcacgcctgtaatccca

SEQ ID NO: 3658 - DNA, 41761 bp, Homo sapiens
acttctaaccattgagccatctggaggcctgctgggacctggccattagtgtacaaaacattgaagcaatggtgaagatgtgggagagcaagtgatcaaagctgagaagcaagacaaagtgacaggaactaacatctattgagcatctattatcacctggagagctgtacatgcacaagaaataacttttgggagatcccagtgagtagccaccaagttccttagattgtatcttctaaatctctgagtccatcatacccttcattgccaccaccactgctttattgaatccccatcatttcttccctggattatgcctttacatttcccctgccttctcttcagctccctttctccacattgctttctggcagatgttgtaatctggtgttacctgcctagtgcttggtagctttcccttgtgcctccaggcccatccttctccactctgtcttcttcttccaaagctctattgccctgtggcttctggctgggtttggtcaatggggagcattggtgagatgggaaagatggagtggtgagggggcatttacctccctaacgttttccctgggggtcactgctggctggctgcatctctcaactgatgctgacagcttccatcagatgccttcttcacatgtctttctcctccaagctttagtacccatttctttctttacccttccaaacctaaggatggcaacagtgccctctgtggtttccctaccttgcccacacctttaaacataattcctttataaactcttcttggtgtggtggctcacgcctgtacaaagtgctagcactttgggaggccgaggtgggtggattgcctgagctcaggagttcgagacgggcctggggaacacggtgaaagcccatctctactaaaaatataaaaaattagctgggtgtggcagcgtgcacctgtaatcccagctactcgggaggctgaggcaggagaatcgcttgaacctgggaggcggagattgtagtgagccgagattacaccattgcactccagcctgggcgacagtctcaaaagaaccaaaaccaaacaaacaaaacgtgtcttaaattaccgatttcaatgtgccatatgtttcttgactggaccatgactaatacatccatgcttaaagcatgtcactggctccatcttgcccagagggcaaatgcattagcccatgctggggaacaaggctccggccttgcttccagacttagtatttcctgacacacccacggtactcctgcatgctgatggacttttggttttctgtacttgctgtggagattttataagtgatgttttctttcctgatttatctgcctgggccttttccatccttcaagattctgctggaagattacctgttgcctgttgttttgttgacctccctaggcagggctagctgcttcctcctctgtgctcccacatcgattatataagtccattacagtgctattcactgcgacaagtgtttgtttgtgtgtccgttttccttctggtcgctgaacccttgactgtatacctgactatatcccatttttctttgttctccaagtgcctgttgttttctcaggtaggattaataaatattttgtgaatgaatacacttgttttatggactacattatttctcaccttttcatatcaacaagattgcagcaataaaatgtcatcttcatctatgcaactgtgcatgctgttttgtgtcttgatgagtattattttatccttatgacaactcagagagattgagtagatgggaagcaaattttcccgtcatgtagattgttactggcagaactttgccaagaatctagaccttttgatactgatttgctcttcttttcatgagaccattttgcctcctgagatgccagattttaaaaaaacaacagagcccaggagcaggctaacctaatgagcaccaccccaaggaccacttcagatggaaggcaactcaggctgccatagagataactccaagtaattataaacacatgtcaggaagaccgaagagagagagcttgttgtcagaagggttctaacgaacagagctggtcacattaccggaacctaacttgctgttgcgagagaattatgtctgatgtaggctccagggactatcaacagaacataacacttggattaaaattaggaatgaacatcaaaaagaagtattccgggaccctggggaagggctggcaacccatggaggaaggagtggattgtttctataattcaagccatatcccatgagaaagtaatatataggcagcagcacaaataaagataaattcaagagcatttggggcaatttctgttatgtcaatagaaggcttataggttcttccctctgccttaggggaaggagcattaagttgaaagcgctgccaatacaatgtagctcacttgtgaggaacattcacagagataactatcagagaatttcaggaggagaaggggtcttaaaggtcatctgatgctaggccttgtacttttggatcatttccaaggggaaggaaaaaaatgagacctgaatactccaattgagtgagggtcaagacagaccaagttttggatgtggcacataggtattacctgacatgatctttgcaatgctgttcggtctcagcatgtctgtgcaatccctgtgggtctgtgtcatgacctcataagccatcatgacagaccctcgatgaactggaacacccgttacttgcttgaatttctccctatgttctccagtgaagacagaggcgagttaaaaagaaataaaggcaataaagaaaatacatttccatgtatccagctttatcttttaaacctttgatgttggtgttctcagtcttaatatgtttctgtcttttggcctgatgtgtttctttttgggaatttatctcagtgatacaataagaattgtagacgaagatctggaaacaaatgacatgaagatgcttatgatataaaccagaaaagcaacatacaaagtatatggtaaaatctctgcctgattgtttgaaaacctttctctctctgcctagatatgtatctctataaatagaaaaataccagaaaggaaaccatcaaaatgttaattatggttatattggggtggtgggattataggtgtattttattttctccttgtacttaattgtactcccaaactttatgaatataaattagaaaataactttataaacagtattgaaaatccttctctgactttgccctgatttccaagacaaaatccagacccttcagctcagcaagtggagttcttttggatctggctgcccactctcctgtcccatctctccccactcccctccccttgccctgccttgcagccatgctgaagctctcgtagttttcctaaagccggatgctccttgaaggtcccattggtgttttttctgcctaggacactttgctctccttgtcagtatttgcacactccagaacaccccggctgctcccgttttagaaagtctcctgtagtggatgctgtggtttgctgtcccatctcctattcaggcgcagggtgcccttttccccagtgctagggtgctgcctgctgcaggctcatacatggatccctctcccagaattgcccttggtccaaggcagcagctgtgtctgaggttatgaccctcccccttgtgggactgcccacatctaaggagtagtgaatgcagggtaccacgatctgactcccttgtctcaattcgtgtcccctcagaaaggttattccagcttcagagctgacttcctgtgggatccgccgaggcctctttggcgaccgcatctctcactctgcccagtcctgtctccttcactttcttacaagtgagcactgatccaggacacctcttgcacacaaatctgtctctgtttcttggggaatgtaactgagtacccgtcctatgaccccttacctcagtccctaagttagagtcccatcctctgggctattgattgctctttgttaatttctccttaagcacttctcccattgcactcttgcagagcatggtcctagcgtctcccccagtgaccgggatctccctgagggtaggaggcagtacgttgtttttctttgtgtctgcagcaccattcccagtgcttggcttttggtacatggtgaatgagcaagtgtgaaaggggatcacatagtaggcagaatagcatggggaagagggtgaactacggatttgaatgagagcgttattgacaaaaatgaaataatacaggctcttctatatcttccaattgaagggacattcctattgaacctttctatgtatacacccataaacaaggctctcactttgaggtcccatgcagttcctgtcactttaagcaccttgggaaattccagtgagttgaaagaattctgaactttatttttcctcttgtcctgtattcgtaagactggtcttcctttgctctccccttccttcattctttcttctcctccccttccttcattctttgttctccccttcctttttttctcaccattttttccatctaggtcgaggactagtttgttgcccagggaattacaaaaaagtggtggccaaggactaatcctctagtagtcttattcttcaagaagttgaagaaaaagtcgagtgccctttcaattcctacccttctctgatttatcactctgaaagtaatgatgttcagctttcttgctctagaggaatgattcaggtaaagccccactgagggcaaaaggtaatctgtaccaggtttcagagttaccagtgtaatcaatcaaaatgtgtcattaagcccctggctgcgtgttctccaaatggagtcagtaacacccaacccttaagcttatgggttagggggacctccccacccctcccttctgtttcactttgatggggtccaccttggataaactctctggtgctaaaaaagtactgagaagtgacagaaagttgcttcacatctactctatttttcaagaaaaacattactattttctctgaatatggaaccaccccagtgcttctgtgaagtggagctgggttattcagaggccctttctggttttatcttgtctttcacacacttggcaggacaggtattctgatctccagtgcataactgaggacagagcacatggagggcaagagaccttgaataactatagagctgcttaactcagcactgggataggaattcaggactccctactcaaggtctgtgcctctagcactagtccacaccaagggcatttccttaacggtggagattttcttcatgagtacattcattcccctcagacttaaaagttgtcacaaatcccaaaactatacaaagcatgagcatggcattggtggctgtgtgtgtgtgtgtgtgtgtgtgtgtgtgtgtgtgtgtgtatgtgcgctgggggcaagggacctcaaccccacagagacttagccttacctgttgtaggtagctgatgggaacatttgttccctgctgtccttgtttctattggggacatgtttccattgagtaaatcccctggccgcctgcatcctctctctccttcacttcattggaggaagaggaacttcagtcggcctgggagaagcaatggaagatgtacgcctcacctattcctttctctctgggaagagcctgaggaaagtaaacatcctctgcccctccaagccttaacttttaagtggtaaatctccatgttgcaaagtttctgtttgccatcagtggtacaatattaacaagcccaaggacctgaaatgatagccaccaaccaagactttgtcaacttaaaagaatggtgatattttccctctatctgcctgattcctattcctcttaattggctcagaagttgggcaggaaagaggggtcctatttattgggtaccctaaaaccccaacataagggaagtcttttctggtttcctctgggaaaccttaggttcaacagtggcctgttgtggataaagatctactcttgggggtgaccaaggatttgggggcaggaatttggaatgagaacccaggcaagctgaactaaaatgctaactgggcaagggtgtcctgtctccagtttgatgaccaagggaaggtcctgactcacttggggcttatgaagggtaacaagggggacttctcagtaaatcaaccactcactcttcatgtgacagtaaaagcagtcatggaacaaacaaacttcctgccaaggctccttcttgttaccgcaaactttcaagtgtgagtaaccatgtgagcaagggggaacccaataattactagaataattcctttgtgtgtgctgaagttcagttcatatctgacctccccagccaaaagtaatctctcttctccagacttctacgtccagtatctggaacttgcatttgagacttactattcctgactggctttattatttgcttagtcattgtggtggtggttcttgctttttgtgcattttatctccagtcccaaagattttaagtttattaggcataaggaccatgtcgtatatctccttgtattttccctgaccattcaagggcctagcataacatttacttgcatttggaagtgtggaaataaatgaagaccaaccaaataagaataagcacaggctgtttattcagagctactatcgtttgtgttttggcagagactcaaatgcgggcagaggagtgggaaaacttcatagtagaaaaaagggaggctccaggtatgtgctgattggaggctgttggtgtgggaagctggaggtggttcactagaagcacagatgcctatgtgattgcttagggtgcatatttgcctttctctggtttgtcctaagttggaagcagggacaaaaatcagggaggctgtccattgtcagtcaagttctggccatttggagctgattcttacaggggttattgtttggcttcctaacttgttgatagagatagtggttagacttctagaggtctggctgatgatagcaggctggcttcctgggccgattgctgttgctaatgggttggtgtcctgggctggctgctgtagattgtaggttggagttgtttttaattatggcttggccgttgtccatttgtatattcagtctcttggtgagtatcaataaatcttgcttgattaactaatagattgttctgactatgggttgaagcatgccctttgaattaatattatttctctttctcctcactgcttgatcaactgtttgacaggtattctccatttgatttttataacatgaccttagaaatagcgcaagggagaaggaaacttgctccatttttgctccttttcttaattacctctttacagaccctatctccgaatagagttactgtctgaggctctaagggttagggcttcaacatttgaagtttgggaggcagtggggcataattccccatcatactctttgagggcctcatttaactgaatatgctcagatctatctcaactcaaacacactctgagcctttggcctggatgcatccaaaagaagtgagtagaatgctcaggtggcctgtgacttgccgtgattcactgaccaaacacgaaggaagtggagcagatggtcacgccattagaaggcagtctctcctcagggaagtcagtctcgtggattccagtggccctgagaatcacgatgctagtcttcaaaagaataagaaagaccgataaaagattgcttctgctctaagttgaaagtggcttatggcagcttctctcaccccattgaccaagcccattcgctaaagcccgtaacaaaaggattttcccccctaacatttagaaatggcaaaaagcaaagagatgaatcatcaaataggcagaacgctcttcctacacctcttttacctgagcaaaaacatgacttcctgaaagagtacaaagagagaaaattggtaggagatgactaacaggggtgactgtgctgatgcaaagaatgtcaggacagcatgaactttagaaacaggcaaggttagatgctgaaacggaggcgggtgagcacactccctcaggaaatcaaactcagggagaaccgtgaataaaaggctccccagaaaagacgtgagtgtgtaacttacttgacatttccaccaacgtgcagcagtgggttgggtatgatggttctaaatacccagtgacacatatttacaaaagaactgtgtggttttattttaaatgacaatgtcttcttaatcacccctccgtactgcctgtctgcagcactgcgagtcaccagggttctgtcttggaggagcactgtttggtcatgagtcgtgtgctggcaatgtctgggaagtgagggagggtcagcagctcatgaccgtaggctccagggagagcaggaagctctgcaggatgcatgtgttatgggttgaactgtgtcccctagaaagatatgttgaagtccccacccccagtaccttgaaatgtgacctcatttggaaataaggtcattacagatgtaatcagttaagacaaggtcatatcggggtaggatgggcccttaatccaatataactggtgtccttaaaagggaactttagacactgagacagagacatacagaaagaatgccatatgataacagaggcagagattggaattgtgaaccccaaacatctgagacaggtctcagtcaatttagggtttattttgccaaagtgaaggacttgcctgtgacacagcctcaggagatcctgacaacatgtgcccagtgtggtcggagtacagcctggttttgtacattttagggagacatgagacatcaatcaatatatgtaagatgtacattggtttggtctggaagggctggacaactcaaagcagggagggggctttcaggtcataggtagataagagacaaacggttgcattcttttgagtttctgattagccttcccaaaggaggcaaggaaattccttgtggacaaattgtaagggaggtacgtagctcttttatcttagtagctatcttttaaagaatagaatgggaggcagttttgctctaagaagtttccagcttgacttttccctttggcttagtgattttggggtcctgagatttattttcctttcacagaataatgcatttgtagtccaaacgttgccagcagacaccagaagctagaagaaacaaagaaagggttctcttctacagatttctgagggagcaagtgcctgacaccttgatgtcagaactcaagcctccaaaagtgtgagaacataaacggttgttgttttaagccccccaatctatgttactttgtaaaggcagccctagcaaaggaatacagcccatcatacattgtggtgagcccagagcttcacaccacacatttcctgctctgtgccttctaaagtatatttttcaaaggtcttcactttcagaaacttgacctttttccaattttaaaaaatgatacaagaccttattgtcttctaccctcttacctcaacatattgcacaaaggctgcacagatcagagctggaaactgtctacctgttttccatggtgacatcctctgtagtctcagcttatcactgacgaccttgggcgagtcttgaggcctccgtctcttcatttgtaaaatgagagactggaactaaagcaactttagcctgaaacattggtaaccatgactcctctttttcttcactggttttttagactccaagatgatgattaaggtgggccctaatccaatctgactggtgtcctcgtaagaagagaagatgaggacacagacaaacacagagggaagactgtgtgagggcacagggagaaaatgactctctacaacaaggagagaggcttcagaataaaccaattctgctgacacctctcaaacttctagcctccagaagagtgaggaaatccatttctgttgtataagccacccagtttgtggtgtttattatggcggccctagcaagggaatacagagggagacaggttcagacatgtaaagcgagcctttaaaagacaccacgtgcaccagtggagccccaggcccaggccccacagaccttgcctcctggtccagtccttactttatctcaggatgtgacattgcgtttcttatggaaaagatctcactaacctacttcatttaggaatgcaatttaattggcaactcaacggtgatgtcgcttcttttgccatttttctgcaacaccaaaggaaaaaattttaagccagctttttttagctgcaaagatgacaaatgttatcaacaatatccaaccagagtatattttcatcccttttcatcccgtcacgataagccagaagtatttgttgccagaaatggaaaacagcttgttcatcagccagatgatcgcagtgctcagaagttccactcgtttgccatgtgtgaaaagttaagaattgaaaacagacaggcttgctctgcttaaaccgtgagttctgtgaagcaagagaaagagaaatttggatactaggagaagagttgtgagatggtttcgacggcaaagtgaacagggccttttcacattattctgagatgggacctctgggttgatttgatagtggatatgactgttctctaattggctagaagatgagtctaaagttaccaaccaccggaggatacttttgtgttctagaacaaattccaatgtcctacacaaatgtgatgctggggacttctctgttacctgacaccaaatttcctagacatttccattatacttcctcttcctgattatcttgagtgggaaatctccatgagttcttagtagaaggcagaagtatacagtggacctgggccttcattagaaaccatgagacttcaaatgagagcctgaattattcctttatgttttcatttatgtgagaaaataagggatattgttgactttttatgagattaagttacccagttatccatcctattattataagttttagtgtttgcaaagagatttctgatcgtttttattagtctctttgtaatagcttcagggactttttgacaaaagagagaaccattttaagcagtagaaatgtaggcttacagaggtcaaatggttaatttgagattgcccagcaaaacaaaacaatacgaaaaagaacacctgaagaaaaatcaagattcatactctgggctgtaattaccattctgtaggtttccggaagctcatatagtcacattacattttgttcatgtcgttagaaatcatttgcagttcaacacttagattccctcctgtgtttgatttgcaaggtcttggaagttaacttgaactcaaggatttgtctacctaagagaggcaaatagaaaaacccctaaagccacctgacctgattcttctttgttaagaccagctcagaatagagtgaaataagcaagctgcagaaagacaatgctacgttgagttccacttcctcttgataaattcagaacagccagtccatcttaagggtggatgtttttagcagcagggagtggtagttggatggaggcaagcggatggaaaggaggagagaggagaagagagacaaactcaggtgccccagaaaagtccactttctccgtccccattcaggccaccttcatcttcccccaccctctgctggcctttctgggggctcaggttttgagctgactgagccctcagcgggagaccacaacgcattttcagatgaaaggacaaccctgaaggtacctattacatgtctgtgagcagagaaacaaaggcccggctgctgacaccctcccactaacttgagttttaatggtaggtttgatttcctcacgcttagctgaaagaaagggaaaaaactaagcggaaagaacgagggtgtgggtatctgtggtggtggggaaacgacagctgttgtattcatggttaatcaggtgtgtctggctttgtgtcgcatctgtctgctactgttgccaggccacatgtgaaagggaaccgaggggaaggggccattcatgttcaaagccagtagcactgacctctgcctcgttctcttcagggtaggaaagcttgtctatttaactttccctattataggaagctgtaattctactctattagcccaccctaaccattttggcctgacaaatgcaagctgcatccagaatgccataaatctgcatgggaaggagtcctcctccctccttcccatttttttcctttggggttcggttcgatttgtcaaacaagagaaaaccagcaagagagagaaaaatgagaactcagggcatcttggttcaccttccatcttaaatgggcctagggaccgagatgggggctgggaggcaccccaaggtcaagcctggagcactggttccccctccagatctgtttatctcacgagtcccacatgcgtgtggtgattgcgtcagaccttagtcatctccctggcaccaaatcctcctcctggatccttgatccccctcctccttctctgcccacatacagagggaccatgatggaggaggggaggcttctggcttctcctggagccaggcctgtgttctagatattgctggcccaggcctgccaggcacgactctcctctctggcatatggagaaacagctgaaatggaaacaacccccaatgcaccacattgcactaaagcttagcgtcagagttcaaaggactactccaattggagatcaaactgatccctcccactgtggccttttttgagggggtccatcacaacccttcgggggtgcttttctccagcacttccgcttcagggccagcccttgtgtttcttggagtaaatgattgctgtcagcatttccaacaccatggagttctggctccaactttggcttcctggagaatgggccatcatagacttattacagggttcagaagagcttgccatctgcaatctattttagttgtcactgcctcttaaaataggcactaacttttatcccatcacattaattcctctcatgttgaggctagagtcgagcttttggggtgtgtgtatgcacgtaactatctttttaaaatcagaagggttattttcctaagacatgggttatcagcagcacagctgagtttcctctttctactggcctgtgctgatgaagttggttgcgttattgacctgcagctttggggtcagaatgcttttggttccctgatgtagaaggacattgcaaaactatcccagtgccctgtgcactgtctttctctctctgatactccccagatctccaaattttaatggtgtcaatagacataactcatgctcctgctagaagcctagcaccctgctaggctctgtgaggactttgagaatttgtcatcttgtgagacgccatgaataatgcaagaaatagcaaaacaggtctgaaaatgaagtctaactaaaaagtgtacaaatcctaagtgtacagctctatgaattattactaagtgaatatgctcacgtaaccatcacctagattaagaaacagaacattaccgccactggaaacttcttaaagttctacctaggtggacaccttgttatatctaaaacaattctacaacgtgattgggagtgagatttagttcttaattatgtggctatggaaatgtagattttgaaaggttcccattggctggaagagatttgcccatgggaagattttgagtatgccctgggctggcctgctgaagttgaactttagagaacccgggcgggctggctgtgcaatgctcttggctccagagaaggacatgcaagattctggcatcctttttaaaaaaattgtggtaaaatatacataacataaaattaatcattgtaatcatttttaagtgtgcagctcagcagtgttaagtacagattgttgcgcaatgatcaccaccatccatccccagagctctttcatcttgaaaaacggaaactcaatacccattaaacagcaactccctatttccctccacccccatacccggtaactaccattctactttctgtctttctgaatttgactactgtaggtacctcacagaagtagaatcatgccatatttgtctttttgagaccgttttatttcactgagcgtaatgtcctcaaggttcatccatgtcatggcatgtgtcagaattcccttcctttttaaggctgaataatattccactgtacatgtgtaccacatttagtttactcattcatccatccagggactcttgggtcactgccaccttttggctcctgcaaataatgctgctttgaacatgggtgtacaaattacccttatgcacctttccattcttttgggtgtatacctaaaagtgggattgctggatcatatggtaattgtatctttagttttggaggaattactatatcatttgctgtagcagctcactattctggaatccttttcacctggaccatttcctcctgaccagcctcctggatggcattagagggagcctgacacgtggattgaggtggtggcaatagtgaggatggtggtctgtactctgtatgtgcccgttgttgggaatctagagcaaatggggcaggatggagtgtgacaccacaatccatggtggaaacttgagagttcactgaatagagggggaggaatttatttatttacttatttttatttttgagacagggtcttgctctgtcacttaggctggcatgcagtggtgcaacatagctcactgcagccttgaactcctgggctcaagagatgtttccacctcagtctcctgagcaactgagacgacaggcccacatcaccacacctagctatttaaaaaaattatttttattttgtagagatggggtctcattatgttgcccaagctgctcttggtctcaaactcttgagctcaagtgatgctcccaccttcagcctcccaaagtgctagatttacagacgtgagccactgtgcccagtctgtgggaatagttcattttgcacaaagataaatgcttttccccctaatttgtgggagactgaggttaaaggagtccttaataaccaggtattcagaggccttctgcctgttcagtgtatcacctccagatttttggggggcctttaggcgtaagtgttgagatatttatagaacagattatgagcttttaaatagattacctaaaaaaaaagaagaagagagagagtgagggaaatggtagccagtaaaccaactgaggaaggcacacaccttttgcctgatagggatgtcgaggagagggatgccacttgaatacgaaggtcgttcttgggctcacgggtgcagtcgtttgggtttagtgctggctgctgatgccagaagcactcagtattgaacattcaggggcttcttcaaacaattttaagtatttctgttttctaaatcttgatgctttattgctagggataagctcacattaatatccactggaaggaagaactatgaggatcaccagggtgaggacctttagaactgaagaaggacacattattattgctaaaagaatatctgcttcttcccagttccttccctttggccttctcccatttcattataggaaaaaaaagctccatgaaattacatattgttttcttaaatttaaaagatacgtatggctgccacctaaagtctgtcaaggaaaaaaaatgtcctaccccaaatggtaaccattatttaacagttgttttattttcttccaaaacgctctgtatatattcactgtgcttttgaggcagcacagtttagttctaattacttacaacccaaacaccaccaattataaaaatatacagatactacccgtatgcaactctttaccattataaactactttcacatataattgaaccttatcaaaattgaaattagtagtagtctttttttttttttttttgagagggagtctggcactgttgcccaggctggagtgcagtggtgtgatcttggctcttggctcacttcaacctctgccttccgggttcaagcgattctcctgcctcagcctcctgagtagctgggattacaggcatgcgccaccatgtctggctaatttttgtatttttagtagagactgagttttgtcatgttggccaggctggtctcaaactcccaacctcagatgatctacctgccttggcctctgaagtgctgggactacaggtgtaagccaccaagcttggctgaaattggtattattcttatttaatagaaaggagaggcaggggagattaagacacttgttcaaatttacaccacatgttagaaaatggagttgggacaagaatccaagtcattgaagtaaactgtaggtccacaagcctttctcctccaccatagaatctggagtgaacattggaggccaaagtgccttacagaaatacttaaaggagctaccaagtcactggcttcataaagctgactaatcttcatgtgtccatggtgtcagtttatgaaaccctttatcttatacgaggaggcacactggactcactaagaattgcaatgagaattgagtttattggaataggtataacctcaatagaatcatagagaagacaactgagaacctggaaaacatttttagtattcatgagtgtgttggcaccagcttatttataaagttgttttgacaacgtgtgtgccttaaacttctatttataagaagtaaaatggaatcatcttcttaccctgctgagttgcaaattctgttttagggcaaatttttaatctgcctctttaatatagagcaatagatatattttttttcctgctgagtttattttttcaagtacataagttaattaagaaccatttacctgaagatatgttttcttccttatgaagtacataatgagaacatggccacagatgttaggtagtgacagaaatgcctgtctggaaggtgaattctttaaattttttttatctcacaatagctgtatagagaattgttgatggttcatgttttatttccctttgttataaaattttcatagtttgcaaaaataaaagttatgggctatgtgtcctttatttgatactccctgtgagaaagggtaagatagaagattcagtaatggccagtgttggtggaagagactgctgcttgtaaccagtagagaggaacggggggtggggaagtttacttcagcactgtattgattagaattagattcttctttataggagacagaaatatcttatataagtggcataaaaatatgaaagtaaatgtgtcttttacataaaagaaattcagagttgcagtctatggctggtatggttcctccatgaggttttcagatactcagtttccttctagttcattaatctgtcattcttaggttatagcttttgtctttattgtcttcatgattcaagatggctgctagagctccagccatcattccttccttccttctttccttccttcatttctttctttccttctttccttctttctctctttctctctccttccttccttccttccccccttccttccttccttctttctttcattcttttgttctttcttgctctctcacccagactggagtgcagtggcacaatcacagctcactacagcctctaactcctgggcttaagtgatcctcctgcctcagcttctcgagtagctgaggctacagttgcacagtactatgcctggctaatttttaaattctttgtagagagagggtcttgcttggtttcctgggctggtcttgaaatcctggccttgatctcctgccttggcctcccaaagttgctaggattacggatatgagccactgcacctggctcatgtgtgtgtgtgtgtgtgtgtgtgtttttacagaggaacttcctagaaattccacacaatacttctgcttatgttgtattgtccagaacctagtcatatggccacatttacctgccaggtaggctgggaaatatatgttgtggatggcaataagctgaaataaaaattgaagttctgttattgaaaaggggaaaaatggatttttttttccaggaagaactttttattaatataaagttttaagatattcaccagtcagatctaaacttactcattaaactctatttttaaaaaatgaacacactgtactgcagtgaaaggcaggaacgtggttttagacactgattgaaaaccagtgtcttcacgcactgagaacaggaaacattctgcactgcgaacgaagtgcacagtcaacaggaagacacacacacacgacagaaagcccccagtgtgagtgaccgtgtacctgggcaggtgacaggatgcccaggccgtggcttggacatggctgccacgctgcgatgcctgctgggccccacaaggactggggacacacacagagcccagctatacactgtgatagagtccacccattttgctaccctatacccatgtgcactgttctcctaccttcctgctacctggattgtgattgtaaggcctggattccaagatgttaacttgataataaaagccacacacaatagaacagtaagatgcaaggcacatgcatccctggcactgtggagctgtggacagactagctctagatttccacgtgagagagaaatacctctctattttgattaaaccattttgctagagttttgatggttgcagctgagcctaatcttaacagatacaagcataatataaacttataaaatagtgttctttttaagattgtgtcttactttgcctaccaatgcaggtggactgaccatctgcctatccagcctggcctaccatgtgatactaggtatacgaagttggctcagaagttaatttcactcacgggagcttctgttctaggaagaacaaacaaaccaatgcagtaaagggactcccattgctttaatggaaatctgtataaaagagagtggtgcccagagatatttgctatatgctctactgccatcttagactaggaaaaaccaaaaccaaaacaatgctgaccatagcatatttttttcatcattgacattatctttatattaatcacttgtaattattccttgaatatacaaaatctgactattggtttttgtttatattgagagaatgatgacatcagattaaacattaattttcccttgagaatctttcaatacaattggagtagaattttttttttttgagacagggtcttgctgtgccacccaggctggggtgcagtggggcaatcatggctcactgcagcctcaacctcctgggctcaggtgatcctcttgcctcagcctcctaagtagctggtaccacacgcgtgcaccaccacacctgacaaatattggaaaattatttatagagatgaggtctccctatgttgttcagactggtctcaaactcctgaactcaagcgctcctcttgcctcggactcttaaagtgctgagattgcaggtgtgagccactgcacccagcctggagcagaatatttttacataaaactaaagagaggttggcgacttataatcgtgttcaggaggtagcaaatgttttacttaggtgagaagaaatatacttttcgtgttgtcatagagtaagcccaatccttatttacttttgttaccattggcatgacaacaatcattggagcatctttgtcttccaaacatttcttatattatttactttttcatagcaacttaaaacggaagatcatagagtttaggtgacttgccctaggacacgcccttggaaaatagtagagccagaatttgaattcagttctgggtctcttttttttttttgaattccattcatgtgttgataatagctgctatggagacttagccaggaaagcagatgtggatggttagcggaagctaaagaggaaaaaggttaagctttttttttgaagttttcctgctcagctaggaaaacattgctgcagttatcaggtaattgaagtgtcaacgtgacgctgtcagaaaggttggatgaatttgttcctgttggcctatatttggctgttaagtgagttgcacaattgcagttttcaggttaagaaactctctggcagtcgtgggagttcctctttagaagcaactctgctaacatgcaaaatcaatgtcactgaagattttgcttatgttactgcctccaacactgtttgatccttacataaaagagacatttgtcatttgacaggactaagactgggaaaggttgtggaggcttcccccagctgtggtgcacaaatatctacacattctgtctgcttaagtttctttggaatgttttcattgcaaaggctgggtcactgagggggcctgcccttgccctttgaccttggtaaattactgcccccagtcctgatgagtttgcaggacaaacttccatcatcttcccaaccttggcaatgagggagaaggctggacctccctggctttgttttaatccattttcacctcccttttctttttctttctcttaattcttgttgttcttcctttgagtgactaccagcccctatgtaactctttctcttttttttctacccctctatcttggctgccactcaacttcaaagctcacttcagcaggagaaatgtgtgagttgtatggaaatgctgccctctggactttcagtattttaacccccggacttgattcaactgcttcccaaatgattggaaagaaatatcccaagcccagaactggagaaaccctttttttttcagtgaccaaatagattttggtgttgtgcctatgtacctttgatcaattcatatttccaatttggggacatgctttttctaaagacaagtgtctttcacttagaggaacttagctgatggatgacttgtacagatccaattagtcttgtttcagattataggcattcagaaagaggtatcttttaatggttttttgggaccgtgggaattttgttacaatatctgtcacatcttccagtaaaaaagtgatagcaatttttttctctttggaggtctttttaaaatgccttctttcctcattgctacagatatgttcttgcataaatctttgaagcaagccaatgtcttctagaatctcattaaatttcatgactttccattccttgtgttgaaaatatattccattttttacataacattttaaacattatcccttaaaaaggtaaaggatgttcatagggaatcagaaagtttgtaaaacacaaataataaaaattaaaataatccataatgataaaattgtcacgttttatcctgtttattttgcttagagagtgatagagcctttgttgggtgatcatacacttgttattgttactgaagagtgtggggttctggtaagcatgttctgagaaagagagagatattttgtttttctctaaagtgcttggatcttctatgagttgatttacactagcatttatcatttttgtcacttgtcagacatcaacaattcaagtggttggcattcaaagttgtgtctaagaaagcagtgttcaaccattgtgttccactctgggtatgaaaaggaatttgctagctaataacagagtatcacagttttgaataatttactttgttgataaattacaatatattttagagtgtgcttccataacaatgctgtttttagattcttgcattctgatctgctttcttgagtgggagaggaaggaaggggcgggtatacacttggcccacgcgtatgcccatggggccatattatttgtgactatcatgtaggctgtttgctgggtcagcggagagacagtggtcggctctgggaggtcacgcctccactacttggccttccttcggaggctcttactggtttccactggagaataagctgtggaagcactctagttaatggtaagtagagaaggaagatggctgtggaatgcagaatataggagtttgtgtactctaatcccactgtaataaactgtgtttctgaagttgagactcaattgagattacgattatgcatgtaaatagtgcatgaaataaccaacatgactatatttagatattggttatgaatcgagtcagacattttcagcaggagaagagagcaagacctcctgcagagaaaatctctgaatgctgctgtcctttaaacacacgtagcctttctgacaggaggcaaagtgccagcctcattgctttggtttcagccacactgagcagaaagggtcagtctgactgcttgctgagatttttctcttctttgctccatagtttcattgatttattttctctccatctgtgttatatatatatatcatttttaaattttttgtttgagacagtcttgttctgtcgcccaggctggagtacagtggcatgatcttggctcactgcagcctctgcctcctggttcaagtgattctcgtgtctcagcttcctgagtagctgggactacaggcgcacaccaccatgcctcactaatttttgtatttttagtagagacagggtttcaccatgttggccaggttggtctcaaactcctggcgtgaagtgatctgcatgcctggacctctcaaagtgctgggattacaggcgtgagccactatgcccagccctgctgagttttagagctacagctcctctgtagttgtttttttttttttttttttttgagacagtctcactttgtcactcaggctggagtgcattggcgcgatctcggctcactgcaagctccgcctcctgggttcacgccattctcctgccttggcctcccaagtagctgggactacaggcgcccaccaccatgcccagctaattttttgtatttttagtagagacaggttttcactgtgttagccaggatggtctcgatttcctgacctcgtgatctgcccagctcggcctcccaaagtgctgggattacaggcgtgagccactgcgcccagcctgtagttgttttttgtggggaatagaacaaaatggaactagaaaacttgaggcctttcaatcacaaccatgctacattttatctgaacacaggagaacctgatagttccccccagctctctacctcattgctgcaaaggtgggatggctgcccaggggtgtaggagcaggaatcacagctttaaaaaatattttatattgatacacactaattgtacatgttgatgaagtacatttgatatttgatagttgcacacaatgtgtaatgatcaaatcaaggtaattgggatattcctcacctcaaacattgatcatgtttttgtgttgggaacattgcaaatcttctagctattttgcaatatacactcaattatttactacagtcaccctactgtgccatcaaacactagaacttattccttctatctacctgtatgtttgtactcattaatcagtctctcttcatccccactccccactaccctttccagcctctggtaaccacccttctactctctaccgccattagatcaactgacagcttttgtttttactgcaaggtcttgttccaccttcttcccacgggtccaggcagttgttcttctagtctacactgtctcttgtagcttgtttgtcatctggagggaataggttggaaatcttgtatttgggtatctattctcatacagggaggaaatacaggcaattaggttaaagtcataggcaccatgtagagggctgggctggaaggaagtcaagctctaagtgttgactgtgtgggaggagctgtgaacatgaggatgtgaacctgagtaagacggatctctacccaaagggtaaggagtttgggggacatggtgagtcctgtgaaataggccagcagagtttgcacagagtaggggcccggagcccactgcttgaggttgtgaggggcagagaaggtctctagaccagagacaatgggggtgcactgcatgcatgcacagggaggtaaggttgcacagaaccccgagtctgcagctcagtaactaaggcctcgtacgaaaacggtggcttcattcattccaaatccccttgtgtggtctcttccttgccgtgactgccacttgctgttgctgccttgcctgtttcttgttcccaacctcatgacttttgcttccttgtgctttctaggccttatggcttctgctctctgtctcttcttttgaagtccttctgcctacttgctgctgtcctggctgcttcagctgctgcagactgtgacaggctctcccacaatccagcttctgagagaggatctgattggacttgaatggttgctgcacagtttagagtttccctccgaggcagagttttcttgtcccgacttgtcagaggccactggcccgctcttggttgattcagttgctgtacctcaacattggatgagttgagggaggcaagacccctgttagccgatggtgacctttgaatagggaattgcctgcggcgagccctttcctcagagaaaggctgtgggccgtggtcaaggagagacgttggtctgtgctgcacaggtgtgcctacaagtctgagctgaactgctccgctctataaagggaagaagattcaactttctggggaagtcctgcagaggcaaagaggctgggtgcagggttggagaaggcaggcaaagagacagcctcctgatcatggataactgggagggcttggggaatgtgcattgtggattttattcctttccttcttgcctgcctttcttttttttctttcttcttttctttctttttctttcttcttttctttcttttctttttttttttttttttttttgagatggagtctcagtctgtcatctaggctggagttcagtggtatgatcacagctcactgcagcctcaaactcccaaactcaagcaatcttcctgcctcaacctcctgggtagctgggactacagatgagcaccaccatgctcactaatttttaattattttttaggacctgatctcactatgttgcccagacaggcctcaaactcctgggctcaagtgatcctcccacctcagctgagactacaggcatgagccatggtgcccagcccatagattcttgatttctgcatgatgtcagtctttcctcttgttcccttctctgtagcacttgttagttattttgtgacagtgacgttgaatacagtagggagccaataggacacagcccagaagcagtatgtgaaggtgtggaatccagaagcagagggcatcaggggagggtaaggcccttcagttggctgaaattacaagaaagaatttggacgttcagaggcctagaattgggtgtttgtgtcaagatcacccacgtgtccaacagacagggagatcctgtttacctataggggtcatagacaacacagtgtccaggtgtagagcagggtcagacacacatgtggatgaaatgagaactcgggagaccggagtggaggagagtaagctcgtgccaccacagtggacagtcaggcagagcccgagggctccagagctgctgaagtgtggagttggggactttcgtatagggatggctttgccagtgggtgcaaggcatcccttagggacactgctatgaaagggaaaagagaagcaggaatgatggagagagaaccaggcacccaattttgacacaccccagttctccctaatggagctggctggaaggtgtgacaaaatgcctaagaaatgctctccaaacccactctcctgcctttctctcttttccagatcagtgtctccacttccctgttcccttgggccctctgtgaaaggtagactgatcctcggtgaaggctttgttaaacccagcctcaatgcatgccctgaaaatgaatgaacgaacactaaggaaggaggctgcagaggggatttttcgagactgcatcagtgttggtcacctgcctccttttggctataataggagtcatgcagcttaaaaaccctgactgctgatttgaaaatttacctcatgcagtgattgataatagaagctttcagaaatgaataaaaaaagagggggaggggatggcaagtgagtgctggggaaacatatgtggataaatgttcagatgttgcaaacgaggatgattaaaacttgaaccattcatcttcacccagtggtgttcggatgtccaaatttgccatgtctgtgttataggtagggaaacagaggcacagggaagggaaagaggctggcaagctctcaagttcatcttggtatcattttttaggaggggtacaatgaccaggtcacctctggtggcttattttgaaccaaccatttgcagaaaagtgaagcccgatccttctcatgcgttgtcttctacaattgcagtagccatctgacagataatagaataataggaagatgttgccttggacaatgggccagccaaagagctgaatgagagacactaaaataaataaataaatattctaaaaaaggcattttgacagaaaaattctccaaagaggggaggcattctcttgtcttttcctatccacctttgcagcagggtatcttttccccctcacttggagtctttcatcagctttgggccctttcctagctcctctgctcttttagagacttttttttcaggggccatgtagtggtttagattttaatggaagtatgttaggtggggcctggcttccattatgctgagctcaggcctagtgatgtgatctgtcctcttcactgttgtcagggaagaaaagaaggaagggaggaagaaaaggaagagaggaaggaaggaaggaaggaggggaggaaggaaggaaggaaggaaagaaggaaggaagggagggaggaagggagggagttaaattaagtttagccctaaagctatctccctacatattttaagttcagcctaaaggtttctctgtacacagtaaatggtcacccacctggacatgtaaacagactgtaatctattattgtgccaatcaccaaattttggccaatcacagggggccaactgttcaagccctgttcaagtaaggcaaacaccagattgtgaccaatccagctgtttctgtacctcacttctgtttcctgtccatcactctccttttactgtccatgagtcttccaccatgtggctatgctggagcccctctcaacctattctggttcaagggctgcctgatccacgaatcattatttgctcaattaaactcggttaaattttatttgtctaaggtgtatcttttaacagagggagagaagaaggaacttatagcaactatcacgatgacagtcgtatcatgcgttcttagaaaaacaaccctgagggtcggcaatggctttagtatactgaagggaatttatagtcgaaaacaattagttttaaaatgcagctgcacagtcaaaacacttgaagaacttaaaaacaatactggtgcctgagccgcattcccagagagcctggggtggagactggacatcagcacttttaaagtctcccctggaggctgcaaagcgcagccagggttgagaatcactgttctagatggatccctcctcgcatccaggaacagctgtttggaatagaatctttggatggtggagtttttcacatggtgaaagggttgggaacttgtgtgggagaaggctctggaagcagaagaacaatgggaagagctttgatatcatccaaggtggtcgtggagagacttggctgaaaggtccttcacaccaacctggggatggggagatttgatttcatactcggggttcaggaagcagagaattttctgctctctacagttgagagcagcctgggaggacatccagcctcttctactcccctgctgtgttttctaggctttgtaatctgccgtttggtttcctggagtgacctaccgcctaggaagggagcgccctggacaggcagctggtctcagttctccggccaggaatacaggagaaccttacataaccctgcaattgagctcttggaaaggaatggctgcctgatgcaaaaatgcttaatgagaggtgaacaattaatggaggatggggctctgttcccaggccaactaggagtgagtggtgacgggtgcacagggtctcggagtcaccctggggctgtgctcattcctgactcatcagcagctcactcacgacaggcacatgctgatgtctccatagtttgtccccaggcaagcattctgtttctatcttggtcttgccctgcacactcagttttggtattttaaaggatttgctaataatgttcctttagaatcgttttgtggatctgtctttcccttccttctttcctttgtgagggttgtctggcatcttttttttactccctggctggttattcacaaaccagaggaacagtcctcatgtacatcaaacttacctctcaactctccaggtgctaaaccttctcatggagaagaacaaacttgactgctagcccattctgcagcagaattctgagagctagggcaggctctgttacaggtcaggagaattggcctgattagaaaccatttgaggtagggaatgggggctcacacctgaatcccagcactttgggacactgaggccaggagttggagaccagcctggtcaatacatgagaccctgtctctacaaaaaaaaaaaaaaaaaaaaaaaaaaaaaaaatttttagtactccgaataaatgtatctgtaaaaggaaagccacagtaattcagagtcatggtttatatacctatttcacataagatgccactgtatcttctcctacaattaataagttgtctttttagtacaattcaggtctctttgcttttgggtcttagaagcctaattttctaggctctggctatctttgactactaataatatcataaaactatgataatgataataactcttatttataagagttgatatcaggcactggtgtaagggctttccttacgttactgaatctaatccgtacataagatcagtgtagtcagcatgattagtatcatctctaggttacacatgagggaatcagggcttagaacatctgagaaaatccagtgacgatagagtttgaattcaaattgacatcattctgattccagagctgattcttagccatgtcatattctaagtgacgttgagatgacacgcatgatctcattcaatcatgtggctttaaaatccatctatatgatgggtgagcctcaaatttatatctctaacttaaaccctccccaggcttggggatgcaactgcctgctgtcattgtcagtccaatttctttctttcttttttttgagatggagtcccactctgtcacccaggctggagtgtagtggcacgatcttggctcactgcaacctctgcctcctgggctcaagcaattcttccacctcagcctcctgagtagctgggactacaggtgtctgccacacccagataatttttgtatttttaatagaggtggggtttcaccatgttggccaggctggactcaaactcctgacttcaggtgacccacccgcctcagcctcccaaagtgctgggattacaggcgcccagcccctcagttgaatttctaacaggcacctcacacctaagctgacctaacaagcttgttcttgcccccttgctctccctgctccctcagtaaatttgtctccattcagttactcaggcctcgatgaaggagtcacccttgactcctctctttcacagctcacatggacaccatcagcaaatccagtgggatgcctgtattcagaatccatccactccttccctcctccactgttgctgctcctctactgtctgttttcaacacagatgtcagagtgagtcagcttttgtcacttccttgctcaaaatcttatctcattcagagagttccagttagtaagttatcatctttcagctccaaagccttccttcaatacttgattctatgctgggcccctgaacactgcatttctcctttgttgggctccttgttgcactcagccagtaggggttgctagagaggctcctactctttcccatgggtatcctgtctgcctgtggctcctgtgtgcagcaccccagtactgctgcttcatcttggcagcagcagtttcttcctgtagcagctgttcaatctacgttgcaatttttcctacactcaagaaccagactcattgtgcctttttagggccacagcactgactgccattgccccatctttgaggtttgggttctagccccatgggactgttttctaagcttctaaattttaattatccgacagccccctttttcttctgccagccccaggggtggagcttcctgaagttgttatacgaaagacaccttagagttgtctttttactctttcagttacctggttaagactttattcctagaaaattattctttatattaaattagccgtgttaaaataactggtgtggcttctgtctcctggttaggccctgactgatgtgctgagttaaaggtgaagtccttaaaatggtttgcaaggttgcaagcgatctggcttccggccacctctcctgtcttagctccttccactgtcaccgtcattcctcgctccttttggccccttgctgttctgtaaacacaccaatccctctcctgcctcacagtcttggccctttctgatccctttgcctgaaaaaccctgccctgcaattctacatggcctctctttcccctgcttgggtcttcctgagatgttacctcttcagtgagaccttccctgaccgcaccacataatccacatcccccactccccccacccctgcctggatgatttctgtccttcttaatctgccttgctttttccatagcacctatcaccatctgatagtctgtttattcatacttgattatttgttaattcctgtgtccccctaactagcaaataaacaccccaacaaggcagaacttttcctactttagtgattgctacatcccagactttataacagtgtctggcgcatataaatgcttgaaaagtatttgttgagtgaatagtaaaattgaagttctggactgtcaggattaagactgtcctaggcccggtgctagagggagaatcctaaagaggacgctggccttagaggaaaatggtaatcatgcttcccacaccacatgtcagggagagcagatggcagtgtcagctcacagttcgcatgagtttggggtgtacttttgaagactgagtaatgtcttttctctcccttctccaaattgctattgttagacctgaaaaagcctgtaataaaatttggaagctactgagtttatgacatctcaactttaccctccatttccaccccaaatggcttttgaactgacactgaattgctgccttattaaataccatcctgagaactttacagaacattttaagtgatgccgagctcccatgagcttcaatcataatggaagagcctgggaccgttggttgtcagctttttcttgtcatctacatggggactgtctgtgagggtgtgtctgctgggtgaagtgccacacctcgcttccgagacggggcctagctcgctaatccaagagggctagcaacatttgcaaaccaggaagaggcaagagaggactttcttaacagtagcagttactggagacctaacttctgagggttgcaggttgaattgtccctaattcctggggatgacaggttccactctgccctgccagattatggggacgctccctgaattacagtggcagctgttgggttccactgctgcgactcatctcttcagtcttgttggccttggatctcagccacccgagtttcagaaggtggtaagctggccagtgttcttggccccagaacacggttgtgattggtgccatgttaaatgcgagtagcaattatggctgccgatttgaaaggaggctgaacacgctggctttcatcgggtcacctttgcttggccacatgagactttccacttaggaaaatgagggctgaattcttgatccagacaggctctttcaaggtgttgcgtttctgctctcagataagacaaccctgtgaagttgggtgctttctgcactgtcactgaacttggtgccctgtgaaaggagattctctctctttttttttttttgagatggagtcttgctctgttgcccaggctggagtgcagtgacgcgatctcggctcatgcaacctctgcctcccaggttcaagtgattctcctgcctcagcctcccgagtagctggggctacaggcatgtgccaccatgcctggctaattttttgtatttttagtagagacagggtttcactatgttggccaggctggtctcgaactcctgacctcatgatccgcccgcctcagccacgtaaagtgctgggattacaggtgtgagccaccatgcccggctgaaaggagattcttaaatacacaaaatccttcactccaagggtttagattttttgctcagttttagctgcagactttgctcagtttagagctactagggctttagtttactgtgccatatttgaaactaaaagtctgaattatgctttattttttgcatgtgttatagatagcacgtaatgaataagcaccctcagaatacctagcaccatgttagggaaacacaacgctgaggccttggtcgttgtcctcaggaaactctcactgtatttacggtccaaaaggaggtccaataaaacaagactatatataagcattaaaatatctatagaaagtcagaggagaaacaggtagttgtggatctgtgtttgttggagaaggcttgattggaatgtgaggtggccttgaggaaagagtgcagatttcgattaattgggagaaggagaaaggccggtaaggccaggggggcttgaacaaggtttggtggcaagaatctgtgtagtatccatggtgctctgcaagtggatgagccctctccaagggaatcattaggagggagatgagcagatgggaaggacaaagcattggaggacacccaattgggttgggtagacaggatatgtgcatagaaagagatgagccagactgttgtttgtgcaatttaaaatatgaagagaagaaaagggaaaaaaaaaagataagggatatttggcaatgtaccttcaaagccaaatgaaggttgccaataagaagtgcttcaggacctcagcagaggaaggaaacacccagggcaggatttgtagaggattgttgagggggaataggtcttaagacaagggaaaggaagggggagaggcaggagaaagggatgcatgcagataaagggggcctcagagcaaagttgactctagaagggctctggctattcggtgaaggaggagaagggtattattcaaccaggaatggggctgaagacaaggtgagaaggtctttaactgttgttctggggaaggagtcagggagtggatgaaggacaaataccaggttactaagtacctgtcagggccaagctgtatttggatggcagaagccactggtgggccaggtctaggggtcacaagcccttctctaggtgtgtttgtaattcaagcagccaggattgggtgtaggtggggctggctcaaagagggcctgggaagatgaagtcttggttgctgatgaaggcagcatttatacagctgaatacaaggtctgccagacttcagagaggattcttgggaaattggaggagacctgctgtgttaggtgtggaggtggagctggtctcatgctgatgaagtcctgggaagaccttgattggccaacacagaaatgagctgaggaaaagaaataagggaagttggaaggagagtatttgtgaagaaagcagaatattaagtattttctttgatacttctttatatacaggaagctaggttgtcagcagtagcaagaataacatgacaatgatgagatagctaacttagaagatcttggaacaaaccattttccaaatacctctgggttttctttgttctctatccaaactcattttattaaacaccctttgttaatattctgatagattttatagaggtcaaaagagcagggattaggcttcgtttggaaactcagctccctcatttcctaactcattaaatgagtccaagtaggaaacaagtgcagatatatttggaagatattaaagagaccttgggcaaattacctaatctttcacccttggttttctcatatgatgacagtgcctttctgatggagccgttatgaaggtaaacattaggttccaacgcatgggaactacagttgtgttaaaatgagaatttcccaggagttcgtgtgtttcattgtgaggtgctattcagctctgtctatttccctcacatctgtcctttctctttctcatcccccactcacttagtaaacatgtctgcttggaccaatgattgggagtatggcgtgctgagccctggtaacgggaagtaagccagcattttcaacaagttgctaattataccacttttaaacacaataagagaagaaggaatgaaccccatgagctggggccacttggcaagtcccgatggtcttcttaggccagtcaggatgtttcttagactcacatcagccttgatgacgatctcctcccacatcgactgagtcaggggtcgctgtgtgctgagtaatgcagtcctttgctgggcgggaagtgggcagcactctgaagggacatgagagtggatgacggtgaagctgtgggaaactgcgggggagctgcacacgcctgatgcctgtgtcagagccacgcagtctctgagtcgtgttcccaagcacaactcacatctgtgaagtacatcagggaaaattaaataagtccaagtaggaaacaagttcagatatatttggaagatattaaaaaaaggaaaaaaaaaatctccaaaaggcctgatctcacctttcactttttatagacaacattttccttctctggttacatcttttcttgaggtgtattagcaacactttgttcatttgacagccatgatatttcttctttagtattgtatgtagggtgaagttcaagttcctagttgctcgacaagttccagttccttggcatagggcatagaggtctggccaggactttgttttctctaattcaatttgtctaaaacacaagaaaagactttgtgggctgaggccgagaagtcgtgcttcatatttgcttgaatcttttggccttacttcactggcagagtctgtgaaagaacacaggtttacttaaaaaataatcttaacttaagcctttccattgtgtgaatttgacaaagaaactcgccttatctgggttgtcccccatttctttgcttctatgaggaaccctggagacttcctgactttaaaaagcaaccaaaaatgaatgttaagttttggcatgtaaaagttctttggtatacattttgccagacacggatgttgcaaaactgtttactgaggtataattttggtgcttctatgtaggaaggggaggaaaagggttatttattaaaagttctatataggcatctcttgctatttgacctcttgccatccaaagtctttccctcagaactcaggaggcaagtggattcagataaactcagcactttctgaaatttcaatttttgttttctgaaactcaggagccaaatagattttttcctctccaaacccattacccaaacactcaccatcagaacttaggaatcaactaagtttggataacaagacatacttttcccttcttcctgtttattagaacccactcattgcttgtagaatattaggaaaagtacagaaaagagtaaaggtaacaaaaatgactcattgtcagaggtataattccaaacactaattttctggtaatggtttatgtcagggagtgaggaatatactccctttgtctcttccacatcctcttcaccctccccaactcagaaacattcagaatccatggaaatttcaaaaaagtagttggtcagtagccatgaatgttggttgggttgcctgtttctgtctggccagcatgtactgtctgcattgagggctttgtgttgccagccttctgcacttgaatttggattcggccaccaagccttctcttggtggccagcttcctgcaggtcttcccaggcactgggggatagtctgctagcatggtttttcagggtgacatttgaagccacaggatctgtgaaaatgttgtgatcgatcgttgacagtgtctcatctccctactgatagacaaggataaaaatgcctggttgaaatactgcttgaaaatctaagcataaggaaggtcagaaatgaaaatgatgtagaactgatggcacacgttgacttaaaaaaaaaaaacacgcattttccttcaagttctcaaaaaataagcaccactgctatctggtgtccgactgagtgtgggaggaaaacaaaggcagatgcagttgattaagtccaaggcttctttatgcaacactgccatggccagtttccctactgcacttattttctctaaataagcttcctcagtttcttcttcactgcttcttggggatgcagccacaaggaaagaggcagggaatggagactccagtcaaatgtgaggtaatgtagctggggtgcaaaggcagctctcaatccaatatgtctgcctgcttcctgcttctgaccacaaatgttcatcccggctatgattctctccaaagcagctctgtttgcaaacatttctctcatctggcattttgcaaatggcatcaattctgacagttgcttcgttcctggctaaggctcaggtcatcatttggtatctagaagggaattcgaaaacgttgcctcttcagagctgatgaaccttctgggcaaggagggcagatagcgcccacatgtgaagaagaggcagctccctccagtcagatgtggctctgctcaaggccgaaagaggacttggcttcagatcctacttgtgcccttttgcagtttatggactgcacagtcatacagggcagaccagttagggtaactgagcacttgaaagaagacattctggatgaaattctggtggtgcatagacacctatcttgcatggagctctgagcaccctgctgcactctcatgattcctctgtactcagagcagaatgttggcatcatagacaagcaaacagaagcccaacgagagaaattacttacctggaagaccatgtacatcagcggccctgccaagaccagatccctggtcctttaactgttctataaatcgccagtagaacttgactgaaatttaatttagttttcaacccttggcaaaccggataccgcgtgtttgtgtaggctcatgccatttaaaaggttcttggagtttaggtcttgcatgtaatttgctacattagctctgggcaaaaatatttgctttttggtcctttgtggtttaagttccttctcagcattgacctggcatgttagagagagctgcactgtggaacgcagcagggggtggagagtttagggagagtgagtgcagtaatgcttattagtgatggcagcttttcagactgtgggagctcacatgagattttcccagttaggttgtttgtttatgtatttggattatgacacaagtcagattagaaagctgatgcagatcaaacgaagccttttagatttggattaagcttgggaaattttctctcctaagatattagattaagagtatcatgatgattttgtcattgttgttcaaagtgacagtcatactattgtaattgttccaacacctccaagtttggccgtctttggcgtgaatagacccaggatgggttatttcaatcaaaaattcgggggctgggcatggtgtctcacacctgtaatcccagcactttgggaggccgaggcaggcagaccacggtttgagaccagcctgaccaacatggtgaaaccctgtctctcttaaaaacacaaaaattagctaggtgtggtggcgcgtgtctgtaatcccagctactagggaggctgaggcaggagaactgcttgagctcgggaggcagaggttgcagtgagccaagatcacaccacggcactccagcctgggcagtggagcaagactccatcttgaaagagtggctgtcttcttggattctctaggttaatcatttcaacattagagaatggatcgcctactaattatatcgaatcactatatattcttttgggatgataaataagaggcagatattatgctcccattttacaagagagacgactgaggcacaggaaaaggaagtaactggttgagtcatatgacaaatctcgaagcagtaccattctggggatagcctatgaggataaattctgcacctatactaattttcagcagtgtactctctctctctctctcttgctctctctttctctctcgctctttaatactaaggctaatacttttgtcttggaagactgtgaagctcttttttccctgtcctgctccattgccagcctcttagttgaattttcaatcctagtgtacatgcactggaatgacactttatgggaggtttagtttctaaagtcagcatggaaggtaagaatctattatatttttaaaaattcactcttaaaaagtgaattcactttttaagtgaatctatttttaagaatctattatatttttaaaaattcactcttaaaaagctgcccattttgtgcagcttgcatagtttactctattgttatacacaaaaacataccatagttaagactatgtaaggagtatgtaattttccagtgccatatccttaaacattagtatctcggcaagaggctctgagagataagcaggaacaaaaattgattcagggcagaatagattcacatctcacatctcctgctcactccggtacatttgctcactaagtgaaatggttggtagaatcgccacgtaactggaaaatttcttccctctcctctctctccttacactgaccctgtgtgcttctctctctctatttttctctctgtaatagacgtacttaaatttgtgtaagttaaatatgcatgtggtgtcgttttactgtatgtttcacaaatgacagctgtaagtcaatgaatatcattgtgaaatataagaaaaggaaaagaaaaaaggaagcttgtttttcagcactcagcaggaaaacacactgttggactttatgtttcttttggaatatgggtttactgttaaagctaaattaatagtttacatggtaagccaataagatcaatgtccttttggaaaaacaaggctaatattctagtctgggatgcactaagccggaaaagcatgagttacaagtaagtttaacacattaaaaagcatcttggggagaattcttgaatttacacaactaagtatatataacagagtctttacatctaaaccccattttatcaggccaggccatttgtcagcacatctcttcttagttacccccaaggcatccatactttacagcaaggagtgatggcaacagctgggggcgggaacttcaaagaagtaccagacccgtaggccccatgtggtggctcacgcctgtaatcccagcactttgggaggccgaggcaggtggatcacttgaggtcaggagttcgagaccagcttggccaacgtggtgaaaccccatctctactgaaaatacaaaaattagcctggcgtggtggcacatgtctataatcccagctacttgggaggctgaggcaggagaattgctggaacctgggaggcggaggttgtggtgaggcaagattgccccaatgcactccagctggggtgtcaaagtgagactttgtctcaaaaaaaaaaaaaaatcccattctggaaaaaaatcctctctgaagctaccatcaacaccatctgggttggttagttgtttattttctctctgagctttttctgatttcccctgctattttttacttcatgatgctaacccctatagaccctattcccaaacgatcttgccaggggttttacagctgggtttggccaagagagtcataggaaggtaggagaatgggagaagccaaggtatttatccctcttgtttcctgcttgggagagtgtatttgtgggtagctgagtctcatctgttctagctgttatggaacaatccctcctgctggaccagcccggatgtgggcatgggtaacatcacctccttcctttatttcctcagtcctagaaggggttgtgactttttgacattgtcaatctatgggctgccttacaatctcatttgggttttgtgtgtgtttaaaaaattaaaattgacaataaaaatcatatgtatttatggcatacaacataatgttttagtatttgtatgcattgtggaatggctaaatcaagctaattaacatatgcattacctcacacacttatctttttttgatacctttgctgcaagagccccatattaaattttcttggttgagctagctgatgtggactatgttttgttgttgttgctgtttgtcatgttccagcctccattgtggatcttgttcttggcctgatgggtttttccctaggtctgacctcacatttaaccaaccctttgctcctcatgtacatccttctattgtttcctggactcaaccttgatgcttggatcccacttgttctctcagtggctttgatgcttcagctccctcctgcaaacttttgtctctgtgcgtgtgtgcgagtccattttgcgtcactataaaggaatacctgaaactgagtagcttataaataaaagaggtttaattggctcatggttctgcaaactgtactggaagcattgtgctggcatctgcttgacttctagtgaggcttcaggaggctttcaatcatggtggaaggtaaaaaggagcaggtgtgtcatgtgatgggagtgggagcaagagagagagaggggaggtgccacactcttttaaataatcaattctcatgtgaactcagagcgagaactcactcatcaccaagggtatagcactaagccattcataagcaatccgcccccatgattcaatacctcccactaggccctacctcccacattggaggtcacatttcaacttgagatttggaggggacaaacatccaaaccatatcagggagtaagaaattgtctgacatatgagatactggattttacaaacacaagagtccttagatatttgacccaacttcctattttcatccatgaggttgctgctgcttagaatgggtaatgacttcctcaagattgccaagttaatggcagggagggaaaaggaaaggaagtttcatgtctaggtaaacgtcatatcactttatttactgtaacatgtgacagggattggggacacgaagattgagatattgattaccctatgaccctcctcattgcctgtcctttgcctttgagcaaacgttttgcactgagtggacagaaatattaattcattcaactcatatttattgattgtcacaaagggcaaggctctatgctgaacactttggaaaggacacatatgaatagaaaatgatccacatcctcaggaaactctctagaaaggagtacagcctataggccagtgattcatatgtatgttgcatatgttacatacaaaagagaaaacaataagctccacagaaagtaagcaaataaagtgttatttgcatgtggaggagaaagttgcttctggcttggcagtattagagaagacataatagagcaggtagtatttaaaatggacaggggctgggaacgctggctcacttctgtaattctagcactttagg

SEQ ID NO: 3659 - DNA, 7059 bp, Homo sapiens
actcgctgattggctgagcagggccgcggacagagagaaatgccgaggaataggggcgcggccgcccggtttcggcgatgggttatagggtccgcgtcagccccgcgcccgcacagccaacgtcacgccgcattcttatttccaaagacccctggagcttggggtcccaccccagcggtctttcggggcgtcccctgcccttcacgcgccgcgccggctcggcccgaagcgccctgcggacccgcagcctgggccgccccgaacctgacggccccgcgggggtcggacgcgggaggaacggcctcgctttcagagacgcagcgggagggcggtccccgctgtccctctggccgggtcctcagcacgcgttctcctcactcccaggactagcgagcggcgggcgcggaccggggcctggggtcggaggcggcgcagccagaaaggccccagcggcgctgagacgtttgggggaaggcgggggcttcgcgtttcgatggcgggaagcggaatgaggttggaccggccgggccggcgttcagggacccggcgggaggcggagggctggcgtcctcgcggacatccatctgcagcgaaccaggcagaggctttgggattagatccttgactccttgcgtcagtagttaagctttgtgatggtctgaggtccatgaagggattaaaaccaggaactggctccttctccaaccactaaagcctcatctgggcccacaagccctggctgttccctggagcgtgactggaagatgtgagcagctttgtgctggagccccatttccatggtgcatgctgctgccaaaccagagatcacttgtagacttgaaagggaacatgagctttgggtgaaggattcccagcccccaacagaggccaaaaagctaccacccagccaggcagaaggaacataaagtatgcattttatgatacgactcagcttggagggatgaagtagaaggtcctcactgcacctcatggcaggctgctgacggcagatattttaccgggctcactgaactgggcagtcagggaagggtcggctcctgctctgtccagctgtcttcataagggactctgtgacactttttataaaaatgactttgatttctgcataagaaggcttcccaagcttgctgtctagcagtggctgctacagggaattattcacatggcagcaagagagccctggctccctggaccaggacattccctttgtgtgtgttggaatgagagcaggaggagtgctggtcagaagcccctccccagggctctgggacttcagtgttctcagacaaactgggccgctcctctgagctgggatgctgacccacacttggccccggctctggcatccacaggacgctgccttatccgtcatctcgctggggctgggggctagaggctgagcaggtcacactgaacaaaagaagtgtgtccccatcactaggctaacatctgagtttcttccacagtatttggtaacacagtcagaaacaagactgaagatgattctggaggcaactgggaaccccccagaacgattctgcaggcttctgggaagctgaaaaaccccaaggccagactggcctcagaatgcctgagtccttttgattccactggaaaagccatccatctgtgccaagtgtgtggagagcttcaagagccatatagccctggccaccatgagcacagccacgtgggggagtagtcctgaaagtgtcctggtgtggcaaaggctttccactaagtggacctcagatggcacaggaagaccctcctggggatgtgggaggacactgcctagtgggtgaggggccgctctttcaggtgtgcacactaaatgcagagacagcctctcctggctgccaagaagcctgtgcatgatccaggaccacaaaacacttgcaaactcactgcccagaggccctgtgcctgtctggagtgtgcccagtgtgtctgcgccccacagcttgtcctggcccgccagcagagccgcagcactgcagggcccttctgttgtgagtgccagggcccttgctggctgcctgagcaaggcaaaaggttcaaaacaggaagtctctgggcagctattcccaggtgcagaggggagcagcggccacacaggtgccagtgtggcaggagctgcagtcagaggcagcatctcaagagccctgggagcaggggccagccacgtgaagcccacgagtgtcgctggcacagggaagggacacgaggatcacactgacccaagagaaggcccacagtgaggaggccccaccgaagcatccccagcaacagggactgaggcatctgaggcagccagcccactcggaaaggcctgctgactgcactccagatgtcaagagcacccttgggaaaaagaaaggcaggagtgcagcactttctagagcctcagctcacttctctccttctagctccagccggagtgatggaagaggctgcgctgggagctgcctccctgggagcctaccctgcccagcctgagagtggaggctaccagcatcacgcttcccctagtgaaatccatctgtcctgaagggaaccctgggacggggtcaaggaaaccctgttcacccccaccacggggtcaggtcttcaccaaagggaggccgcacggattcccagtcgcaaacccaaagccttgctgcctttgcctctgtttccatagttgtttcaatgtcttttttaaaaatcacatacactcgagtaagactgagtctcctcaccgaagagatctggctgtatcccgagtctctgaaacctttgctccagtcccgtgggagcgtgccgtcccgaggatgtggagccgcaagggctcgccagagggatctcaggagctaggcctcaaggagcgctgttgagtgacaggtctgatgcagtagcttttactattggtggaaatcgatgttttttccttgaaagtctacctttctaagttcagtaaaccaaattagatcatgtatgtgaaagcactttgtaaactatgcagtactccagaaaaggcagccaagcccttaattataactcaccaaacagccaactctcatctttaccttctaactggcaaaaatgattgagctcactttgaaggactagagaggaaagaaactgaaagacaaaaatcaggtgaatacacaggcacttcccctgcccacctctgttcctggccctgtcccctcgtgagtgagagcagagctcgttctgtcagcttctctgagctcctggtcctcgcttagggacacacaagacagagatgtgttgaaatagactctgctttattcaggtagcaaaaggttaggaatcaaacatggtttttaaaacctcctttcatctttgaaaatagaggagagaacatccctgggccagtcacagttactgtatttggctaagcacacacctgtatgagggacccgcccctccacactgttctgataggtacttagcaccctagaaactcatcctctgcaggagagagaagcaagggtctggagcgcggtcacatactctaaggtatcttccaggacagggggctgggctccctcactcccacctggagtcgctatggctattgggatcaaactaccagttacatactggttacttggaatgtcagacccggtgggtatcagtcatcagggagagggaggggaaatgccaggacacgtacatacggatgctgtcaagactacaggcaaggaggagggtggcgacaagcgctgggactccagccaaagcgggagtgcatgcttcttcccctcccagagccctgtggtttttcttcttgtgaggcataaacaggaagcctctccaacaagggggtctccagcactaggggctgaaactcagccagcctctccaaacaaagcaaaggggccagcctgggccagggcctctgataaggatgctcactgtgtttccacgggggtcctgaatgaggaagttcaggaataagatggcagtcatcttcttccttcttggccattggctgacaaaggggaacggagcaggcctgtgccccttgagaaatcgggtagtgcaaattttatgacaaacagcattctcagtggccccgctgcacagggacccccctttcccaccacctaaggaaggcactggccggtgtcctcggagcacgctgatgctgacgtggagagggcgagttgcttcccctagcttccacctcagctccagaactactcccacagagacccactcacggctgctcacaggatggcctcctgctctgagggattcttcaaggatgaagaggccgcaggaagcatgtgtgctggaacagcaccttgatgtggaatccctgtgggtagggcagaggctatagccccacctaaaaaagcctttctccctccctttccacgagttcacatccacagtgcctgacctgggcaagttcctgaacgcccatggagacggtgatggggagaaggaggcctgtgtgtgccttagccacgcagatagtaacacctcccagagctcccgcaccacaggcctgtggggtccctctgaccgccagacccacagggctgggagacatttccacaggtcaaaggcagaaagcaagaaaggaattcctgactagaactgaaaatgacacgaaagcaacagtgctaaggctaagtactggggtggggatgaaagggcaggtggggtaccagggtacctgcggtaccagggaggggctcggacgccagcatctaccctgggaatgggaagggtactcagacagcagcttctaccctgggaataggaagggtactcaggtgctcagatgccagcatctaccctgggaatgggaagggtactcagacagcagcttctaccctgggaataggaagggtactcaggtgctcagatgccagcatctaccctgggaatgggaagcggcagactatggagaaagggcccacccacaggggcctgcagcacagcacaggacctgcctgagccaggcagcaagcaagctgggatggatggcgcccacttcctgcctgtttaaaacaagtatcaggcagggcagagaaaccctgcctgctgacttgcctcatttcctgcccatggttaaggaaggcagaacctagacaaaatcatcctcctcctgataagcggcctcctgagcctgccaagacggagctgcccttggaaggaaaagtgcttcactttaggtggaaggaagatcggggcgaggagggtgtgaacctagcagtgccagaagcccctctgtgcctctagggcggtggttctgtggttctgaagctagagcaggcccaaagtccctggaggaggttgttcaaagcccttgtcactgagcgcccattcggggatgtctcagtgggccctggagatcctggtgcagagtccccagggcagctcagagaagagtggactagcctgtcgtgcagatggtgcattcagagagcaactcctacaacaaggactttggagacaaattcctacctgtcccactaaggacgaggatggggcagatggcagctaagtccacactgcagccagaggtctttgagggagctcgaggctctcattcactaatcctagggcagatggggagtcagcaggcacttggatctctgctgccacttcatggagagggaaactgaggcacaaagaggaagggattaatcagaccactgcctgcagcagagctggggctgcatcccaagcctcccaactccaacttcgtcccatcctctcctgggtaaaccgggccgggcatgccacgggttaaacgcggctcggctctccgggaagcaccagaccccctgccagaagagcccagctccaccatctggagctgcaggaagagaactttcttgggtgctctgtgcaaagggcttgtgattgtttcgccctaaaggaagccctgggaagaggtagagttccgcacgagaccacggcctcactgcttctgctgtgggagccagggtaggaagtcccagaacaatgcctctgggggctcttgcagccaggccagctgtccctagagcaggggcaacctccccctctaacaaggtggtctttcccattcccacttagactgtgggcagcctccctggaacattccccagggatgtccaacagtctcccctaccaggacactcctcttgccaccaaaactcaggggctgaaacctttcatgatggggttattttctgcagcaccttaaaaatgaacttgagatatagaaccttctggcacatttgtgtgctgtgaggcatggctgtgctgagtggggcctcaggaaacaggtcatgcacctcctgatacccctgctgctctgggatgccactgcccacttcctggtgcttagagaccatcgccaccagcagaagatcctagggcagcctagaatctgcagagcctgtcccagtgatcacagaggcgtctccaaggcagtcccaaggactccctgtccctcaggacatcccgggggcctcctggctggtgtggggatacaggagtctctcgggaggctccatgatgcagtccttcagaacctccgctgcttccctggagggcaggatgggtggcttctgggtcctgggctcctccacatagagggctcccatctcctccttcctgagcctggcgcctgtgagggaggaaggagaatacaattagactgactgacagtgaccgccttccacatccagcttcgcccaggggctgtttggtgaggaaagcttggcagaacagactgaagtcaggaccacgactgctctttgcagccctcatctgttgctactctgttcattcttttatcctgagataggggatctcaactgggggcgattttgtcccccaggggccatttgccaatgtctggagatgatttttgtggtcacaaatggggtgtgtgctactggtatccagtggttatctaataggtagaggccatggatgctgctcaagttcccacagtgaacaggaagggcccccaacagagattacccagccccagcatcaacaatgccaaggctgagagccctg

SEQ ID NO: 3660 - DNA, 1359 bp, Homo sapiens
accctcggccccccacggcggttggtcccggcgggggaaggagaaagtgagactcggtgtcatcaccaatccgtcgccagaaggggaggaaactggaatccagcagcggcgagcagcagctgggcggtcacatctggaaatggaaagccgacctccccctcctcctccacctcttcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcaggacaactgtgcagactacaaagcttcggaaaaccggagaggctgagtcgactaatcgtgttgttgcacgttagaaacgcttgcattgcctgactctgaaaccagaagggcggccgaatggccttcaccctccattaaccctcgcctccttcagaagccagtgcctctggaaatgcctggatctgcgaccccagcctgagcctagtagggcccaagggaagctgaacgccccgacggctctcatgggcaccggcaacagttttccgtttgtgcctactccacctgctgtctttgttgggtcagcgaacatcgcctccctctaccgctcaatcagcaaaagggaccgcccttgaggacctcacccgcggctcactcccctcccaacttcgcgggcatcgcctccggtcgcctcttccgaaggcctaacgagcatgttagctgcgaacggaggtgaggaggctccgctgactgaccggtgcccatgtccagggcacgcacaaacgccatgacttggcttggcctctctcttagttattcacaagctcagcccgataggcacctctggggcggcgacggcaaagagggtgcgcttattaagtgcagctccacggggactggcctctgcacggctgtgtacacctgagcgagacgctcagtcgctctctaaagccgcttctgcggatgacagacacggagataaacgtgagaggtggcccaccacgacttgccctcctttgcccgggtttgcccctcgctgcggaggctgttctacatctggcccttggagcaggccggctgacagcgtggtaaaggaagatttctgcgggagggcggccagtgcaaaacaattccctgaccgggaatcgaacccgggccgtggcgctttcagcaccgaatcctagccactagacaaccatgcagatgcgg

SEQ ID NO: 3661 - DNA, 1138 bp, Homo sapiens
gttcttagaagtggtgatgcaagaagtttctaggaaaggccggacaccagctcttttaaaggatctgtcttctcaaggagcctagttggctatgcacaaggaaagcgccaaaagagctaaagggaggaagggaagagaaaacatttaactctcccatggtggttactgacccagcgtgggtgcggggagattgggatgggaagtccaggtctgggggcagccagcagttgtcagtttctcattgacagccctgctccttggagattgtttttgtgggtagtcttgtgtgtggcattggtggaatggctgaatctaggagacgcggcgtgtccagaacttgctggaaattggttttgagattttgggcaaggcctctcacccggagcctcagttccctccctaataaagcagggctgttataaggataagatgcaatcttgagggggtgggaaaggactaagagctctgtaaaaatacaaaccaaatgctggtggtgcttccacacctgcggcatttggggtgggggtggtgacaacattgcccacactcaacccacacactcaggagttggggggggctggttcttaagacgagttggcttgcaaaggagtgaacttgagaaggacctgcgcctcgtgtatgtacatttgtttttggccaggcagaggcttacggtgaaaagcccaaggcccagctgacagtggacacaggggaatttgtttgtttgtttcaatccgcatctggagtgagtcattgccacttgtcatggtgaaatggcaaatctgggcttcctgtggttccagaagcctgcgactggaaatccacaagcgagctggtggttgaagctggttaaagaacagcctaggtattccagaagtgtttgaggatcccttccatgaaggaagagaggaaagtttttaagtaaacctcccactcccatgtgtcttcagctttcttttgcaaaggagaaaatccttgaagtttggtaaagaccgagttagtctatctctctttgcctatctcgagttgggctggggagaggaggagataggttcttttgtctttttctgtcttctcccttccccacttccttccctccagtccccactcactcacatgcacacactaaccttggagc

SEQ ID NO: 3662 - DNA, 3476 bp, Homo sapiens
tggcaaaccaaaaaacatattctatctaaagtggatggccacaacttgctccagctgtggaaacttgggccatgtactgctagatctaaggattttcttttgagagatgctagatatatacgttttttaaaaataaaattatcctgattttaacaacattgccttattatataaaacataccttggagggtgtgggtaagacacaatgtccttgaaattatatttcactaggttaataaaattggctccggaagaaaataattttaaacagcaaaccaaaaagtgaaggccttcaaaactaacaaaccaaaggaaaacaaaacaaaatgacaacaagaaaaaaacaaagaaacaaaacccctggaccttaccatttttctaaggcatgttgacatgataaaatcaaaattgctttgtgcttataaggatcaaaggttatgcttttgactttataaattcagagaaagaatttaattggaattatttttatgaattaactgaagatctaaggcaactggataatttaggttctgctaatatctagaatattcaaagtttatgtttagtctgacactaaagaatccattatttctcttgacttccaggctggtcagtgtctttcctgtgtcatataccaaacaatgtgttagaaattgtcttctcactcataaactaatatttgttcagagtaaaaagtcaagcaagtaaataatgagaaaaaattcagtgtattgtataaacaaagacagaaggcagaccaatggttacctggggcctaagctaaagagattaattgtacacagacacaaaggaattttttgggatggtgaaagtgttctaaaactggattgggatgattgtggcacaactgtataaatgttattaaaactcattgagttgtacacttaaatgagtggctaagttgtgctttaataaagctgtaattttgaaaaagaataatggatgatcaactgtgggctagagtatgatgaaaacacaagacatttacatagtttcaaagtatctccccatcaggtacttattaactgcatcagggaaacagtaattttcttgtggcagaaccctgctgacaaagttaacattctagtaaaagcacaggtggatgtcatgtgcctcctgaagtgatgcacagagaaggatgcaacatcaacttgtagtatccctgccaaaaatataaaacctgaatttaaccatgctgaaacataagacaaatccaagtgaaggaacattctacaaaacaactgaccagtactcctcaagagtgtcaaggtcctggaagacaaagactgagcaatgcttctgattaaagtagactgagaggtgacaactgaatgcaatgtgggattctggattaggtcttggcccagaaacaggtcttcggtgggacaactggcaaaatgtgaataaggtctctggttttgtgaatggtagcgtatcgacgctcattacctgcttttgatcatggtagtgatagtaagatattaacattcaggaaagcacagtgaagggtatatgggaacctctactatttttgtagcttttgtaagttgaaattgtttcaaaatgagttagaaaattaaaaggaagttttctctttcagctgggaaaacggcaatggattaataacaagaaattaatggtgaagtggtgacgaaaattctacattgcttagaaagcaaatagtgaaatgaacatttacattctggcaacctcagaagtacaacgaacaaaggacaccagccaggtagggcaaaggcctgtgaacccccttttgctgttaaatgtttatcagatgagtgctctgtttctgttatattatattgcttttctctccaatgtttactgaggaagaacaagtagctcctcaggcaagtcaactgttaactttgcagtttttatttaatctcccaggaatgtaacccttaactttaaagaatgtagtgaccataaaacttataaagcatgtttcttaaggaaattgtacctgtttatttaatctatcagatatgaatgttatagaaaattaaatttgtccacttaagctgtagatgaacttttcacctttctgatcagaaattcaccatcttatagtataggttctgttattaatcagaatatttcatttagactctttctatccaactttttcttagaggctattcaaaataaaggtgcttctaacagtttcatatcgaaatacgatgcaaagccttgctcttccatggtatcctttgagtgagccaaacttatttagccattcccctatagttaaatagctaggatgtttccaacatctcacctttaaaacaatagtgctatgaatgtcataaatgtttgtatatgtaaatatgtaggataaatccctatcagtagaatttcaaaaggtatacgcaatcagtattttcatacatatttaaaattttccatccatacaaaggttgctaacatatttatttaaaattttaaaaataattttatatgcctcttgtaaccagtaataggatgcaaagttttttttaaggtaacattgctcctcttcccccattgtctctgtcatctatagtactccctgaggtagttcatgttattgcaagggtgtgtatcatcacaaacatattgcttccacatacatatatcagcatacatatatatatatgtatagcatatatatatatgagcacatattaatatatgcccatgcacatacaagcatgtttttgttaatttttactgaaatggaatcatactgcatacttatgaacaaattgcttctttcaccttatatcacttataattgttattctacaaatcagtacatataaaaaatacatatttacatatgtaatactctatctttctgttataattttctgcatgcacatgtatgcatatacatatattcataaacataaaacttaatctaaacgggattttttttggggggggtgatatggtttggctgtgtccccacccaaatctcatcttgaattcccatgtgttgtggggggacccggtgggaggtaattgaattatgggggcaggtctttcctgtgctgttctcgggatagtgaaaaagtctcacaagatctgatggttttaaaaagatgagtttccctgcataatctctcttctcctgtctggttccatgtgagatgtgccttttgccttccgccatgattgtgaggcctccccagccatgtggaactgtaagtccaataaacctctttcttttgcaaattgcccagtctcaggtatgtctttatcagcagcataaaaatgaaacaatacagtaaattggtacaagtagagtggggcgctgctgaaaagatacctgaaaatgtggaagaaactttggaactgggcaacaagcagaggttggaacagttttgagggctcagaagacaggaatatgtgggaaagtttggagcttcctagagacctgttgaacgactttg

SEQ ID NO: 3663 - DNA, 6886 bp, Homo sapiens
gcccggtttcggcgatgggttatagggtccgcgtcagccccgcgcccgcacagccaacgtcacgccgcattcttatttccaaagacccctggagcttggggtcccaccccagcggtctttcggggcgtcccctgcccttcacgcgccgcgccggctcggcccgaagcgccctgcggacccgcagcctgggccgccccgaacctgacggccccgcgggggtcggacgcgggaggaacggcctcgctttcagagacgcagcgggagggcggtccccgctgtccctctggccgggtcctcagcacgcgttctcctcactcccaggactagcgagcggcgggcgcggaccggggcctggggtcggaggcggcgcagccagaaaggccccagcggcgctgagacgtttgggggaaggcgggggcttcgcgtttcgatggcgggaagcggaatgaggttggaccggccgggccggcgttcagggacccggcgggaggcggagggctggcgtcctcgcggacatccatctgcagcgaaccaggcagaggctttgggattagatccttgactccttgcgtcagtagttaagctttgtgatggtctgaggtccatgaagggattaaaaccaggaactggctccttctccaaccactaaagcctcatctgggcccacaagccctggctgttccctggagcgtgactggaagatgtgagcagctttgtgctggagccccatttccatgggcagaaggaacataaagtatgcattttatgatacgactcagcttggagggatgaagtagaaggtcctcactgcacctcatggcaggctgctgacggcagatattttaccgggctcactgaactgggcagtcagggaagggtcggctcctgctctgtccagctgtcttcataagggactctgtgacactttttataaaaatgactttgatttctgcataagaaggcttcccaagcttgctgtctagcagtggctgctacagggaattattcacatggcagcaagagagccctggctccctggaccaggacattccctttgtgtgtgttggaatgagagcaggaggagtgctggtcagaagcccctccccagggctctgggacttcagtgttctcagacaaactgggccgctcctctgagctgggatgctgacccacacttggccccggctctggcatccacaggacgctgccttatccgtcatctcgctggggctgggggctagaggctgagcaggtcacactgaacaaaagaagtgtgtccccatcactaggctaacatctgagtttcttccacagtatttggtaacacagtcagaaacaagactgaagatgattctggaggcaactgggaaccccccagaacgattctgcaggcttctgggaagctgaaaaaccccaaggccagactggcctcagaatgcctgagtccttttgattccactggaaaagccatccatctgtgccaagtgtgtggagagcttcaagagccatatagccctggccaccatgagcacagccacgtgggggagtagtcctgaaagtgtcctggtgtggcaaaggctttccactaagtggacctcagatggcacaggaagaccctcctggggatgtgggaggacactgcctagtgggtgaggggccgctctttcaggtgtgcacactaaatgcagagacagcctctcctggctgccaagaagcctgtgcatgatccaggaccacaaaacacttgcaaactcactgcccagaggccctgtgcctgtctggagtgtgcccagtgtgtctgcgccccacagcttgtcctggcccgccagcagagccgcagcactgcagggcccttctgttgtgagtgccagggcccttgctggctgcctgagcaaggcaaaaggttcaaaacaggaagtctctgggcagctattcccaggtgcagaggggagcagcggccacacaggtgccagtgtggcaggagctgcagtcagaggcagcatctcaagagccctgggagcaggggccagccacgtgaagcccacgagtgtcgctggcacagggaagggacacgaggatcacactgacccaagagaaggcccacagtgaggaggccccaccgaagcatccccagcaacagggactgaggcatctgaggcagccagcccactcggaaaggcctgctgactgcactccagatgtcaagagcacccttgggaaaaagaaaggcaggagtgcagcactttctagagcctcagctcacttctctccttctagctccagccggagtgatggaagaggctgcgctgggagctgcctccctgggagcctaccctgcccagcctgagagtggaggctaccagcatcacgcttcccctagtgaaatccatctgtcctgaagggaaccctgggacggggtcaaggaaaccctgttcacccccaccacggggtcaggtcttcaccaaagggaggccgcacggattcccagtcgcaaacccaaagccttgctgcctttgcctctgtttccatagttgtttcaatgtcttttttaaaaatcacatacactcgagtaagactgagtctcctcaccgaagagatctggctgtatcccgagtctctgaaacctttgctccagtcccgtgggagcgtgccgtcccgaggatgtggagccgcaagggctcgccagagggatctcaggagctaggcctcaaggagcgctgttgagtgacaggtctgatgcagtagcttttactattggtggaaatcgatgttttttccttgaaagtctacctttctaagttcagtaaaccaaattagatcatgtatgtgaaagcactttgtaaactatgcagtactccagaaaaggcagccaagcccttaattataactcaccaaacagccaactctcatctttaccttctaactggcaaaaatgattgagctcactttgaaggactagagaggaaagaaactgaaagacaaaaatcaggtgaatacacaggcacttcccctgcccacctctgttcctggccctgtcccctcgtgagtgagagcagagctcgttctgtcagcttctctgagctcctggtcctcgcttagggacacacaagacagagatgtgttgaaatagactctgctttattcaggtagcaaaaggttaggaatcaaacatggtttttaaaacctcctttcatctttgaaaatagaggagagaacatccctgggccagtcacagttactgtatttggctaagcacacacctgtatgagggacccgcccctccacactgttctgataggtacttagcaccctagaaactcatcctctgcaggagagagaagcaagggtctggagcgcggtcacatactctaaggtatcttccaggacagggggctgggctccctcactcccacctggagtcgctatggctattgggatcaaactaccagttacatactggttacttggaatgtcagacccggtgggtatcagtcatcagggagagggaggggaaatgccaggacacgtacatacggatgctgtcaagactacaggcaaggaggagggtggcgacaagcgctgggactccagccaaagcgggagtgcatgcttcttcccctcccagagccctgtggtttttcttcttgtgaggcataaacaggaagcctctccaacaagggggtctccagcactaggggctgaaactcagccagcctctccaaacaaagcaaaggggccagcctgggccagggcctctgataaggatgctcactgtgtttccacgggggtcctgaatgaggaagttcaggaataagatggcagtcatcttcttccttcttggccattggctgacaaaggggaacggagcaggcctgtgccccttgagaaatcgggtagtgcaaattttatgacaaacagcattctcagtggccccgctgcacagggacccccctttcccaccacctaaggaaggcactggccggtgtcctcggagcacgctgatgctgacgtggagagggcgagttgcttcccctagcttccacctcagctccagaactactcccacagagacccactcacggctgctcacaggatggcctcctgctctgagggattcttcaaggatgaagaggccgcaggaagcatgtgtgctggaacagcaccttgatgtggaatccctgtgggtagggcagaggctatagccccacctaaaaaagcctttctccctccctttccacgagttcacatccacagtgcctgacctgggcaagttcctgaacgcccatggagacggtgatggggagaaggaggcctgtgtgtgccttagccacgcagatagtaacacctcccagagctcccgcaccacaggcctgtggggtccctctgaccgccagacccacagggctgggagacatttccacaggtcaaaggcagaaagcaagaaaggaattcctgactagaactgaaaatgacacgaaagcaacagtgctaaggctaagtactggggtggggatgaaagggcaggtggggtaccagggtacctgcggtaccagggaggggctcggacgccagcatctaccctgggaatgggaagggtactcagacagcagcttctaccctgggaataggaagggtactcaggtgctcagatgccagcatctaccctgggaatgggaagggtactcagacagcagcttctaccctgggaataggaagggtactcaggtgctcagatgccagcatctaccctgggaatgggaagcggcagactatggagaaagggcccacccacaggggcctgcagcacagcacaggacctgcctgagccaggcagcaagcaagctgggatggatggcgcccacttcctgcctgtttaaaacaagtatcaggcagggcagagaaaccctgcctgctgacttgcctcatttcctgcccatggttaaggaaggcagaacctagacaaaatcatcctcctcctgataagcggcctcctgagcctgccaagacggagctgcccttggaaggaaaagtgcttcactttaggtggaaggaagatcggggcgaggagggtgtgaacctagcagtgccagaagcccctctgtgcctctagggcggtggttctgtggttctgaagctagagcaggcccaaagtccctggaggaggttgttcaaagcccttgtcactgagcgcccattcggggatgtctcagtgggccctggagatcctggtgcagagtccccagggcagctcagagaagagtggactagcctgtcgtgcagatggtgcattcagagagcaactcctacaacaaggactttggagacaaattcctacctgtcccactaaggacgaggatggggcagatggcagctaagtccacactgcagccagaggtctttgagggagctcgaggctctcattcactaatcctagggcagatggggagtcagcaggcacttggatctctgctgccacttcatggagagggaaactgaggcacaaagaggaagggattaatcagaccactgcctgcagcagagctggggctgcatcccaagcctcccaactccaacttcgtcccatcctctcctgggtaaaccgggccgggcatgccacgggttaaacgcggctcggctctccgggaagcaccagaccccctgccagaagagcccagctccaccatctggagctgcaggaagagaactttcttgggtgctctgtgcaaagggcttgtgattgtttcgccctaaaggaagccctgggaagaggtagagttccgcacgagaccacggcctcactgcttctgctgtgggagccagggtaggaagtcccagaacaatgcctctgggggctcttgcagccaggccagctgtccctagagcaggggcaacctccccctctaacaaggtggtctttcccattcccacttagactgtgggcagcctccctggaacattccccagggatgtccaacagtctcccctaccaggacactcctcttgccaccaaaactcaggggctgaaacctttcatgatggggttattttctgcagcaccttaaaaatgaacttgagatatagaaccttctggcacatttgtgtgctgtgaggcatggctgtgctgagtggggcctcaggaaacaggtcatgcacctcctgatacccctgctgctctgggatgccactgcccacttcctggtgcttagagaccatcgccaccagcagaagatcctagggcagcctagaatctgcagagcctgtcccagtgatcacagaggcgtctccaaggcagtcccaaggactccctgtccctcaggacatcccgggggcctcctggctggtgtggggatacaggagtctctcgggaggctccatgatgcagtccttcagaacctccgctgcttccctggagggcaggatgggtggcttctgggtcctgggctcctccacatagagggctcccatctcctccttcctgagcctggcgcctgtgagggaggaaggagaatacaattagactgactgacagtgaccgccttccacatccagcttcgcccaggggctgtttggtgaggaaagcttggcagaacagactgaagtcaggaccacgactgctctttgcagccctcatctgttgctactctgttcattcttttatcctgagataggggatctcaactgggggcgattttgtcccccaggggccatttgccaatgtctggagatgatttttgtggtcacaaatggggtgtgtgctactggtatccagtggttatctaataggtagaggccatggatgctgctcaagttcccacagtgaacaggaagggcccccaacagagattacccagccccagcatcaacaatgccaaggctgagagccctg

SEQ ID NO: 3664 - DNA, 1525 bp, Homo sapiens
agaggctcgcggcttctgcctcccgcccccactcttttcgttttttgtcgtcttcataagccgcagaaggaacccaaaccttttccctgtttctttcactacatgaaagcacagtagctgagggtaggggaaagtcgttgcagtggcgctctcggcgcttctcccgttgctgccctgcccaccacggccttgaggagaggcagccaagcacaatggccgcggtcagggccgcgagctctgcttgtgcccacgccccgacgcctgcttggcctgggtgaccaatgcttctggccaggacctccggagctgcccttcgcctccctgcgattggcccgtgccagatttttcctggggccgagcgcagaccaccccggccgccactcaaaggccgggcctggctcccacccagcggttggtgaaccagagctgcgggctctgagagcttcggtcccgggcggcagcccacagcgggcgcggggcctgggtgcgaggggcggggcagagaccgcgagagagagttctcgtgaaattcgggagactcaacgtgggggaaaaacagtatctggggatccaggtgcggaaatgcacctcaagtgcaggaacgcgggtcagggataggcccgacgggccttgggggtggggagaagggtgaataatggaaggttggtgcgggaaagaaccttggtacaaatcccgccattttaagcggaggttcggagagaaaacaaggtcactaacccaggaaaatgtctgcctctttcccataaatcgcctggccctggccacagacctcctggagactctgttctctgctcacgccggtcagtcttagattggttggctggagtactgctggacagatagagaaataggagaaaacagggaagcctgagaaccttgggaggaattgttatttgcttaatggccagaacctccaggagggcaagaaccagatatgctgtgttcacccttgttctctattatctatcacagttgcaagacaacatggggatcagtaaatagtcaacaaataatggagtagaagaaggtgagaaagaactttgcagtggaatgcaccctatttagttctaatcttatattactatatgctattatagacagtgtgaacagtggttaaaccacagactctggaagttaagattcctggttttgccagacactagctatacaaccgttaacaagctatatgacttctttatgcctcagtttgctctgacatgaaatgaagctaataatacctacctcagaatctttatgaggatttatatatttgaagcacttataacagtaccgtctgtaagctagtaatacttttttaaagcaactctatgaggtagtgctgcaggaaattaagtcttcaagacattctagtagttgcctagggtcccacaaattagtaagtcaaaaatctgtcatataaatctggatctgacagtacccccagagtcattgcattagttgggatacagagatggcttattcacagtctgtcttaagaagcagg

SEQ ID NO: 3665 - DNA, 1998 bp, Homo sapiens
gggatttcgggctccagcagcacgcagcctccagtcttgagtgactcctgggctttggctcagcagtaactcctccataaaaacaagtgtgtgcatctggctgttagaagaattcatgctcatccgggtaaggataaactggagaaattattcctttttttccctttgggtggttttgaggttttagaaaaattgatcctctctttgagaagagttcagaactatttgtctgaagtttttccatccaaactgctttatcgtattatccactgtcttacccttttcctgtgaaatctaccctcttcaaaacatagtttcattttcaaattttaaaagataagattccatttttctttccgtgcatgaaactttaaaaattaaatcaccacagttgctactggcttagaagtggggtcttatatttttaggaagtatactttaaaagttaggcagaggggaaatctatgtttgcatttgatttatgaaacagtgactgttacattaaagggcggattttcagacatactacttgatctgctctgacaagctatgagctctctctctctgccacttttctcccgaactgtgttctaatggtggaatcagctcatcttttttccttaggcatgtggtttagtctgtgtacattcagcgcggtggcatttttcttgaagaagtgactaaggcttcttggatgaattctgtctttgaaagaggtagtagaattgcatcagaaaggcatttacagtaaatggctacccccccttcctgtaatgaccgcatgtgaaagaatgcattaattcttgttttgaggaaatgagagttgtagagttctatgaaaaactcccttttttatcattagttagccaggtttgaatgttcacattttaaaaatcaggctcattttgtgctatctaaataaaagtcacaaagatacagctttccactccatgttctatgtggagtaaccaatcatcctgaactcaaaaagaggaaattatgttgaatatggctacagttaatggcataagcctaaactaaattaatttcttcatagtctttttttatattaagttactgtgcttcctagctatgttgctgatttgtccatcaggatttgattctcagtgcgacggacgatgaagactaaaaggaaactcccatagatgatctggtcaggagttctcatggaagcagtaccgccccctaggtgacagagtggaaatttatgagggtattctggtggtacaatgaaggatttttctggtttttttttgagatggagtctcactctgttgcccagactggaatgcagtggtgtgatctcaactgactgcaacctccgtatcctgggttcaagcaactctcctgctgcagccacgaaaaatgaggaagctgtgagtaccagtggaaggaacgagccaggaagagggactggaaccatctcagaagccatgcccctcaggctggaacttgccctgtctcctcgcagatgagactgagtgtacttggtctggtatttgtggcataacttacggaacacataagaatgatacagatactatttaatgatgacctaatacaagcttagatagctaaggtgaaagcttctatggccttaacattttcctcttgaagaatgtattttctgtaataaaatacagtggctacttgaaatctataaacttatgtgaggtctggataaatctgagcaactttcttctttgtgctccaggaacctacgcactatatatataaataaagcttaagtaaacatcactgcaatctgtgttttgtttgattatattacgtattgcctgatctttaaataatgatgaaaaatagcctttaacataaaccatgaatggatatgcacttgagggaaacagtttcttggataattaaactttaatttctcaccgtggattccttggatcttgtaatattttttaaaacagtcctggggatttatttttaaggcgtccaaatgaattatta

SEQ ID NO: 3666 - DNA, 566 bp, Homo sapiens
atggccttcaggcctccctgccacggggatgctgccttttctgctccgggtgtttccacgaggcaggcatggaatcttccctggacaagcgacataccgtggagagacagcggaagacaccatacagtaaacacaggagcctgcgagagaacctctgccgagcaccagtgaacggccaagtgacacgagtgacaccatgagcttggtgccctctccatcccaagccagaggcggaagccaggcccttcctcccagcccagactcctacatcccaaacttgagccatggcacacatgctgggcacttactctgtgcatagcagagggagctgagctgcatccagaaacagacctaggagctcacagacccaaggcctgggtctccacccctggaagagggtggtgccgagagcagggcccccggctgtcactggcccggagctcaccgtgcaggggcagcccaggccctccggggatggcactggggtgtcggaggccaaggagcagaaacagctgtggatgcttccctcggaggactgggtggggccgggaccaccaggacctgcc

SEQ ID NO: 3667 - DNA, 1131 bp, Homo sapiens
gtgccagatctcaaatcacaaatggtcatgctagaactgcccaggttgtatttccctgagacaatccatggaccttttcctgagttagtaaatttcctgagttagtaaattttggacctcccttgaaaaatcagaagacctggtgatgccctcggcatccggttcccacctggagccaattggctcatgctggagccaattagctcatgctgaagagcgccctctctcgttcattaaggttccgcccaggccttgcgcatgtcttttccctgcctgcttttcacagcccggtgccaaataaagcagctaccagaaccagctgccaccccccagatgctgagctcaggtgttgcaggttctggtgcctgggagcatgagcacagtgagcatttcccagggaggcccaacaggatagtccttgttccaggaattcagcgatgttttacagctggatgtaaaagaaaattcaaagcatgctatgctatgaacaatcgttatcctgctgtctaattggggtcaaaactctgaatttaagagattattaacaggatgactaatactagccaaatttggggagaaattggggagtgtaaacagaaatattttccagctctactacataaaaatgtacttggaggatgcaaaatccagtttattttgcatttatggaactaaatgagaggatgttgagagttataaaaagaaagcaaaaaataagtttgactatttgaattgtaaaatagaataatatataattttattctattgatttttaaaacaaaatttattaagaattctataatcctatgcaagttttgagatttaaaaatctacaactagaagatgtgctttgttattcttttctgatactgatgtatttataactgccttcttccttctttgaaaagaaaactatcccaataataaaatattaacttatttatttttattctttttatttttactttttgtgggtacatagtatgtatacatttatagggtacatgatatattttgatatgggcatgcaatgtgacctagtcgcatcagggagaattgggtatccatcctctcaagcatttgtcctttgtattacaaacaatccaattacactcttttagttatttttaa

SEQ ID NO: 3668 - DNA, 3673 bp, Homo sapiens
ttctttccttcttttttgagacagagtctcgctctgtggcccaggctggagtgcagtggcgcaatttcagctcactgcaacctccgccttcctagttcaagcgattctcttgcctcagcctcccgagtagctgggactacaggcacgcgccagcacgcccgcctaatttttgtgtttagtagagacggggtttcactgttggccagaatggtctcgaactcttgacctcgtgatccgcccgcctcggcctcccaaagtgctgggattacaggcgtgagccaccacgcccggcgcgagtgtttacaattgttgtctgggagtcatagcaaacgtgaacacactttgtggttttttgtgtgtatgtttttgtttgtttttttttgttttccttcttgagacagggtctcgcgctgtcgcccaggctagaaggcagtggcgccatcacagctcactgcagcctggatttcccgctctcaaaccatccagccctcagcctcccaagtagcggggaccacaggtgcaagccaccatgcccgactaatttttttttttttttgtatttttagtagagatggggtttcaccatgttggcaaggctggtctccaactgctggcctcaagtgatccttgcccgcctcggcctcccaaagtgctgggatcacaggcgtgagccaccgcgcccctctacgtttttatttattcctaataactactttattgtgattcttaaagagctttaacttttcttgagataattttaaactcacaggaaaggtgaagaataataccaagagagactaacagcaggacggcatgaagagctcgggattcacccctagtgaaactgaaaattatttaaaacaacaaacaaccattaaccatttaaagcctttgaaatggtcctaagggcaaacagcaaatgaagaaacatctgttccaaaaaatctatgaaaactcttggatcagaatgtgagagtcagtctgtggtatttaaaccaaacctctccctttgttcagcaagagactccactccagactgctgcaactcagaacctctctcttcccacagctcccagtcagagaccagcatatcagcatttctcatcttgcccctagctacctgatgctgaaggtaaatcctgggggagtgtggtggagaggtgggagattccttcttccatccagaggctctaccttgggtggagtgctgagacaccagaggagacttcagctctttttctccatcactttcaccccatattcacccccaacctttttttttaatctctccatcttcccaagatagttatattctgtttgattaatcttcagtatatatgctattataatcatgtaaacggtagtcacagccaagttatgtaccaaactatgattacttttcctttcccacacaacttttagttttttctggagttaataattgtcttgttttgttggtttttccatgtaattctatcctaaactctgtcagttatccaagtttggttttttgtttgtttttgagacagggtctcactccaggctggagtgcagtgacccgatcacagctcactgcagccttaacctcccaggttcaagtgatccttctgcctcagcctcctgagtagctaggactacaggtcctagcatgccaccatgctaggtgtgccactacaggtgccaccatgcccagctaattctttaaaaaaaaatttgtggcccggcgcaatggcttatgcctgtaatcccagcactttgggaggctgaggcgggtggatcacgaggtcaggagttcaagaccagcctggcccagatagtgaaaccccatctctactaaaaatacaaaaaattaactgggtgtgatggcgggcgcctgtaatcccagctactcaggaggctaaggcagagaattgcttgaacccgggaggcggaggttgcagtgagcctagattatgccagtgcactctagcctgggagacagagtaagactccatctcaaaaaaaaaaaaaaaaaaaaaaaaaaaaaaaatatatatatatatatatatatatatatatatatctagtagaagcgggggtcgtgggtggcagggagtcttgctatgttgcccaggctggttttgaacttgcctcaagtgatcttcctgcctaggtcttccaaagcactgggattacaggcatgaccactgctgctcttggcctttcttatctttttagtacaccaagaaaattttattacagatcagcacctgtccttaatttggaaactactattcaagaacacctagcttagcacctccatcaccacctccaacccaccctatcccaagtgaaagccatttctggttgtcagtagaaccatcatagtggacttaccccaggcccaccttgcatgcccactgattcttaccacttcaacacacaccagtatgacttctaacccagcatatccatatgtcgttccctgagggctttttctggctcacattggaagcccatgttgtcatcccatttggcaaaccagtaggggcaggcatttaaccccctacccctgtgccatccttatcctttggcttcagcagccctcaaagaatgactgtatacacctatgttgacactcccacctgcagtccactttccatttacatcctcttaaaatcagccaccccttgggcttagggatgtgcatacttgcagcatagtttgtccctggggtatggacttggggaagaggccaatgtaggccctggtgggaggctcagggctctttgcgtagagaacttcaggtcttaggtacccaaagagggtttattctttttgtttttttgagacgtagtctcactctgtcacccaggctggagtgtagtggcacaatcctggctcactgcaacctctgcctcccaggcccaagcaattcccttgcctcggcctctcaaatagctgggattatatgcgcgcaccaccatatccggctgatttttgtatttttagtggagacagggtttcactacgttggccaggctggtcttgaactcctggcctcaagtgatctgcccaccttggcctcccaaagtgctggaattacaggcgagagccaccacacccagccccaaagagggttttaaacagagggtctcggtgtgggcatgtcctcttgaccttgcagactcctcccacctctgatgattctcctcacctgagggaagggcacagcccaagaagagccggagcaaggcccttctaaatcagggcccacaacaggacccccagtgcctgggtccaagggcagtattgcttaagcctctctgactttctgtttccacacttaacaaagtagcaacaaatgttcacgttttcatcaaattcactggttgtaaaccttggctgcacattagactgtccccaaggagctgcaaaaacctcagtggccaggtaccattccagactaattgtatcaaaatctctgagagtgagacccagggattggtagtttttaaagctccccgtgtgatttcaatgtacagttaagattcagaacaactgatctaatccaaacattttctcactccgtcaaccacaacccaattttcagatgaagaatctgaggcttaaagtgagttaataaattgagacatctcacaactagctagtgacaggactaggacaggatgcc

SEQ ID NO: 3669 - DNA, 1214 bp, Homo sapiens
tcatactctactgcacttccttgaagatgaaaaatatgaagaggttatggctgtccttgggagttttccatatgtgaccatgaatataaaatcacaggtgttagatgatgaagacagcaacaacatcacagtaggatccttagttacagtgctggttaagttgacaaggcaaacaatggctgaagtatttgaaaaggagcagtccttctgtgctgcagaggaacagccagcagaagatgggcagggtgaaactaacaagaacaggacaaaacgaggatggcaacagaagagtaaaggacccaagaaaactgctaaatcaaaaaaaaagaaacctttaaaaaaaaaaacctgcacctgtgctattaccacagtcaaagcaacagaaacaaaagctggcaaatggagttgttgggaatgaagctgcagtaaaggaagatgaagaagaagtttcagataagggcagtgattctgaagaagaagaaaccaatagagattcctgaagtgagaaagatgatggtagtgacagagactctgatagagagcaagatgaaaaacaaaacaaagatgatgaagcagagtggcaagaattactacaaagcatacagcaagaagagagcgctctattggaaaccaaatcaaaaataacacatcctgtgtatagcctttactttcctgaggaaaaacaagaatggtggtggctttacattgcagataggaaggagcagacattaatatccatgccatatcatgtgtgtacactaaaagatacagaggaagtagagctgaagtttcctgcaccaggcaagcctggaaattatcagtatactgtgtttctgagatcagactcctatatgggtttggatcagattaaaccattgaagttggaagttcatgaggccaagcctgtgccagaaaatcacccacagtgggatacagcaatagagggggatgaagaccaggaggacagtgagggctttgaagatagctttgaggaagaagaggaggaagaggaagatgatgactaagcagtactctgaatggaccatagtgtttgcacatatttgcaattttttgctgttttggaagtttatcataaaccagaaacagtacagaactgatgttgagggaggtgtagtttttttactctagaaatgggtgcataatataactaggcagtggcagtgccttggtacaacctgaaaaatgttaaggct

SEQ ID NO: 3670 - DNA, 306 bp, Homo sapiens
gtaaaggaggcggagccgtggtcaccatcgggagggccccaaagtaacctcgggaggaaaagccaagcggcgcaaggcggccacccaggacgagcggctcccgctgcgggacggagacgacagtcatagcgctaggaagcttgtcgctcagcaacgaagagagaaggagaaggtgaatgaagccagtgaagatagggtggcggcgatggatgctgctaggagagcctgagaagatcgcggaacatgactcgggcggtggcggcgcagcaacaaatagccacagccccagctccgagtgttgttatc

SEQ ID NO: 3671 - DNA, 963 bp, Homo sapiens
gacagcagtttatacacatttgtttccttcccagtgcaggcatagagcccgtgagaagggcagtctctgaatgagggggccaggaacgtaggtcggacacgtctttggcaggcatgttcagccccagcaggatgcaatccttcaagttggaattccactgggtatctgagagggaccaaggtggggggtagagaggaagtcttcaacaggactcacatctcggtccaggcctcctctctcactatacaagtccatccaagttttaggaccctggggggcaacagtcaggcccacccacctcaacaggggcagattcttcaatctgtgcccagttcacacacacctgtttccgctggtcacacagttaaagagaatcagacttatggtaacagacagaccacttcctctctgcccctccccggcacctctcttcagcagcatctgcacaggaaccgctgggaagacggaggcctgccttctcagttcagccgcacatgccctcatccgcaaaccttccatcagtgacaggacggaggccacacgtggataaaaaagtagatggatgtgagaagaatgaaagagtttcatttgatagactaattagagatctgaagtgattttacctttatttccttcactttaagccaatcatgaaatttcacagtgatttctggggtgggagcagaaggaaggctgtgttaagaatcatcggggctgtggcccagtcagcccgcggaggtgcaggcagggtgggccctcactggggcagctggaggagcacggactgccccgctggcaggtaggtgatgttccgagagcgtgagagctggtacgcgatgtcctctgcagcttccagcttgcgcagctcgatcaggccatcccctgcagtggccagtgagttggcaatcagctcagctgccttggagtcgccctcagcagagatgatggccgcctttttctgtt

SEQ ID NO: 3672 - DNA, 1521 bp, Homo sapiens
caaagtatggggatacagcaggaagttgccatctatgagccagaagggtgaacctcaccccagatgctgaatctgccttgatattggacttcccagcctgcacaactgacaaactggaaacacaggttatatcaccaaggctttgactgaaacatcatgttttcagatatgaccagaaggctttaggggactaaagttggctttatggaaccaataaagtaccatcttggaaaaactggctctagggttcccagacttacaggcactgtacgtggcactgagaatgcaaagcaaaacgagtcatggtctactggcgggagccttctcagcggagaaaagatcaacaagaaaagtgcctgctggagacctctcctagggcataaaccaatatagaggtggggcagctacgtcagcctgaggtgtccttaggcagaacagaaagtgagaatcagagcagtatctcatttctgaacacctggattgtagctttccctggactgactgtcaaaggaggtggttttaaaaagcaagccaaacaggtttccatcctttaggaagaccctggaacgtgccagttgattctgacaatttctcatgaacagaaacacctaggaagggagaactgttctgtttcatcaaatggaaatgggacatggacagtttctcctatcccatgcagaccatgctcctgaattaaaactgcagaatgtgttaaagcatcattcaacatcgtgagcacatttgagcctacttgtgaagacaaggatgaagacctccatgatgagccatctccacttaatgactgtctcacattggccggcaacttgttccagtttgtgtcttccagattacaataattccatgtaaagatgatgctggcacaaggctttcaacccatcccctcttctgacccagaagataaagacatcctacctttgagccttttagaacaggtatccagggattttacctctccagtgctaggcagggtctatgcccataacatcagcaggaagcagttacagaagatgaacctccgcccttctgcaagccccttaagattaaggaggagtatataatctctgatggggaaatgaggtaggagaccagaaggacttattttccattcccaaccccattgaacagagcaggatctggtcaaaacagggtgcagtggagaagcctgctgaaaccagcagatgatgatgaaagtgacctctagttgccctcactgcttatgagcataaagacactaccactgggaccatggccagtttacaaatgtcatggcaacacaccttggcaatggcctggaagttactttatatggttctggaaactccctgcccctttcccagaaagttctgaataacctacctcttaattggcatgcaattaaaagtggctctaaatacaactagctagtagcccacaggcacaaactctgggcacactgcctataggttagccctgctctgcaagaagtagcaccagttcaataaaagttgctttctctcacca

SEQ ID NO: 3673 - DNA, 2915 bp, Homo sapiens
tttcatacacatatatacatctgaaactcagaaaattcattaggtaggaactctttggatgcatctccttttttaacctcattgggatgatttttcgttgcaccatcattttatagagcttcctagcactgctgagcatgcagaatttttgcaaatgcaatccagagaaacagacttgctatatactagctatttgaacttgtctgagcttatgtggcatggtctaaagaatactgaaatatttctggcatacctcttaattgcagtcactttctccaggttgctttatggattaaatgagataacctactaaaggactccagtaaaaagctaaaaaggtagctagcttttgaggtgttgtggcagactggcatctagtggccagcgataaaggtgcagactagtgtccacacctaagtggggacagtgcaggctgtaatgtccatacctagtggggacatcaatggggtatttgtcagagaagctccatggcatagtttggacattgtttctggctgtgcaggttcaaacccagagtctggctctcccaaagattatctgagttattctattattttacaaagtttgaaatagccattagatacccttacaaacttatcatttttgtgattgattttaagtctactgaaaatgtcaaaagaaatccaaaactgattgctagtaactaggccaggtgtggtggctcacacctgtaatcccagcactttggggccggggcaggcagattgcttgagctcaggagttcgagaccagcctgggcaacatggcaaaactccatatttacaaaaaatacaaaaaattagccggacatgatggtgtgtgcctgttgtccccgctactagaaggctcagaaagaaggatcacttgagcctgggaggcggaggttgcagtgagccaagactgtgccactgcactccaacctgggcaacagagaccccagctcaaaaaaataaaattagtgttaacttgtactgtttagccacattcattaagtttttaattttaactctactatcgcacaaccaggaatgtacaagagatctggagcctgatttgcatggcaggaaggagaccacgtatttttgtttgggatgggttttagccactatcagagacatagtttgtttcttaggggttcggtcccagtagtatgatacttagttcatttaggaacttccttttttaacggctaagaaaacattttagctactaaatgatatgcaaagataactttccaaatttaagctgtactcaaaaatccacagaatctgcaaaactctcaagtttctatatttaaatagaaatgtgtgttgatatacatactttaatcagtcatttcttgctttcaatatattttattctgacgaagttacaaaagtagatacaaaatactttttttagaagtacagttaactgacttagaaaaatagataaagcccctaaggattttaaaacacaacataaatttttatgtaaagaacatttaaaaatattttagatggtaaccaaaactaacttacacaaactatttttgatgtagaatagaatgctgttctataataagaagtctgtagcacactggtaatccatttggatctacagaatacttgtttggaacagaatctgataatgagagaaaactcaaatgaatgtcagtgcagttgcttcaaaaaaattactgctaccacatgtactatcatcccccaaggccttttacagtctgaaatatcaaaattgaaagcaaaaataggatgaccaaaggactactattttacctcttttcagaactctacaatagtagaaactaaattcccttatggatctcagggggaaataatgtgcctgttgaaggggctcagtgtttggtgtccaggctggcatttttcaggtgagggtttcatactgacaggaggcaggctcctaaaacaaggcggtagcaccagcaccatgactagggctgctttaaaacaaatttctaggacttacgctctttgggcctgatttgttaatgcttatgaggtaatgatattatgtttgagaagctctacttctagtatacctcaatgctcagagagaaagccaacaatacaatcaggaaaccacaatattgacaaaacttagtactaccaccaagattgttcctcttgccttggcactactaaaaaactttacctttgttactaaagtcatggtgaatacagattttgcatttctcatgtaagcagctatataagctagggttctacaagccttagatgaaaggaaaaactttgctggaagccctgtaaaaatcactttattcacaatctgaagaatgaaagacaaatttggctgtcaatacaaaaactgtagtacaagtgttttttgaaggcctgaaaattaaagcaccataggattaactgcataatttagcaagcactctctaccccatgactgtaatcatgtatgaagagcagagatcagacactgagaggagatggcttctgattagcaagggggaagggagtgagtgttatggaacaggcaaaccttgggcatggggagataaaagtgagaagagtcaaaaagattgatttctataggccgggcacggtggctcatgcctgtaatcccaacactttgggaggctgaggcgggcggattgcgaggtaaggagatggagaccatcctggctaacacggtgaaaccccatctctactaaaaatacaaaaaattagccaggcatgactaaaaatagaaaaaattagctgggcgtggtggcgggcacctgtagttccagctactcaggagaggctggggcaggagaatggcatgaacctgggaggcagagcttgcagtgagccgagatcccaccactgtactccagcctgggtgacagagtgagactctgtctc

SEQ ID NO: 3674 - DNA, 374 bp, Homo sapiens
cgctccccaatgacgtaactgccctgcagcttctagtagcttttcgcagcgtctccgaccgccgggcgcggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttttgcccccctccct

SEQ ID NO: 3675 - DNA, 25970 bp, Homo sapiens
ctttggtttggtaagctgtaccagacagagggtggggtgcggagtgggactcagactctgccctgagactcagcctccctcccttcagcctgaaaggccgaggtgacccttggtactcagggcgccaagtttagacgggagggcttggatttgctgtactggaggtggcctgaggataagaggctttgtaaccttaggcaggggcacttaatctcggtgagcttgcggggtcttcgtcagtaccacagagataacaatgctcttcttaaaaccttaaaaggattttatagtcctgattggttccagggcccctccaggggacccacgtccacaaatgctcaagtccttggtaaaaaaaaaaaaaaaaaaaagtgtttgcatatcacctacacacatcttcccatcataaactttaggtcatctccacattccctaagtcctcacctaacatcgtggaggggttcttggaaactgaaactttaagccaaatgactgtaaggaaaacagtttgaccacaggctaattgatatgagtgaagttcctacaacatatctgtggtcacaaaatcgcccctaaacttcgaaataaagaccaaaacacttctaatattaaacattgaaataagtgtgagccatgcatatatttaaggaagatttttagctcacgcctataatcccaacactttgggaggctgaggtgggcagatcacgtgaggccagaagttcaagaccagcttggccaacatggcgaaaccccatctctactaaaaatacagaaaattggctgggtgtggtggcgcgtgcctgtattctcagctactcgggaggctgaggcaggagaatcgcttgaacccaggagccagaggttgcagtgagccgagatcatgtcactgtactctagcctgggcgacagagcacagctctgtctcaaagaaaaagttttttttaaacaccccctatccctctcgcttagagaaaaataaagattaataaaagtgagatcatttttaccggcttattccaactcagggcacctcacagggtgtgctcacacacacccacactcacactcggatcgtgtagatgcaccaatttacctaaagtgcactgcacggctttgggatgtgacaggacaccagaagacagagaaaatccacacagacatggataaaacgtgacagtggacccagccagaaatctatttttttctcatcattataagaaaaccactgagcaaaatgatgaaatgatgttattccaggacctgctgtacttataatacctaatacaatgtaaatgctatgtaaatagatattacactgtacttttttatttctatgattttttattattttttgttattgtaattttttcaaatactttcagtcccaggttgattgaggatacagagggctgaccataagttccaagtaaagtggatatcagattgtaattttatgattcccaagtgagggtcagattgttaactttatatttttacaaccttatacccttataattcccagataaggtgggaataaaactagtccaagttacagagattggttttccattagccgagcaccatactgggacagtgctggaaggacccttcatacaatcctaacaaaagtagggaattgagagctattgtcttgaccttcaacctttggaaactggggtccagagaggcccatctgtttactggcagagctgggagattgaggctgcaatgagctgtgagcgtgtcactgcactccaacctgggcaacagagtgagaccctgtctcaaaaaaaaaaaaaaaaaaaaaaaaaggcttcctgaagaaagtgaaagaggtggcagctggaggcaagaccttagcagttgagctaagggaaggtcagctaagggaaggaaatgagctaagggaaggtcagtgttggaaaagtgggaatgttggaaatgaaggaacaacatgagcaaaagtctggagtagaagagagcatgatgaatttgagatactgagagctgttcagtcgagtggggagggcaggggaaaatgagtagcaatggcaagtaagaagagctgggcagggccacgttgtggcaggtcacgaaaccattgcattgcattttttttttttttttgagatggaatctagctttattgcccaggctggagtgcagtggcgcaatcttgtctcactgcagcctccactcccaggttcaagcaattctcctgcctcagcctcccaagtagcagggattacagccaaccaccatgcctggctaattttgtgtttttggcagagacagggtttcgccatcttggccaagctgctctcaaattcctgacctcaggtgatttgccctcctcggcctcctcccaaagtgttgggattacaggagtgagcctctgcgcccagcccattgcattgcattttgaaagcagtggaaaacaactgaaggatttagaattaggagagtggcaatctcagatgtgtgttgtagaaggatcacagcagcgacagcgtagacaatagaaagtgaaggcagcagacaaatccgaagactgtttcagtaacaggagaagaaacgagaagttcctgagtatatccttgaccaatggattggtgaaaagtggatggattcatgagataagtaagaggaaccattggtagcctttaggatttgattgatttagagggtatatggaaggaagttgtcaaggatgaagccccactttctggcttgaagtataggtggtgctattcctagaggaagaccagaggagagaagcaacaggcttagccctatcaagattggcatgcctatgggatatcagagtggagatgtggagtaggatgttggatccatggatgtatagctcaggagaaagttcaaaaatggagatacagatttgataaccatggttatgggtaagatcaccgagagagtgtatagaagacaggaggacctacaatagcaccaaaaaacacaaacaagaaagaagcagaggaagacaatgccacaaaagagactacggagggaaaaacagtaggagaaaaaattagaaagtgggccgggtgcgatggctcacacctgtaatcccaacactttgggaggccaaggtggggagatcacctgaggtcgggagttcgagaccagcctgaccaacatgtgaagggggcctgcccctccacacctgtgggtatttctcgtcaggtggagacgagagactgagaaaagaaataagacacagagacaaagtacagagaaaggacagtgggcccaggagaccggtgctcaacatgtgaggacctgcaccggtgctagtctctgagttccctcagtatttattgatcactatttttactatcttggtgaggggagtgtggcagggcaacagggtgatgtggagaaggtcagaggggaaacatgtgagcaaaggaatctgtatcatgaataagtccaaggaaaagtactgtgcctggatgtgcatgtaggctagatgtatgtttccctttacacaaacatctcagtgtagcaaagagtaacagagcagtattgctgccagcatatcttgcctccagccacagggtggttttctcctatctcatgatcagctttaccctgagacatttcattcccagggacgtgcaggagacagaaaacttccccttatctcaaccgcaaagaggcctccctctttcactactcctcagcacagacccttcatgggtgtcgggctgggggatgtaaggtctttcctttcccatgaggccatatctcaggctgtctcagtgggggaaaccttggacaatacccaagctttcttgggcagaggtccctgcgcctttccgcagtgcattgtgtccctggttaatagagaatggagaatggcgatgacttttaccaggcatactgcctgcaaacacattgttaacaaggcacagcctgcacagccctaaatccattaaaccttgatttgatacagcacgtttctgcgagcacatggttggggctaaagttacagattaacagcatctcaaagcagaacaatatttcttagtacagatcaaaatggaatttcttatgtcttccttttctgcatagacacagtaacaatctgatctctctttcttttccccacattctcccttttgtttttgacaaaactgccatcgtcatcatggcccgttcttgatggtcgctgtctcttcggagctgctgggtacacctgcagactaacaacagacagaacaggcacacaaggattaatatgaaatttataataatggaacttctgatggttttaacccaagtgactgggttaagatttgcgaggccatcagtagcttccgtaattgcttcagttcctggcaccaaatttaaatgggcttttgatgcctcaaaaatttgttcttttaattttgaaatgtctgaagtaagattatcttctcttccttgtagatggcatctaaccatgtcccagtgaggctcagactcattacaggcttggggtgtaatacaaaaatctgacgtattccagtcacactgtaactgaaaatgatgttccaagctcacgagcttatctcccatccaaatgacattttgtctaagatcattaatctaatttgccaatttttgatcaataccagattgtgaattccacaatcttgtagaattttttttgccaattgttaacaaagtgtaccgtctgaacagaagagtgcaatgcaactcctgccacagcggccataactgtgactgcacttaatcccgtagtcaccgcaatcaaagtaaaaatgaatcttttggatctatttagaactccttttaatacttcagttaaaatatggatggatggcgaagcctcctacagttggtccatggacacagggatccacatggcctctcttgctctcactggtagaatacagtgctgccaattaaaagttgaatcaatgcaagtaaacaatctacaattttcacaggttatagtttgggaatctgggttaataactatttttcctacaactagcatataagggggctttacacaaatttgcaaaggaattgtcagactggaatttaggtcgatagtataagatggcttaccatctcttgtttttatagcttaatttccagaccaaattctaatgtggtgcgaggccacagtaagcttccaaagttccggacgcttaggaccagtaacaggactaactaactttggtcgaggtgatgagattcccttttcaccccattcccaagggtatagagactctaaccttttatacttatttttatctaaaccttctgttaagtcactgtccacagttggactcacatgtgcactgggacacgattgagtttgtcctgtgcaattgcagtagaattgacctcgaggtgcccaatctataatggttccgaattcattgttttgtaatatcaccgtcctatcagccacacattcttctcaaactaaaacttctgggccttttgatcctttgggaatttctttggggcaaggcttccccttaggcctagattttaatcatctttgataagaagggtcctgcaaataatttacctgtggcctgagtgacattccacttaccctgtgataagtaaatccactggtggcactgacagtaggtacttctaccaaccaattttgggttgtaggcattaagcatcctggtgccctccccaggcaaataggaggataacaatacccagtggaaataatcatcatcattccttcttccttgggttgggcagggcaacgatcatccgtggggccaggtacccatgcactattattaacatatacttcaatagaattatccacccatgtaactgcccgaattaagggcaggaaaggcacataggcccagtaagcataattagctgcagctgctcctgcagacatgggaagacttatcaccgttgatacaatcatcaaagctgcaagcagcatattctctggagtttgtgtcacctttgtgaatgtacttaatgccactgaactgtatatttaaaaatggttaagatggtaaattttatgtgcattttaccaccatcttaaaagtcaagaaggaggtgaagaaacagctcaaattggtgatctaagtttgctagagtcaattactatcatttacaacaaagcactctgttgtgtacagtggttaaagtgaatgcaggtgaaggtcactggccatgagcaagtcaagaaaataaagggctggatgttgagaaggtcatccatcgaaatatccatcaaatagggattttctagatattttcaaggtggtggtagtatataggggtggagagtataggatgataaggagactgattctgaggtgtgggctcaccttcactgaatgaggccaattggtaagaaggtcaatggatgataggagtcaggtgacacaaagatttgcattccaggctgggcacagtggctcatgcctgtaatcccagcactttgggaggctgaggagggcgaatcacctgaggtcagaagttagaaaccagcctgaccaacatggtggaacaccgtctctactaacaattcaaaaattagctgggcatcgtggcatctgcctgtaatcccagctactggggagactgaggcaggagattcacttgaacctgggagacagaggttgcagtgagtcgagattgcgccattgcactccagcctggacaacaagagcgaaactccatctaaaaaaaaaaaaaaaaaattgcattccaaatagccaccatgcaatagttcattcattcatgagggcagagaaggaatggtctccagccacagcatggatccatgaagcactgactccacctctcgaacttgaggtgttggattgtgggagaatgaatagccttcctttaagagatccccaggagaaacatccttaaggaagagctaagtgttagtttaaaaaagaaatgaattggccgggcgcggtggctcacgcctgtaaccccagtactttgggaggccgaggtgggcggatcacaaggtcagactgagatcatcctggccaacgtggtgaaacctcgtctctactaaaaatacaaaaattagctgggcgtggtggcacgagcctgtaatcccagctactcgggaggctgaggcaggagaattgcttgaaccagggagttggaggttgcagtcagccaagatcacaccactgaattccagcctggcgacagcgaaactccatctcaaaaaaaaaaaaaaaaagaatggagggaactgcttccattaaaatatagggaatgtagaggagttcaacatggaacttaaagtgacccagagcacgcagacagaagatgtgggaagaacagcagcagtgagaaggtgggtcaggagggagactaaccaggaaggatggtcagaggagcagcaacccggggtaacagcttgaagcctggtggtttatgtggctcccaaaatgccaaagagacagacccagcaaatactggaaggctacaaatgtagacaggacacttggataaaacaagggtcaacacagtttgcacttctatgggagtttgttccatgaaagggctgtatttacacagcaacccccaaatgcagaaggagcctggaaaccaaaggaggcagagaaatccaatgtgtggttctgggtgatttattagggaaatttacaaacagaaacgtggtcttgggcggctacaagataggtagatctctgcaccacaaccccctagacccagggcttatatcttggggaaaaatatacgtgttctagaaggaatgtgtaggtggctaccagcgtcacagcctatgatttctgcaacagcaacgagggttgttttgaaggaaacttacagtaaatgggtgtttctacataaataataatacatcaactcaacattttggaggcattcccagacttgggattagtcagtggattggtatttaaagtaaattcactcttgtccccaccaagagttttcctcttcaatgaatgaggaggctttgtgtagaaagcaaaagttcctcttcaaatccctttaaatcataaatgttattgatatcttttctcaaaactaactttaagtttcttattttatagtaataactctctgttaagccttatgtagcaaaggtaacagaataagcatactctgacttcagtatctgttaaacatgctcacaggcatgtagtacattctatgtccttgtaccttagtcagaatattcgtgctggacatgcccaggcatgtcccagcttgcagcctaccctcctcccttatttgggaatattattacttttctaagtcctttcataagcaacttcctttttttcctttgttcctcactgcctttacctattttaaaaagttttgaactgttagccaatcgggttttagtttagattgtgaggtctggctccagccaatggagtcaggacacagcaatagggacctcatgtgtaaggcaaaactattctagtatcttttttactttgtgggtactcctggcaggattgctgacaggcaccaccctttctgcaaagagtaaaaagagtttcctgttgaggaaacattttgtctaattgcggattcttctctgtaacatcggggaataagcatttacttccaacactttggtcttccaggaaggactacctgagccatgagtggtttgctgggcttggggagaagctctggtttgatgcagctttttccaaagctcccagggagtgcagtctgggcctgatctgtgattgtttaggctggaaagcatggccctggaaggtgcaagcctggtcgataggagtatgggtagcatacgcaccaacaatgctctgcaaaatctgtcttattattaatatcaaccagcgtatggcactgcaggtgaggcatgcatggagacattttgtatccggaattggttccttccagtgggttcttggtctcactgacttcaagaatgaagctgtggaccctcgcggtgagtgttaaagttcttaaagatggtgtgtccggagtttgttccttcagatgttcagatgtgtccagaatttcttccttctggtgggttcgtggtctcgctgatttcaggagtgaagccacagaccttcgcagtgagtgttacagttcataaaggcggcgcgtccggagttgttcattcctcccggtgggttcatggtctcgctggcttcaggagtgaagctgcagatcttcgtggtgagtgttacacctcataaaggcagcgcatccagagttgttcattcctcccggtgagtttgtggtctcattggcttcacgagtgaagctgcagaccttcgtggtgagtgttacagctgataaaggcagtgcggacccaaagagtgagcagcagcaagatttattgtgaagagcaaaagaacaaagcttccactgtgtggaggggacccaagtgggttgctgctggtggtgcaggtggcctgcttttattcccttatttggccccacctgcatcctactgagtgatccattttgcagagagctgattggtccattttacagagtgctgattggtccatttttatagagtgctgattggtgcatttacaaacctttagctagacacagagcactgactggtgcatttacaatcctttagctagacagaaaagttctccaagtccccacccaacccagaagcccagctggcttcacctctcaatttcccctctaaacaggacaccccaactgctgtttggaatttggccaatgactgctctagctacttcctgctggataggggtgaagcaggggccctgcagttgtggtgtcctccagagggaaactctttaggccagtggaagggccagcgggtcggtccaggggtcctcagtagaagttgttagttgaactcattcggagttccatttgtaagaccatctgtagcttgattgccttgattttagaggaaacaaatttgacaagaaggttaaaaatacagggcccaaaggcgagtaacagcaagatggctgccacgggacctagaaaggggagaagccatgttgcccaactccggaggttggtataagagtttgaaaggcgttgtctgatttcagaagccttttcctgtaaatgccgggcggcatttagtactatccctgactggttagggtaaaaacaacactcttcccctaagaaggtgcagactcctcctttctcagccgtgaggaggtctaggcctcagcgcttttggagagtcactgctgccaaagagtctatttgggattgtagagtaaggatagatttcgtgatttcttgcaaactgtctgagaaatcctttgagaatgtgtggtagtaggataatgaagtagataaactggctattccagttcctgtagcagtagccattcctgaccctataagtaggggtattagttgtatggctttgcgctgacggacttgagctttgaggggtactgataaggtctgacttcccggggcaatattaatgttgggacttagaaagactaaggtgcaggtgcctgtccagttagtggggaggcagatataggtcgacattccacataagaagagtataccttagctgggtagacagaactggttgtgtatgttaaaaagatgtgtgaatttgttgttttcattttcccatactcctagagtacttgccaaggtagctccagtgagcggctggaaaggggtgttgggagcaaactgagtggctccctgtgttctattttcccattggagaaaaaaacattttatatctactaggaaccactcgagagagtgattgaaagaggggatgagaaggcattcactagtggtgggggcgctgctgcagggggtgcaggggtgaatggtcatgcagggagtatgtttgccattacaaaccctggactatttgttaagcagggaggaggtgatgatttttgggggccccaagaagcagacaagccatctaaatggagctgtttgggtgactcagaagttactatgatcagttggggcttgaagttgtagcgtgtaattacactgatggggtagtaagtgccccaggggcaggcctgataacaggttgcgttggatgcataaaggggcttggaaagttaagatagtatttgtagttacagggccgtgtatgggcttttcattgcttgtgtaataggtgaggttggaaatgtaagaacgtaaaagttggattgcacatcctgttagggtattcttgttcctatcagagatggggaagttggctaatgattgcatatttaaaagtcagaaagggtcttttccttcataacgagggtggtaggttaatttggtaaagacccagttttttgcaggaatgggagtggcagtgtaagcagaggttgatagagagatacaaagccaacagtcatttgccagggaaggattggactggtttaacagagagtaggttaagttgagagacttgtagaggtaattaggagctagtggaaggggaggggcaattgtatgaggtatccaaggaagcaggagggatagataggcaaagagtaaataggaaggtaaagagggtgctctggaagacgagaccattttatccagtctgagttaaaggcaggagtaaattgctgtcagaaggaaggaagatagaaggttgatgtgattaggatttttctcccagcaggagctacagtatacagtcctatcgcaaagagtatggttagtatgctgcttaataatatgatgaaatagtaaaaggattccattaaaggggcaaggagaggtgttaaagattatgtaggttttcacttatcttttttaaggagaaagggatttttcttcaggatcagcggtaggagcctttttagtctgggatgtttccttccgaaataggagatgcaagtcctccaatggttcgcaggtgtatcgaggctggtctggcttgagactcctgagctgacagtcctgcaggttcctcaggggatgtccaaaatgtaactcgggtgtggtgaatccaagattccactcctgccaccttaactgcagtggggttagagaggattaccgagtatggtccttcccacaaagagttcatagatggggaggtagaggggtgagatttgaccaacactagatctcctagttgaaacaactctgttcccttttctctgtgacatccttcaggtaggtttttaaggttttgttgatattttgccaaataagttgtatctttgaccaagttggccatttcctgatcaagtaggaggtcatttgtgagaaaaggtcgtccctacagcatttcatgtggattaagccccattttgtgaggagaattttggattctcaacaaggccatgggcaaaagagtaggccatgggagatgagtttcttgtattagtttccttaagtgcctcttgagtgtttcatttgccttcttgaccttccctgaggattgtggcctccaggtgcagtgaagatgctgttgtatcactagtgccctggaaactccctgagttatcatgtctttaaaagtcagaccattgtcactctgtaagctttggggaagcccaaatctaggaattatttcatgaattagaactttaatcacttcctgagccttctctgtcttgcgggggaaagcttctatccaatttgtaaagatatcaacacagaccaacaagtattgaaatccctttgacttaggcatatgggtgaagtctaactgtcagtcctctccgggatagtgacctattctttgtgcccccacaggggccttatgatggaccaagagattattcctttggcatacctcacaggctttgactacctgtcacatggtctggaggagatttggccctgtaaatagggatttggccatttgatgagtgttttcaatacccatatgaacagtttggtggagagttttaagtattttccactggcttgctttgggaataagtacctttccttcttctgtcgttaaccaccctgaggggagaaaactatgtccccgtgaaagtccccattctgtttcaatcggggaatactggggcttaatctcctggagggggttgttccataccaagggtccttccataggtatttctaatgggagattccacctggcagcaattttggcctcagtatctgcccagtggtttccttctgccttttctccttcacctttctgatggctttggcagtgtaagactgccacctccttgggtttttgcactgtgtgcaataactccataatttccatgtggtatttaatgcgggtcccccagaggttagaagctccctttcttcccatattgcagcatgggcatgtaggattagataagcatacttgctatctgtatacacatttattctttttccctttcccagttctaaggctcgggtaagtgccactagttctgctaaatgggcgctggtccctgagggaagaggcttactttcaagtacagctacatcactaactatggcataacctgcccttcgtatcccgttctccacaaatgaacttccatgggtatataggttaaggtcaggattagctaaggggacctctaagagaccatcttgggcagcataagttggactataatttgtcggcagtcatgcatgattggttccccatcctctgggagaaaagtggcagggttcagggccatgcacgtacgtatttgaagcaccggtccctcaaagagtagtgcctggtatctaagtaggcggttgtctgataaccataaacttcctttggcacctagtatgccatttacatcatgagtagtccagacagtgagatcctttccttgtattattttgatagcctctgacactaagacagccaccgctgcaactacccttaaacagtgaggccagccttttgctactacatcagtttccttacgtaggtatgccactggttgtggggttgtcccacgagtctgaataaggactccaagagctatccctgctctctctgtgacatataaagagaagttttgtcctgtgggaaggcttaaagctggagcttgtactagggccttttaaggttttgaaggctgtttctccccctggttcccattctactagatgagtatttgccctctgggtctccttgattagagtatataggggcctgactatctcactgtatccggggatccatagttggcaaaagccagtaattctaaggaacccccacaactgttttaatgtcttagggtgaggatgagccagtatgggctgtattcgttccttgctgaggtccctggtccctctggctaagattaggcctagatatttgacctgttgtaggcaaagctgggcctttgacctagacaccttgtacccttgattagctagaaagttcaagagatctacagtggcctgctggcacgaggcttctgaactggtagccaaaagtaaatcatccagatactgaaggaacagagtgcctggacttgagacatggcctagatcttgggccagtgcctgaccaaacagatgagggctatccctaaaaccttggggcaagaccgtccacgtaagttgggacatgtggtctgtgggatcctcaaaggcaaagagaaactgggagtcagagtgcaggggaatacagaaggcatccttgaggtccagaacagtgaaccattctgcttcctctggtatttgagagagcagggtatagggtttgggtacaactggatatagatgaattactgcctcattgatgagtctaagatcttgcactagtctccactgaccgtttggtttttgtactcctagaattggggtgttgcagggactgctgcatttcctaagccttgagcttttaaatgtttaacaatatcctgtaatcctttatgagcttcaggccttaagggatattgcctttgataaggaaaagtgatggggtcttttagcctgatttggactgcgcaggcattttttgctctgagggagggaagtgatctctagagttggaagagtgatgccttttgtcctcacttatatgaataggaaggatacaatttctgaggctccccatatcctagcttcaggaatagcttttgttaggcccacttgtctgaggaggtatcctaaaattccagatagtatcccctacgatggggctttgggaaaaattatgtttttctgattggtgagcccaggtgccgaaagaaggtaacagagtcctggagtttgaactagaaatcattcttataggagaaactagaaaagcaccagagacagggagtggtttttagaagcgggactagcctcggagaagagaggtgagagggagtttgtctggcaggcattaggacccaggaggcaagggtcaaggtagatagaatagatgagagagtctggcttgggcaacatgactttgagagttccgctcatggctgcagggtcaaccaacttgttctcaggacctcggagctgaatggctttcctctctgtcaaccctcagctcagcccggaagtacaggaaaagtggcaaaccaatgctcccaactccaaagagtgggggcttgttagagagccctttcccagaaatcctgacatccatgtctttagtctggtggccatgctagttgcttttaactggccgacaggtgcctgatatttagccctcaaatgctaaggaaaaataggacagaatagcaagcaaaaggggtccgatggtactcactgcttggcaatagtcaatggtcccttcgtggtcaccaaaatgtgtccagaattgattccttccggtgggttcttggtctcgctgacttcaagaatgaagccgtggacccttgcggtgagtgttaaagttcttaaagatggtgtgtccagagtttgttccttcagatgttcagatgtgtccagagtttcttcctcccggtgggttcgtggtcttgctgacttcaggagtgaagctgcagaccttcgcagtgagtgttacagttcataaaggcggcgcatccggagttgttcgttcctcccggtgggttcgtggtctcgctggcttcaggagtgaagctgcagaccttcgcagtgagtgttacagttcataaaggcggcgcatccggagttgttcgttcctcccggtgggtttgtggtctcgctggcttcaggagtgaagctgcagaccttcgtggtgagtgttacagctcataaaggcagtgcggacccaaagagtgagcagcagcaagatttattgtgaagagtgaaagaacaaagcttccacagcatggaaggggacccaagcgggttgccgctgctggctcaggtggcctgattttattcccttatttggccccaccacatcctgctgattggtccattttacagagtgctgattggtgcgtttacaaacctttagctagacacagagcactgattagtgcatttacaatcctttagctagacagaaaagttctccaagtccccacccgacccagaagactagccagattcacctctcaatttgatacataaatctttaactgccgttgaatttattctcttagaataaatttccggaagtctaattaatggctcaaagaggatgaatttttaatgttactgattcatattgctaaattcatttataatattctataccaatgtgtattctgattcatttgggattaacagtctttctccatccttaatcatactggataaaaattaaaaaaaacttgtatgtcacaaaattagcatggttttgagaccattctttaggggtctcatgattttgtatttcttcatgtcttgtattattctcttaccccagactatcaattcaaggacatttttagagcatacagccttggaagatagaaatagtatctccccttagggcagaaggcagatttgtttgcctccacagaataaagataatgtctccctccaggggcaaaggttgggcagatttgctagtagcttcttttaagtttggggatttctgagcccagggctcctctgctgtggaatgaaccactgtgtgtacaacaaccccctgggctgctctgagactagcggggtgaggggaagcaatggaaatgtaaagctcatgctaccggctgtgctgtaatcatgtccttcctctcttacccaggagtcttgtgtcttctgccagtattgatgaaactgaggcaggttaccttgttagcttgcaagctgggtaaaatctcacagttcttggcaatcgtttctgagctgggttttgaggacttagcgggtttccctttggatagtaggggaagggtattgcaggcagagggagcagctcttcctcatataaaggcagagacagattatggggggctttgtggaggattttttttttctttgagatggagtctcgctttgttgcccaagctggagtgcactggcatgatcttggctcactgcaacctccgcctcctgggttcaagagattcttctgcctcagcgtcccgagtagctgggattaccggcttgcccactaaacctggctaatttttgtatttttagtagagatgggttttcaccactttggccaggctggtctcgaactcctgaccttaagtgatctgcctgcctctgtcccctaaagtgctggaattacaggtgtgaaccaccgcactcggccctggaggattttattctgtgtttaaaacacagaataaaagacaggaagtggggaagacagtggcaggacaactagttaggacgctgttatagtagtccaacaaaaagactgcaaactagaggaggagcttctgaggaagaaaggagtcgtacatggggaaaaatgacattggctctggacaactcagagatgtcctgcaggaaaaatcttgcactgaagaggggagtttgaccctagagatggtgttttgggaaacagagtatatatagtagtgaattcaggtgaattcatattaaaggagaatggagtggagatgatttggtatcacagacctgaagcctctggaggcttctagaggatgggtagataatacagtattaactagggaagtggaccaggtataaaacttcccccaaagcagctatacgttctagagatctttgtgacgtatgtttattttatcttaaaaggagagatttcttattttctacctaaagcatctgtatttcaagtgtaccacggttgctttaaatttgttgacgaagtccataatgaaggataaaggaaccatttcccccaaaggtcaaagcaagtgtccaccttttagggtgactttcacctttagatcccctccttagatctcatagcattggcctcaccagaatccaggtccacacagaccacatcttttttttttttttttttttttttttttaagaggtggaaatttggattttatgcttaagcctttctaaaattgtaaaagccgagggccgggtgtggtggctcacgcctgtaatcccagcactttgggaggctgaggtgggtggatcacttgagcccaggagtttgagaccagcctgggcaacatggtgaaaccctgtctctactaaaaatacaaaaattagccaggtgtgatggcacgtgcctgtagtcccagctacttgggaggctgaggcaagagaattgctcaagcccggaacgtggaggttgcagtgagctgatatcacgccactgcactctagcctgggcaacagtgcgagactgtctccaaatagataaataaataaataaaattgcacaagccagattgagcccctgggccagcagtttgcagcctctgacttaactgtggtttagtagcaggaatctgcttaccctgtggtcttgatggttccatgagaactatgtggagaggcatacattgctatgtaaacaggagggcaaattgggggcttatatttgcccgttagaacagatgatttgatcaccatccaagccctgttgttttatattgagcttgataaacatggttttggaaccaatgaggtggaactgcctgcttgtctttctttcctattgtacgatgcatgtgaataagccattgtcaggaaaataagactcttgtttttcacagatacataaggtggactttgatccacagatgtgtaccaaaattgtaaagtgggcaagtgtgttttttggcaccccaaatcgaggcattctgggccttttccttccaccttatttgacttcaaccccacatctacatgctagggtgctctatgatctcatcacatcaaaaggcgggaagtaacaacagcagcaagtaagttgctttaaaaaaattcacagcgccctcagaaatccaatatgatcaaaagcagttatcaggacaggcagtggtctacatggaattttgaggagggtctgataatcacaccttcctgtgcccatgtagatgcttagcctaaaaggttactggaagtctgcagagtaaatgtctctggaattctatcagccatgagatgggaaaggcgcagagagtctttccaaaatgccacctcccatgacttacctaataagagctctagagaaagttgataccaccagatttctgagtgtgctgtgaatctttttaaagcaacttatttgctgttgttgtgacttccctcctttgtgtatctggtttgaatatttttcacatgctttgagctcagacgaatttttaactctattcaatgattaaaatgtatggaacactacaagttgcccagcactgtgaggggctggtaaagccatttctacctcaactggtcagacaatggttgcacatgctaaattttagaatatatttttctttttttttaagatggagtcttgctcttgtcacccaggctggagtgcaatggcaagatttcggctcactgcaacctccccctcctgggttcaagcgattctcctgcctcagcctcccaagtagctgggattacaggcgcccaccaccatgcccagctaatttttgtattgttagtagaaacagggtttcaccatgttggccaggctggtctcgaactcctgacctcaggttatccacccgcctcgcctcccaaagtgttgggattacaggcgtgagccaccatgcctggcctagaatattctttcaaaaaggaatttttgatcttctgttaaagagctttcaaatatgctatacaccagacattccaaattttattaatttacagttatataggttgtgcaatcatattttgcattaacctttttaatacagcaaaatttccacagtatctctctatataaatatatataagcgcatatatatatgattttgttaaacagaaaacattgaaaaaaagggtaggtatgatagctcatgcctgtaatccctgcagtttgggaagccaaggcaggaggatcacttgaggccaggaactcaagaccagccttggtgagtccatgtctctttaaaaaaaacaccaacaaggccaggcacgtggcttatgcctctaatcccagcactttgggaggccgaggcgggaggatcacctggggtcaggagttcgagaccagcctggccaacatggtgaaaccctgtctctactaatagtacaaaaattagctgggcatggtggcatgcacctgtaatcccagctacttgggaggctgaggtaggagaatcgcttgaaccccaggagacagaggttgcagtgagctgagatcatgccactgcactccagtctgggccgatagagtgagaccctgtctcaaaaaaaaaaaaaaaaaaagaattgagtgtagttatcacaatccagatagagaaagttatacagcattagaggatctcagagttcttgaagtattaacatttgctctttcaaatagagattttttattgtttttactaaaaaaaaccttaatagacaaatcttattaagtattcatgttcaacagctgtatttatagctcattataagcctgctcattaaaatttttctttaaggactgaatttatgtttaccatttacacggggcatggttattctcctgttatttgtttctctaaactgaacttggagcgaacccatccattttccacctcaaggtggaacaggaagataaggcagatctgagggctcctcagtgtgaagttggaaaactcttctctctaaaatacactaaaagccgaaggctgtttcttcagtctgaggaaagtcaggtaatccacattttcattataatggggtagggctttttgcttacatttggaaagagttgctttggaaagtgtctgtaattatcaactaatagcagcatatttttgttccctgtaaactttctattaaagaaaattaagaacatgaagttacatgaaaaaaccctcaatttgtaccaaaaacttctatagtaattttcttttttttttgagacagagtctgtgttgcccaggccagagcgcaatgacgtgatctcagctcactgcaacctctgcctccctagttcaagtgattctcgtgcctcagccacctgagtagctgggattacaggcatgcaccaccatccatttttagtggagacagggtttcaccatgttggccaggctggtctcaaactcctggcctcaagtgatccactcaccttggcctcccaaagtgctaggattacaggtgtgaaccaccatgcccggctatattaattttttgattcaataataaaagttaaaagaatgtcttctgttacttactgcaaattttttcaaaaggtaatttagcaactgatctaatttagctttcgctcaagacaacaaaaatcctagacaccaaattcactgtttcaaaggtaatccaaagatgtagaaaatggtctatcatgggccgctgagacatagttatatcattgtgaccctgcaccattttctccatggttcacaaggcaagaaaaagtattatagctaaatgtagtttggaaacatcttgatgttctaaaataaacacattaattcacactataaattaccttgtactttacaaactttattaaataatggacgttactaactttcattatcttatatacagtatttaaactatgtttttctagatgcattttttccccacaaagaatagagcaggtgaaaagtaaacttatataaaaaaaattgaaccttcagtacaggaaactagtaagaacttgacatactttaaagtacatataacttttcctcgttatatacatccccaccccacctctaaaacaaactgttttaaacaaaagcaattgataactttcaggaaaaaaatacaaacatgattatatatatatacacacagctctcaaaatctgtgtcctggccaacagaaatggtctataaatctacacatttgtcctaaaacctaaagccatgtagaccttttatacagtaagatacccacttacgtgcagtgaggtgtattcctataggtgacatcaaagtcatgcaacaagacactggcgtgaagaagtaatttctgagagtcagacagaacaataatatgaactacatagaactggataataccaatcaaaaagcgaaaatgcgaaacagctttcctgggacaagagtcaggtaattttgttcataggtaatacaaatgcacttacacacacctctaaaaacatactttcttggccgggcgcagtggctcatgcctgtaatcccagcactctgggaggccgaggcagacggatcatgagatcaggagttcgagaccagcctggccaacatgatgaaaccccgcctctactaacaacacaaaaattagccaggtgtggtggcgggcgcctgtaatcccagctattcaagaggctgaggcaggagaatcgctggaaccggggaggtggaggctgcagtgagccaagattgcactccaacttgggcaacagggagagactcagtctcaagaaaaaaacaaacaaacaaaaaaaccaaccaaacaaaaaaactttcttgtggtacttatcttttttgatcatttcatcttggaaactcatatcatgttcaaataaacacaataaagaaggaatgttcccagaccatgctattcaatgtggactttcttttataagctatgagaagaatactttggagaagcaagaaacttgggttattttttgttatttaaaaataaaatcacatgccttaggtacctatttgtaagataaaaacgctcatattctatgttttacagttaagaaaaagaggcataggacttaacaaagagaaaaagaattatgtcacttactcaatattactgcttacctttaaatgaagagcccaggcccctttccctacatatattattgtatcttttaaaatagaaactaacagcatgggggagaggccatagaatgtacacctgattaaaatgagaatacaaaggccaccgcttgagaaagcattcttgctgcattaattgcagtcttcaataaaatagaatatgttataaagttgcaatatatctgccttcatttttctctttagcttctttgattttgctttttattcaatgtcttatttttgtttgttgcctttcataaggagttagatcagtatacagtatcacaatgaaatgtgacaaatggtcagaatataaaaggtgttatttattagtcagcacctagtaaccaaagatttcattctttaatatacctgaaaacaacgaaaaaaaggctcccatgttatgtgtagtttaggaaatagattcttgccctattcctgcagccaatgactcctcagggccaggatcaagttggtcatttggcagaatcccaaactcaggagggtgcatgtgcaaagcgctctggaaaggataaatttaaagtgctttgtctgattttagctcatgcttaactttgtatcgattagaaacaggcacacaaaatggtctggtgggatttcagttttgctttttctctttcaacagtcatttgaagagttaagtggttcccagaagtcatcccatcttttctaatagttaagtcaatctgcattttattgaccttggttttctctaagccagtaaggaaatcattcatttcaccccagaaattatattagaaacatgatgagcagctcgttctctaggccttgtccaggaatacaggtaaagggttctgcgtacagaaaatgggtcccgctacattttaattttcaacagtcacacaatttctgcatcaaaatgacataaaagaatactagcacaaaaaccctaaaatgggcacctcagactgcagtccaatttacagatctctggcttacgttatcctaaggtgttaccacaaatataaccaaaatgtgagatataagcataattctttcaacagctttcgttgccttttaaaatgtgaaaaagtctccttgctgcctttgagtcacaggataaaactacctgggccttctggataacaggaaaggattattgcatttcttaaggtgtgggcactattgtcaggttatggccatcgtgttaaaagtctaaaaactttcaagtaagattgacttacatgaaacatgaagacactcagcatgagaaaatatactgttgatgccaacatgtgctacagtacaatccgggctgcatcgtcagccatttccaaaagttgtgctgtaaaagaaagtatattttacacctctggttcttacaaaattgttttaatctggtatacataaaacacctcatcagtatctgtaacgttttatgagcaaaataagaagttgattcaagcagttattatgaagaaccttaagcaaagctgcttgaactgagacactgaaatttttcccttagagactggacaatattttgttgattgggagatggccccctccaaagatagtcattcagtttgtcagaatcattatatggtgtcagatatggtgaaaggccaagtttgctgttaaccggcttttttggagtgcgcggactattcaaagaatgcaatgtgttgccgctgcagacattatcagaaaagtcagcatccacaaactttgagtcagatttccttctacgattgtgagatagctccaactccgactcatcttcttctgacttgatttccacatagtcatcttcatctccatcagtctctttgaaattggaaaaataattctgtgttgcaatttgggcatttaagggtaaatttctattgaccaccacaactttctgtgagtcttggagtgtgagatctgagagtttttcagtgccctgttgatgcgagtcagcaatatctggcagcaagtcctggtgactctcacaccttgaacttctgtgtaaagacagcagctgctgctttcccacatcactagggtagttgatggaatccattgatttgttgatcaagacggaggaagatgactgggacctgtgataaggctgagatttagcgctgatccctttccgacccaaggagttgtaaagatggtcctgacaccagttctctttgttgggctgacttactaccacgctgcatctctgcacagagcctggcagagggtcagaggtttgaagagaaggcacagagcaagctgcggacaattgcctgggagtactttttgtattgatctcaaacgtgggatatcttgacctcaagtcttgctctggtgggagacagaaatctgctaactctccattactataggttgaatgcagaagccagtctccactaccatggtggacctgggaaggtgacacagacctcaggagggaggattcttgagggctggcccagccatccttctgaattttcaagggagactctctgaatacaatctggtcatacaactgggaatactcagcaatcctggcacctggaaggcaaatattgaaacagtaaatacacacaggataattcctatacgtgaagattaaaaataagagaataacattctaaccaacgtattttaaaattttgacagtagacaagactaactgatgtctaaggatgagtaatctttgaactctgagcaacacacacacacaaatccatggtttaatataaataaaaatgc

SEQ ID NO: 3676 - DNA, 5977 bp, Homo sapiens
ggtgcagaggatttgaacagaatgagagtcctcctctgtgcagggagaaaggcttcagtgggtctccccctccctgctagggatcctccttgccagccctgggctgggcgctggcaggcccgttcccaggtctcccgccgagggcaggagaggagccaggcctcaggagagaagtgcttactgagtaatttaccaagagcgataggcttcccactgagccagacgggatccccaggaggggagtcagaggcgggcctggcatgcatgcacagagagagtgtgcccacttggggagtgtgaagggccttgctgtgggacccgagaggatgagcagagtcaagtggcaggtgggacacacagtctgcagtcacttcttaaaaggccctgggtggtgtgtccttcaatgatgaccattgtccacaatagtgagttccagagggtcgattgggacagttggatagccaaggaccagagtcaggaggcaaggctgatgagcaagaggctgttgccattggccaggcgaggcgtgagggaggctgatggagcgcagcagcagagggatggagaggcaggaatggcatctcctcacaggccaggctcctctgccggattgggtagggacgggaagatgatggcccccaaccctgggccaaggaacaatagcacccatccgggggcgggggacctgctggagtacttctcctggaccactgctcagtgggcaatagagggaacaatggtgtttctgaccaggacgggggaaggcaggggaatggaggaagatactgacagggtacagaggaggtagaatggagcgagggccatctccaccgggctaggaaatggggctttggtgggccacactccattgtgctggagcactctggcatctccattggcagtggggaggggcttgtgacctatcagcatcttcaccctttctgagtttccgccgggctgggctctccagccaggagtcacaggtaccgggtggttgttcatgctgaggccttttgcttggcaaaaagttaatccatttgtgttcatttttaacctaagcaagggttggagcttgttggattcagcatctgtggaacacagtctgtagcccatgggaagacgtggacattctttcccaagttcttgaaggacggaaaggaccatgaacttgtgaggtgaccggaggattggttttgggtgtcagttttgtgtctgtcccagtgctgccacttttgctttgaaatggacggggagagctgaaggccagcatgggtttctgcacctgtttcctacagctctgctggggactgtggctcaggtggcagctgtggacacggatcctgtcagcctttgggtggccagagctccaaggccaggtgtctcttagctgcaagcagccttcactgttaatcaacaggctacacaaatctcacctctaaagaggtgaaatgtgaaaatatatgggaagcgctgccttagccctgtgtccacaaatcctttctgtaaagggccagatagcatttcaggctttatggaccatgtggtctctgccacaactgctcagctctgccactgtagcacaaaagcagccagagacagtgcgtaaatagatagcatggctgtgttctgatgaagcttcacttacaaatacacagggctgtagtttgccaacccctgcaaagtagggagtattttgccaaacttggctgtatttcaccaaccccttagactatagagatgacttaccctttggcttaatcatgactggaaacttccttcccatccactgcctggatccatccacctccccacaaaggcttcctgagcatctcctccgtgtgagcactggctcaatgcacaggacgatgtagttcctgcccatatggaacttaggttttgagtgacacgtgggacattggaagaggagagcaggtggctaaagagcatcatacagaacagggctcagggaagtcccaggtgatagaatctcaaagagaagggctgagggtgaatcaggaaagccctgaaggcaggcagctccggagtcgggtttagacgaggaggctgcagttctccaggaagggaagcaggaccagataacggatgagattgtgtcaaacaatgaggaggcctgcatagtcacacaggcgcatgaggtctgctcgtaaaggaccaggagggccaggctcaggggtgtggactggattctctgggctgtagggagccactggacagctgtgctcaggagggtcatgtgatcacaaatgcttattagaaatgtcactggctatggaggaccatgtctgtggttgtaagttacgcctttccgtttagtctggacttcctggtcaaggtacttttggtattagagtggggaagagaggcccagagagttggacaggttttctgaccattggcttatagtcagtgagcaccccacctttattttgacatgacagagctttacagaatcttccttcttcaggcgttttctttcctgctatcctaaagattcacgtacgagggcaggataaatgaaacattctgtctccaatctaagttcggcttggggcctcagaatatgaaggtaaaggggcggggacggactgactgccccttgcttcagaatcaagtcacatggcgggaacgctctatggagcagattgcttcctttgtacatgccctaggcccgtgttcagcaggcctcagagaagcagaggtgctggcctctcgtctccagaggctgccagctactaagggaggtggaagcaactacccctgggggtggactgctctgggccgggcccgacgtcaggcgtaggggactgaggtgaatcagacgtggtggctgcattgaggaatgctcagtgtagttggggtgtttgtagcgctttctgctgagcatggtctttcctctcagaggggtttctaggcacgttgaagggagctgccgttcagagcatcggagaggtgccagggacgtgagctgctgccagtctgacgtgaacagaaggtgggaatagctggcgctgccgtgcgttgataggagcacagtgtccgctgcgaaggggcggctagggctggagaaagatggcctgatagaagcgcctccacaggcgctgattcagcgaagccccagcagccccgcggggcaggcgaggatcacatgcagctcggagaagaggaggcacttgcccctctgcctgagctgggaggtggtggccagctgcacacagggctgtcccaggatgctgacgaggcgggaccagccacaggccggcagcgctgcactgtgactccctttcacggggcccagccttgtctctggccttccgggactgagtcaggaggcgagggctacgttgctgccccagcacagtcgggccaggtgtggggaaaggcgggagggaggtgtgctgtgctctgagcagcctggcaggccctggagaggcaggaagccactgcaaacttcagaaactgggtgctgcttcctctcggtgaagttgtgttttgctaatctctgataatcaggtcagggatacagaaggaagagttgcccctgggtggctgctgtctttagacttgtcgggctccctctggtacagaagtgcctctcggattttgctgcctggtcttctctcttatggacatggagtagctctcaggctcttatggtacagctctaagaaggaacacttcttgcattgtctagtgaagtttctgggtttatggaagggaaactgacaaactggagccggcacagatggacactgggtaaagagaatgcagcctgtccctggctgcagtgccaggtgtggcctttcctgtgacagcaagtcacgtgctgtggctccagcttcataggaaggctcttgtctgtcaggcagtggagttacttacagacaagagccttgctcaggccagccctgcccctgcctacaggcacaggtgctttgccatctgtcccgttttcctgcttagggaaccaagatggtcagaaagttgcttgactctaacctaaatatttctgccgcttttgcgagtcagactctttttcttttccttgttcatggaaatggatcaaggagtaggagttttagatagctagggaggtggtgagaagttccgtctccacctgtaatttacaagtcgtgtcttaggtttccagcctctttcctctgttctgggtatctcgtgctctccaccctttagggattttggtgtggtgggtccgtggcaagacactcgatccagacacacgcatttccgaggcacttccatgtcacttaccaagcctccttgtgtgtggatatcacttcactggctccctcaggctgcagccctgacccccaaggtagtgatggcagctggtgcatgaggtttgatttggaagtagccaggcaagccctggttgcaaaaaatacctcttctattccgacagcgggccagaggccgctgccattagacgcatccctctacttacccccgatcacttttcatggtcaggccggccttgcacaagcaggttctgttcactgcgcacccccatttcttagatggggtactgagcactgcttttcccttagctcacttcatgtggcagcttctcagggatgggacctaccatggctgtgggagatgctttgctactacttactacctttccgagggaggagggctcatttttagaaatgttactggggagccaaattgtaggcctccgaccagagggcctcgctctctccatctcccaggaaccaagggtagctctggctctctgaggagctgtctccagcctccaggtggacgtcctttccagcataccagggcttatggaggcaaaatgaaagctggtccacgtgggaactccctactgttgtcctttccttgggcagacaccatatactttttagctcctagcagtgtttatcccgttttccccaaagcatccttggactcaggcctttcatcctggacccatctgtctggcctgttgtgctgagcctttggtctaagtggttggttggtcccagccacttcttcaaaagaaggtttcctgaggtaaccataaattagggcaatcgtacttccaggaacagtgaggctgatgggcctgttcccaagggtactttggcagggggtgctggggaaggggctggcctagggccaggttcatcataccgttagccctgcagccccatgcctgtgtgtcctggtttacccgccgtgtagtggtcctgcaggagtggagcctgtaggacttgcttctcagcggctccaagcagaactctgtctgggaaggtgggaggtgcagccagtctagacctgaagccctcacactaaggactaaggtaggcctgctcagccttagcccttcgtcaggcccaagggtgggggaggcaggaggaggctgagcgtagtcgtggatagaaacctttccctaccgcacggttacacacatggcatgggactcctggctgtagctcactcgggtctactgaagaccaagttggtttttagaaatctatttaaaatatctatcatgtatctatttactgtgtttttctgaatacgcaagtgtaaatagtataatttgcagtgcaaaatccttggcaataactttgtgtattatgtttaaaaacactggaaaccgtgaccaccatggactgcccttcccctctgaggcaattattacatgtaggactctgaactttaaaccttcagcgtgactgaagcagcagcctgcacatgtggatggtcatcagtgcctcgcccagagatacctggccttcatccaaagggaccctgctgccacaagtcctccaggcagcacccgcactgtggctccttcgcactgagtatgttggactctgccatagactgaccctcttgtctggctgctgcagtttgtctgtaatgccctgacatgttgcattctccccatttggataaataaaaacaaacaaatgcttctgtc

SEQ ID NO: 3677 - DNA, 8227 bp, Homo sapiens
ctctgccttcgctcgcgccgctctccttcaggcctgtttcatggatagggtccccttgcccgcgtgaaagtctcattcctcctcagctcagaaacactccaaggtctcggcgccctatactggccttccctcatccgaatacccctcgtgctcctgatgtacttttccattcccactccctactctggcagtctagcttctaagctgaggagtttggccttcgctccaggtgcggggactcgtggaaggatttgattcgcgcttgagaaagatcgctccgctcctgtaaggaagagagcgtgtaggggctgcaaccagagacacagtcagaagctccgaggctaccgcgatggtccagcacgcggtctggtggcaccctgcaggatttaccagctttttgccaacattctggcctatgcaatcaatacgtcccttcagcgttgcacttggatggattggacctatagttgttatatatggatattgtctaatttatttattacagtattaactgactcctatgttctggccttcagaatttctcctttggatcaattactagcctgtcttacattttctgcttcattcttttaaaatgtttagagatgatttgctaagttttcttcattgctgtcaatgatgcaatttaaactgtcaaaaaaattttttctcaagcagggtagtaatggtgaaccattcccttgctattcagacagcatggtttagatgaggcgcacctatccccagctttaggaatggaaacaggacccaagtctggctaatcagagactggtttagggtcggccccatggtctgagccagaccaatgagaattggtagagggacttccttttgcaacttctattttagaatcgggggtatatatgcaggcttgttacagaggtatattgcatggtgctgaggtttggagtatgaacgaatccgtccttcaggtaatgagcatagtacccaataggtagtttcaacccttgcccccttcctccttccccagtcttgtattccccagtgtctgttgttcccagacattgatctttttcctctatgttgctaagctggtagaaaggctggagttgctggcaaccatctttgcaaccatgcagggagaactactttggaaatgaagcaagataaagaagaaaacagataaaaggagacaaatgtttgactttgtacagctggaaaccagcaatgctggaaatgagcactgaaggcagtttaatgggtttgtcacttgtaaccaagtgacccatggcaagctcacagatttgtattggcagaattcctccttttctttatttaaaatggtacttttggccaggcaaggtggttcacacctgtaatccaaagactttgggaggccgaggcgcactgatcacccaaggtcagaagttcgagaacagcctggccaacattggcgaaaccccatctctactaaaaatacaaaccattagctggctgcggtggcctttctaccagctttttgtctcaaaaaaaaaaaaaaaaaaggtacttttgcttatctctaaccttcctcttccccataatttaacagttgcccatactatctgttactctgagctactctctgccccattctcctcctcttatcttcagttcctcctaggctgtcagagccatctgaaatgaaaacatttaggccgggcatagtggttcatgcctgtaatcccagcactttgggaggctgaggcaggcggatcagctgaggtcaggagttcaagaccaccctggtcaacatggtgaaaccccatctctactaaaaatacaaaaattatccagacatggtggcacatgcctctactcccagctacttgggaggctgaggcaggagaatcgcttgaacctaggaggcaggggttgcagtgagccgagattgagccactgcactctagcctgggcgacagagtgagactttgtctaaaaaacataaataaaataaaatgaaatgaaaacatttgctacttgaaatccttcagattccccatcgcctacctacaggcaaaactctcaagttcttttgtatgatttaaccactatctacctgtccaactgaaatctacccttcagtaatattatacttgcacctcccttcataagctatgctacaagtttggttatgcagttgcccaccttttaaggttcaagccttgtcttctccaaagagccacctctgactgcctcacagtaagcttagggcccgcaacttacctgtaacttttgttgcacttatggccttttacaactatcaatttatgtatgtgtctgttctcactggtttataagctccctgaggacagagccttgcttgagtcatctgtcagcagcccaatatgggacaaaaagtgcatgcattgtaattactgaacagaactgatagaggctcagcaatttgcgctccataggtctaagtttgaacttttctagaaaaggatttgcaggacgatctgacgaatcttgggcttccaaattagttccaacagttctagtatttttttttttttttgacagaagcaaataagtaagttttactttgtgattaaaacaaaagtgaaatgcatttagtcccaggaaatgtcaatcctttctgcatcttacttttttttgctgtgacctcgagattctcttgttctcttcagttgtattggtccatgatcactcatagctttcatacacatatatacatctgaaactcagaaaattcattaggtaggaactctttggatgcatctccttttttaacctcattgggatgatttttcgttgcaccatcattttatagagcttcctagcactgctgagcatgcagaatttttgcaaatgcaatccagagaaacagacttgctatatactagctatttgaacttgtctgagcttatgtggcatggtctaaagaatactgaaatatttctggcatacctcttaattgcagtcactttctccaggttgctttatggattaaatgagataacctactaaaggactccagtaaaaagctaaaaaggtagctagcttttgaggtgttgtggcagactggcatctagtggccagcgataaaggtgcagactagtgtccacacctaagtggggacagtgcaggctgtaatgtccatacctagtggggacatcaatggggtatttgtcagagaagctccatggcatagtttggacattgtttctggctgtgcaggttcaaacccagagtctggctctcccaaagattatctgagttattctattattttacaaagtttgaaatagccattagatacccttacaaacttatcatttttgtgattgattttaagtctactgaaaatgtcaaaagaaatccaaaactgattgctagtaactaggccaggtgtggtggctcacacctgtaatcccagcactttggggccggggcaggcagattgcttgagctcaggagttcgagaccagcctgggcaacatggcaaaactccatatttacaaaaaatacaaaaaattagccggacatgatggtgtgtgcctgttgtccccgctactagaaggctcagaaagaaggatcacttgagcctgggaggcggaggttgcagtgagccaagactgtgccactgcactccaacctgggcaacagagaccccagctcaaaaaaataaaattagtgttaacttgtactgtttagccacattcattaagtttttaattttaactctactatcgcacaaccaggaatgtacaagagatctggagcctgatttgcatggcaggaaggagaccacgtatttttgtttgggatgggttttagccactatcagagacatagtttgtttcttaggggttcggtcccagtagtatgatacttagttcatttaggaacttccttttttaacggctaagaaaacattttagctactaaatgatatgcaaagataactttccaaatttaagctgtactcaaaaatccacagaatctgcaaaactctcaagtttctatatttaaatagaaatgtgtgttgatatacatactttaatcagtcatttcttgctttcaatatattttattctgacgaagttacaaaagtagatacaaaatactttttttagaagtacagttaactgacttagaaaaatagataaagcccctaaggattttaaaacacaacataaatttttatgtaaagaacatttaaaaatattttagatggtaaccaaaactaacttacacaaactatttttgatgtagaatagaatgctgttctataataagaagtctgtagcacactggtaatccatttggatctacagaatacttgtttggaacagaatctgataatgagagaaaactcaaatgaatgtcagtgcagttgcttcaaaaaaattactgctaccacatgtactatcatcccccaaggccttttacagtctgaaatatcaaaattgaaagcaaaaataggatgaccaaaggactactattttacctcttttcagaactctacaatagtagaaactaaattcccttatggatctcagggggaaataatgtgcctgttgaaggggctcagtgtttggtgtccaggctggcatttttcaggtgagggtttcatactgacaggaggcaggctcctaaaacaaggcggtagcaccagcaccatgactagggctgctttaaaacaaatttctaggacttacgctctttgggcctgatttgttaatgcttatgaggtaatgatattatgtttgagaagctctacttctagtatacctcaatgctcagagagaaagccaacaatacaatcaggaaaccacaatattgacaaaacttagtactaccaccaagattgttcctcttgccttggcactactaaaaaactttacctttgttactaaagtcatggtgaatacagattttgcatttctcatgtaagcagctatataagctagggttctacaagccttagatgaaaggaaaaactttgctggaagccctgtaaaaatcactttattcacaatctgaagaatgaaagacaaatttggctgtcaatacaaaaactgtagtacaaggaagttcaactgtttaaaaatctgcacatcactgtacaagtgttttttgaaggcctgaaaattaaagcaccataggattaactgcataatttagcaagcactctctaccccatgactgtaatcatgtatgaagagcagagatcagacactgagaggagatggcttctgattagcaagggggaagggagtgagtgttatggaacaggcaaaccttgggcatggggagataaaagtgagaagagtcaaaaagattgatttctataggccgggcacggtggctcatgcctgtaatcccaacactttgggaggctgaggcgggcggattgcgaggtaaggagatggagaccatcctggctaacacggtgaaaccccatctctactaaaaatacaaaaaattagccaggcatgactaaaaatagaaaaaattagctgggcgtggtggcgggcacctgtagttccagctactcaggagaggctggggcaggagaatggcatgaacctgggaggcagagcttgcagtgagccgagatcccaccactgtactccagcctgggtgacagagtgagactctgtctcaaaaaaaaaaaaaaaaaagattgatttcgtcaaactgttatcaaaggttggccctctagccaactcaggaaggcgccatcctcttcccattatctccccttcctccaattctcctcctccccttggctccctagccttggaggtaaacactaatatttcagtgcactgttggttaagccagattggcttgggaacctggtaatgtttttatttttattttaaaaaaggacagtcttgagtctcaaaataccaacacatctctgatttatgtcccatttataagctgcctttactactgtcctgacatgtgatcgtctttcatttgctttggagcttagtggtgaagagagggaacatttccataactgaaaataaatggagaaaagtggtaactcttttgtttgagaatatttgaaatactagaaataatgaggaaagtacaagcctagctgagaaactagtttcatcacttgtggacttaaaaaagtaaagctaacagggtttaaagttgagaggcagttcacatcctaagtgatacctagaaacctgctttcttgttcgcaaatgatcaacatgaacatacagaatggctgacatttggacctttggataagcttaaaacatggattgtggaatgtctaatagagggcttttctctcttttttttaataatgactgtcccacactttaattcctcaatgatatgtggatgctaactaaatcagatgaaatgttttctttaaaattctgtatatatttaagaatttctaggaaatgattatttaaaatggagtttctaagtaattattttctttatagtttagtggagtaagaaaaataaatctaaaaaaaaacatcaaatctaacctttatcaaagccatcgaggaggttggtaaaatactttgcaaaaatcacagctctgaaccacatagaatgctgatgaacttaaagctttgccagtttggcaagtcttccagtataatacttgttgtgcctcagtacattttaaatagacagctagagtttactaaatcctaggaatcaaataaaaaataaatgttttcttcactgaaggggaaggcttttatatcccaatagaaatagaggaatttcaagttttgatacaaaaacaattaaaacaagataaaacccaagtggaagctcagtccatcttttgaatattaacaaaatgaggatttttttaaaacttatttctcccattttgtttcctttaaacacatacactcactcactctctcaagaataggtagcacaccaaaactttatctgtgttataagatgtgtacaccttcatggtttattgtggttttccttaagttttatccttattaggatgaagttcatgcatttctacactactcttaactaaggctcaagagacaataaaaacatagaagtaattttttaataaaaggaaataaaataatcaagtactctgagtattttcctccattctcttatccagaattttaaggcctctgaaaaataatgaaataataaaaatagtggttttgagatctaaatttattaatattttggattccttttctcagccaaaagctactatctgaattaagcttttcagtttaaaagcctggaagaccatccttagaagacattaaaaaattacttctgatacacacactcctaataatttagatagatatgaaaacaatctcaaataaagatcaaaaaataaagtccctgtaaaaataactttggttgctcccacccacacgtcatatgatgatttaaactgcaatcatgaattttgaaaaaatagacgtatcttatctataaaaacactaccatacaaacttgaaactaaaatgttatctgaagtgacacagatgttctaaatctcaaggatactgaaaaatacattttttattcgtaaaataaaagaataaaaccaatctgattgtgttattaggaaatttgttctggaaacttattcataaattattgatggaaattcttaatgtccattgtgctgtcacctaaaacagattcaatcattttcttgtaaagaaatgactgagtaaatgagtaaaagaataataagtaaatttataagctacaggttaaccatcacatattacaaccaagtatgactatgtgataacaacaagagtggtcacacagtacttaagatttggctgtgtccttaaggtcttactcggaaactatcacaccaacctacctttgggataattttatcagtagacacaggcaatgggtatctttttatcctgttttcttaaagtttgtatcactagtctataacagatagcaatgagatagttctagcaatagatgaagcaagggggtaactgtgttctagaagaaacatttatctgtcttttgatccaagtttctctattaattcttgaagaggtgccagctcacgcctatcaatcagattaaactcctaaaaagagaagaaaaataacaattaaaaatggatctaaaactgaaactctgtaaatgtcttttggagaagggattcccaactctagttttctgaagtccaaaagaatgatgaaat

SEQ ID NO: 3678 - DNA, 289 bp, Homo sapiens
atcgcaattaccttaggcatatacttcaccctcctacaagtttcagaatattccaaggccccttttactatctctgatggaatttatggctcaacattctttatagccacaggctttcatggacttcacatcattattcggtcaacatttctcactatctgcctcctctgccaactaaaatttcactttacatctaaccaccactttggctttgaagccgctgcctgatattgacacttcatagatatagtaagactattcttatatgtctctatctactgatgaggat

SEQ ID NO: 3679 - DNA, 1800 bp, Homo sapiens
cagcatcaacataatgcggtcaccagtggggagtgttttgcccctggcccactcagccccatagatggccgtgatgaagccactcccaaggatgccagtgatgcactctattccggagaccaccaaagtgaaggtgaccttgaacttggatatgtctttatctgtggcatctgtgttcaccgttgccattctctttgatcctgactttcaggtttctgcgccaagaatgggtaactgctctgcaatcttctgacccttgctcaatgttataatttctgccgccctcattaatggttatttccaatttttctccatttgtttatcacatgactacaagttagaggcttcacatgcaaataatgagaggatctggttactgggtctgtctcaatttttcataaagatacatttgtcttgggctttcagaagctcactggaaataatttgagacatgtttctagctcaacaccttcttaccttatttactttaagtccacatttacctgataagcaatgaatacaaggcctttttacttgtctcacaagatctctgttacctgctaaattatttgtaaaagctcatacagcttttaaaatctgttttccccacttcttttcttgtctctcttattttgggagagagttttattttgatagttaccatgtttgtgaataagaaattcccataagctcatatatgaacatcttttacttagaattgagtttcttccaaaaaggcctgctattataatgtcctcgaatagtatatagaaaagccaaaattggatgctattcgagttggagagaaggaagtctccatagtcccagtttttattgtttgtgtatgtgtcatcaatttcagcttactgagatcccacatgactatttgagctcagaatcaggtagaatgagcctggggagaattcagtgttctggacatggtgttgaagtttggaaatgtgataaggtactatgacttgaaatttaatttcctactttttaaccctggctgtgaaccagaatgaactctggcactttacaagaatatgtagatgcccaggactcgtccaaatctaggaaatcagaactggactagggctcaggcatgctatcttttaaaaaagccgaaaggtcttgttgctcatagtcaggattgagatccaaaatcttagctggaaaccaatgagccttgggtcagatttggcctgtagtcattttaccttgcattggttaatgctgtacagcattaatccaccagtgtgtaacttttctttttgaggggttctattggcaaacatttaaacttaggagattacttatatgcatgcacaaaaaatctatcttctcttgaaaaattagaagatttggcagtattgggtcttcatagtgaactggctgaagctgagtaatggctgcccattttaaacaaggtatatacttttcagtttgttgacaatactaattcctagtgtcttcttgacacagaagctgagtgccagttatcattttccagtgtgcttaccctgttatttttatttgattatttttctttttgagactgggtctcactctatcacccaggctggagtgcagtggtgtaatcatggctcactgcagccttgacctccatagctcaggtgatccccacacttcagccacctgagtagctgggactacagatgcatgccaacacacctggctaagttttgtattttttgtagagacagagtttcgccatgttggctaggctgatcttgaattcttgggctcaagcaatcctcccatctcagcctccgaaaa

SEQ ID NO: 3680 - DNA, 1708 bp, Homo sapiens
gggccccacccagcctggctgaggggcggtggagagtgtccgcctggacggtgaggtcagctggcggctgctggccaccctcgtgctcgaaagatgcccctagcgccccctccgttgcatcaggaccctaggccagcctgtcccagtgtctcctcagctcaccatggcaggctcaatggtgaccccccttttatataggaggaaactgaggcctggcgaaagaaagatgcggcctgaggtgggacgtgaacccgcggccctgcagcccagacagcggccccggagtgaccaccagcttcaccgaagcccctttactgtgcccccgaggacacctgcctgccgttccccagggccgtcaccgccgatagcggtagcgcttgaagtgaaaccacagctggaagatgccgttggcaaactggcagcggaagccgtggcggtgcgagtattcccactcgcggttgacgatcttgaaagcgatgtcctcgtagggcggccccgcgtggaagcgcaggatggcgaaatccttgttgtcggcgcaggcctccaggaagtactcgggcgtggagcgcttgtcgatgaggtcggggtagaagatgttgaacttgtatccctgcacgatcttgggcggtgggttgtcaaagtcgtagtgcgtctggttgtacttgttccactcgaagcccgtgtgcacgcggttgaagaagcgcggcttgcgtggccggtacttgtcggcccacaggtaggccttgccggtgagtggcatctccacgctgaactgcgcctcgtcctggcccatgccctccttggcccgccggaagaagatgtcctcggcgctctcgctggcgtctcccgtgacctggagctgctggcgcgagagctgcaggcgctgcaggtcctcatccggttccagcacgtgcgcgtccagtggcagctcgtgcgccgtgagcagccgcgggctgtacctgccggcgtcgtagtcgtccaggctctgctggatcaggtcctcctccatgagcaccgcctcgccctcgccctcgccctcaccgtccccgtcgccgtcgccctctgtcggggtcgcgccgtccacctcggcctccgcggggccgccctccgaggagggcccgggcggggtgggcgccgcgtcctcaggctccaggctgcggctgggggactggggctcctgcttgaggatggggaacagcggctcgctctccacgccctgctcctgcttcagtttgtacagcttctgccgcagcacgtcctggtggcgctcacgcagcctagtgctcaccgggcccgtgccatgtgggcacgaagctgctgcaggaggctctcccagtagcccatgtccaggttggggccaccagcgcggattttgccctcgatgccctggaagatgacctgcagctggttgtatgtcttccccttgaacaccgactgcacatcagagctgacggaggcgttgaccccctcgcggcgctcacctggccccttgcccgaggcctccagcttgcggagcttggagatctcgtcctcggtgatggtggtcatgtcccgccagaagtcggcgttcttgccctgctccagctccatgtagacctggatatcctccagcaggtcctccatgtcggccacggtgaggccgttgaggaacgtgtagggctcatgcatctccacggccagatcgtcatcctcagcgctgatgtacttg

SEQ ID NO: 3681 - DNA, 666 bp, Homo sapiens
aggacggagagcagtaagcgtgctggttcttcttttggtctgtttagcaacttcccatgacttttgagcaaggaacaggtgtaaccccttgcaccctgaggtgtgcagttgactacatatgcctgtggcctcaaggccatgtagaaattgtccctggttcagccaaagcaaattcaaaaccaaaagcaaattcactgaccacgggggaaagagtaggagatattaaacaagcagctctgcctggccttccactcacatggccatgaggcccatcattcagcacatcatctcggcccctactgcgtgctgggcactgtgaggagcttctgcctcctgtctccttcacgctcctttcctttcccctccatagctcagcaaggcccacattttcccggtgaagccacagaaccacagggagaaacccatggacttcgcctctctctctaggggaccagatgtgcagaggtaatgaataccagggaatcaggaaaccactggatcagttctttgagccacagaacaacactcatcccagcagctgggaagctatctgcaaaagtccatctgcagaaagggcttcctggtcttgcgtgtggctgggccatttctctggatgcaggtttttcattatacagtcttctcaaagaaccacctgctctcaacacc

SEQ ID NO: 3682 - DNA, 288 bp, Homo sapiens
cggtcctaaagacagagcgcaaagacaccacgaccctggggtaatcccagggttccatgcgtatcctctgcacattcagcatgggctcctcggtgcttgtgtctccatttttctgtcgttctgcgataatcatggcccggaggagaggcgggtacggcacggaggccaggctgtcttccggcgccggcgtgaacgcggtgaaggcctcctcctcgtgcttgggcaccagccgccagtcatggtacatgacgtgttcgatctcccgcgcctcgctctcagtcttccctg

SEQ ID NO: 3683 - DNA, 888 bp, Homo sapiens
gacccacagagtctaacagatgtctctatattccttctcctcgaactctcagaggatccagaactgcagccggtcgtcgctgggctgttcctgtccatgtgcctggtcacggtgctggagaacctgctcatcatcctggccgtcagccctgactcccacctccacaccccatgtacttcttcctctccaacctgtccttgcctgacatcggtttcacctccacacggtccccaagatgattgtggacatccagtctcacagcagagtcatctcctatgcaggctgcctgactcagatgtctctctttgccatttttggaggcagggaagagagacatgctcctgagtgtgatggcctacgaccagtttgtagccatctgtcaccctccatatcgttcagccatcttgaacccgtgtttctgtggcttcctagatttgttgtccttgttttttttttctttttttttttttccctcagtcttttagactctcagctgcacaacttgattgccttacaaatgacctgcttcaaggatgtggaaattcctaatttcttctgggaaccttctgtgacaccttcaccaggaacatcaacatgtatttccctgctgccgtatttggttttcttcccatctcggggacccttttctcttactgtaaaattgtttcctccattctgagggtttcatcatcaggtgggaagtataaaccttcaccacctgtgggtctcacctgtcagttgtttgctgattttatggaacaggcgttggagggtacctcggttcagatgtgtcatcttccccgagaaagcgtgcagtggcctcagtgatgtacacggtggtcacccccatgctgaaccccttcatctacagcctgagaaacagggata

SEQ ID NO: 3684 - DNA, 449 bp, Homo sapiens
cccctgcgcttgggcgcggccggggtggaggggggcgcggcgggagccggggctggcggggtccacacgggctctgcctgggggctcacgctggccgggggaggagggggaggccgggccggaggctcgtcgtcctcagggagcttggagggcgagactgcggcagcagacagcggggatggcgcgggcacggtcgacgacaccgggctcgggtcccaagacggctgccgctccggggcgacggggggagcggccggcaggggtccccggggcgccggcggcacgaagtcatttccgaagtccatcaggggcgcgccggcggcaggggcggtgggcactggggccgcggacagcccggcggcgggcttcctctccagcacctccagctcctccaggtcttcgtcctcgtcctcctcttcctcctcctcttcttcctcctcgtcttccat

SEQ ID NO: 3685 - DNA, 955 bp, Homo sapiens
agttggtcatgtccaggaagaaggcgcaaccggcaggattgagctggaagccgagcagcctctggaactcggagatgagcacgtccttgtcggtggtgcccaggcagctgaacttctgcatcagctccgggtccaggtctacgtccatgccctccatggcggggaccggacacccgcttccccgcctcttcacaaccaagccgccgccgcgccgccgggcccggggacctggaggggggccgctgctagctagcttcgcgaccccgctcctttgaggtaggccccgggcctctcacagtctcataggggtaaactcactctgccactcactcactctcccccccctcccaccccccccagctccgccgcctccgccgcctctcgcctctcgccactccgccgcctccgcctcctcccgcgccgcgcccactgcgcaagcgtcgcccgcccaggccccgccccttcctctcccggacgcccgcctcttagtgtcgtcacaaactcgtgacgtccccgcgtgacctcaccgctgcggggcgatggagcgaaaagtgaggaaactgaagtcccgggagagacagtggcaaggtcaagtagcaaagtgcactcagccctcccagcaaggagtctgccactcgcgcttgaaggacgtgtttgaagagctgctttcccagtgggatgctgccttaaagtcttgattccctggcactctttcctattactacattttatcggtgctgtttgtgttatgcaacggtagcatcgtgtctccggaagataaaaaaggtctcgatacaaacatccataaccttccacccactccgtcaggaacaacccaatcaaaataaagtcatgagaatttagcatgccttgttctgtgtttaaaatagaagacaaagtatttctgtatatatcgtacaccttcccggtcaaggtctgtcaaagaatgagaaag

SEQ ID NO: 3686 - DNA, 13517 bp, Homo sapiens
agtgcatcccgccctaagccagcggggcgacctcaccttcagagacctcatctgcggggctcccacctggctggatcccgcgcccgggggtccgggcgccgtctggagctgagcaggcagatgtgcgggcgccgagggtggggcgagggctgggggcgggcagagggaggggaaggacgggctcgagcgggacctcccagggaaactgagtcagtctggctgtgaccaggggcgggcccagcagaggacccacacagatggagggcgtggcggcacaggacgccctggggtcgcggcctggaggggtccgcgggggctaagccgagctgggacgggtgggggccgctggcagcccgcggctcgctctctccgtccagtctctgtctcccgctgtctctcatcagccccgcccaccctgcgctggccacgcccctcgggcccgggcctggctgacttggagtcagtgggtgccccccgcacgccgggacaccctacagccttctggggaaggcggcgcccttgggacccccaggccaccggtggcagggatgcaatggcccgcgtaggggtggcaggggcgcttcctcgggagcctcagcccctccagccgcccagcgccctgccaggcctcttcccggcgctcccgccgccaggcccgcattattcaccatctgggcagcacccaaggcctggagggggcggggcaggtccaggcggatcggctcccgggggtcgcccagactccagggctccaaattcactgggtgcgctggaacgcggcacacagtagtagtatgccctgcttaatacatacaggacatatttgaggccccttccaggggtggggtgggaggacagagggatggggggtgcaccagacgacacagccagactgagaaaggtggtcccagagcaggaggctatccaactcctatggatgtggcaaaaccctggctccaaggctgctttcccgtgaagccgacctaatctccaagtcttactctccccaacccctctctgtgttcagcttatacagtgggacaattatgagctccaagtgagacctgaaaccaggcctgcccttcaggatgccctaggctggagaatgaactggacacaggctgttccagccccctggggtcagggctgggccaaaggaagagacagggcctagggaagcccagagtgaggacatttggggaggctcatcctgggcactgaagcacattgggcagcatccctggcctccactcactccacgccaggagcagccccaaggtgggaccaccacgaatgcccccaggcatggccaagcgctgcccccatgagagcctgggcccaggccagcagctgtgtccacccttgtaccctccctcctgtcgtctgggaaatggactgtcacccccactgtgggaggcaaggcagaggggtggggggcaaagacagatccgggcactaacacagctcccaagggaccaccgggccccagttgggtgccgtgttgtttcccaggctcttcccttgggacaaatgcgctgtgtcacaaatgccagcagcaactagggcagcgggtgtggggcgtcggacacgttacactctctgcatttctgcaaacctaagattattctaaaatacaacgtttattaaaaaaacatgcgatcttgccaataggccaattccatgagaacaaaagattttttttcccacctacaagtctttttagagaaacaaacggaactatttccagatgaggcggggtgtctgggaggggctgtgggtggtctggggctggtgactggtgaggttgggtggccctctgggggtccgggaggcactttccgttttgcttctgttggagatgttcccgtcggatgctgaagaacaagcctgccggctgggccactccgacctgggctgtggcacccgtgtggccctcggccctcctggcctgagaaaggggagtgagaaggagccactgtcctgatatgggcaaaactcggggtcactggtctcatgctccaaggccccgtgagcaggccagagacagggacctcgacgcatcctccatacccgctgcggggaaatggaccccaccagccagcacggggtgagttgggggccagtccctgcagagtgtgggtgtccacagagggtctcttctgcagtggcggatcgggcgccagcagggtcccggcctcagtgctgcctgtgcgggcgagggtggcctgtgggcagggctggagctgccccacagccgcgggctctgcctcacgcccagtgggtgccccgtgatgtggcagggctggccttgagtttcctgcttctcacgagcctggcaccgccaagcccaggcccctctggcccatctccacaacaccctgtgtggccgccacttggggcaggccctgtgggccccacccagcctggctgaggggcggtggagagtgtccgcctggacggtgaggtcagctggcggctgctggccaccctcgtgctcgaaagatgcccctagcgccccctccgttgcatcaggaccctaggccagcctgtcccagtgtctcctcagctcaccatggcaggctcaatggtgaccccccttttatataggaggaaactgaggcctggcgaaagaaagatgcggcctgaggtgggacgtgaacccgcggccctgcagcccagacagcggccccggagtgaccaccagcttcaccgaagcccctttactgtgcccccgaggacacctgcctgccgttccccagggccgtcaccgccgatagcggtagcgcttgaagtgaaaccacagctggaagatgccgttggcaaactggcagcggaagccgtggcggtgcgagtattcccactcgcggttgacgatcttgaaagcgatgtcctcgtagggcggccccgcgtggaagcgcaggatggcgaaatccttgttgtcggcgcaggcctccaggaagtactcgggcgtggagcgcttgtcgatgaggtcggggtagaagatgttgaacttgtatccctgcacgatcttgggcggtgggttgtcaaagtcgtagtgcgtctggttgtacttgttccactcgaagcccgtgtgcacgcggttgaagaagcgcggcttgcgtggccggtacttgtcggcccacaggtaggccttgccggtgagtggcatctccacgctgaactgcgcctcgtcctggcccatgccctccttggcccgccggaagaagatgtcctcggcgctctcgctggcgtctcccgtgacctggagctgctggcgcgagagctgcaggcgctgcaggtcctcatccggttccagcacgtgcgcgtccagtggcagctcgtgcgccgtgagcagccgcgggctgtacctgccggcgtcgtagtcgtccaggctctgctggatcaggtcctcctccatgagcaccgcctcgccctcgccctcgccctcaccgtccccgtcgccgtcgccctctgtcggggtcgcgccgtccacctcggcctccgcggggccgccctccgaggagggcccgggcggggtgggcgccgcgtcctcaggctccaggctgggaggagagagcgttggaggcgcggaggctgcccacggcccctccatcctgctccgcgtctgcatcggcgtccccggggtgccggccgggcctacctgcggctgggggactggggctcctgcttgaggatggggaacagcggctcgctctccacgccctgctcctgcttcagtttgtacagcttctgccgcagcacgtcctggtggcgctcacgcagcctgggacgcagagccggggtcacccgcatggaggcgaaggggctccgcgccccacccccaccgagattctcacgccccttattgctgcaaggaccctgagaaggtggcgagcagccacggctctggctgggacctttgcccaggcttggtcagttcagggtcaaggcttatgggagagaggacgagaggacgcaggtaccctggtgaaccatcccatggcagggagaggtgggtctctgtctcacgctgcagtctcagtgtcttgtggctggggctggccaggagaaggggcccagcaggacaccagccaacaagcatgataaatttagagacatttacaaattagcagaggagacatgtatttacacagcggtgccaaaaacactccagaaatctgtacacagccagaggccgggaggcagcagcgctgggagggcgcaggcctgggcgcaaggcagtggggacaggcaggccgcctgggggcttcctgtgatgccatggctgctggagcgcgccaggtactcgttaaagggcggaagctcctggggagccctgtgagaccaacagggctgactccaggtgagggcactggagcatcctggggccttcccgctagggcacgggactacgcgccccccggccccccttcgtcactcacaggctggccccggccagtcggcactttcctgcccctctccaccccacatggtcccaggaggaggcgagacccaccccacccaggactcaggagggggcgaaacccatcccacccggacggcaccaaccctggtacccgcacctagtgctcaccgggcccgtgccatgtgggcacgaagctgctgcaggaggctctcccagtagcccatgtccaggttggggccaccagcgcggattttgccctcgatgccctggaagatgacctgcagctggttgtatgtcttccccttgaacaccgactgcacatcagagctgacggaggcgttgaccccctcgcggcgctcacctgcagcggggtgggggcatgggggggcggttccacatttcctacgtgctcctccaccccatcagggcctcctcccctgccatgggggggtccccctcccctcctcttcccccacaggggtcccatccagtcccgccacctccctggtctcaggttgtccccaccctggccacagcggaggggagggggtgggcggaggttgggagccacgttaagatgcagttgctgaggccttgacctggaggcccaggcccccagcgtgggggaggccaggactggccctgagaatgcccctccccaggtgagtctgatatgtgggtctgggaaccctagttgtgggcccggcccaccaacctggcccaactctgccctggccttgggcagtccatgagggggttggggggtgtgctcggtagccaggctctctggaattcagatcttctctgccagcctgggctgtgtgactgtgggcaagtggcctgccctttctgggccttagtttccctctgtgaagcctagcaaagaaggccaccctgctggcccctggggaagtcctgggcccgccccaggacaaacagctccccaccgccgccccccatcctacatggagtctgtctggcatctaccactggcccaggggcccgaggctcaagtccctcctcgatagacggggaggctgctgagggcgggagtggggtgctgggaggctggagcctagcctgactccgcgtgctctgccccacaccacgtggcatcccggcggcctcagtgctgctctcaggccacttccacccaccccgctgggtctggcctcacctcgcaaccctgccccttgctgcccatgccgaacccctgccacctctgggcctttgcacgcactgtgcttcctgccagctacccatccttctctgtcccattcgcttcctgaattcctcgcatcctccatgctcagtgagaacatcccttccgccaggaagccctccctgaccatccagcgatggcagcttcccgaggcgggcaatggggctggctgctgctgttccctgtgccatgctgggcccacagggagcttggtgcatagctgctggtgacacactgggcgggggtgaccagtgcaggcaccctgctcgagacctgccttctccagtccccgctggcggacagagggtcaagaggcccacacctacaccacaggggactggatagagtctagacggacccgagtcccctccagccaatcacctgggaccctggaatcggcacccagagctgcagcccctttgctgggcgctaagtggcactggaatccgtggcagccccagccaagcacagcgcggccgtgcccagacaggcggggctaccacgaacactgaaacccaagcagaagagcccagccgcgaggctcccaggaagccaggccaggtgccgccaggtcagcgtctatagaaagccgggtctggacatgctgctgcatgtctggatgcctcccgaatgcccacaagggggcccgggggtttagggggtcccagcagctgctagaggctgggggtgcaggccaagggccctggggctgcgtgggggaaaggccaggccctacacagggtgggaggctaatgaagctgagctgggatgacacccgttttctactgcacaacctcctgtagggttagaacttcctagaaaaagctaggtgcaccaaaatctcacaagtcaccactaaagaacttattcatgtaaacggccgggcacgatggctcacgcctgtaatcccagcacttttggaggctgaggtgggtggatcacgaggtcaggagatcaagaccatcttggccaacatcgtgaaaccctgtctctactaaaatacaaaaaattagccaggtgtggtggtaggtgcctgtaatcccagctacttgggaggctgaggcaggggaattgcttgaacccaggaggcagaggttgcagtgacctgagaacacaccactgcactccagcctggcaagagagcaagacaccgtctcaaaaaacaaaaaaacttattcatgtaaccaaacaccacctgttccccaataacctacagaaataataaaaaaactttaattttgtaaaaattaaaaagaaaaagcatgcagtcactcatgcctttaatcctagcccttctggaggtgaggcaggaggattgcttgaggccaggagttcaagactagcctgggcaacacagtgagaccccatctctacaaaaaattttcagaagtggctgggcacagtggctcacttctgtaatcccagcactttgggaggctgaggtgggaggatcatgaggtcaagagattgagaccatcctggccaacatggtgaaaccctgtctccttaaaaatacaaaaattagctgggcgtgatggcgcgcgtctgtaatcccagctacttgggcagctgaggcaggagaatcgcttgaatctgggaggcagaggtcacagtgagcagagatcgcaccactgcactccagcctggtgacagagtgagactccttctcaaaaaataaaatagctgggtgtgatggtgagcgcctgtagtcccagcttctagggaggctgaggtgggaggatcacctgaacccaggaagtcgaggctacagtgagccttgatcgcgccactcaactctcgcctgggcgacagagcgagaccttgtctctgaaaaatgaaaagtaaaaggaaaaccccaattaatttaagaagatccaggacaggggctctgtgggtctccagggggacagcaaagtcaagacccctcggttccctactcctggaaaccatgttgaaaggagaatcagaaacaaactccctcggaagacaccaaagccacctggggtccccaactgtaacgcgtgaggggaaaggagggctgagcgacgtggtggaggcagaaggccatggaagggatgggagaggccggggcctagggcagtggggcacgctggaaacgcctcccaggcttataggagaggccgggcccagggcaacgctggaaacgcctcccagtcttacaggagagggcggggcctagggcaacgctggaaacgcctcccaggcttcctgcagccggtgggtagggtctgcggcttctgaaggaaaatgtactgcacccagaagtctttgcccagccccgctgccaccagcaggagcacaccaagacccttaacggacacacctctgatgctggagaactgccctgcctctctgaggttacgggagaatgtgccccacggaggagaccactggagggacaggatggctgagtgaactccacctccggggaacacaaagctccactgaaaaagaggaaagccacaggctctttcctaggaaggacctgccacagaccacgctgagggctgcaaatgacactgacccagcctcctgggatcctcggccaccatgatggcacccaaggcctgagagggagggcaggggaaggaccgggtctatcgacagggatgcgtggcccatgagagccaggcactgttacagcagccgctggggcgtggattttggcggggagggggcagggctgctgtggttggcttttagaccggggggggggggggtctcatctagggcaattctgcccccaggggactctgggcaacgtctggggacatctgcggttgtcaggactaggggtgctcctgaccctgggtggaggccagggacgttgctcagcacccagcagtgtccaggacggccccaccctagggaacggcccagcccgcatgtccgcagtgctcagggtagacgctttagagcatccccggtgaccatgtgtgtgcaaccacacggaggggggggaaacgtgattttaaaagcccatcaggttggaggggcacgaactgacgcacgggacaggtagcgccctgaagctgggctgcacggccttcaggccaggtggagcgagacttgctgtcaaacaggcagagccactgagagcactgaaacctgagcggaaagccccgtggctcccataaggccggcaccgccgagtcagcgttaacgggacgctgggtctggacgctgctggccctgcaccccagacagaggcccgccccactcatccctcccagggcctactgcccgctgctgccccctggtggctcggcccagaaggggaggccccagttggggaaaccgaggcctgcagagagcaccaggccccacagcaagtctgaggcttctgggtgaacactgtagcccccgcagctcccctggagcccaggcccatgcccgccgttacctggccccttgcccgaggcctccagcttgcggagcttggagatctcgtcctcggtgatggtggtcatgtcccgccagaagtcggcgttcttgccctgctccagctccatgtagacctgggggcagggggcaggggtcaggacacgggtgtggctggggtgggggtgagggtgcaggtcagaggagcatcgggtggggctgggtacctggatatcctccagcaggtcctccatgtcggccacggtgaggccgttgaggaacgtgtagggctcatgcatctccacggccagatcgtcatcctcagcgctgatgtacttggccagcaggtcgatgggcttggcccgcccgtcccggatgcggatcttggaactgtggggagcaggggaaggtggcatcagagcctgggctgtgccctccatgctaaagaccctgcccttggggtgaccacaccagtgggagccgaggaggggcctgacccgttgggggtggtcagggaaggcttcctggaggaggaggaggaggaggcataaggtagagtgagccgggtcagccaaagggcgcaggccagcagtgcagacaaagtgcaagcagcgtggacccggaggtgggccaggtgggaggggcttcctggagggcctctgggatgtgcccaggatggcggcttctatgtgggctgtgatggggaagagtggaggagctgaagcagaggcaggctgggggaccagagtagtcactgccttgcaaccacctcctcccccaggcagaccactcggggcagagagccgggtttctgttctgggcctgcaggggggtacgcgttgcaggcgggccctggtccaacccaagggaacccgtcaccagggaggcccgagctgggaggagcctgatgtcacccgccacggggcccaaggcaagcagggacaccccggagcctcagcttgtctgtaaaccaggcggatgggggtgccaccctcctgggtggagtgtgggagggacaactgcagtcagtgcaggactggcgtccagcatgcgtggggtgccgttcacctgggcccgtctcctctgcaccctgcccagcaggggagggcaggagacagaagccttgccgcccgggaaggggtcaggaagggaaggtcccaggaagtgccgtgtgggaccctgaagggtgggagagcagtggcttccagagtgacagccagtgcccggccctggctccaagtctgggtcggagggagggggaggccccagcgcaccgcagcttggcctgctggaggtggaagttgtcctcctgctcctcccatgtcttgaagtgctctgcctccttctcgcgctgcagcatctccagctcctgctcgcgcatggccttctcccgctcccgctccagccgcagctgcttcacctgcaggcacaggaggctgagggcagcggggaccgtgcggtctgcagggctgcggggggaggggctgtgatgatgggggcccagccttcacccagctgccctgggcacagggattggtccggagatgcctgggctggtggacagaccttgggaagggagagggccctcctgcccgagactcagcagctcagatcagctggggccctctcggccaccctgaagggagcatgtgggagtgaaggcccgaggccagcagagccgagaggtggagggaaacagtttcctggggccatggtctgagcccctggatccagccttacctgaagccagcccccaggacttcccacttaagcccctcaagtcctgccaaagggggcgggcctccaggccctggaaagggagggccctgcccagtgggctggcagggtgcctaccttctgcagctccagccggttgtcctcctggatcctcttgttccgctccttcagctccttctcctccaggtggctgatccccttcttctccagggcctggaagcaccaggcacacctgccctgagcacagacccgccccctcgcccccctcctcagctccttcgtccaagagattgaccagggcccttgttttgcagagagaggtgacctgccagcactgcacgtcttccaccccctccttaacactcctgaaacccagtgcatccaattcagtgcagacatggagcccccactgggagtgagatgtatgcaaagggtaagaaggggctaccccaactctcaacaggagggcctcactcggggccgccccaactcccaacaggagggccttgctcggggccaccccagcccccaacagaagagccttgctcggggcctgctgactcgctttacccgggagtctgagtgcttcggacgtgaaggccacgccctcagcaagtcagggtcccccactgcacgtgggacagggcaggaacagtgagtgggggcagcagcagctctgaaagcaaacctgtggggtcatggggccccgcccacacagcggggcacaggggtggccactgatgggcttgtcccagcctggagaccctcaaagctggcttcttccagcagctgtctgagagcctggcgcggagcccccacttcccgaccaccttcctcaggctcccggtgccccgtcgccatgagggggttccaggaacccctgccgcccagaacttgcctccagggacacaggctgcctggctggggaccacccccagacacccgggccactctgtggtctatccaacccagcctggggccgcttccacaggcgtcaacgatgaccacatcttcctcctccatggctgcccgcccagagctcacggtggtgcccagcacaccgcaggtgcacagcacatggtggcgatgaagtgccaggcagcagtgtgtgcctcaataaagaactctggggggtctggggagcaaggggccaggaaggggtctctcaagaggggatgtgtcagttgaggcctgacggaagagaacagccggggaaggggcagagcatgtccaggcaggggcgcggcagtgtgagggccccgaggcggaaggagctcgttgtgttctcagacgacatcgggcagaagccacctggagaccccacagctcccaactgcgcaaccggcgagcaggtgcagtcggcccagcccacacgttgcctgctccaccccctccacaagtggatgctgcttcagatgagctgtgtcccccacaggcacatccccgtctgaacccctgcagctgtaatcatgaccccatgtgaaatgaggtcttggccaggtatggtggctgacacctgtaatcccagcatattgggaggccaaggcgggcagatcacttgaggtcaggagttcgagaccagcctgaccaacatggttaaactctgtctactaaaaatacaaaaattagctgagtgtggtggcacccgcctgtaattccagctacttgggaggctggggcaggggaatcacttgaacccaggaagcggaggttgcagtgagccgagattgcgcctttgcattctagtctgggcaacagagtgagactccatctcaaaaaaaaaaaaaaaaaaaaagtgatgaggtcttgcagacgtaggtaagatgaggtcatcctggaggtggcgggccctcatccaatgcctggtgtcctcatgggaagaggaacatttacacacagacacacagagcagaaggccgtatggagacagagacgggaaggcagaccgccacacaacacaggaacaggccgggttctgcggctgcaagccagggagggcccaggaatcaccggccatgactggagctgggagaggcaggaggggcctcccctcggcccccagagggagtggggtcctgcccacacctgcccacgccttgattttggacttctggactccagaacgaagagatgataagttctgttgtcttatgccactggtgtgactggtggctaaatggcaggcgcagaacgaaagaaccagctcagacgacagagcgcctggaactgtggaaccctgtcctgggtacatgatgccaagagctggctctctagataggtttcaggttgggctggtgttcggggcaaagaatggctgaagcttacaccgcaagagacacagttaatggcaagaaaatgacggtgggctgggcgcagtggctcatgcctgtaatcccagaactctgggaggccgaggtgggaaaatcacttgagcttaggagttcgagaccagcctggccaacatagtgagactccatctttacaaaaaaataaaaaattagccgggcatggtggtggtgcctgtagtcccagcaagtcaaaacgctgaggtaggaggatcgcttgaggccaggaggtcaaggctgcagttagccacgatcacgccactgcactccagcctgggtgacagagcgagaccctgagtcaaaaaagaaagctggccgggcgtggtggctcacgcctgtaatcccagcactttgggaggccaaggcgggtggatcacaaggtcag

SEQ ID NO: 3687 - DNA, 1481 bp, Homo sapiens
acatttttggtccactgcttgggatccttcacctggtacagccttcgctctaggctgagtgagcagcctaggcagcctgacttaaggatgaatctgagccgccagtccctaacgaagcatctccaagaacccagttggggggaaagcatgaggagatgggtgaggagtgggcaagaatcaaaacaccacttggcaacaaagcccaagctctgcgtttagcgatgtaaaacctggattgacagatcactggaggatcactgccaccaaggtccctcggatgcagggctcgccacagtcctcctgtgctaggactttccgctcctccgacctggaggatcctccttgtcctcggactccaggcttccgctttcgtctcccgctgggctgcagcccgcccccgcccgccctgggcacagctgcgttactcacgtccttcttcacttcagtgaggtcctcctcggtgagggacggtgcggtgggctccatggtggaggcgggagatggcgcttcttccgggtccgggagctcgggctgcgccgccccgccctggctgggggcttcggcctccgggtaatggggaagaaggagaggaggcggagcgggtcgggagaaagacggccgccccttcgggaacagagggactcgggggtcaaaccgtagcgcttccggccccgcctctgaggtcgacggcgacgcgaatctacgcgacgcgacgcggagctcggagcagcgttccttccctctcgtagaggctcaggcgcaggcaccgccccacggcgaggcgcgtcgcttagcagagcccgccctgtctctgcggcagcctatcgacgccagcccgcgggccgatcctgttcccgcccccgaccggagcctttcgggtggctccgcccacagcgggcgtttcctcaagccacgcctgcgcaggtcgtcgggggagactgatgaagagacgactatccccagaccgtattttaactactatggcgctgtgtaagaagcaacctgagaagtgtggatgaaaagctacaggtagagccctgggcccaagacggtggcttggacaacatgctaaataaactataaactagatggtatttgaagctacgagagtagataaaaatgacaggaggaccaaggagaaacttgggaacgccaatgtttaagaaacgggaaagcaaaaaaaaaaaaaaacacacacaaaaaaacaatgtaaccagagccacaaaaaccagaatcacagcaagggattctgatgtttacattatgtcctgtttccatgttgacacattacacaaggacagtttttttctaattgcttaatttttcatcatcttccatccgatttactgaaccatccttaactttaggatgaatcctttcatttaacaaatgtgttttgaatgtccactatgtgccagacactgttctaggtgctaggaaaacagctgtgaacaaaaccaataaaaatctctttcctcatg

SEQ ID NO: 3688 - DNA, 560 bp, Homo sapiens
acaggaaattgacttaggcacaggaacttgctaatctcttttgtcacattcggattgctcctgctgccccacacacactaacccaaccatcttggggtggactccctgccagcccaactgttgtattttcagttcttccagtgtgaatcagttaatattctcgggaacgagggagaggttgatcctatgaggaaatcaaccacagtgaaaaggcttgggccgcttttgttttcacctgcttttgttgaacaaatttgatttccggagtcagtcattttactgtcaagacatttcttcggcattctgcaacagggatatttgcatttcaacaaagtaccaaacctcaagagaaagggctgctccaaggatggaagatatatttggtagggagaggactttttatcacccttgattcactccatgtatggagtgctttgtacaaggtacaaaacttctgtccttggtatgaacatttgggaggcaagtgagtgataatgacccacggctgcctttttgtccggcaaagcacgaggatgctttggagaacggaaggatttcat

SEQ ID NO: 3689 - DNA, 7359 bp, Homo sapiens
cgcaggggctcctgaggaaaattccaggcccagagggccaagctggtgaatcctacttagagaagaaataataggaatccagccactcagacgatggacgaggaggggcacttccctgctcgatgtatgggccagcattgccttgatagcaaagtcagacatcaccagacagtagaaccacagaccaatgtctttcatgaaccaagacacagcatttaaaaaaattagcaaatggaatttatatctgcctattgtttacaaaaaaagccaaactttgtaaaatacttgaagagatttattctgagccaaatatgacccatgacacagcctcaggacgtcctgagaacttggcccaaggcggttgttttactgcttggttttattcatttcagggagacataagacatcagtcagtacatgtgaggtgtgcattggattgatccagaaagtcaggacgactccaagtggaaaggcctccagagacaggagacagtaaaagaaatggcctctctcctctgtcagagtggagtcccgagctcccagaaatgccacatgatggacaaacgcttgggggaaaaaaaaaaaaaaggagacctcagtcggacacaaaagcaggagctttaaaagaaaaaataagagataagttgaacttcaccaaaaaataagcgtttctggtctttgaaagacacttaaaatgaaaaggcaagccatcgatggggaaaatactcagaataatggatctgacagagggctgtatctagaatatatgaagatattttaaaatccagtaatttgacataaagatggtagccagcctgacacacaaaggaacccgaatggccaatggacaggaagggaacccgtatggccgatggacagaaagggaagtgaacgtgaacatctcattggggatgccgttatcaccactggaatagtcaaaaacatggacaccaagtattggtgggtgagtggaatggcgggaacccacatacacggtcgatgggagctgcaccctttggaaatcatttcacagtttgtgctccatcctggccaaacccacagctggagtctttccaaaaacagtgacgggagtttccaccagggagtgcctcaaaccatcccgagatggggctggttgggattccagggagaggcactcgttgccagggtgatccgtccagagcacttcctaggggatctggcataaggagggctgcagtgtatcctcaggacagataggacagatagtgtatctttgggacagacggcaagatggggattccacccaggtctgtctgcagcgagttgatatgagagtttaaggaatttggaccagggctgctttgtttcagggttttgggcaatgacctaaacacctttatcagtgcctgggaatgctcaaggcccagcttgagttcaggcctgcagggaaaacctgcaactggccgggctgcagagtggtcagggcacggaaagccagaagctggggacacacctgctgtatgatccagccgttcgtctttacctgggagaaatggcaccacctggctgaacataacttcttacactcccatgagtcctcctggacaggtgctgtgacctcgtgcagccttggggaccctgacactcccacggacaggccaaggggtttgcctgggccctgtgggcacagagccccttgagatgggtttccctatgcagccccccaccccccaccggggacccatggcactgcagccctcaccccccctctagggacccacaacactgcagccctcgcccccctccggggtcccacagcactgcagccctcgccccccatcggggacccacagcactgcagccacgcccaggccaccgcctccaaacacagggccgctgctgtttctgtgaacagatacttcttgcagatgtcaatggttaatggatggggaggtgaccgcccaagcagaagccgaccctcttcatgaaggggccacaggtcaccccgaagcagaaatccatagaacagccaaggccacagcggaaccgagcaggccacgcctctgcctctgggccgctcagggccaggcctccctgaccccactggctctattgtgaggactcagggtggagctctgctgggctcagtggccttcacagccggggtccacagacccgggtcctacgggcagtactgtgctcacctagaggccacggtccatgccctgtctccagcaggcccaagtcacttgtccatggcgaaggcccggccttgcttcaggccccgggcgcgctccccctgctccccctgcccaccgtttcttcccaggtgacagaggcgggagagcaggcgagccacgtgccgggcgccgcagcagggggcactccaggctggcgcccctctgcctctccgtgggctctgacctttcttctccctgcctgggcagcctccttcaggttggggagtcttttgttgacccctggattaaagtcctaatcaggaatgacccggaagaggtcttatgaggctttcctcaagagaagaaaatctgtccctgagtatcaggaagtggcccctttccctgcaccgcagtcttctgtgaccagcggctcacacagcgaaggaggggctggcggcccccacaggccactgccccgaggccgccacgagagggcaggagagcccttcctgggagctctgtgccacggggaaacgcagccccgccaagcacagcatggatgtttccagcagggaatgaagagagaggccccagcacatgagagaagagcacactgggcggcccctgtcggagcctctcctgtccccagcgacccctgagagcaggccctgggcctctgcggcccctcccggagccactcttcaactgctgacctgctcccagctcttctgtgccccgcccagctccctgcaaaacctcacctgaggggaaggaggccctgtttgggctcagacgcagcaggtgcagcttgtggtcctggggccacacctgttagagcccatccttctacccctgctgggccctgagtgtcgtccgtccccacagaactcagcagggtcaggtctgggcactccaggccgccagccccctgagtgagccctgggccggaggtagttgtgggtcacaggcaccccagccagaacacccacagtgggtagatgtgtggggaccggatgtgggtcctctcctgagagacgtgcagatggggagaggctgggcagttctcagcacagctggagcatctacctgtcaccacctcggagcctcctggccccgtgggggcggccctgggagcagggtcggcagtgaagagcagagaaaggcagttggggatgttgccactgtcccccgagaccaccctgccatggagacgagggagctgtcccttcgcggaagggggctggccagcaagaaggacagagagtggactggccgaggaccgctgagctcaggacccaaggaggactcttctaggagacgagagagcgaacgccagggaccctgtgcaggcctgctcctccgtttgcaaggtgagttaccaggttcacgtgtttggagtttctggactcattgcggagttccacccctgcacgttgcggttccccagtaatcaaatcctggcttttgtgcctggaagtgcacagggaggggacaactttgtgagtcagtggcagggcagggagttctggttctccagagccagaggccgtgctcagaaggatttcttagcaggagccttggggcccccagtcaacacttccctacggacagcctggccagctctgtgcacggagcaggcgcccgagggtcccaggtcaccaagtgaccaagtcgtgaaggcgcccagggtttcctgggggtgcgctgatcccaaggaagccacgtgtggtcagcatgggggaggggaccagcgccccggggggcctgcagcacagcagggcctgccctcctgggtgagactggccggtgcctgtggggatctggggggctacagtcagggctctgtgctcccgagggccacgccagcccacctgccctggaacagaacccgaggcttctgcctaggggagtacctgggcacctgcctcctgtgctgccctggacacatcccagcggctgcacataggggaggcacagcctgggctcagggccagggtccactctgtggggatactagacccgggggtgacaatgccagctcagaacttccccccacacctgggctcctccagcctggcctttcctggggaagggagggcctgtccttcctcagcactgtgggagggaggcaaggcctgcggttgaagcgtccccaacacggggctccaggagagaaagcaccacatctcagggaatgaaaacagagacggggccgcccagtgcactcggtggctcggaaatcattaaagaatgttctgagcccccgattttggctgtaaaagggactggccggcttgtgaccgctcccctgtctgtgccttgagacgggagtgttcagcgttgggggcagctttccctccaagaggagcttcacaaacatccgctctctgcggggccgcctctccgtggcctggggccgctgtcggaggaaggctctccagctgccgtcatctgggaaacgtggggggcgagcaggggtcatggatggggctcactggggactgtgagaatctgtcccgcaggactttctgggatggaaacgctggcagaggtgaagcctgcgtcatgtgcttcactgaacccggctgcttatttatgttcggagggctggtttcaaggactcctcgtctccctctccagtgatagcgtcagcggaaatgcagacggggacggggctgctgggtttcctccctggaatgaagcacagccggaggttttgctgattcaccagcaggccctgaccgctgagttcagggtaacaaatccacatggatcctgagcccgcatagctccctgggcctcagcataaacatcgtaaacctccgggccctggcagtgtctgtttcatcccctccagagcaagtgcaagtgtgagatttagagattctaagaggggaagggccagaggtcttgaaaacgaccttcattcgttcattcattcgagaagtttgcgagggcctccgtgtcctgcgtttagtggggcctaggacgcagatgtgaagggcgctgctctcaggagcagacagaggtggggatgaatcagtacacgcccacctcgggcccacaggggaggatgcgcggagctgtgggtgtggggaggagacccctctgcgtcatgctgacggtgtcggcagagtcgccagcttctgcaggagcggtacctgtgggttcttctgtgacttgtttaaccgcatcttttgcccagtagttagtcttttcctgttgggacaccatgttggtagtttggaaatggtttcttccatccattgcctgccttttagctttgtcgatggtgttctgttgtaaattttggtgcacgtttaatgtgaacaatggttatgagacgagtgccatgagttcctgtgtgcctgtcacccagcccggccacaagaggtgctgggggcagtgtccacacccccctttcttaggacgcctgagtctcagatgtgacttatagggtatttcttatggcaagacggttaaaacaaacttcagcgtctcgtctgtccttctatggctgtggcttctgatgttctaatggcgttctcgtcagccggggctgagaacaaaataacatagactgtggggcttaaacagcagaaacttacttcccacggttctggaggttgggagtcttggatcaccgtgtagcatggtcaggttcctggtgagggtgggattcctggctaacgtaacgaaggctccctctcctgataccgtgtcactgggggtgaggcttcaacacaggaattttggggggacacatcagcattcactccatcacaggtggttagccctttaatccgcgggaattttgtttggggttgtgtgagatacgggtctaacgttttctttttcaaatacgtagccagttgtcacatcatttattgaaaaaggaatcttttctccaccgactgacatgaaatgctaccatcatcgtaaataaaattcccgtaaatacttgctgtctctgctgtctcagtcctgactcacgggctgagttctctttctgcacagtagcactggcattaactgtgacagctttacagcaggctccctccccgaggccgttcagaagcattcctcagcgggtcctacacgtttcctctcccatgtcaagtttagaagcagtgtcaagacccacagcagtcctgcgggagttttaagggatgcacggagtttatggggacagtttggaaaattgacattcatgtgacttagagtcctactacttgaaaatggattccagctctcaacgaatttagagctttggcaaaatttttaagatttctttgatgtccgatgtgctcatttcttggtttgttcttgagtattttgtggatttttatgaaatccacaaagtttttgttataatgaatgggacactttcccataaaatgttgtaattctgtattgctgttttagtaaacactgttgattgatgtatattgatgttacacttggtcacttgtaatagtttgtccgttcattattttgaactttttaggtaaacagtcatataattatgcaaataattatagttgtgtctctgcctttctaatatttatactttgtgtatattatcatgttggccaggactcaagcgtctttctcttgtttctgactaatgcgaatgattctaatgcaggggtttccaaactggtggccggggggccaaatccagccaatggtctcttcttgtaaataaagttttattggaacacagttacacacatttttctacatattgtctgatggctactgtcacgccacagcaatgctgttaaatagtccagacagaggcggtattgcccgaaaaacctagaatattcaccatctgagcttttacgggaaaatttgctaatatctgttctcatgcattaaatacaatgtttgttacaggttaaggaagtttctgactatttttagctttctgaatatcttgtggttgtgtgtgctttaaaattaggactaaatattaaatttaccagttgcttgttaggggcctatcttttgagatgcccaaagtttcccttttttagtctcttcatgtagtgagttgtactaacagattctctaatgttgaaccgtctttgctttccggagatagactttacttgctcctggtggattggattctgtttgttaatacttttatttttgggtaattacatccctattataaataatatgtcag

SEQ ID NO: 3690 - DNA, 10494 bp, Homo sapiens
acccggctcaccgttccaggccgccgagcgccctcggccaaggcccgcccgccgggagcgcccacgccggggagtgcccgagtgcggcgcggctccacctctgcgttttctgaagacccgggactagaggcttctcggtttcctcgttgaggacttggagatagcactacctcatctgtaaaatgggtcttctctcctgtctggtggtcgcagagatcacctcgcaaggacgtcaagagccagcgaaggctctgctggcccgaaacagctgtgcaaacctcagaatcacgctcttgaatgggacggtcgccgccccccgcagccccagggcgaggtgcccccggtctgtaggacgtgaaattctaactctctgccctgggaaagccccctgccgacctctccccacggccccacccggggccccgcacgtctacccgccgcgcacgggccaccgcgcgttcccgcctgaagttttcgtacgcgctgttcctttcgcgtagccaaattccaccgacctcgaggaaatgccaccttctccaggggccttcccagaccccctcccctgcccgcggtcgacggccgccctgtgattactgggggtgcggtgggagtcactggactcgctgccgatcctaggagcccagcacggcgccgcacgcggtgggcccaaagcccgaccgtgggggacctcaaaccagaggccctcaaggcccgttccacccggcctgtggcgcagtgctgggcacttgggaacggaggtccctgtcttctcgctgcaagcccctccgtggtgcgcgccgtgggtctgcgggttggtctttttcctcgtttatgaagttcttttcactcgtcgttactattttgtaagttcaccatttaaaaattaataatgccaagcccgacaaacacccctcggcacttcctcccctccccctctcccgcgggcctccgtggcggggcggggcgggcgcgtcctgtcccgtccggccgccgggtgcgacgcggcgcacgtccgccaggccctgccgagggggagccggggaggggaggccccgcgcgggggccgggaggggaagggaggggagcggcgtctgccagaaggcgcggcggcttcgtgcgctgaggctgggagtaggggcgggaggggactgtcggggactgataccccggtccccgggctggatccctcggccctcctcctgctcctgggtagcccacggggcggccaccattgcgcttcatcaccgtgatcgccacacgctgctggcgttttcctaggcctgctctggctgcgccccctaatctcatttaccccttagaacggcctccttcttaacccatttcacagatgaggaaactgagtttcaagaaaggaagcgacgtgcttcgggtctaccggcaagggcaaaggcgggattccagcctgggagcgggacatctgtctcccctgcggtccggccccctgggtggggcctcggctttatctccggatgcggggccctcatgaccccaaaaggaagcgtgtggcgagggactgagtggagtcgtggcctcgcccttggcctgggttgggtggcgcgctttcctctccctctgtgaagggggctggtacctggccggctgtccccacacccaccattcccagacgcgccatcctgagctcacaggattcctcaggaatcccccacctcctccaccccatcttatcgccacttcaagccgttgcccgtgcagttcttttcccagggagacctaactcctcctcccaggctcccaaagcggcagaggtagccgcgccttctgcctggagccctggacttatctccccacgcctggggcgggtagttagttacggagtgagcgagaggccaggattgcgtggggggaggggggtccttcgagtgtcctcactgtaggggttgtctacacccagctgccctctgtctctacaggtggaggtcgctttatgcactctattttttgtctgttttatcattcgcaccccaggaaaaataaaatcatgggggccacaagtcagaaacggggaggggcaggaacgggattcagcaaggtgctgtctggcacctgtggatttggaagcgtctcttccaacacagtccctcagtttccccatctgccaaacagggctggtaaaagcccaacccagggggaggcggggagccgtgcacaaagtcggggtgcattcagcaggctcttggggagtgccaagtgcgaccacgccctccctgggaggcctaaagggagcttccagaagagcaactctgcacccctcttcctggagggtcgatttgaggccaggctggaagaaccagagctactatggggggaatgggggcagctctaagtagacgccttccagtgtccaaatgactgaccttggcgcgacctcatcactagccctttgcccaggtcctgggtagccctttagccgggtctccgtgtcttcttgaccaacctgcccattactctgccgtcccccgtcctgccccacaagatctaagacgtccccagaaagcttcaggtcttggcagatgtgcacacacgtgcccccatgctcctggcactctcattcctcctgggctgtcctgtcaacactcccccctaccgccgacccccccttcagcaagattcagtccccttccctggctggcgtcacgggcagcgcccttcaccgcatcctgccacagggacttgtttgcacagctgtctcccgccgctggagtgtggggtccttgagaactgacatctttaattcgggactttgccgccctccccaacttgtaacacagagcctggcagaggactggcactcaatgccaagaggggtgtgtagggggtacaacgggggcacttccaggaggctaaaggatctgggagatgcctttcttcgctaaacgtcccccatccatctcctccttcagctggcatggacccatcttctccagtgccaaacccagaggaggcgggcggccctcttgcccaggtaccctctgcagcgcttgcccaggtcgcaccagaccggtcccatctcttctctccttgagggacccactcgcatcgttgcccttttaagaaagaggaaattcttctcataaacaagcgtccggacctgagcgcggagccaggccgcctgccctgctgggtccccaggaaatcgggggttcttccaggtgcaacacccggcccaggttcaactctagggaaaggcctgttggcctctcctcgctgcggccctccgcaggtcctgggctggggtctgagggacccgacgaggctggaggagggacttgggggagcctagaaacagcctagggaacgtctataaagtgcagcccctgaatggggcgaatgggtgcccagccgctccctaaggcagagggggctccccgcccacacagcttcctcccacccactctccccgaaggattctggggcccctggcgcgagccccgagcgcccgcctccccgcgtcgttccgcctggcggggaggggtgaggccggggcgggatggcgggcgtcgggaccgtctctgcccctagggggagcagtcagcagagagggagcggtaacggcgcggcgtgggagtcgcggccgccggctcccctgaggaaacagcaaataatttgggcctcagaggcacagactcttgggttccttatgacctggtgcctgacggagaaagaagtgcgccgccgttttactgtctggaaaatgggttgcaggcggaacagaaaggctgcggcgaataggagcggaccagaccctggtgtaggggtcttctggatgctttagagacttcgtgccttcccggttcccattccctgctcctttggacgagaagggaactagtatttatttaactttaatcaggccgggtttggtggctcacgcctgtaattcccagcactttgggagacggagatgggcggatcacttgaatccagcagttcgagaccagcctggccagcatggcaaaccccgtctctgctgaaaatacacaaattagctgggcgtggtggcgcgcgccactcccggggctgaataaagagaatcgcttgaacccagaaggtggaggttgcaatgagttaagattgcgccactgcactccagccttggcaacagagggagaccctttccctgtctcaaataaataaataaatagatagatagataatttaacattcatcagacactatttcaagctccagtttggagcctgtgtcccgcccaagtcctcaagccctcaccccacccacccttgggctgtcaggtcacgcctgcaggtgctcaataaataccttttgaaatgtttttcgtttgtttgtttttgtcccaagtgccagacactgtgttaaagtgcttaacctccatggcaagggtggtggtgtctccattttacagatgaggacactgagacccagagggtaatcacatggctgcgctaggaaacagcaggtccctaaagcccccaggttggctggtctcaggaactgtcccactctatcctgctgcctgcacgcgccccctccacatccagcaggccagtcacgtcatacatgccactcccagccaggccctggtgtgggcctagccagaggtggctccgtgggcaaggcaacaggtccagacctgggggaggggcaaccatgaattggggagatgccaagacctctggggaagccccattgtgtccccccaaaccctccccattggttgcctcttgtccttccctcatccattcccaaggcatcccctggccctactgtaccaggtaggtgctgaggcccaggtaggctgcggccagcaaggctgcaaggccgaagtaggcagggtggggcaggctgggcagatagctgaccacgaagtagaggttgatggcgcagactagcaccatgatggaagaggtgacgaccttgttcagcctgggggacacgagagaggctcaggactggctggttgctgctggcccacctgcatcaactcctcttcatctcccagcgcccacactgggggtggggatacactgaggccgcttctctggtctgtgggacctggagcagacagaccccctccccacctcctgcctcctgggccctccaggctacacactggcgggatttggcaagagctgagtctgaggcgagagtgaggcgctcaggctctagaaacagccctcttccctggattccagtcttggctcctcaacttgctagctgtgtgaacctggagacagagtctcactctgttgcccaggctggagtgcagtaacaagatcataacttactgtacccttggacttcaagactcaaggtatcctatctcctcagcatcctgagcagctgggactacaggtcctccccccagccccgcatccaacccagccttgtaggtgtctggtcataccgtccactagagagcaaagcgtctctggagtctgcagcagcaggtctgacgaacgaacaagggaaggagagagcctgcaccgccaccactccctcaggggagcttgcctaaagtttgctactgagcatccggacagaagccactggccagcactgacgttccacgaggagcccagaggatgcgacgatcatctgcccattatttttactctcggaccccccacctccggagtctgggggtccctctgtgtcagtgggaaccgggaggagctcgagcctgagtgctagctgcgtttgcgagatttcagggggtttgagctaagccagaggtggtccacgtcggccctcctccctccccaaccccccgccgcttgttatttttctttgggcggttggttgggcaattatgctctgcgaccgtaagatctgagtgccaaggcgcccgcccctccgtgctaacctagtaagagtgtgggctttttcttttttttcttttcttttcttttttttttttttgagacggagtctcgctctgtcgcccaggctggagtgcaatggcgccatctcggctcactgcaacctccgcctccggggttcaagcgatcctcctgcctcagcctcctaactgggattacaggcgcgcgccaccatgcccggctattttttgtatttttagtaaagatggggtttcaccgtgttggccaggctggtctcgatctcctgacctggtgatccgcccgcctcggcctcccaaagtgccgacaatacaggtttaagccaccgcgcccggccgagtgtgggctttcaagtccaacgttgaggttcaaattctgcctccccacctgccaactccaaaagttaaactttctgtgcctctgtgttcttatctgtagaatggggataatgatgaaaacagcatctaggaggaaaggctgaaatctactcgaggtacgacggtaacggttcctatttctagcccgagacactagacgctagccagggacgctgtcgacgggcgctgcagagaagcgggagggccccatttattcccccaaaaccgcagcccggaaagcgcacccgccccggcgcgtcccgcccgcgtcccagcccgacccctggtttcctgccctgtccgggcctgggccccgcttaggccgcccccgagcgggcgtctccctccggctccagggagcggaaagggttgggccggtgggaggagcccaaggccggtgacgacggacgccacgggtcgaaggggccgaagaactcggcggcgaaggtgaccacgtcctccggctggcgcagcagcaggaagagcaggaagtcggagatgagcgcgtgggcttcggggtgctgccgcagatagctggcgtggccgagccggagctcctcctggcaggggacagagcccgagcctcagccggacgggacccccgcgccccaggagcccccagccgctcgctccaaggagagctaaggggcgctggagccttctagcccctacgggtgtgcatttcaatcaggtgcagagatcagtaatgaatttaaggcccatgggggaatgggaaccccaggctggtggagcctcccctcaccttccggtccaggaacttcgaatagagctccatatcctcctcccataccaggggcttcttctcaaacactgggcgtggctcaatctcatctaggtggggaacaaggaaggctgggcgtccctaccccggaaccttccttggatacacagcgagatcccgagaacacccaaacagaaggctcaggtgaaaccccaggattctgcccacatgggcagagttgcaggaagggacttccagtaggaaagatcctcctcttattgcttggggtcaggggctggagggcagatgttctccagctgattccaggctcctgtcccgtttacagcacactgggtccagccccctgcatcctggaaggcccaggtttccccactccccttaactctccctgcctgcacaaggcctgggcttcactcaccctcttccctcaagatgggcatcttggtgatgatgcagcaccctggggagcccacctgtattctcttggccaggtgcctggagtgcaacacaacatgtgagagtgagaatcttcccagaccgcctgctatggactgaattgtctctctaacccccagtgtggtggtatttggaggccatgtgaggacacattgagaaggcacttgtctgcaagctaggaagacagccctcaccagaaaccaaccctgatggcaccatgatcttggacttcctgccttccagcaaatatatttctcttgaagccacccagcctgtggtgttttgttatggcagcctaagcagactcctacatgacagtgccccttgagagacctgtcccgggcctctttacttctgcctccctctcttgtttattaagttcctgggtggtgttcatttctggatctccaaataacgcacagggcttggcaagtattaggccccctgtttaaaaaaaacaaaaaggatctttagaggtacagcactcgaaaatcatggagcctcttggccaggcacggtggctcacgcctgtaatcctagcactttgggaggctgagatgggtggatcacttgaggtcaggagtttgagaccagcctggccaacatagtgaaacgccgtctctactaaaaatacaaaaaactagccagacgtggtggtgggcgcctgtaatcccagctattttggtggctgtggcatgagaatcacttgaacctgggaggtggaggttgtagtgagccaagattgcatccctgtactccagtctgggtaacagagcgagactgtctcaaaaagagaaagaggcctgtcgcagtggctcacacttgtagtggctcacgcctgttatcccagcactttaggaggccaagatgggcagatcacttcaggtcaggtgtttgagaccagcctggccaacatggtgaaagcctgtttctactaaaaatacaaaaattagccaggcgtggtggcaggcacctgtagtcccggctacttgggaggctgaagcaagggaatcacttgaacctgggaggcggaggttgcagttagccaagattatgccacacattccagtctaggtgacagagcgagactctgtcaagaaagagacagagagagagaaagagagaaagaggaaggaaggaaggagaaagaaagaaaagaaaaattatggaatctcctgctatgcggcattcaaaataaaaaggttggcctggagctgtggtgcatacctgtagtcccagctactaggaaggctgaagcaggtggattgcttgagcccaggagttggaggctgcagtgggctatgatcgcaccaaaaccgaaaacatactaagttatgagataaagccaacaatgttttgattaccttttccccagtgtagtgattatgtgaatatctattctgaaattttaagaaataaactcgactggagtctgtctcaaaaaaacaaaacaaaacaaaaaaacagaaagaaactctttcttccacctgaattttctttttctttcttttttttttttgagacggagtcttgctgtcacccaggctggagtgcagtggcgcgatctcggctcactgcaagctctgcctcctgggttcacgccatcctcctgcctcagcctccagagtagctgggactacaggcgcccacgaccacacttggctaattttttgtatttttagtagagatggggtttcaccgtgtcagccaggatggtctcaatttcctgacctcatgatccgcccgcctcagcctcccaaagtgctgggattacaggtgtgagccaccacgcccagccctgaattttcttatgatttggagccagtgctttgctggagactgcacggcagcctgccacaggcaattcttccagcacagtgatttcatcaagtgtgcagtcattcagaccttggtgtttttcagtattatcccttacacagtggtggctgcactagctacaccccaggcctgtggtgtgcagtgagaaggtttgggaggcactgtgagggttaagaggacgagcaaataaatgaagaaagagtgaatgatatggataaagcggagggacactcctatctcaatgccagttcttcctggtgctatccccagaagcagccggtctccttgagcacctacaagctcagcaccacccctctgggcccaccatcagcagctcacccatcggagagcaggtagtactggcaggacatggggatgccctcctccgcgtggacagtctgctccacgatgaagacttcagcctgctgatggtctacctggatggtctggaagcccaggttttgctggcaacagccaaaattggggggtgggaggtaaggtggatgcccgccaagggctccccatcatcttaccttagccttttctccatctcataacaacctcaagacatttaatattgcatctccaaacctccaagctgagttggcgacccctcatagggagctagctccaggttgcccttgccctgacccctcccatgtcatctcgctgaccaggtgcttctagttggcaaattctgttacagggatgagaagcggtatgcgggggggtgtgggagcggagaggtaggatgagctactagggccagtgggtggaggtaaagtgaggctcagaggtgtgagaccagacagatttgtggccacctcagacctgtgctgttgctggcaggctgtccctgttgtgattaaaacttaaacccctgttgtagctgcagctatggagaaaaaagtgctaatgttaaacacatgtttcaaagaacacggaggggaatggattgtgcttgttcatgtcaaatgcattgctgcttggtgtgttttgatagacaagcctggaatgtaatttacaaagatggtcaaagaaacacaaatcagcccccaaagtgtctcactggaaattgtgtgttcagtggcatggctttaaaatcactgattgcaggaagtcctaggcatgctgattatgaaattttagttaaaaacaaaaaacaaaacaaaaacggaac

SEQ ID NO: 3691 - DNA, 35034 bp, Homo sapiens
gggctgctgctgccgaggtcgtgtgcgacgtgccgctcccgggccctgtgtccccagccccagcagggccgcgtggacggcgcggcgcccccggaaggaggccatgtgctcagtgccggcgccaactacgcacgcggcgccctccggcccgctagatccgaagcccatccccactgcggccagcggcccggcggggcgctgcgctcgggacccgcaccgagccaggctcggagaggcgcgcggcccgccccgggcgcacagcgcagcggggcggcgggggaggccctggccggcgtaaggcgggcaggagtctgcgcctttgttcctggcgggagggcccgcgggcgcgcgactcaccttgctgctgggctccatggcagcgctgcgctggtggctctggctgcgccgggtacgcgggtggcgacgggcgtgcgagcggcgctctcccgctcaggctcgtgctccggtccggggactcccactgcgactctgactccgacccccgtcgtttggtctcctgctccctggcgtgctcactcggggacccgcgactagcgaccggcacgctcgctgttgctacctcttgcctcttgccagagagcgcgcggaccgtagcgtttataggaccccggccattggctggcgacgccggtgtgtcaggggtgtgtgggcaggacctcggggcggggcctggggcccagcctgtcctgggcggcgctctgcggggagggggtgaggggagtggccggggccggggccccccctaaccactgcctcgctcaggctgccgatcggctcgttctctctgcgttgggaccgcggagggcattcgctgtgtgactcagggcaagtgtgcgcacctctctgagcctccgcggccttctctagcaaaatggtggagccggtacccggctgtaaggcaagctgggatgcgcggagtagcgggtggaaagctggactggagttctcactcggccgctgggtgacttcggtgcactagggatagtaacagtaccacctcgtagggttgtagaaagaccaagtgagttaatatttgtaaagtgtttagaacagcgtctactgcatggaaagtagtatttatttgttagagagactccaggaggtcttgcccagggattgacttctcccttccctgtctccaccccccacattcccgtttgtgagccaagccttgcttttgcaccggccgggctctcttgcctggaaatgcatacccatctcaaacctgggctttaaaatcacctcctctgggacgccttcctctacttctcacagttcaggcctgttctgccccacacagcagaaaatgcccacgatgcaataccagagtctgcatgggaccatttcaacaacccttagaagctgactcagctgtctcctggccctgacttttctaagatgagaggagctggtaggaacaatttgggtgagatgtttgtcctgagtccatttggttatggtcaggtgatacggtcacagagcacaaacaaggctggcagagccccactctgtgtgaggatggggtggaggaagcatgtgttcctcctgatgttgtcacacaggcacacatgcattcattaaaaatgtttttgggccaggcgcagtggctcacgcctgtaatcccagcactttgggaggctgaggtgggtggatcacctgaggtcgggagtttgagaccagcctgaccaatatggagaaaccccgtctctactaaaaatacaaaattagccgggcgtggtggcacatgcctgtaatcccagctactcgggaggctgaggcaggcgagttgcttgaacccaggaggtggagggtgcagtgagccgagattatgccattgcactccagcctgggcaacaagagcaaaactgcatcttaaaaaatatatagtaatagtaataataaaacagttcctacctcccagggatacagtgtgtgttaactaagacatttattcacttattccataaatacttattaagtacctagtacgtgatggtatttgtggaagctgcacaatgactggccagtggtggaggctcagtaagttggagtcacttaaagctctgccttccaggtgtgcacaactaagttgatgctccacacaggtgcttctgctcttgtggtctgtgtgcattctgaaaatctaggaatgcaaacaaggtgccacagctatctattgctgtagattatccatgtcaggccgggtggggtggctcatgcttgtaatcccagcactttgggaggtcgaggcgggtggatcacctgaggccaggagttcaagaccagcctggccaacatagcgaaaccctgtctctactaaaaatacaaaaaggggccccgctcagtggcttacgcttgtaatcccagcactgtgggaggccaaggtgggcatatcacgaggtcaagagatcaagaccatcctggccaatgtggtaaaaccccgtccctactaaaaatacaaaaatttagctgggtgttgtggtgcgcacctgtaattccggctactcgggaggctgaggcaggagaatcgcttgaacccaggaggcggaggttgcagtgagccgagatcgcgccactgcactccagcctggtgacagagcccctactcacccccacaaaaaaaaaaaaaaacaaatgagctgggtgtgatggcacatacctgtaatcgcagctatgtgggaggctgatgcacaagaattgtttgaacccaggaggtagaagttgcagtgagccaagatcgtgccactgcactccagcctgggtgacagagtgagactctatctcaaaaaaaaaaaaaaaaaaaagaaagaaaaaagaaaaaaagagtaaccatctcaaaacttagtggatttaaacagcaacagcttattatttctcatgattttgtggactgactgggcagttctgccccacatgatggcagctggggtgactcatgcggcagcattcagctggacacatggctgggccattctctccatatggtgttgcatcctcctctgtctcctgaaggatagcttggacttccttatagcgtggtggctgggttccaatggggagcgttccaaggggacaatcctcatgtggaaaagcttatcaagcctagttatatcaatgcaaatcattctggatttaagttgctttgtctcttgattgctcatgaacattcctatgtgagtaaatattcttcccaatgtgatttttttcttgttgttaaagacaggctctggttttatcgcccaggctggagtgcagtgacataatcatagtataagcatagctcactgcagccttgaactccagggctcaaacaatccttctgcctcagcctcccatgtagctgggactacaggtgcgcactaccatgcctagctaatctttttttttttttttttaaagagatagagtctcgttgtattgcctaggctggtctccaactcctgggctcaagtgatcctttcacctcagcctccctagtacctgggaccacagccatgtgccaatacactaatttaaaaaaattttttttgagagatgggagtcttgctgtgttgcccaggctggtctcaaactcctggcctgaagtgatccaccttcctcagcctcccaaagtcctaggattacaggtgtgagccactgcactctgcccccaacatgattttttttttttttttgagactgagtttcactgttgttgcccaggctggagtgcaatggtgtgatcttggctcaccgaaacctctgccttctggattccagcgattctcctgcctcagcctcccaagtagctgggattacaggcatgcgccaccacacccggctaattttgtatttttaatagagatggggtttctgcatgttggtcaaggtagtctcgaactctggacctcaggtgatctgcccgccttggcctcccaaagtgctgggattacaggtgtgagccacggtgcgcagccccaacatgattttgaatggctgactgatagaccatcattgattgaaccaatctcctcttgatgagtaattaggcagttttcatttggaggcagttataaacaactctatgaaggacagctttgtgccaagaactcagtacatatcgttgtagtagaaggattacagggccaaaggacaggtgaatttttaaagctttgccaaatttcccttcagaaaaaatggtacattttgcacttttatcggctgtaaagagacctgctctttcgaagtcttctggtcaatactgggtgtggtttgtcttttcagtctttgtcaatcgaaaaatggtgttttatcattgtcttcaaaagagagaagattagaagtaagttacccagagccagatgcttaagaagagttctcgtcttttactctgaggtagcccgaataaatcagcagggtcgaggccggggcaatgcaaagtgtctctctgcacaatgtcaggctattaaatgcacagtgtccctctgcccgctgactcaggctgtaaaattggagcatggtgctgacaacagtgctcatggctgtggggatgaggtcactgtgtcctcactgtgcggtcgactgggacaagcccatggctttcctgtcccatgtctgtgggccttccggcagacacagggctcgtggcctcaccctccacgcccgtgttggctttcaccttgttccctctgacccagtctggaggacctggtgctgcatctgggccaagctggctgtaactaataagagttgtaacaagggacatctaaaacaggaccctgagattggtctttgtttttgagcagccaaagccatacctcatagtgtcagaagttttaaaactgggggatccttcttgtgtggaagcagagctcctggactcagagccgaccctgcttcttcctagctgtggagcaagtaggggagcttttccaaacctcaatttcttcatctagagaatgagggtaatggtgatttaaggactattatcttcttcctctgtgcctgatacttgtgattctcacaggaaccctcaaaggctgagagtatcccacccacttcacagatgaagcaaactgaggcccagagaagggaaattacttgcccaagatcacccagcaagtaagaaacagagctggagatgagctcaggccagcacggaaccacgcaaactccttctgtaggctttgtaaaggattgatgagaaaagcagatggttaagagctctacaacttctgtgaggtaaagaatatctgcagggctggacgtggcggctcttgcctgtaatcttagcactttgggaggccaaagtgggtggattgcttgagtctatgagttcaagaccagcctgggcaacatggtaaaactctgtctctctaaaaaaaaaaaaaaaaaaaaattagctgagtgtggtgttgtgtgcttgtagtcccagctactttggaggctgaagcggaaggatcccttggcccaggaggcagaggttgcagtgagctgagattgtgccactgcacttcagcttgggtgacagagccagaccttatttaaaaaaaaaaaaaggatatctgtgattacaagattaccatgcaattttgaaagcctgctgttgcccagctggacagctagagttattctcagtggtgggatggctgaactgggggcccactgtggagagctggtttcccactggagttctctgaaaaggtgcctgatttcacagctctgattctacagaaggaggccggacccttcacgtaattgctaccctttatttatggagctattcctctgtcgggatgccctttatatgtgtacagtctgtgctgcagtcgattcttatagtgattctatgcagaagttactttagaggaggctgctggggcgcagggtgggtaggtaccttgtcagcatggtggggctgggtctccagctggttgggaccccaccctcctatcatggcccaggagtgaggcattcagggctggaccaccagcatttgtgaagcttttgccccattatcccatcagaacatcttcttggccctggcaggcagccagggcagggccattctccaccttactgacaaagaagcccagggaggggaagagggtgctcccccaacacctccattgcctctgcctgcttagtccagaatgcaggatagagaaataatgggaaaagctcccaagtgttgctggatctctgcctgccagggaagctgtgaccccagtaagggcagggtgttccttccagggaactcgaggtggggcaggatgggtagggagtgagatcagagggaaggccatgttgggaagatgggaaggcaagtctctgggggtttgtgggatagaggaagggaacatcatagaacaggccaggaataggagcttgacctggagattactttgcagcaggtttaaacaggggccatgtgagagtgtggagccctggggtcagaggttactggatgcaaattatgactctgccacttatgggaatggtgagttaggacaaatgatttccctgggcctcagggtcttcatgtataaaagggctgaagctcagtgggtaactggagcactgcctgggttagatcctggctccacccctttccagtgtgacctagggtgaatgagttcacctctctgggcatcagtgtccttgtctctaagatggacttgataataatgaaagctacccctcacagggctgtggtgaggatgaaggggtctggcagcacatgtagaattcttagagcaggcttttttcctgcagagtctttgttgctatcatcatcatcatcatcatcctcatcctcatcatcatctacctccagggattcttggggggcttaaacaaggcaggttgtacaaattatctggcacagacgtcattaaataataacagggcagagtgacgggtgctgtgatacagggaagagctgggagagacacaggaaagagaaaagacttctgtctggctgggtggaagaagggtgtggaaggtatggaagccaagggaaaacttcccctttgccctctgaaggttcactgaaaagtcaactgacaaaaggcagatgaatagcagaaatggcatgcaaatttattaatgcgcacacagggagaaccacagagtgattgattactccccactctgcaatggggtgcagaagcttatatgccatcttgaggttacagaaagaatgggggcttggggcctgagcgcagtggctcatgcctgtattcccaccactttgggaggccaaggtgggtggatcacctgaggtcaggagtttgagaccaccctgaccaacatgaaaccccgtctctactaaaaatacaaaaaattagctgggtgttgtggtgcgcacctgtaattccagctactcgggaggctgaggcaggagaatcacttgaaccagggatgctgaggttgcacgagctgagatcgcaccgctgccctccagcctgggcaacaagagcaaaaaaaaaaaaaaaaaaaaaaaaaaagaaagaaagaaatgagggagggagggaggaaggaaggaaagaaagggaggcttggatcctggcaaaacagtttatgagatggggagaagaggaggcctccctagcaaaggtggtcttgttatgtagatgaaagctcacagatagcagctgtcagagagagtagacctttgaaggtaccagactctcatcagttagtctgtcctagatctgacaagggaaggtccgcagaggaagcctgcctgcatcaatgcagatgtccctatagatgcaggtctcccctacaaaagacagctttgcaggcctacttctgttcccaggctctctgaacagccatctcaaaatatgtcaaagaagtatattttggggtgaaatatttttatttgctgcaaagcctcgctcaaaggacatgtagaagttccctgtgtagatgaggggaagacagaaagatgaacttctatcatctttggttgtgagagagcaaccaaagataaggaacatggagcagtttcatgagctgcgtgcttggagtgaagggcgtgaggctgcacgggagcactggggccagattgcagagggctgggaataccttgctggagggtttaaacttgacctggtaggtgaggagttcttttaattttttttttttttttgagacagagtctcgctctgtcacccagactggagaacaatggcgcaatctcagctcactgcaacctctgcctctctggttcaactgattctcctgcctcagcctcctcagtagctgggattacaggcacacgccaccacacccggctaatttttgtattttttactagagacagggtttcaccacgttggtcaggctggtcttgatctcctgacctcgtgatctgcccgcctcggcctcccaaagtgctgggattacaggcgtgagccaccgtgcccggctttggtgaggagttcttacccgtctaaatggcagaatcacccagggcactaaaaataaatactgttttatggtcctgcccaacagtattctaagtcagtaggtctcaagtgggactcataaatctttacatttttccttcaacttttattttaacttcagggttacatgtgcaggatgtgcaggtttgttacataggtaaacgtgtgccatgatgatttgctgcactgatcattccatcacctaggtattaaacccagcatccattagctattcttcctgatgctttccctcccccgatcctacccctaacagcccccagtgtgtgttgtttccccctccccaatgtgtccatgtgttttcatcattcagcttataagtgagaacctgcagtgtttgcttttctgttcctgcattagtttgctgaggataatggcttccaactccatccatgtccccacaaaggacattatcttgttcctttttatggctgcatagtattccatagtgtatatttgccacattttctttatccactccatcccagatgggcatttagattgaagaatcttcactttttaaagcttctcaggaaattctgatgcccacccagaattgggaacctttgccatggaagagggtggggggatatctttaaacaggaatagggtccattgagatgcccaccccagacctccaatatatggggagagagcttgagaaggtgggaagtgtgtgtaggagactctgacccccagccttccacccctctccaaagcagtcccacactctgatgtttaccaccagggctgacccctggaagtgcctcttccctatagccctctggatccagcaaggacagacagccttccctccttccttccttcttcccaacagtttttgagcccctccacgatgtgctgagcatgctgttgggtactgaaagtgaataaaataggtagtttctccccgcaacctcctgacctaaagctttgggtgattcctgctgttttggctctgctaagcatgaagtgcgtgtcatcaggcatgtggctaagcacaagagagctgggacaggagtccaccctgggggctcaagcagtggctgcagggctcagtggtccagcctccaggccctgtggcttcctggttcccccttctcacaggcccggtctcttgtcctggctctagccttgcaggccaaactcccaggccgtgccctcggtgccccctaccaggggggtcctggtgcatggggtaggagtgagctgtgcagccgccttcccacctcatcttacacaggagacaacaacattgggtaaggtctgagcaactcttcccaggggcagggttaaggatcatttcctcacaggggtagcagaaacaacaaacacaaggaaatgacagggatgccgaggatttcagagcacacagctccggtccaggacggactcccacagagagatggggggaacgctcccggggcagcttcctcacctccctcttggagtcggctcttgtgtcttcatgctgtgttctgttgtttcctttcatcaggatcccttgcccacaccaaccccacccacaccatcaccgatggcactgtttcactcgctcattgccattcatttacttcttcctttctcattcaacacataggtaccatgtgccaggcacaggataaagccataggcaatatacagcctcatgtggtgttcccagttggatggggtcaccaacacaatcagacagctctaatataacatgataattgccactgtggagttgtgcatagggtgttataaaaccaaggagtaacccagggaaggctgattcttgaagaatgagtaggaatttatgcagcgcataccaagcagtgagaatagcaaatgcaaaggcacgaagtttgtgatggctacagcatggcaggttcaggggagcagagggagtggaggcagggagatgagcaggggcatccatgaagggcctgggaagctgggctgaagaactagaactttctgccttaggcagtgggcagccattggaggattttagggagagaagggacatggtcagatctgcatctttttttttttttttttttttttttttgagatggagtctcaccctgtcgcccaggctggagtgcaatggcgcaatctcggctcactgcaacctccacctcccggttcaagcgattctcctgcctcccgagtagctgggattacaggtgcccgccaccacgcctggctcattttttgtatcttcagtagagacggggtttcaccatgttggccaggctggtctccaactcctgaccgcccgccttggcctcccaaagtgctgggattacaggcgtgagccaccacacccagccagatctgcctaatgctatggaagttgattttggggaatgggtggaagaggcagaggtcaggcagagtgttcaataaagaggatcagacaggccaggtaggagaagctgatgcctagcctaggacagggcaggtagctcagcaagtgtgagcacctctcagtgtaagagctgaggtgggagaggggcagatgggctgtggagctggccacactaaaggcagctgtgtgtttgcagggctcaggaccaaagggaggctgagtcaggaaggcactcctgggcttctggcttgagcaggctcaaagtcaacagatgcagctgcatctgtgtctagcgattgggaaggtccacagcaggactccagctcatacctgggagtcagggcaaagtccagcctagggaagagcccccaagagccaggctgggtgtcaggtggggcccttgtcctgaagggagaagagactacaaggtagagcaccaagcacacctggctctggcacctttacgtctctggccacttctctcttatggctccctgtaacaatgagatacggacacctggaggcacctggggctagtttcttcctcatacctgccccgctccgatgaggctccctccaggctccgcatcttgacttagttacaacctgatcctgagctgggacccaagggtgtcctgctcctggctccaatctcctggtgaggatgaactttggtttggctccacctgctcaagtgccttcggaagtgtgcccaccttgccagcctcgtcagaatgcagtctcaggatgatgaaagagttcaggaaatgccaccccaaggtacgtcactttggacttcaaactgagagcatttgaggaacagcaaatgcagggagggactttctctgaacttcccttatctgcttcaagataaatcctccaaaaggaactcaatggttataactcccctccccaggaacctcatcaaccagagaagagtaaactcagatcacaggacaggagactgggggtcaacaccacccccagacagactttatcacatatcacctattcttctgaaggcccattcatctttcctccaaatcatttactctctcctaagttgcctgaaccctccctccgctcaccccctttaagaggtatatatgctctcactgaggtttaggacatttgcttttctttcatgtgatgcccccatgcatgtagtatatttgtgtaccttttcttctgtaactctttcttctactgtcagtttatttcatagagtcaattaccgaaccctcagagggtagaggggaaatcttccctcccctgcagtgatgctctgggactgccagacacctggtgtctaatagacaccagaactcactcccaacagcccatttgggcaattagtcgctcatatgataaacatttttttaaacccccaaagtgtaccagtccttggactgaaagctggatttacaaggtcaaatcagattcagtccttgtgatagaagagttcataatacagtggagccaaacgcatgaaacataacacagcctattacaacacaacgcgacatgacagcttcacacatcccaacacaggatacaagggctcaggtctggtttctaacttctggggcctcagctgagaaaagggcagctcccagtgaaaggaggcttattaattagggagggagcttattggaatgtcagcagtggaatgcagaggggaagagactctaagtcagactagctgcttcagtcctggcaccataatcttggatggatgacagaactctctgtgccttagtttccacatctacaaaatggagagaataatagtgtgtatgtcatagggcttaaggattaattgagataatacacgcaaagtgcctggcacagtgcctagaaggtatagcaagcacaatagcattagctgtgtggttcttgttgccatagaattatagaacctgattatactcttaggttcttggagtcagagaactgtagaatcatagaaccctaggaccttagaaccttagacatagaggtttataaatatatataaatataacgtgcaccagaatattagctaggagggtgaagaagggagatctccccattccttcagattgaggcgaaatgtcctctaatgcctgagttccagggctgtcacattcagttgctcaggttgtacctaatatacctctaaagaaggccattcacatagacttcgatgtgaatggagttccttagacgcagcatgacatgcaccattgcgtgagaaagcccacatttctcccagagaagtcggctaagtcccagggggcttacacttagtaccataatctctgcctccagcaaaacatgctggctttgtcctgagccacactgacctgaatgtgatgaaactgaaacttggattccatataaaaataaaatcactcctgcacgttgtgcacatgtaccctaaaatttaaagtataataataataaagttaaaaaaataaaaataaaaaaataaaatcactctccttaagcattcccaagagcagattacacagaggtccagaatgttctggagaggtatcacatcttgtgaagcacagcttattgctacccagatgtacaatgagatgtgagctattcctccctgacctgtcatctttctgctcacttctctccctccctcccaatttgctcctcaggagcccaggcataagctatcccaggctcttggtggggtcttaactcaaagcccttatcaaagcattttcctcaacaaaagtagttccttttcctaacaggaatttgggccatatgtttaggttgtaatttttgtatgccttatcatatttagtgccacttataaaacctgagactcacagaattttaatagcaaataatctaagaaacaaaaattttggaataacccagcctaaggaccacaagttctaagaattgtggagaatttcagaatcccaaaaatcttaacaattagaagaggccttaaggggtcattgagtccacaccttattcaacacaggcatctcctctgcaacattgctggcaagtgctgatactgcctctgcaacaacaacaaaaaagcatacttctgagaaaaattggaagacagcttgttatctgaactatgcgtagacttgaataatctatttttgttttttttgagatggagtttcgctcttgttgcccaggctggagtgcaaaggtgcgatctcagctcaccgcaacctccgcctcccaggttcaagcgattctcctgcctcagcctcctgagtagctggaattacaggcatgcaccaccacacccagctaagtttgtatttttggtattctttgtatttttagtttctccacgttggtcaggctggcctcgaactcccaccctcaggtgatccacctgccttggcctcctaaagttctgggattacaggcatgagccactgcacccaacctgaataatctattagagtctttatctctaagaagagaaatacatctgaactaaagggtaaaaaatggcatgttttaattggtaagtctaaatgcaaaacgatgacaataaaattttaaaggactgcttccttcttaagctttattttcgtcctctgtcagtgtattgctagactcatctttcccagacacccagacctcccacgagagtatgtacattccatttggcttgatttcaagtgctaatgtataaagcttctgggttctgggtctggcaagctatttctcatgttctctgataaaatattgaaaaccatctctaaggtcttccaagaggggatatgtggaagatacatttcaattttccactgcatttcaaccttaatataatgtgattagctacagcattgaaaattagcttaatactggcccatcttattataggggccaaggaaaaactttccctttatcctctgaaggtccactgtaatcaactgacacaaaaggcagattaatagaagaaaaggcataaccattttattttaatgtacatagcacaggagaactgaaggagaatgattaccctgctatcttaatttaattccaatgtggtctgagagcagacattgtatggtttctattattataaattggttaagctgtgctttatggcccagaatgcagcctgtcttagtgaatgttctgtgggagcttgagacgaatgtgttttctgctgttgctggatgaagtattctatagacaccaattatatccagttgattgatggtgttgttgagttcaactatgttcttactgattttctgcctgctgaatctgtccatttctcagagggatgctgaagtcttcagctatactagtggattcatctatttctccttgtaggtctgtcagtttttgcctccatagtttgctgctctgttgttaggcacatacccattaaggatttaactatgtcttcttggagaattgacccatttatcattatgtaatgtctctctttatccctgataattttccttgctcagaagtctgctctgaaatgaatatcgctactctcacattcttttcattagtgttaacctgttatatctttctccatctctttacttttaatctatatgtgtctttgtatttattttttatttttttttaattttttttttctgtggggtcagccaggagagaggggggacaggtgactggtccatccctgaggcaaggatcccagcacctaccaggcttcccccgagaccaacactctgcagctctgggaggaagtggagagccccagagtctggcgaacttggcaggacgtgagagaacagctcaagggagaaccattccagtcccttccatggccccaggaggtgggagacaggccctccccattctgcaggacctagtgtctctgagcctcagtttcttcatccaaaaaaatggaaatggcaccaccacagggctgctgtgtcatacgagaaggtactgtgtgtgggcgatgcatactctctgcccactacctatggggctgggctgcccgcccggctcgcagtggcacacctgcacgacaccgagcagtgaggagcagcgagtctttgttgagatgggctgcaagcagccctctggtccagatgaactccctcaggccgagcctcatctcacccagccccggctttcctccttcccaagacacggggcctggggaagaccctgccctgtccctgcacgaggccttgatccttgcctacagttttctgactgttgtgtgcttcaaggagatgtggataaggatccctctcctcatatcaaacctggtgcttctaagctgtgcatgctgcaggagcgcctgtgggcatggaggcagcaggcctatgtctggattctgccctctgagggccactaggctgcatggggtcatcttctaggctcactctcctaccacagagctgctaccaaggaaccccagtccaaagcgtggctgcaagcctctcattccccagactgagcctgtactgtttggttgtctcatgaagacaaatatggaagagactaatggaaagcccaaaagagaagctgagatgtggttcgccatctgcctttggtcttggcagcccagggggtttgggcccttttttttttttttttttttaaacacggagtctcactctgtctcccaggctggagtacagtggcacgatctcagctcaccacaacctctacctcccgggttcaagcgactctcctgcctcagcctcctgagtagctgggattacagccacatgccaccacacctggctaatttttgtatttttagtacaaatggggtttcaccatgttggccaggctggtctcgaactcctgacctcaggtgatctgcccatctcagcttcccaaagtgctgtgattacagttgtaagccaccgcgcccggctggtttgggccttttctgtacattgcctgtccctgtaggggctggcatgctgtcctgggttcatcccagtgcccaggtccactgacagtatctagcttgaggtgctagcgtagccagctgagaccaaaccccagggagtggctgataatctgaatctccagtactctccctgtccctcccactctggagttaagaacatgttccccaggagaccaggtgatactccactttcagctgtgtgccctcccctgttgcctgggatggctgtgacttgggccccaacaatggcagtagtgccctctatcaggatcccctccccaagtgatggggccttcagtcagggcatggtgggcagtctcttgagggccaggcaggcctctggtgtctttgtatttaaagtgggtatcttggccgggcgcggtggcccacgcctgtaatcccagcactttgggaggcccaggcgggtggatcacgaggtcaggagatcaagaccatcctggccaacatggtgaaaccccatctctactaaaaatacaaaaattagctgggcgtggtggtgcgtgcctgtaatcccagctactcgggaggctgaggcaggagaatagcctgaacccgggaggtggaggttgcagtgagcagagatcgcaccactgcactccagcctggtgacaaagctagactccaactcaaaaaaaataaaataaaataaaataaaataaaatagagtatcttggccaggcatggtggctcacgcctgtaatcccagcactttgggaagccgaggcaagtggatcacctgaggtcaggagttcgagaccagcctggccaacatggtgaaaccccgtctttactaaaaatacaaaaattagctgggcatggtggcagttgcctgtagtcccagctactcaggaggctgaggcaggagaatcgcttgaacctgggaggtggaggttgcagtgagccaagagcgtgccactgcactccagcctgggcaatagagagagactctgtctcaaaaataaaataaaataaaaaagtgttctttttttttttacacagcgtatagttgggtcttgtttttggttcactctgaccaaatctctgtcttgtaattgatatatttagatcattgatgtttacagtgattattgatgtagttggattaatatataccatatttgttattgttttctcttcattgcccttgtatttttgtcttccacacattttcttcctttttagacttaagtgagcattttacataattacatttcgtcttattttcagcatattgatattgattatacttactttttttttttttttttttttttggagatggagtctcgctctgtcgcccaggctagagtgcagtggcgggatctcagctgactgcaacctctgcctcccgggttcaagcgattctcctgcctcagccttccatgtagctgggattacaggtgcatgccaccacgcccagctgatttttgtatttatttatttatttttttttagtagagacggggcttcaccatgttggtcaggctggtctcaaactcttgacctcattatctgcctgcctcagcctcccaatatacttactttttaaaaattttttaggctgggcatgctggctgacgcctgtaatcccagcacgttgggaggctgaggcgggcggatcacctgaggtcaggagtttgagactagcctggccaacatggtgaaacctcgtctctactaaaagtacaaaaattagctgggcatggtggcgtgtgcctgtaatctcagctactcgggaggctgaggcaggagaatagcttgaatccaggaggcagaggttgcagtgagctgagatcacgccactgcactccagcctgggcgacaaaagcgagactccatctcaaaaaaaaaagtttttttagtgctcgccctagagtttgctgtatacatatacactaatcccagtccactttcaaatggcactattctgcttcaataatgaaatattcctaattcctccttccatcccgtttcactgtattcattttgcttatatatagctatattcattgttgctattattattttgaacattctcttatttgttagattaagaataagaagaataaaagtattaattttctctctacttgttctttctctattgctttctttctttaagtggatctgagtttctgatctatattattttccttctctctgaataacttctttaaacatttcttgtaaattaggtttactggcaacaaattccttcaattttgtttgagaaagtctttgtttttctttcactttttaaaaaacaaagccgggcgcggtggctcacacctgtaatcccagcactttgggaggccgaggcgggtagatcacctgaggtcgggagtttgagaccagcctgaccaacacggagaaaccccatctctactaaaaatacaaaattagccaggcgtggtggcacatgaggcaggagaatcgcttgaacccgggaggcggaggttgcggtgagccgagctagcgccattgtactccagcctgggcaacaagagcgaaactctgtctcaaaaaaaaaaaaaaaggaatataatttttattttgttaatataatcaagtacacaaattgattttctttctttctttttttttgagacggagtcttactctgtcacccaggctggagtgcagtggcatgatcttggctcaatgcaatctccacctcccaggttcaagcaattcgcctctctcagcctcccgagtagctgggactacaggcacgcatcaccatgcctggctaatttttttatttttagtagagatggggtttcaccatgttggcccggctggtctcgaactcctgacctcaggtgatccaccagccttgacctcccaaagtgctgagattataggcgtgagccactgtgccaggccacaaattgattttcaaatactaaaacaaccttgcattcctgagattaaactctattcagactagatttattaaactttatatatatgtctagatttgttgactttttttttttgaaatggagtcttgctgtgttgcccaagctggagtgtggtggtgccatcttggctcactgcaacctccgcctcctgagttcaagtgattctcctgcctcagcctcccgagtagctgggattacaggtgcatgctgccatgcctggctaatttttgtatttttagtagagatggggtttcactatgtggccaggctgatcccaaactcctgacctcaagtgatctgcctgcctcggcctcccaaagtgctgagattaacaggagtgagccactgtgcctggccaacttttttcttttagagacagggtcttgctatgttgcctcaggctggcctggaactcctaggctgaagggatactcccacactagcctcccaagtagctgtgattataggcacatgccacctcacccagttccttcacttttgaaggaaagttttcaggatacagaatactaagttggtgggtttttttctcccaacatttaaaatattcacttcattctcttttagcttgcttggtttctgagaattcagatgtaatgtctttgctcctctataggcaagtttttccccactgtggtttcttttttaaaaaatttttcctttttttttttttttttttgttggccggagtactgttggctacccctctgctttcattccaagattttttctttatctttgattttagattttatgcagtttaaatatgatatgcctaggtgtagcatttggggctttgtgtgtgtgtgtgtgcgcgcgcgcgtgtgtgtgtatgagggcgagagagagagagacagagagagagagagaaatctctgagtttcctggaactgtagtttggtgtctgacattaatttggtgaagttgcagggtgcggtggctcatgcctgtaatcccagcactttgggaggccgaggcgggtggatcacctgaggtcagtagtttgagaccagcctgaccaacatggtgaaacctcctgtctactaaaaatacaaaaaagttagctgggcgtggtggcaggcgcctgtagtcccagctactcaggaggccgagacaggagagagaatcgcttgaacccgggaggcagaggttgcagtgagcggagattgcgccactgcactccagcctgggtgacagattgagactctatctcaaaaaaaaaaaaaattggtgaaatgttcagttatccttgcttcaagtatttcttttgtcctcttttctccttcagctattcccattatgcatataatatagcttttatagttgtctcacagtacttggatattctttctcatgttttttcagtcttttctctctttgcttttcagttttgaaagtttctactaatatatcttcagtctcagagattctttcctcatctgtgtccaatgtactaatgagtccattaaaagcattcttcatttctattacagtattttttatctctatcattaaaaaaaaattctttcttagaatttttgtctctgtggttacactgtctatatgtgcttgcatgttatctactttttccatcagagcccctaacattaattatagttgttttaaatttttagtctgataatctcaacattcctgtcgtatcccagcctggttctgacgcttgctctttttcttcaaagtgtgtgttttgcctttaatatgtgttgtaatttcccattgaaagccacacatggtatactggtgttggggctcagaaaccgatacaacaaaatatggtgctttgacatgccaaactgaagaagaagcctcaaggtctctctgaccttccctcatctcctgtctctcagtcctcccgtccctcccaaagcacatgataaagttgttttctgaagttcccctatctgcctaaagtccagttccgccaaagaagaaaacaattacctctagtcccttctttgagttttcattaactgaattcatgtcacaggaagaaagacccaagtctgtcaacaaatccagacagactttttttttttttgagacagagtctcactctgtcgtccaggctggagtgcaatggcgtgatcttggctcactgcaacctctgcctccgggttcaagcggttctgcctcagcctccccagtagctgggactataggctctcaccaccacgcctagctaatttttgtatttttagtagagatgggctttcaccatgttgaccaggatggttagacagacttttgtcacaaaccattgtctgctccgcaggcccaacagactttgttcaaggaaattgtatgttcttcaagcccattgaattctcctaaaactcatttcctatcccctaaaatcattatagtttcccatcttcctttcccctaagaagaagggtatatagtgctcgctttggcagcacatatactaaaattggaacgatacagagaagattagtctggcctctgcgcaaggatgatatgcagattcgtaaagcattccattttttttaatttaaaaaatttataaaagttttaaaaaaagaagggtaccatcttactccattgggatattgggtaatcactctgtgattctcccctgtgcatgctaataaatttgtacgccatttctcctactaatttgccttttgtaagttgatttttttttttttaaaagacagagtcttgctgttgtcgcccaggctggagtgcaatggcgcaatcttggctcactgcaacctccgcctcctgggtttaaatgattctcctgcctctgcctcccaagtagctgagattataggcgcccgccaccatgcccagctaatttttgtgttttcagtagagacggggtttctccatgttggccagactggtctcgaactcctgacctcaggtgattcacccaccttggcctcccaaagtgctgggattacaggtgtgagccaccaagtccagcctgtaaattgattttttagtgaaacttcagagagtgaagggaaagttttcccatagctcctacactgggtaaaaggaattcccgtaaaataggcctttagtcatgtggtggaggaggtgtggggcaggggtggcgttccacagtcctgtgattagctctcactcttttcatgagcctgggaaccctcctgggctgtgaagttcaccagtgcttctccatttttttctccccttaggtgggacagagatgggagtggaattggctatttcccctccctcaggtcagctaggctctgataaagctccagaagattgggctgggctaaaatagtttctcttgagaagcaggccttgttaagaacagaatgctctggcatatttcaaaatggttacttttcccatccccctgctgaaagcacaaggagatttttctctgacattcactgggaggactcgatagagatcctgaagattaaactcacaaacatgtggggacgcccctatggctggctcttgctggaatgtttaatgttcagatttgcccacgctgagcctccagctattcttcaattacaggttaggttgtcctgtcctggtaccggttctagagcaggtttctacttgggggtttctccttctctgtctcttcaattttgagggcagtgatttgccctgtgacctgactcctctaaaggatctaagaagaattgttgattttccagtttgctaaactttttacttattattaggacagagagacaacgtccaagccccttacatgcctgactggacactagacgtctcactaccatgtattgaacacccaggtggaagtaagcactttttacatattatctcatttaatcctcacattcaccctgtgaagtaataccactaccccatgttgtagaggtgattcttatggctcagcaagaatttagtgactccctcaaggtcacacagttagaaagtaggatttgagccgggcgcggtggctcatgcctgtaatcccagcactttgggagactgaggcaggcggatcacgaggtcaggagatcaagaccatcctggctaacgtggtgagaccccgtctctactaaaaatacaaaaaattagccaggcgtgttggtgggtgcctgtagtcccagctactggggaggctgagacaggataatggcgtgaacccgggaggcagagcttgcagcgagctgagatcacgccactgcactccatcctgggcgatagcgagactccgtctcaaaaaaaaaaaaaaaaaaagaaagtaggatttgaacctcagtctgtctgttaacaaagtcagtgtgtgtcccgcgcaccatgccatgccccagaactaagcagattcggattaggtcttcagacccagaggcagacaaaagccagaaacagagacaggagcccaggccaaaatagaggatgggacccagagcctccgaaagttcccaggatgtatgtttgacagaccatcccccaggtctccagaggtaagtgttgaatccccctttttcccctttccagctgcgtcacttgggtgagcagctttacctcttctagcctcaattttttggtaggtagctcagggcctggcaaatagtaactgctcgaaaaatggaagtttgtcattgttgttgctaggtagtggctaatgttaccagctgggaggccgtaagtgctaatcccctccagctctggccaggtgaggtcagtaactggagatgaggtcagagcccttagaggaaggcaccctgaccccagctgggctggctggagaggtggcagcattggaacctcggtgaagaagcattctgttgacagttataatgagatatgccagctctagtttcccatgggcacaccagttacctcctctccctggtaactgacccagttggcacccagtgcctgagagcttgacggcacagtaggatcagtctttctctgggggcaggtgtgccagctggtataaaggaagaaaagcctccccgctccagtgcagagccagctctgacacttcctgaccaactccaatgccaactctgacaccgcaaacttctgctttttcagaacggagtcacagagactagatttaccctcccttctgaaatgccttaaaatacaaaaccaaacagacagacacacacacacacaaaatggcactcaagacactatctatacattagataatggcaaacagtgatcaatgagagaaacgaagaaatacaggttagtcctactgacttgtcacctggagaaaattcccatgccatggctcccctcattaacaagacatgtccaggggcctgggggaagccaaagaggctgaagtttgtaaggcagagcactggagagaggagaactacagagaaagagcactggagacactcagagggtcccccttaactattcagttgagtatatatatatatatttttttgagacggagtttcgctcttgttgcccaggctggagtgcattggcgcgatctcggctcaccacaacctccgcctcccgggttcaagcaattctcctgcctcagcctcccgagtagctgggattacaggcatgtgccaccaccccggctaattttgtatttttggtagaaacggggtttctccatgttggtcaggctggtcttgaactcccgacctcaggtgatccgcctgcctcagcctcccaaagtgctgggattacaggcatgagccaccgcgcctggcccatacgtagaattctttgagcaaacttttcacctgctaaacctttgctgctatcgtcatcatcatcatcatctacctcagagggttcctggggacctgaaacaaggcaagctatacaaactgtttgacacaggcatcactaaataattatggggcagagtgatgcatgctgggatatagaatggtgggaggtgctgggagactcacaggaaagagaaaagacttctgactggctggttggaagaaagatgtggaaggcttcccagaggaaatagtgttttagctggcctcagaggacatgtgtggaagtttcccaggtagacaagggggatatagaaagacgaacttgtgtgaagactcagatgtgagagagcctaagcatgtcgggaacatggagtggtttcatgagactgcgtgtctgggtgagggcaaggtgtgagcctgcacaggacatgggggccggatggcaaaaggctggaaatgccttgcctgaggttttaaacttgacctggcaggtgaggtcctgttaatatggcagaatcacaaagggcacttaaaagaacaaattctgtggtcctacccggcaacattctaagtcagcaggtctcagatgggacccagaaatctacagtgtttatttttatttatttgggtttttttggatacagggtctcactcttgtcactcaggctggcgtgcagtggcacaatctcggctcactgaacctcaacttcccaaacttaagtgatcctctcacctgagcctcctgagtagctgagaccacaggtgtgtgccaccacgccaggctaatttttttgtatttttatttttttatttattttgagacggagtctcactctgtcgcccaggctggagtgcagtggcacgatctcagctcactgcaaccactgactcctgggttcaagcaattctcctgccttagcctcccaagtagctgggattacaggtgtgagctaccacgcccagctaatttttgtatgtttagtagagatggggttttgccccaggctggtctcgaactcctgggctcaagcgacactcaggcctcaacttcccaaaatgctgggattatatgtgggagccaccgcacccggcctacaatgtttatttatttactttatttatttatttatttatttaatttattcactcctctcagctcatgcctaaggaatctacagtgtttaaagctccccagggccaggcgtggtggttcacacctgtaatcccagcactttgggaggctgaggcaggcggatcacctggggtcaggagttcaagaccagcctggctgacatggtgaaaccccatctctactaataatacaaaaaaaaaagctgggcatggtggcatgcacctgtagtcccagctactagggaggctgaggcacaagaatggcttgaacctgggaggcgaaggttgcagtgaaccaagatcgcgccactgtactccagcctgggcaacagagcaagacagagactccatctcaaaataaataaatagaaggctctccaggacattttgatgcccactgggatatgggaactcctgccatggggaggagggcgtctttaagaaggaataggccctattgagatgccagctgtagacctctaggagttgaccatcgagcctgagaaggtaaggagagggtgtaggagacccctgactctgacctccaccctctcattcctctccagggcagtcccgcactctgatggccacatctggtgccaggtagtttctcgtaaagatctacactcacattacaacctagacatcccactagtaggtatttacccaagacacctgaaagcatgtgtgtacccaaagactcgtaaatgaatgcaactctatatgtaatagccaaaattagaaacaatccaaatgttcatcagcaggtgagtggtaaaacaagttgtgatatgttcatacaatgttgctactcagtaataaaaagaaatgagctacagatacagataaggaaacttggaggtgatatgttcataatcttgtttgggtcaaaggtttcagggatgtatacatgtgtcaaaacatatcaaaccgtataatttaaatacgtgctgcttattgtatgtcaattatatctcaataaagctgttataaaaatctgatgccagttctgtgcacccacggccagtgacaatcccaaggccacattgaatgattactgtgcatgaggtactgtgtgctgagcactctatggagatttttcctttaaccttcacaatagccttaggaggtggcactattattattaatacctctgtttacataggcagaaaggaaagctcagaaaggttaaatcacttctccaaggaaatgtcacctgactgaattccagccccagctttacccctaacctaatccaagctgtgttctaatttgtttttatgattatacaagcattgtaatcattatggaaagcaaaagaaaacatgtttcaattgctttcagccaacccctgtacatcattgaatccctatatgtctagtgatttttttttttatttgagatggaccttcactctgttgcccaggctggagtgcagtagcgcaatcactctgttgcccaggctggagtgcagtggcgcgatctcggctcactgcaacctctgccttccgggttcaagtgattctcctgcctcagcctcctgagtagctgggattacaggcacacgccaccacgcccgactaatttttgtattttttagtagagacggggtttcaccatgttggtcaggctggtctcaaactcctgacctcgtgatctgcctgcctcagtctcccaaagtgctgggattacaggcataagccactgcgctcggcctatgtctagtgactgttataggcagtatttttttttttctttttgagacagggcctcactctgctgcccagtctggagtgcagtggcacaatcaaagcccactgcagccttgatctcctgggctcaagttatcctcccagctcagcctcccaaatagtagctgggactacaagtgcatgttagcatactcagctaattcttaattttcttttttttttttttttttttttttttttggagagaccaggtctcactatgttgcccaggctagtcttgaactcctgggctcaagcgatcctcctgcctcagcctcccaaagtgctggattacaggcatgagctaccacacccagcctagccagtattttttttatcactatcattcagtaatgtacatagcattttgtttgccccacccttcctaccccaaccttatctctttccatgtgttttttgttgttgttgtttttgtttttgagatggagtttcactcttgttgcccaggctggagtgcaatggtgcaatctcggctcaccacaacctccgcctcccaggttcaagtgattctcctgcctcaggctcctgaatagctgggattataagcgcaccccaccatgcctgtctaatttttgtatttttagtagagacagggtttcattcaccatgttggtcaggctggtctcgaattcctgacctcgtgatccacgagcctcggcctcccaaagtgctgggattacaggcatgagcccccgcgcctggccttccatgtggtcttatactcttctacataaagaacaccatgaacaacagcttttagggaaggtgatttttttttttgttttgtttttaagaaaagccctgggagtggaatgcagggctcaaaagtgtttatgcatttttctctcatctggaaaaacacaactgaacctttttattgcttagtctagattggaaccttcctggcactctaatccagaccctgaaattcctgtaacatttgtaagtttggccactaagcatctgttctacccatgcctgaaggaagtagctcatgccccaggaccaggaataggttttgatgggtcttagccaatccacatgtcccacccgccgtctgcagccatttattcagggctggctctgaaccaaatcagagccaaggaaagcaagagacttttttggcattctttttttttttgctctgtcgcgcaggctggagtataatggcaccgccttggctcactgcaacctctgcctcccaggttcaagtgattctcctgcctcagcctcccaagtagctgagactacaggcatgtaccatcacacctggctaatttttttgtatttttagtagagacggggtttcgccatgttgaccaggctggtctcaaactcttgacctcgtgatccacccgcctcagcctcccaaagttctgggattacaggcgtgagccaccgcacccagtctttggcattcttgagaaagagaagtggctgccccccacacccgtgggtgctaccagggagaccttttctgggacagtgtagggaaggacaaggaatcctttagcacagtggtggtaggtcgtggatagtgggtcatctaagcatgacattgcagagatcagagcagagagagagagagagagaccccctctccattcctgattatgttgtttgagtcacttgaagccagctaacagattccatttgcttaaaccagtttccattcattcatttctttgaccaatatatactgatcacttactatgtggacaatttctaggaaccatttgagctaggttttccatgagcataattctaaatctaatcttaacctaacccttagtcataaactagaactctgacccttttctagtgaagagcttttagtggcaagaaacaaagtcctggaccactcacactgacccagtccaaggggcattggtgtaagaatatgcatgaatcactaagtgaaattccaggaatattacaaagattttaccagcaatgggcctcatgagggacctaactgatgaggaattcaatccctccctactacctgtgtcttcaaagattctgaatgtcaaaaaccccaactaataaagagatccttaaatgattcattccctggacaaactccgtgaccacctatatagatctttaataggaatctcccctggacaaattttttttttttttgactgagtcttatactctgtcacccaggctggagtgcagtggcgtgatctcggctcactgcaacctccgcctcccgggttcaagcaattatcctgcctcagcccccaagtagctgggactacaggcacctgccaccacacctggctaatttttgtatttttagtagagatggggtttcactatattggccaggctggtctcaaacccccgacctcaaatgatccacccaccttggcctcccaaagtgctgggattacaggcgtgagccaccacacccagcctaagaatggtgtctttcaaagagcaaaagtttttcattctgataaagtcaaaatgaaatcttaacctaaataaacacaatcttaacacaaaatattgattttgtgtatcatttttttttaatgatttctgtcttttatgttctctctaagtctttgcttagcccagggtttctcggcctcagcactattgggatgttggcccagataactctttgttgtaagaggctagtctgtatactgtagagtgtgtagcatcatcccagctaggagaaaccaactgcaaggttgtgagcagctctatggagagttccatcatgtgatgaggaactaactgaggcctctgttaacaaccatgtccagcccccagatgactgcagcgctggtcaacacctggattccaacctcatgagaaacccagaaccagaaccacccagctgagctgctcctgaattcctgtggaaactgagatagtcaatgttcattttaagccactaagtttaggataatttgttactcagcaatagataactaacacatacatcttgcacatatttaattaagtgtatcactaagtatttgatgtggcttttttgttttgttttgtttgagacggattttcgctcttgttgcccaggctggagtgcaatggtgcgatcttggctcaccaccacctccgcctcccgggctcaagtgattctcccgcatcagcctcctgagtagctgggattgcaggatgcgccaccacacctggctaatttttgtgtttttagtagagacaggatttctccatgttggtcaggctggcctcgaactcctgacatcaggtgatccgcccgcctcggcctcccaaagtgctaggattacaggcgtgagccactgcatccagcctaagtatttgatgtttttatgtacttttaagaagtgtttgtaaaattccagtttccaattgttggttgcttgtatatagaaatataattgattttaaaatattgactttgtgttctgccaccttgctaaacttacttagttctcacttattattagttctagtagctaagaagtctgtaattttgacatgttaagaacctagtgtgatggtcctcaattcctggctgtgaatactctcctcctcttttcccggaatgcatttttagaaacagagtacttataagttctaggtctgtggtctttccccttcaatgctaagaacctttaggaccacctgtagcaggagggcatgaacttttactttcacagctcgacattaacacaacaacttgactatcatccacacctgcttcaactcactaactcaatccttttgatttctctgctcagtcactggcttgaacaggctcagatctctggacctctccatatcatgatttctttgcctccattttcctactatgttttcccaattcaggttcccaaggtgagaatctagtttggctcatcccatcttttccctccatgtcattgattgtcaggcagcccttgagtcagattccttcttcttccaattggctccatccacagaggatgtcttagtccatttaagctgctataacaaaatgccatagactaaggggtttataaacaacacaaatttatatttcttacagttctgaagccagggaagtccaagctcaaggcactggaagatgtggtatctggtgagggccctattcttggttcatagatggtaccttctcactattcttacatggtagaaggggcaaggcagctctctggacccttttttttttaaggcactcatcccattcacgaaggctttgccctcatgacataatcacctcttaatattatcacctgggggttaggatttcaacatatgaattttgggaagacacaaacattcagaccatagcagaggacaaggtttaatgtccaaatgtacccacttgggctatggggattttggacagaaccatcttcctagaaaggaatgtgatggggcaggccctatgatggacacttcccatatagaagatcacctgtcttgcagatggtcccctctcttgcaggtggacacctgtcttgcagacctccaatcctaaaccctcattcctcccaagccgtgaggttcactgttacctgacactgctcttcatccagcctctaagagaaactgaaaccccatttatagcactgcacgtttttactcttgagcattgattatcttcttccttcctcctaagcttcccactccttcttcctctgctcattcacagtcagaactgaaaggacatggaaaaatcacacagtccaatctgggcacgtggcaggtgagaaaagtatgacccagagaggtgaagtgacttgcccaagttaatgcgtaggctaaatgtaaatataggcctcctgatttttactattagtgttttctccccactagccagtagttggccccagtaggcatgcctccccccaacttccactggggtctaatggggcagaaaaactggtgctgcagcccaatggaggcagacagggccaaggagcaggtgacagctatgacccagactaggtggcgggtagcaggaatcccatcccaccaagatcaggcttcggggtttggtgggtgaatgcatgaaggcctaggtccagatttggctagaagatgagaggtgcagaggcaggggactggctgatttggagccagaatcgatagacctgtattactttcctgtggctgctgtaataaatgatgatgaattgggtgagttcaaacaacagaagtgtattctctcacagttcaggaagctaaaagtctgaaagcagggtgtcagcaaggctccactccctccccagactcttggggagaatccattccttatctgttccagcttctggtggctgcaggtgttccttggcatgtgactttatcactctcatcttagactctgtcttcacatggccttctcctctatttgggtatgtcttctcctctctctgtctgtccctctcctctctcataagaacacctgtaatgtcatttaggacctacttggacaattcaggttaagcacctcctcttaagaacctcaacttaatcacatcttttgctatataagataatgctcacaggtgtcagggattcctgtgggtatctttttttttttcttttatttatttttgagacagggcctcactctgtcacacgggctggagtccagtggcacgatcgtagcttactgcagcctcgaacttctgggttcaagtgatcctcctgcctcaacttcctgagtagctaggacaacaggcaccatcagcacacccagctaataactaaattttttgtagagacagcatctcactatgttgcccactatgttgttcaggctggtcttgacctcataggctcaagtgatcctcccacctcagcctcccaaagtgctgggattacaggtgtgagccaccatgcccaacataatgatgtggatatcttttgaggtaccacttttggcttcccccaaacctcaccaccccacactactatcctccttatgatggcttctagactgtggtggaaggggcagcagccaggaatctttccttattccatcctggaagtagaggggaaactgaaggtaggaagggaagagatggtcttcttactctggactcagatgcttttgcttatgttcttactgagtcgtctcaactggattatcagataggaattcatattccaatattatggaattatgggtgaagaaactgaggctcatagatgaaataacttgcccaagaaactcgcccagctaatgggtttcagagtcaggattcaaagccaagttggtgtgactctgaaatccatactgattccactgtcctgggaatgacagtgggaaacctacagtgaagattccagctctgccttgctgctgtcactgcctctgccttctactgtaagtgcacactgagcgttcacagcatctttaaaacagcaccctgtctttggccctcaggaaccccggatgcattcatggctgtcagatctcttggggaaggcagtcactgggagacagggttccaagtactggcttacccttgtctgcactggctgaagccatgcagagaggagtgtctatagggaggcccctctctcctgggagttaagatacttcagttgaggtccgtattagtctgttttcatgctgctatgaagacatactcaagactgggtaatttataaagaaaaaacgtggtcaggtgcggcag

SEQ ID NO: 3692 - DNA, 832 bp, Homo sapiens
gcggaaggtggggtgtggggccggaagaccctccccccgcgtcttcagaggagcgctgtttctggaggagttaggggaaggaggctgcctggtaagccaggaaaggggcttctggccgttctgttggagcgcctctgactgacttcccccatgtgtccgtgtggccacaccgtgctactttcagaggcagtgggcttttcgctaagggataaaaagaagtaaaaccttgcctttagcgcagctctccttcactgggcagattgctctccctccccactctcccaggcccaaattggatctcagcgcctgggagctccaactttagcaagtgcgaaatcctgtcttcggttttggaattttcatccgcacagactatatcagccacggataggatatgtgagaataccagcatgtcaaggctgggaatcatccttaggcatcacctagccagtcctgcctctcattttaagatgcagagtgttcatatgaggagagactttcccttgtctccgtcatctgtgatttcacttccctgacagaagacgaagcttccatctcagatgttttcttaaatgatgaaacagcatacgcctctgttcttgtcagctcagggaaaacagatctggggacctcttcatctctgcgttgggaagcataggtggtataatcccctcctgtcacgtccaacgttgcatagtcagaagcttcgcccttgtagttggtgcacacagcacggtgatcacaggatctggtttgccactgaaaggaatcttgatgctgaccacttcacctcggagagcatgaactgctcccatgccttcaagagttttag

SEQ ID NO: 3693 - DNA, 6524 bp, Homo sapiens
acaaaagcttgtgactaggcccctttgttcccaggaaacagcagacagtgagccgcagggcagggcctctccatgccgtgaattcccgcttgtcctttctcacataatctcaagtgaggcttatttacagctccttgtctgccttccaccggggtggcactggagtgcctccctggctattctcaccccacatctcttggagatcgttccctcttaggacacatggccttgcctcattggctggagtgactgcgtggtattccgtctcatgagtgtgtcatgatgcatttaacccttcatcccctgtggatggaaggttaggctggatcccgtcttttgcaacctgaacaatgttggagagataccatttgtgtgctgggggagacgcagccctagaagtgaagctgatgcagcaaggggagccagggaggcacattgtaaatggtggcgggtggttccaaatggctctcgagagtacactccaccacgaatatgtgaggtgcctgtgctccccccgcccccgacgtgacaggtagaaactgatatttttcctagttctaatttgcattgattttcttaggctagggattttgaatgacgtgtgtatcctaagggccaggcaggagctatgtttcatttcccacagaaagcctcagatcactggcctgggcagagaggaatgagaagctggggcaccttcttcatgtcctcaagagcagcaagtctctgttctggtcattcaaactcagtgccctaaaaatgaccattatgtgaccttgcatggctctgtggggtggcggggctcagctgggtgggtcttctgctgctcttgcttggggtctcttgagaagatggtcctggggatgaagccattggaggcttggctctgatgctgtgatggtcaggcctcgcttctcctccaggtgatctcagggcctgtccctctccatggggcctctccacctggacgacttgagtggtgctcaaagctcccaagggagcaaacaccgaggctgtcaggccttcttgaggcggaggcccagagtggcacagcctcacccccacggcactctcctggaatgagtcccagatagtccacaagggtgtgatgttgggtgaccgtgctctgggcgtggtggatcagctgctggacggtgagaggcactccctgcagggtaggtggacggctgcccccagggccttacacagcaaggccaggggacggccaccctggccggtgagcccgacttccaggcaaggcgccttccttgcatcccagcttgtttggagcctccaggacatccctactgagggtcccacaggagcctgggtctggacagggaccctctcacctcaagtcagacacctttcatccccaacagcagagggactgatacctccccctggctaccctctgtcgcccgaagccagccctgactttgtgcaggcgccactcaccttcctgagggtccacctgcctcccagctggctgtgctcccagccaccctccctgcacatgaatgggccaacgaagtccagatagcaatgtctgcccatcacatatcccccagcctgaccccatatccagcatcccagcacccaccctgttctgctggcacccacctgcctcagccctgcttcgtggtgtcagaggcaggcctatcctcctggcacctcgacccaggaagctgctgggcagcgcctccagccagggccctcctcccctgggctgaggctgtgtggtggggtcactggatgggagggagggaggccttggggcccggagtaccctgccactacccagcaattccagctgatgcctccacatctttggagttgggtctgattggtgatgggttgggggcttctcagtgttctacagtccaatactgcccagctccggaggctcctattgtaccaggagcaggtgttgcataagtgctttctgaagatcatgagacacctgggcaaggaaggactgtgcattgagtgtttcatgctgcggtggctcctccagtgtttcattgatggggtaaggaggcacagggagaccccagcccatggacacagtgcccggctgccccagctcaggggtccagctccaccaggaggacgtggctcacccccagcccgtaggaggcacaggcaggtccctgcatgacacacaaaccaggccctgtttgagagggggtatcccatggcagaggccagggcttaggcccagctttatgggcagactggaccaggacccgacttgggagggcccaaggaagcccaaagtcctcaggaagcccctccttccagaagcaacagcgctgctgaggtgggtcccccatgaggagctgcaggaccttgtctgaccctgctttatagggggctctcatcccatggagaggtgttcccagcattccaggagactgaaaccccaggcggccctgctcaggcctctgagcccagcccagaaaggcaggtcctcccacacttcctgtccccacaaaatccttcgggctcaccctgcaactgtgggatatgctcatcttggagggcgagcagagtgcctcatgaagctttcctggagcaccatctgggagtttcaggagcgactttttcagagctgggccccggaggacaacgtggtcctcaggaaccttcaaacctccgtgaaggaactcacaaggaaacactgggacctgccacccccaggtgggctccagcaccaagtctcctcccaagtcaccctctggggcagtcagtggtggggagtgccctggccctaccagccctcctacctggccttcctcctgcacctcttcctcctctactctaagaaagtaaaatgggtctgccactcctcagggcaggcactgagcgtgtgtgtgcgggacatgaggtgcagacaggcaggggctgtgggcaggaccccccaacttccctccccctctttccacattgtccccatcaccccctcaaagggccctgaagggcactggggcagtcagatccaggtgtggaagaccccacccctgcctccaagcagcaggatccctcattcttgagtgcccctccaagcctgtcaagacaacaagccaggaggacaagagagaatcagtgtcccagatccagagaggatttgggcagagggcacggggggaagccctgacccagagccagaaccaagagttcagccgggcatgggatttgtccagccctggcatggggtggacggcctggagggcagagggaaacccgtgcccttcacttctcacccactgtggagacagaccccatgcgaggtggcaagggggctgggtgacagtgaaggtccctttcacctgagttctgagtcagggctgctgaacagccctgaggtgagggagggcgtgaggcaggaagccctgagccagcctgaagcctgggagccgtttcaggaccgacctgaggttccctgaaagctcccccaccccaggctgcacacagccctcaccctgggatcagcagcttgcagaggtgtcctcagtgtcaggccagaggacacccggggaccccaggactccagaggcccagggctgtgggcccagccctggagaggcccctgaggcctctgaccccacctgtgggtcagagcctgtcccccagggcctgagtcccaggcccagagggacctggcttcaactcgagttgtcctaggaggacaggggcactgcagatctccaggtgaccacgcagggcaccagggcactgcaagccctgatgctgtaaggattcacatcagagaacctgggcaagccaggccagagacgctgagcccgtgcagtgatgaggatgtggagggctggctcaagggggtcaacagctgtgaacactgctgcctcttcccggcctcattgttgcagtgcaggcagtctgcaccccggagcctggcccaacagcgccccgagtgccctagtccactatgccaacatggtacccggaggcttcgaggccctgcctgctgcaccacccgcctcctggaggccttgttctgcagcctagcccctgccgcagccacagcaggcaccactgccaagtgccttccagccgggcttcccagaggacagaggcatcctgcagtcattgcctcagcagctcacactgtgaagatagtttcatccacattcccatgttcccaccaaagagaatccctgcagagggtgctcttgatcctgcggtggggaaaacagcacactaggtggactcagctcctttccctggccaccatgattgctggatgggcccacaaagcagccatcagacaggcatgttggggaagagcctaagcaatcctgcttgttccctgaccagaccgacaccactgccgagtgccccatctgctgatgagagatttggtgtcgatccctggactggcaccatttcccaggaggagcggctggctacctgtgggcaggctgcccacactgtggagagggctgagatcggccttcactacggggagcccctacctggacatagactcgccagccctgcctgttgccatcacagcagcccacatggcattgcttgtgaccagggtaccccattcacagtgacggacatgcagcagtggcccttgactagggaactaactcttctcgctacgtcacccaccgcctggaagcaactggacttaggatcgctgttatgctgaagtggtgaggttgtcttacaagatgaattttatcctttctactggaagccagtgtatggtgatgactcccccacaaccagaaggtgtagttctgagtgaaggtgtgaaagtggacgatgttcagtgttgcaccgaatgtctcagtcacaaagttttcctattgcctgtcctggagaaatggaactttgctggttggaaggtcttaggacccaggaagagtgaagcttcccccaggggaacacaacaatggttctatttaatatgaggagacaggactaagtctgaaacctcggggcattctctggtgttcttgagtgtttccatgtaaaggaagtcaagtaacttgccacaaagctttgccacagaagcatctgaaaaaggagggggcagaactattcagaactcagaggtttcagaaccaaagatgaggccgagaagattcctgacccgctgagggcaagggaagtatgtgggggcggctgggagaggatgttatagagtccgccatggcctcgtgacctgtcacagaaccgtgcactttaatagctgtgcacatcttctctgcactgattatagtatttctttgcctttgctactctccacacagggagcttgctacaaaatgcacataaccacagcccgggtcttgcaatccaagcctggcaaggattcagcatgtcaagggcttcaggtctgaaggtccatggctgtcctgaatcctggatatcaccttcttgcccaaaaaaggagggacgaggctcaaaccgcagcaggccactcacagaaagggacgaaacgttgagtgcgtggcctccctgacacccagacaagactttgggcccaaagccaggctgcagctctggccactgactcagaccagggacgcccccatgcaggccggtgtcccctggccgctcttctccctcctgccaccctctcttcggctgcttgtgtcaataaaaggaaaactggccagttctcagagaaaatgtagctttattatgacataggagagactacaaagcactgggggggaggaggagtgacacagctcctcaaaatggaaggggaaaggaagagtaaacatcttggtaaataaagtctccaaccacagcacagtcattggaatttttttcttcatttttattttcaaacttacagtaaacaaaacaatcacttaaattgtcaaaagaacagcaattttacacaatgaagagcatacacaccaagccaaaatacaatagcactcaggtctatatgttgcagtggtgctggcgctggagggaatgcccagggaggctgcagtgctcaccacgaagcccaggtccacggagggagccaaggtccacagagggccccggggccagagggaggccgcccacactcccagcacatcacctgcctcaaagcactcccttcaggcatctgaagagggaaaggccatgtgtcttcctgggaggcactgaaaggccagccagcatctccaaaatgcaggccattttaacactgctgtgaatgtgctggggtcaccaagggggccccttagtggtcagatgcactttgtcacaatgtacacctacatggggtgattactaggcaacgggaggtttcctgaatttcacagccagatggggagctaaaagaaattcctgaacccaacgcgtaaatattttgttctgacaaagtaaattcacaagaacacatcaaacacaagacctaatgcaaggggcagtgccagggccgccgccgcctcctgtgagcagctcttcagcagcaggcatcagctctgctgacaagctcaatcacggtgtcattttactgccaccacgcccgaaagtac

SEQ ID NO: 3694 - DNA, 2859 bp, Homo sapiens
ggagggaggtaaaatccccagacctgaggactcgaaggggcagtcaaggagaggatagctcttctccagagcttaaaggcaaatattttctttttccctggtttctcaccttattgctttgtgtactgagtgaacttatttgtttttgagatccagtaacccatgcaagaaatttcataacacttctcatttagtactttaatactagttgaagaatctagggttacacacacacacacacacacacaccaggcttagttccattacctatagctgtaaaaatgagatttttttctcagttttgtgaaaatgaaaggctgctggactggaactcacagtattgtatatcaaaaagtatcagattgtgataaaatagaaacccagaattaaacttggccttatgatttttagaaagtcaacagattttgaaggagcccacccagtgtattcatttcatttttactaatcctttctttcatgctaagatagagatgaaaaagaatgacagacttcctgttctcatttcattacagcaaaataaataagttttagtgttccatagctctgtaggatgactatagttaaaaataacatataatttcaaatagccaggaggacattgactgttcccaacacaaagaaatgataaatgtttgcaatgatggatatgctaattacactgatctgatcactatacattgtacatacataaacatgactatgtacctcatggatatgtacaactgttatttgtcagttttagaaaataaaaaagcagaagagatctgctaccaaatgcaggaattttctatagagtctgttatagctagccttctacaggcttaactcttctcatgatggagtattgaccatcaccaacaggaaatcttttgttttaggcactccaggaaattatcagggagttctctctgtagataaccaaagtttccctagttgtacttctacccatttttcttagtgtgatcatttaaagcagtgcctcaccaactatcagagatgggggccagtaatttttgtttcatttttttccagttcattacaaatcaatgcatatgtctgtaaaacacaaaatcacacccttaaatgtgatggcaacatcaaattgccataaaagtttctaaacttttcaccccaatttctgaatttatcacagactggtaaaaaacagctcacaagccagcaccacgggcagaccacactttgcacagtgctcaaacgtaggcctaacaacctggcttggcttggcacttctaaaaaccgatcctgaggcaaggcttcttgtaaaagagtttatactggaagttaaaaatcatcaaattattagatactgggaatggagtagtaaagtagacagagcagggaaggaataaagtatgaattttcaagctggttacccatctgggcaactggagctcagttttgctgggaaagtctggaagacagtgtcagatataactaagagttattcccatcaaggggaaaggaaactgtgcttttcatccaccaaatccttgcttaacattggaatacagatgcttccaagacattaactttgtggcacttctggcttttcctacacacttattgtgtatgccaccatgtctagggggaaaaaggcccacaggcaaagaggtaccagcattcataccaccagctttcagcttgtagaggtggccgccaagaggaactcgtagttggcagtgccaactacaactactacaccaaccagctggaaactatacaaagagtatgaacaaagttcacaggagaaacaaggctctgcaacatatgaaaatatattctacttcattcataatgagacgcatgaaaattgtaactgtatcaataccatttctcacctagtagatgggcaaaaatccaaatgtttgagcacacattctgtgggtgaggctgtggaaacgtaggttcacatacattgctcttggatatgcagattaggaccgctcctgtggagagcagttagggaatatctttcaaaattaaaaaatgcagagttaagttttgatccaggagtctcactcctgagaatttatgctatagatatgcctacaagcatttgagatgaaaaagaagcattgctatttgtttttcttgtttttcatgaataacattgtaaaagtagaatatgggcagtgattcaagcattcatctttgggactggttaaggaaactatgatgctttcacagaatgaaattctatgcagctgtttaaaacaaaccaagacaccttctttcacatatatggaaagatgtccaaaatatactgttcagtttttaaaaaggtacaaaataacatatatagtatgattccttttgcatatgtgtatttgcttttaattgcctaaagaaactctcagaaggattcaaaagatccataccaaacaagatgggagaacagaggagtagtgacaggagtagaagcactgtagaccttttcatatcattttggtttttaaattacatgagtaggttacctaattattaaaataaatttaatttaaaaggtaatgggggataggaagaaatttgttaaaagatacaaaattacagctagataggaagattaagttgtagtgttctatagctctgtaggatgactacagttaacaataatatatattctaaatagctagaaggaggatattgaatgttctcaacagaaagaaatgataaatgcttaagatgatggatatactaattaccctaatctgatcactgtatattttgtgtattgcaatgtcactatgtaccccataaatatgtataattatcgtgtgtcaattaaaaatttttaattaaaaaattataaacaaaaaa

SEQ ID NO: 3695 - DNA, 3752 bp, Homo sapiens
catgcatttgttctacctaaggaagacatagcagtatatgttaattcaaggtatataccacatctttaaagatagcacccagcaactccaggctgatgcctttgcttgacctctcagtggccttttaaacattcaagccagcaatttctgggtgatatagtaagacaagtggatttcatggacatgtgcttactccttggcacaaatgtggtcccttgacccaaggtgaagctatgtgagatacaaccacaaatcagacatgggctgatccctcagataatggcacagaacaaggtgctatggcaaggaaggtagactttcttgtttctttttttttttttaagactgggtcttgctctgtcatccaggctagagagccatggctccaagcagtcctcccacctcagcctcccaagtgggactgcagttactcaccaccacacccagtttgtttgtttctttgtagagacagggtcttactgtttcccagactgttctagaattccttgcctcaagcaatcctcccaaattggcctcccaaaagtgttgggattacaggcatgagccacaacactcaaccagggaaggtagacttataaccaaaatatgtatcaatccagtaaggacaaatgactgtcacctccaggttggtgtcttcagaggacagcatcctatcaagggctcagcatcagtttttaccactgacagtttggccattctgcagtagcagtgcctagatcagccctggtgagagggagcctccgctgccaggctcatgcatcaccttcactccttgcacaaggctactccactcatgggcccactgtgcaaacactgggatggccaagaagaaaagcttgctaaactccactggacaaatcatcctacccgtcttgtcttctactccttctctgatgtggatgatcaccgtaagtactgatgtgggatgcaaagactcacatactttgtgtccattcctaatagtcaacccacatttttctttcacagatttcttgtaattgatcttctcatcttacttcttccagatctctaatcaaccagcctttccagtaccttgcattttcctcagtggtagaaaacagaaggtacaatagcttttctagcttggtggggaccaagaccacaatacttctaaaactttcaccaatgtgggaggcctctgattctctgtagcatttctctctcaccctttggtgtatgtgtcttaccaaggcatccagaggactcaagacttccttctcctggtccatttaatgtggatgtcatctaaatggtagaccagtatgaattttctgtagaatgtttagatattcaagttacctttttactatatagtgatgaagagcaagagagttaatataactcagcatacttttgtctcttccgaatgaatgaagattgcttctgataaatttttctggcaaagaatgaaaagaacactttctccagatcattttctgtacaccaagtgcaagagactgtgttgatctgttctggtaaatgtacatccaaaagagcagctggaaacttggctaagttttcagaagtttacattttctgttccaatccatctggcttttttccagaagtaagagtaatgacgatagtgacaaccacccctgaatccttctttgagggtatctcttattgctgccattccacctgagatgcagtcttgcttctgattttctgtttttgttggaaaggcagcaggatatttcaagggcttccatgcagtctttcctccagtagcagctctgactctccagatcaattaaccagtctgaaggttctgactctgctaaatatgttcatcatgagtagggactcagggaatgagtacatgaccacagcagcctttgaactcactgtgagatggacttaggccaggactccatttatggctttgtatcagtttgatatggctgccataacacagcaccacacactgggtggctatgacactagaaactcattgtcccatggttctggaagttagaagtctgaaatcaaggcattgacagggttggttccttcccaggactatgagggatttgttccaggcctctcttcttggcttgcagatggcatcttctttctgggtctctttacatcatttttcctctataagtatctgtctctgtgtccaaatttcccctttttataacgacacaagtcatataggattaaagcccacacaaatgactgtattttaacttgattacctctgtagagaccctgtctccaaataaggtcacacgctaaggtatttagggttaagacaccaacatttctttttataggagacacaattcaacctataacagaatcaaacaccagaaactccctctctcaaaacataccaatggcatttcagacccttatccaacagccctggaaatacatagtattcccctttcaccactgcattattactctggtaagtggctctgggaaaaaatggggaaattactactgtctgtgcttgctgaggcactgcaaactgcttcctcaagactgcccatctttctcttcaatcaatgctgagtctgagaactgcctcatttctggaaagtgaataaaggatcatgacttcatctgtttgttgttgttggcagctgacatcaacgtttggatcacctgctcttgattattttgcttaaacagataaaataatactctcactaagtgcctatctagtaaaagcattgatgattgaagttttttatttctttgttaagaaaaaaaaacttatcaagagtagtttgaacagtgctggccttcttcctctcctatcacatacaatataaagtgagcatcttttgtatgccttggcacattttcatagtactttctaagtttgaatcagattccagcattttatcctttctacttttaatgcgttgaattatctctgagagttctcttaaatgtgaaatttctcactggcatcgttttctctttaacctttccatcatgaccacttttctcatttagactgatacagttgcctttgctaagtttctctgactgcacgtctagactctcataaatagcagaggtgtcaacattcccacagtcaactatttattctataagcccatttacatttgattagaatttcacttcaaacattatgctttttgtttccttgctgtactttcatatttggcaggcggttccctctttcaagtatccatttttgtaaaatgtcatatggctttatcactgggagacaaggagatgacacaactatacatttgccatctgtgtgtgaacttaataacagatatgcattggctaattacctaaagattttttaaaaagtgacacaattggtcactggttaggatgtgcatctgtcatttatatagtgctttatccactgaagagagagcaaagtttgtattttatgcaattactcacagttaatatatcttcataactgaaatgtagacagtgctcttgggacactggtattagttaactaaacttagtaacagaaattcatatcagaaaatgggtatcagaaaatcaaagcaaaaacaataaatctattctaatgtagtgaactctctgagtcatttgacacctacttcaatgattggtcaaggcagctctggcatgtccatcatacaagcacaagagtatagctgactcctggtgtccttgcgaggatattaaatccatatgagagactcatatcaataaattttcctttattcagcctt

SEQ ID NO: 3696 - DNA, 333 bp, Homo sapiens
atgtcagacgcagccgtagacgccagctccgaaatcaccatcaaggacttaaaggagaagaaggaagttgtggaagaggcagaaaatggaagagacgcccctgctaacgggaatgctaatgaggaaaatggggagcaggaagctgacagtgaagtagatgaagaagaggaagaaggtggggaggaagaggaggaggaagaagaaggtgatggtgaggaagaggatggagatgaagatgaggaagctgagtcacctacgggcaagcgggcagctgaagatgatgaggatgacgatgtcgataccaagaagcagaagaccgacgaggatgactag

SEQ ID NO: 3697 - DNA, 504 bp, Homo sapiens
tttttcttcatttttattttcaaacttacagtaaacaaaacaatcacttaaattgtcaaaagaacagcaattttacacaatgaagagcatacacaccaagccaaaatacaatagcactcaggtctatatgttgcagtggtgctggcgctggagggaatgcccagggaggctgcagtgctcaccacgaagcccaggtccacggagggagccaaggtccacagagggccccggggccagagggaggccgcccacactcccagcacatcacctgcctcaaagcactcccttcaggccattttaacactgctgtgaatgtgctggggtcaccaagggggccccttagtggtcagatgcactttgtcacaatgtacacctacatggggtgattactaggcaacgggaggtttcctgaatttcacagccagatggggagctaaaagaaattcctgaacccaacgcgtaaatattttgttctgacaaagtaaattcacaagaacacatcaa

SEQ ID NO: 3698 - DNA, 308 bp, Homo sapiens
ggcatgcactgcctccacgcagcaaccctcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaacctcccccgttgcccctctggatccactgcttaaatacggacgaggacagggccctgtctcctcagcttcaggcaccaccactgacctgggacagtgaat

SEQ ID NO: 3699 - DNA, 433 bp, Homo sapiens
ctgggaggggtggtggccattttttgtctaaccctaactgagaagggcgtaggcgccgtgcttttgctccccgcgcgctgtttttctcgctgactttcagcgggcggaaaagcctcggcctgccgccttccaccgttcattctagagcaaacaaaaaatgtcagctgctggcccgttcgcccctcccggggacctgcggcgggtcgcctgcccagcccccgaaccccgcctggaggccgcggtcggcccggggcttctccggaggcacccactgccaccgcgaagagttgggctctgtcagccgcgggtctctcgggggcgagggcgaggttcaggcctttcaggccgcaggaagaggaacggagcgagtccccgcgcgcggcgcgattccctgagctgtgggacgtgcacccaggactcggctcacacatgc

SEQ ID NO: 3700 - DNA, 1302 bp, Homo sapiens
ctggcatcactatactactaacagaccgtaacctcaacaccaccttcttcgacccagccggaggaggagaccccattctataccaacacctattctgatttttcggtcaccctgaagtttatattctcatcctaccaggcttcggaataatctcccatattgtaacttactactccgggaaaaaaagaaccatttggatacataggtatggtctgagctatgatatcaattggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggatttatttttcttttcaccgtaggtggcctgactggcattgtattagcaaactcatcactagacatcgtactacacgacacgtactacgttgtagcccacttccactatgtcctatcaataggagctgtatttgccatcataggaggcttcattcactgatttcccctattctcaggctacaccctagaccaaacctacgccaaaatccatttcgctatcatattcatcggcgtaaatctaactttcttcccacaacactttctcggcctatccggaatgccccgacgttactcggactatcccgatgcatacaccacatgaaatatcctatcatctgtaggctcattcatttctctaacagcagtaatattaataattttcataatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgactttttcaaaaagatattagaaaaaccatttcataactttgtcaaagttaaattataggctaaatcctatatatcttaatggcacatgcagcgcaagtaggtctacaagacgctacttcccctatcatagaagagcttatcatctttcatgatcacgccctcataatcattttccttatctgcttcctagtcctgtacgcccttttcctaacactcacaacaaaactaactaatactaacatctcagacgctcaggaaatagaaaccgtctgaactatcctgcccgccatcatcctagtccttatcg

SEQ ID NO: 3701 - DNA, 2746 bp, Homo sapiens
tgaaacaggagtgctttatggtctgagtggagtgtttgggaggagtgcctcccggctcctgccttcgggctcacctgagcgggggcgcagctgaggccactgtgggaaacacaacccccactcccaggagaggcctcacatgctgccttcggtctcgccagccttctagcgtggggcctgggccgccctttagggtgagtctgcacacccgtgttcagggctcccggccggaagcggaaccataggcatgctgcggccccagatgagcgcggagggcaagcaggtgccggggcagcgcacaccccacagccaagcggcccctgcccagcctctgtaaacagaccctcacaggtccctcctgggcctcagtcacatccctgagaaacactggcggctctgccccgagagggccagggtgtccaccgagcctggctgaagccagctgtcccctcccttcttgcagagcaggctcacactgggcctgaaggcccagcacctgcagggcccagcctggggaccaccaatgcccggcctcttccagctcagaagcgcacacggcagccacggggcagcggcaaaggcgatggtacagaggcaaatgcctccccaggcagtgacaggcacgccccccgccccagggcggccactgcccacgccggcctagagctcctcgtagtcgccacccccagggtggcggccgcccggggccccgccccccaggaaagcctccagctcatcggcagccgtcctctccctgctgcgcgggggccgctgctgccgccgtcgccgctcctccttgccctcctccttgtccttgctcttcttgtgtttgctcttcttcttggcagctttttcttcttcctctttgccttttttcttcttcttcttcttctccttagagggggttttgccctccttaccttcctcactgctctccttgggtccggcctcctccagccccagcccgaagaggtccgagtcattcttcagtctgaaggcggggagagggagcttggggggtgggggcggctcggcagggccctcatcctcgtcagtcacatcggaggggtcatctcgcacgggaaagtcatccgccctgcgctgtgtgtctgatccctcgctctcaaagtcggggtcatccatgacgaaggacagcatttgtgcagcaatgggtccctcggggtcactctccgacgaggaggcctgctcacccttccccggctccatctcagcagggggcctggtgctgctgcgcttctccggaccttcttctcgtccctggcgggggttgtgtcttccaggaagctgcggtccaggcggtcgtcaggaacaaagtcctccacactctggaccgttgctgggccctctgcggccgggactggctctggaggtggaggggctgcctcggtggcaggtgacgtcccaaacagcctagagatgatgctgcgccgtggggcgggggctgaggggcacgcaggtgggggcagggcctctgagggtggtacagggggcacagaggatggtggggcggcattgaggggcagctgtggggcgggctggggtgtgccggggctggagctccccgtggacacagcgcctgcaggcaccactggtgactgggagcccggggatgggctctgcccgttggccgccagtggggacgcatggccacggctgcgagcctccatcatctccaggaagatgccgtagttctggtcctccgtctcctgctgcaccgacagctcctccagcgtggcgtccatgtccagctggttcgtctccagctgccgcaacagcgtctccctctgaagctgcaaaaatgggatattgaagaacttatgaaggtactttaggccgaagctgttcttcatggaagactcagcatagcggaagtaggaggaacctggaggtctgtccaggttgtcgatgaagtcacgcacgtcgtccggcaggatgactcggtgctcgcccatgtcccggtagtttcccagcacgcacactggcacgtgggtgggcacttttggaagctcccggagaatgtaattgaaggtccactgcttggtaatgtcgaacatcatgaccaccccgttgcagttcttgtacacgtccaggaactcagcatccagggccatttcagactccgcctcctgggggtcgttctccatctttaagccgtcgcctcgctttttgcattttcctttgtctactacatcccagacttcaaccttcacgatgtcatccgtggtcttgtagctccagtggatgctggtgacctggatctcctgtgtggggatgtactcctccacgaacggccggccctgcaggcggtgccacagcgctgtcttgcccgtgttcctgtctccccggatcactatcttcatgttgtactgcacccccttggcgaagcgcctctgcaacgcctggttcatggactgcagcccggcggggatgttcttgtcccggcccggggcctggtccgaccccaccagcttcttcagggcggaaaacatcttcccgctcggacgtcccagcccgggcgcggccggcgagctcagcggcggcggggaaggggtgcgactggcaccatgtcccggcggccccggcccccccggaggccggagccggcgcggccagaggccggggtcccggcggcggagcgcagccccgagcggcgactcgggaacctcagccgcggctgctccgctccggcccccgcggcctccggcgcgaccgctctccaggagtc

SEQ ID NO: 3702 - DNA, 508 bp, Homo sapiens
aagtggactcattccaattacagggcctcgaaagagtcctgtattgttatctagagtcaccaaagccgccggcgcccgccccccggccggggccggagaggggctgaccgggttggttttgatctgataaatgcacgcatcccccccgcgaagggggtcagcgcccgtcggcatgtattagctctagaattaccacagttatccaagtaggagaggagcgagcgaccaaaggaaccataactgatttaatgagccattcgcagtttcactgtaccggccgtgcgtacttagacatgcatggcttaatctttgagacaagcatatgctactggcaggatcaaccaggtaggtaggtagagcgcggcgaggccccgacgcggccggacggccggccggggggcctcgcgaggacgggcccggcgccccgcaagcgaggaggacgacggacggacggacggacgggccgcggacggcccgacccgcgcccggcggccgggagggaccggcg

SEQ ID NO: 3703 - DNA, 910 bp, Homo sapiens
atggcaaataagcacatgaaaagatgcccaaagtcgtaagtcattagggaaatataaatttaaaccataatgagataccactgcatactccctagaatggctgtaatgaataggattagtcacatggtgacaagaatggaggatcatctggaactctcatacactgacgataggaatgtgaaatggatcaactactttggaagacaattgggcagtttctttcaaagtaaatgtgaagatgccatacgattcatccattccatttctaattattcaagagaaatgaaactgtatatccacaaaaaagacttgtacacaaacattcacagcagctattatttattggtaatagctaaaaactgtaaacagctcccatatccatcaagtgtatggataaacaaatttggtgtatttatacaatggaatactactcggcaataaaaagaacagttgatactctcaacaacctagatggacctcaaaataattcggtttaatgaatgaagccaaacttaagaagagtacattgtatgtacttggagaactaacttcttgcaatagatttttaagcactattaggagcatatgacttaaacagtttttaaaagtcagggagtaagtatgcttaaataaaatacaatctgtgaaacaaatctctgaattattatcacttcactggacactctaacttgaccatatttctgactttaatgtaactcactcttattccgtagtcacatgtttgcttgctcattggttcacattacatttattcagcatctgcttgagccaaggcactgtaactacatgttttttttagttacctacttttgtaaggtcctgtttctttggctacatctgattacagtaaacataggaagtttaataaaacaattttcatgaccgagga

SEQ ID NO: 3704 - DNA, 4127 bp, Homo sapiens
atggacacgcgatcagattcgctaccgcagagctctagctccggagcgcgccaagttgaaggccaaagtcgaggttgggatgcccgatgcctggcgcggggagacggaggaagcaaagtgctgctgcctggtggaaatacagtattatataatgacatgctactatgcatctctacctaactcctcgtctggtgatgccatattgaaatcagccatactgagagtatttacacactgctgaagtcagtaaatgctacaaatcaaggcttgaatgtaacctacatgagaaagagttgccttgctcactgccgtatcccagtatcccaagaaccttggagatgctctatgaatactgaatgaatctgagaggaaactagcccgaagggggaaggctctggaagcaagccctcatggaccaacggagaaaaaggaaactgaatcttggggagattaagcaactctttcaaggtcaaccggggagcggcagaaccagagttcgaaggaaacctttctgaatctgacgtctgccccttctaaattaggactctcatctatcagcctgtgagaaaaaatacagaaagcatcattcaggcaacacatgaactcaagacactgagacttcgctaaccttcctcgcacacaaggtcctaaaggaactaccacacgcatgtccacatttgatgcacataacagactctcaccgcattgaaataaaccccagtatgatcataatagcttttttctttcaatttttattgaacacaagtattccgacagaatgcaaagtcaaaattctcagttagtactcagtatttacaccagtgagaatggaaacaaaggtggtatcgatgtttcacttggtaaaaagttttataacaagagagaaggcccccgaagtacagaatgctgggtagggatgttaatggaggtctgaaaaccgccatccagacagacagcctcaagtgaaaacctgggactcggaaggctccatagaaaagtgtgaaaatagagttccacctccaaagctgcactatatacaccacagccctgcagggtccagtggccctgctcgtcacacttgagtgctcctccagcagaacttggccatgccggtcttcatgtgaatacatatgtatggcacatacacacatagacacatagacattggaaactggagttgatccctccttcaaaaattaaaaaagaaaattataagctttgatctcttaacataaaagataaaacatcttggaataaaatgactccctctttgattttagagaaagcattgctttttttttttttttttttttttttttaaaggaaaaactcttgcatgctgagacaaacctatgtgtaatgggagagaacagaccaaaatgtgggcagagtcttaggtcctagctaatggcagagccagggttctagggggtcagctgtcccgggccaggtgatctgagggctgacctgtttcttcctaaccatcagaaccaaaaccagtttgacctaaccacaaccactttgacagtcttgacaaggtatggcatgggcttggcctggtgtggcaaagccatcgacattacaagatgaagaactgagtccactgaacagcctggtgaccagaagagcctgcccctcactgctgggccctcccggtctcagacacccaggctctcacattctactgtgtgctctaagatctctcttcatgttcctctattctgagggcctgtgcatttgaaccagagatctgtgcaggccctagaatcaaaggggccagggctgtgtgttctgggatcctccatttccatccccaggagctgagaaaatgcaacataaccccacattgagcaaatgacaagaccattattcttcacagtttgaaattataatctagcatcgccactgatcagactgcagaagtgtcagaacgttggggagagtggcccacagaatggacccagaggcagccttgccaccctaacctcttgctgctttgtaccttaggagaggagcgcatgcggagtactgatttctgtttacttagcatcatcttcatcatcatcatcatcatctgtatttcattttctttgttaaaaggcttcgattccgtttgagtgatttttgtttcctgaatattttttctgaactatctgctataccttccacaaccaaactatgttgaagttttatttcaatactatgacaaaaacacgtttcacactaaaatattcacgcatccacagtgcacaagcttgcagttctaaagtagaatgagggaaaaaaaagcaaaatttctatacaaagggctggcttttcccttctcccccccctcccatcccccttaaagtttctgtattttttcccccacttggtttccaatccaggaaagttgtgttatgactccagacagtaggttgtttctttcttcttttgtttctataaatgctgcctaagtgaacagaaggccgatgttactttacttcaacagatttccaaaaaaagacactaattccctgaagcacacatgctcttccgctcaaatctagattctgggctcaaaaggaaatggtatgtatagattttatttggctttctacacaaaggggatgtgtggggtaataatgtgtgttcaccaagaccagccccaactatacaatcttctctgcttcattcaacaaagcctaaggagtccttcaaaagaagggtgagaacgcctgggagcagatcccttttcacagatgcaggcaggtggcggctaatcagaaagtggtctaacccccaaagaaacacaaaaataaccaaaaattcaaaagcaaaaccattccagaatgagatggattttcacctgagtgggacccaggcaaaaactgcagatcagaaaagaggggaagagcagctgtaaacaatcatgttttgtaaagttgtcctgtgctaaagcaagcgtgggatgatcctacctacctctaggtggtatttgttaccttaaaaaataaaaggcagctattttacacggacatttaaacacaaccaaagtcaaacatttgtcaccttgtaaacactggaaaacaaagttggcagaaagaaagaaagaaaaaagaatgtaaaagaaagaaaaagaagtctgaatactgcaaattgagatctacccccagaagctgcaatttggcattcgtcctataaaataagagtctacgtgggaattgaattcagctagaaagggtgacacactttgcatactgaacaaatacaaagtgaacagaaattataacttatttatgaggttttacagagttcaaacttgactgaaagtataaaaataaactgtggactttgttcattcgattagtcttagtgcctgaaagtatttctctgaaactggtctgtgccaatcgggtaacaccaagtgtggtcttcctgaacctagatttcgtttctgagcttcctagattcttaatttggggtccttttgtttgattttttaacggtttcagggaacggagtgtcctagtttggctgtgggtttaacctttttgtctcattttcttacaagtgagtgtgcaacaaagggaccctttctataaacctacaaaaaggagattcccatgttttatctgtttagttttttttaaaggcaaaagacactagagaaatgagatgtgtgtgtgtgcatgtgtgtttgtgtgtgtgcgtgcgtgtgtgtgtctgtggtgttggaaatgctctggtgaagctgctgtgtcactttttattttgatctttgctcggttctcttcacccatcatgctttgctctcgttctcctttgtctgtgtggcgtcattggggaccgtcttgacttcggctggcgctggcttcgtttctgtctcctggcactctggctttgcttctacggggcccttcctgcagagaatcaggaaaacagaaccactgagaccacggtctgcagacatctcgcccctgcatccaggccttggggacagcagggaggaggaggggttctccagtgacagcacccggctccaacctctgcccgtcaaatcacctgggagcactaaaaatcacccaagcccgagctgtgttcgcggaaatcctgatttaattggtccggacacagtgacttttaaa

SEQ ID NO: 3705 - DNA, 2659 bp, Homo sapiens
ctgacctggtcacaggggtctgggaaagacagaggctttgttagagccggcagctgagggccgaggccgagcaggggttaggccagcacaggacgaaaaggaagaaagttccaggtggagtctggtggagaaagaccgacctggaaggcaccagcatgtgcacgtggcaactgaggtcgaggacgtgcctgagagagaggaggaaggtgccctgcggaccgggtagggtgcggaggtcgggaatggagaacggtcgttgggcaggtccgggtacccgtagccagaaccacccgggtgtgcgcagctcggccaggccccgcctcccggcgtccccgccccctgctgggcctctctccgcagccgcgagacccgcgcttggcgcataggccggttctaatttacaagaacaccgcggcctgaggccggagagtcccttcaacccgggaggcggcggctgcagggagccgagacggcgccattgccctccagcctgggcaaaaagagcgaaactccgtctcaaaaaaaaaaaaacatggccgaaaccaggaagctgcgcgatggcgccacggcccctcttctcccggcctgtgtccggaaggtttccctccgaggcgccccggctcccgcaagcggaggagagggcgggacgtgccggggccggagctcagaggccctggggccgctctgctctcccgccatcgcaagggcggcgctgacctgaggcctccccgcaaaggtccccgaggcggcggcggcggcgggctgtgagaaccgcagaagaacgctgggcgcgcagcgacccgtccacccccgcgaggagagacttccacagaggcagcgtttccacagcccaaagccacgtttctagggtgatgcagccccagtaagttcctggcggggaagctcacggctgtcaaaagaactcttcgctccagccggcgcacgaaggggaggagggcaggaggctgccgcccgcacaggtcatctgatcacgtcgcccgccctagtctgcttttgtgaatctccactttgttcaacccccacccgccgtctctccctccctgcgccttccctctaaccttaaagacccagctacctctacgcaaatggtagctacctctgcgcaggtggaagttgagttcggttcacgcgggaccctcttccctgtggcaagctgctgaaggagacctgctgttactgctttagctgctgttctgcttaatctcagacagctggaaggttgctccggatctcgccatctggcctgcgttcaatcagcagaagcttcctggaggagcaggaggaggcactgtgctcgcatcacataccagtggccagaagttggcttcagggaagctcaggaaataggatgcgagaagccatgagacctccccaaactctgcagtaacagagtcaacaagacaatggcttaaagatggagagaccagttgatcggtcacacaagctgttccacgataattcttgtgtcagaaggggaggctgactaccaggaccactggccccacttccagcccctccattctgagtacacttcagagggctctggcagggtgagggggtcttggtggtgccacagagagtaaaggtctagcacacccattgtggagatatttcatggggacaacccagtgacttcacttgaagtaaagtgggattttccaaccttgagattcttattttctttggtatgcgtgtggaagaagtatgaaggtgggggttgggagggagagcaaatgagctgtgtgtatgaggagctggggcctggctcttgacaatatcacccacccccaccccaggctttccttggggcagaaagactatggccggggctttcagtgtcggctccgaggtatagaggtataaccagtgcttttggctaagtcacgtcactgatgagcttctctttccaccttggcaaaccaattcttctgtaaaatggtcttcaaagtttcttttttaaagcagagaaacttatttttcagataaaaatttagatagaactatcgggggaacccgataggggccagatatcgggggaacccacccccaatatttcaacataggttctttctattttccataaatgttggccggctgagaaataaagagtacaaagagcggaattttacagctgggccaccgggggtgacatcacatattggtaggaccgtgatgctcacctgagccgtaaaaccagcaggtttttattaaggatttcaaaaggggagggagtgtacgaacagggagtaggaacaaagatcatatgcttcaaagggcaaaaggcagaacaaagatcacatgcttctgaggaaacaggacaaagggcaaaaggcagaacaaagatcacatgcctctgaggaaacaggacaaagggcaaaaggcagaacaaagatcacatgcctctgaggaaacaggacaaagggcaaaaggcagaacaaagatcacatgcttctgaggaaacaggacaaggggcaaaaggcagaactcctgataagggtctatgttcagtggtgcacgtagtgtcttgataaacaccttaacagaaaacagggtctaagagcagagaaccggtctgaccaaaaatttaccaggatggagtttcccaatcctaataaggctgagggtactgcaggagacc

SEQ ID NO: 3706 - DNA, 5863 bp, Homo sapiens
gggggcccgaggattctagagagagcacagcccaggcacagtgggagtcgcagtggctgccgccgtggccgcgtagcccgaacgcagatcgtggaagccgaagacgcggcaacggtggtccctccagatgccagggaaggtttgcaggaagccgctcccgacaccctttgcgccaccggaagcctcgttccctcagatttccccctccctcccggaccgacttccgggtgtggctgccgcccttcccccacccacgccggcgggagccgcccgttcgcgctgccagcagcttccgcctgctacggtcctggcaagcacctcgggatcccattccttcacagggaccctagccagttaaagctgatacattcctgtgggtcaactatgcaactaactcagattttgagcaaacaaagctctcaagttggtgatcctcaggagtctctgcattagttggacagctcttctggaattatcttctaagtcaactgtgggttgggtaggtggctctgctgatttttcgctggacttccacatttgggacgagttggctgtcatcagctctagaaagggtgtggccgttttacattggctgttttcctcacattcctcaagcaggtactgtaataaagaactggagaaatacagtcagatgggaagtagcccttgctgtcaaggagcttgccatctaatgggggagacaggcaagtaaaccaaagactacacagtgcagtatggtaagtgccatgattttgatgtgacagggcacagtggacgaccttccaaatcaaagcaagtaactaggggttgacaatggtaagtatcatagttgaagtatccttgaacaaggtttcaggaagaagaagaagggaatttcatgcagggaaacagccaaagctcagtgagtcaaaatatcacagcattcttggtaagcccaattgttttttctgttttgctattttggtggagagaaaggaacacataaaggaataacatgagagaaggctatttggggaagtgtagtagttaaggttctggctcaaacaacaactgcagctcataaagttgactttagtggaaggatactggggtatctcatggaatcttgggaactgttgaataaccagggaaactctgggaaactcactggtaggaatccataaactgtcctcctggtgggctgtaaacaactcaccctctatgcatctcacatcaaaattccagtttcttgggaaaacaagtctgtttgcccaatttgggtcatatttccacgtccatgttactcaggcatgattcatctgcaagttatgtgtatagatattttgctactgttccacccttacgctgtgctggggagggaggtgtcactgtgagctgtgtcggtgccttaagagatatctgttgtgtcttattacttggttgcttttccccacatgtacaatgacaaaaatgccttcaacctatttgatccagccgttccagtacaactcctatacttgccatctttccaagcccaaagctatagttcctcatggtcctgcactccatggactaaattgtaagtataattactaccaatgtactctataaataacttttggggccagggtggcaatagttgctagagagaaaaaaaaaaaaaaggaaggagaagaaaacagtgatagttcttattttaaaaggaaaaaaagaggcaggaggctctcttgaggccaggagtttaagaccagcctaggcagcatttcaagaccctgtctctactaaaaagtaaaaaaaaaatttagtcaggcatggtggcatgcacctgtagtcgtagctactcaggagactgaggtgggaggattgattgagctcaggagtttgaggctgcagtgagcaatcatcatgccattgcactccagcctgggcatcagagcaagaccttgtcttttaggaaaaaaaggcagggaagaggaataggtaatttttcagtgttcagacattccagcaatatgtgtggagtactcattctcactacagtttatgaggccatagctagtatgtatgactacccatccaagtttccctgcttacagttactattccaactgattggggggcttttcctaatagagtgatttaagccttcatttttagacatctaagcccttggtgatcatcagcataaaatgtgacaaattaaacaaaagcaagacagcacatcagagaacaactctgaggtggaatgattgggaaccaatgaatagttgttcagtaaatggtttatattttacagatgatgaaactgaaacacaaaaaatttagattaactcttaggtgacaaagccaggattgaagctcatgcggtctggctccagaacaactcttcttcatagttacgttatactgcccctgcattgttggtattgaaaataactgataccgtgcttccagaagatttttctaacagtgtttgcaagctataaaatagtgctttcacttagaaaaggctagacgtggtggttcatgcctgtaatcccagcactttgagaggccgaggcaccatgctgggagataaggatccaacataagacaaacagtgctgatgcttttggaaagctcatattcaagctggggagacaaacaacatacaaaaactcactctgtcactcaggctggagtgcaatggcacgatctcggctcactgcaacctctgcctcccgagttcaggagggctctgagagatttcatttctgtcctgctgatgaagtctacgttcattcagggcctgctgtggaagaccagccccaaagttgctgaacagaagacttttgagagtcagcagaaatcttccactttgcatggttctcttgatgtgaaatcatctatatagccccagaattggaaaagaaaaaaaataaaaaaatggaaggaaactggattcgacaacagtctaatgctttctacttttatttactttttctttaaaaaaagtaaattctgtttatagttacaaacatctgatttctcaatgaatactagaggaaaaagggaacaaaggaatccataatcttcaatttacttaagaacttaattaaccaaatgcaatggactctatttgggtactgatttgaacaaataaactataaagacatttttgagacaattggggaaatgtgaacaatgattgggtatttgatgatattaaggagtcactgtcaatttttaggtgtgatcatggtattgtggttctgttccaaaaaatagcccttatcttttagagctatgttacagtttggctccgtatccccatccaggcttcatcttgaattgtaattcctgtatgtcaaaggagcaacctggtgggaggtgattgggtcatggggatggtttcacccatgctgttctcatgatagtgagttctcatgagatctgatcgtttaaaagtgtgacacttcccctcttgctctcttgtctcccaccaccatgtaagacatgacttgcttccccttctgccataatcataagaattgtaattttcctgaggcctcccaagccatgtggaactgtgagtcaattaaacctcttttctttataaattaccctgcaactgtcaccattctccagaccccagaatggtagatccagcgacagcccttgcaccttcacctggaaaagcctcaggcactcacaccagccctaagactgtgtaatttataaggaaaagaggtttaattgactcacagtttttatagcactgtgaaaatggactaataacagaaaactggtatcagaatagtggggtactactataaagataacctgaaaatgtggaagtgactttggaactgggtaatgggcagaggttagaacagtttggaggaatcagaagacaggaagatgtgagaaagtttggaacttcctacagacttgtcaaatggttttgactaaaatgctgatagtgatatggacaatgaagtgcaagctcaggtggtctcagatggagatgagaaacttattggaaactagagtatcttgtatgttttagcaaagagaccagtggcattttgcccccaccccagagatctgtggaactttgaagttgagagagatgatttagggtctctgagagaagaaatttttaaggattcaagaggtgatctggcttttgtgaaagtgtacagtcatatgcattcacaaagagatgatctgaaattggaacttatgtttaaaagggaagcagagcataaaagttaaaaaaaaattgcagcttggccatgtggtagaaaagaaaaacccattttatggggagaaattcaagctcgctgcagaaatcttcttaagtaatgaggagctaaatattgccaagacaatggggaaaatgactccaggccatttcagagatcttcaaggaagcctctcccatcacaagcctggatatctaggaggaaaaaatggttttgtgggccaggctcagagccccactgctctgtgcagcctcaagacggggtgacctgtattgctgttgcttcagctccacccatggctaaaaggggtcaaggtacagctcagaccattgcttcagagggtgcaagccccacaccttggcagcttccatgtggtgttaagtctgcaggtgcacagaagacaagagttgagctttgggaggctctgcctagatttcagaggatgtgtggaaatgcctggaagtccaagcagaagtctgctgtggaggtggagccctcatggagaacctctactaaggcagtacagaggagaaatgtgaggttggagcccccacacagagtccccaccggggcactgggtagtggagctgtaagaagagggccaccattctctagaccccagaatggtagatccaccaacagcttgcaccgtgcacttggaaaagccccaggcactcaacgccagcccatgaaaacagccacaggggctgtaccctgcagaaccacaggggtggagctgcccagaactttgggagtccaccccttgcatcagtgtagcttggatgtgagacatggagtcaaaggagattattttggagctttaacatttaatgactgctccactgggtttcagatttgcatgggccttgcagcctctttgttttggcaaatttttcccatttggaaggggagcatttacccaatgcctgtacccccattgtatcttggaagtaactaacttgttttttattttataggctcatagatggaaggcttgtctcagataagactttggacttggacttttgggttaatgctggaatgagttaagactttggggttctgttgggaaggcatgattgtgttttgaaatgtgagaaggacaagagatctgggaggggccagggttggaatgatatggcttggctctgtgtccccacccgaatctcatctcaaattgtaatcctcacatgtggaggaaggtacctggtgggagctgattggatcatgggggtggttcccccaagctgttctcatgatagtaagttcattctcatgagatctgatggtttaaaagtgtggcatttacacactctttctctcctgctgccatgtaagacatgccttgctttcccttaaccttctgccatgattgtaagtttcccgaggtgtccccagccatgtgaaactgtgagttaattaaagctcttttctttataaattacccaatctcaggtatttctttatagcagtgtgaaaatggactaatggactaatggaaaatggactaatacaagatacttattgaatatagaataattatgtctacataattatttacagatgaaataattatgtctaaaatttgcttcaaataatatgtgaatatgggggatgggttgggaatgggtttaaca

SEQ ID NO: 3707 - DNA, 1736 bp, Homo sapiens
ccaaaaaagtggagctataactgtgggaaaaggggatctgaagtcagacacaggatccacagtagcctggggacctttctcacccccgcccttaagcaggccccaacataaccggctgagaaacctcctctgccagatcctgacctgagccaggaggcggccaggaaactggattttgggactgggatttcagagaggaagctggagagctgcagggtggtcatctgtcactttattttgcccgtcttgtagcatgtgggtctttcgcagcaggaagtgtgttttacaaccagagcccccgccctcctgcagcgcaggcgcagctggctgggctcctgcttcccactctccacctcatccatatttgtcctcgtccctgccagtctcgaaaaggcactctgtcacgtgtacacaggaaagggccctgacaagaggatgggactgcagttgtggctgccaggtctcactctcccttggatggtcggcggggtgggggtggaggccagggctgtagtgcagctcccgcaggtgctggctcagggggagcaggcaggctccggttttcggtaatcctcctggatggggatggtgctgccctcctcctccctggggcagctgtaatgacaaggctctgcaggctccacaggactttctcctttgtctgcagaaggagatccgatgagtcttggccagcagtgggggcagggggagacgggagaaggagatgggtagaggcgggtgcgcttgggggaggggtgtcaggagcacgccagctaaggggagagaaggggtaggaccaaggctggtgaagtggagctggtgggtttcagtgagattccaggcgtgggcagtggggttgagccagtggggtgtggtgcaggggcaggaccggaggcctgtgttctgtctcttacttgatctatatttccttcgttgatggaggaacagggccccggccagggtgaaaacaaggaacattccagagaagatcacaaggatgcgaataaaatcggagctgcacagggatctttgggctgagctttctgtctggcttccctcctggcccctcgtgtatgcattctctctagcggtggggattaaggagaaaactcacgtggccagtgggtagagagagtccgggcaggcagctgcctgaagtcagccagagtctgcatgtgcccagctgtcctggcctccagcatctctggaaaaacagagacagaatgagtagcagcaggggaccccatagggcacatctgaaggcctgagaggtgctggatgggatgggaaggcagaaacaggctgaccttatctaggggtaggagtggggagtactggttggggtatcaccgctaccccacgtgatggcacagagagttgcctggaacttaccactgacataaggtaagtgggtgggctgagggtgtgggctcagggcctgagacgaccgagcggtcagcgaagggtttggaagaggatcacactcggtgcactccttgtccctgcactgccagccattgcgacaggcacactcagcattggcagtgatggtgcagttgcgaacgagaagacctgggggaagagaggcccagggagcataggacactcagacctgtggagaccttcaaggtccacttgcttcatcccccaacccccatcccaggcccacctctagggacgtgcttccctttccattcccacccctgcaaaggcctgccctttgctcacggtccccc

SEQ ID NO: 3708 - DNA, 1422 bp, Homo sapiens
acgcacaggccagggaacacggggctctaggctgtggctccgagtgtccctggtgactggaaagcctgaggggaggctggaagctgatacaggatgccggtggcttgtgagacagaatgagctctttcttcctgaagagggacagaggggagagaagagagcagacatcacactgctccttccatccctgcccgtggcagacatcactaatcaaacttacggtgcctggcagacatcactcatcaggattgcactgccgtctcccactgagcccagaccaaacctcagatccccagcacagcctccagcagccacccctgatctatcagggtaggagcatcttgcaatccagttgccaacactcgtctagagtttgagaactgaatacttgtgggtgtgcatctgcgagtctccctgcccaagcctggagggaatactaagaaatgtgcggacagtgaagagacaggaaaccttgttgcagcagaaatggcctcgatgccttcgggattctttagcctggagagaagagggctcaggggagtcaatgtgtgacctcaacactccaggaaggagagtgggcaagtgggatgccatggacagagccacagaaaaacagaaacctcttctgtgtattaagctgatgctaaagtcagagcagtccaaaggcaggaggctgccttgggaggtagtaagctctctgtccctggaggtatgcaagagggtggagaagtcttggcaaggatgttgaagaagatatccaagcctcagttctgggtgtggagagggagacccagatgatcttggggatttcttccactcttggagctggggagttggggaaggaccaggggtgcatgtgggcagcagagctgacagagtcctggatgcagtgacagcagcctggagacaactcagcttcttttcagaactgtcacgcctgtgctgtgtgtctgtggatggtcactgtcctctctgggcctttgagattatttggtccaacagatggggaaagcaaggatcctaccagctgggccattcttggatgccgtgttagcagctcactcttggccccggcctgaaggggggaacagtccatcctccagtggaccagggattgcgctgtgggttccgagtcctcaaagacatggcagctgaatctccgtgcagcccctgggctttgatgacttctctgagatttgcttttgcctccttgttgcctaaatcctcactttcttggcatcaggtcctggtgcagtgaggagagagggcccagggtctggctggaccaaagagggcgctgggcctggtgttcctttggtctctagagcagcctgcatcctgggccagttgctggggtctctggagaacccacggcacctgccctgagtccaggcgaggatacatcagtccatatttttgtct

SEQ ID NO: 3709 - DNA, 1835 bp, Homo sapiens
ggtgttggggacggagccgtggatacacccatactcaacaggcagagggaatagatattcgacgggggaccggggtgtcaacagatgtatccgagttcatgcgtggcagggagctggcggcgggacccgtccctccagctggctctccaaccccaagcctgcattacgaccacggcaaaatgccagaagcccagagaagcggggtttctgaagcggatcgtttgttcagcccgagtgcgtggggcaggaacacacctggaggtcattaaagagaagtcttcacggggcactcaaggcacactgcaaaacaactttttatttaaaaggccaataatgagaataatgagttgcacaagaatgaaaaccttatcccttccaaaagatcggcctatacattatgtataaagttagaataattctaaatacaaaatgccaaagaccagcgggtccactccttcctctcctaagccatcttgacagtttcacatttcagcttccagacgtcatttctgttgcttttaagggtgcttacccagccgtggtctgtaccagacagggtagttggcacagcgtaggcactgccagcaggcccttgggagcttggcgaggtgggagccttgagaaatagctggctcggacccatggcggggtttgtgtgtcaactccctggtcctcagagaatccgagccacgggagagcaaacgctgcttccaaaaccaaaggaggaattttgcaatcgtttagacgggttataatagaatctcattcagatcttgaaggttatcggtgctttctgcaggtttttattcctcaaaaatgcagccaagctttgctgtgcttatcttggtggatctgagctaggttgggctatcttttcctaattcaattgccttttttttgcaaggaagggggtttctggtccatcggagggatcaagggcatggtcctcacgtctcgtcaggagacaaaaatagacattcagcagacagaccacagccagcgcatgcgaccagcgtcgtttggctattttagtctcttcttaatacacagacaaacgagcaaagaaaaagctactttgtccaacaccgggccctgggttggagtttagccctgcttggctctgcccgctagtctcagtcaggtcactcaccccaggcctgcgggaacggtggtcttggtggtcttctctggcccttccacctcttctgccttgtggggaccacccaagccctctcccgacttgcccagaggctgcacgcctctctggcatcacagtccgcacggagcctggctgtaaggctccactgaaatccccccggcgctggcttcgtgccccaggcacacccacctcacttctgcctcttttctgctggtttctggcctgtttggtcccagcccctccctgcactctctccgcagctgtctggtgggtgatgtgaaccaagggacacccagggtcatggcactgcctggattcagtttggtaatcgtcggcagtctgtccctggcttctgagcctggggcctcctcctctttctccccatcctggatgagcaggacacgctggggagacagcgtcctacaaaggcctcctaagagctgtgccctgtgccaggaaagcctcctgtatctccaaggatgtccctggagccctccagctggtgcctctgctgaggtctgtgagcagcgggaataggcctctaggggaggagttggggacaggcctctaggggagagcacacctccgggtactgcacctgtggctcaccagccacctgcacggggccagcttcagcctcagcagtgtcagctcaacagacgtgactgctgtcaac

SEQ ID NO: 3710 - DNA, 555 bp, Homo sapiens
tccggaccgaaccgatccggattaaggggccggaggcgggtcctgggcaccagcggttccgacccaccccggccctccgcgccgcacccgagtggcccccagccgagcgggcccccacctcctggcccggcctgggcccttctgcgcctcccttggcctttgtccagcgccaggaggccggtcccgcgcccgcgtcgggcgcctggctctgtacgcgagcccggggatctgcggccttcgtgccccccctcccccgcccgccctttcgtggagcccggcgcaggcggctgctgcccgggcggggggttgcggcgctcaggggaggccccggctccgccccgggcctgcccagggggagagcggagcggcccgcagccgggtcgggtcggggcccctcccgggaggagcgtggagcggcggcggcggcagtagaaataatggaagaattgcatagcctggacccacgacggcaggaattattagaggccaggtttactggagtaggtgttagtaaggtgagtaaaatgatgataatgaacactattcatattctag

SEQ ID NO: 3711 - DNA, 2479 bp, Homo sapiens
aacttctagagcgcatgcgtttcgcccacccaggcccgggcgcggttaggggtgactcccacgatccctagcggctgcagagtggaacatggcggcctccttgccgcttgcgttaccagagtccacccggcctcgtgctttctccgggcgcccgtagctggcgccggcatccacaaaaatagatcaggtaaagcagcagagtaaggcataggaagacttggtcgggctccgcggcccctctttaccggattggaggctgcgcgggtgaaatcgagctttaaactcccctggcctcggaacaccatttgtagcctctgaaggaggaggacttataagattctgtactaaggcagccgtgggaagggaggagaaccaggtcggcccgcgcgctcccggctgcttttgctctccctttggtttcgaaagcgtcaagtcccaagacagaggatgaataaagaggaagctccaggctgtgaagcgtctagtccttgctcccctcagaagctgggacatgttggaccaaggtggtaaggatagtgagtttcccagaagctggacaagccacgacggcgccttccaataaaaggggaactccagagacgctatgagaaaagaggaacagacatctgcaatagatatctgcaacttccttttcaaaaacaccatcggcattgctttctcaggaagccactgccagcctattgtgatagctgacactgagttcctgagaattctctaattaggatcccagattggagggtcagccagtggttaacatataatggacacaaaactgattttactggaagactgagggtgggcactcaccatggttctaagcattcattactcagaagatccataaaaacattacagttctgttgtgtaagagtttaggaaaaaaagaaaatcctgacaaaaatcccaacctaaaaaacagtgtcaacatttgtaagtaggatggggaggcagagatgaattggcagtgttatcacagctactggactatgtggactttaacaaagtaagaaacgggtgggggttgggtggtggtatcttaatagagcaggagtagagacggatgtcctggggcagaatgggtaccaatgctgcctgaagcctggagctgggagctgaggactaagaggtagacaggagggtggggaccggtacctgctccaaggaactggtgccccagaactggtgagctggggtatgcatttagctcattcgtttaccagaatgcagtcaccacctgatgaaagaaatgactaatggcaggacttgaacagttctctataaatgagtacctgggagaaaaacaggtctccaggctccacaatacccaataaacacactgcctttagcccacttcaagctgcacttcttacatggaacccaacccaaccaacctcagaggtaagggtgagagcaggcaatgaacagctatgattctccattccctggccaggcagggagcctttccatccaccctcgtgagactgcttgtaacagaaataaggaaaccgactccaaggctcagtaacccacccaaggtcagaaccacggagtggcagggcctgtgagccacaaaggagactgaaaaccagaaagagcttctctctggtctgttattttaagaaaaacatgcccagaggggccacctggaagcaaggctgtgtggcaccctcaccttcctaattaaacaacaacttcccaggagcaacgacagcaacaacagcctggcccagcagatgaactcgaatcaatccaagcccttcccctatacgggtcagtttgggcactactttacctgctgtgaagtctactgggatcttccaggaaagtcccacctcattagtaaaaagaaaaacaaagactcgggaagaaagttcctgccctccctgttgaatgctgtgtgaggataagatgtctggagcatggcagtcaccctgtgactatcagaaggccaggcgtaccacaaggtggtcattccagtgctctgaatcagccccaaaccacttccctcaagactcatgttctgaggtgattaaaagtgtgctttgaaggtaaatctaggatgacagtcaacagatcagtgattgccaggagtcaggggtagagggagggaagaacagatggagcacagagaatttttagggcagtgaaaatgttctgtatgatactatatataatggatacatgccattatacacttgtccaaatgcacagaatgtacaccaccaagagtgaaccctaatgtaaactatggactttgggtgatcatgatgtgtcaatgcaggttcgtcaattgcaacacacgtaccattctagtggggggtgttgataacaggaggctatgcatgtgtgggaccaggggatatatgggaaatctctgtacatgcctctcaattttgctgagaatctgaaactgctcttaatgaagtcttacaaaaataaagaagtctgctttgcctta

SEQ ID NO: 3712 - DNA, 699 bp, Homo sapiens
ttggatttcctttggcagggttcccttgtatggaagttctcaggagaacaacactctcagagtcccactgtctcaaagaattcttaatggacagctatacttggccccaaggtttcaacctcacactgaagaaagtgacataagaaaacacaagtcccagtgctatcaggggctatctggaaaagctgcttaaacagcaagtgaaagaaggctctcccctaccccgttctaggtgaggaacaggtggctggtgagtttttaacttgataggagaatctaataacctcaccacccaacaatactgatagctttcctatatgtgctgaaactgttgacaatacctaaagggaacagccttagagagtgcagagcagggaaagtttatatgtgtttgctagttataaaacagatggcactgttttcatagtccagtgatactgggagatcataaaataaaatgtcaatggcaagacagtgacaatgggggcagtgagcctggcaaatggagatgagcctaaagctaatttgctagaaaaaaatgacttgattaggtcagggaggtggaagaacaaccagttttgagcagagattgtgccactgcactccaaagtgggcaacagagcgagactctgtctccaaaaaaaaagaaaaaaattaaaaaaagatacacaggatatattaagtgaaaaatggattatt

SEQ ID NO: 3713 - DNA, 7184 bp, Homo sapiens
ggcgagctggtcgggccggcctggaaatcctccctggcggggcggggccagaggacctcaccaatcccagcgtagacctccgggcgcaccggcccccacagctgtacccttgaaggcaggcccgtgggcgctgggccctttatagcacctgccctttctctgaaacgtaaaaggcggagccagtcttgcttcccaggcctggtcctggaggctcctttgccagggctctggatctcagaatggaagggccagcaggtgaaattgcacatctgttgggggatttgtttctctcttctctcaggtgtaccagccttggggccctggtgagctctggaggatgaacccctcaagccaaggtcggagaggaggatgtctcaagctgcctggctccagcagctgaccgggccctgagccaggggctggagggacctccttccagcgtctttgtctgggacctggatccagggacaattacagtcaggtttctgttcaagatcaggccccctgcagtagatggctagatcatctcgctttctgtccacaccagcttaacccacggcaggccatagccctgcttaaaaatagccccgcttgggatatccaccgcacgccgggaaggctgcctgtaaatagcaatgacccagcaggattttggacagcagccctgccatttcaagggagcctgcctaggcatctggtgaccgtcacgtactcagcttctgaggccacgtggacatgaccaattggttcctgtctcttccttctcagagcccagctcatgctcagaggacttgatggagcaaggggtggagccccaggaataaccttctacccagtgtggttctccttcattctctgaaggagtttccatttcttttaaacacgacccatgtttaaaaatatcatctattttacctttgcatggggtactgacagggagagcacgtgagggggccttttggcgggatgggaagtttcctgattggggtggttatataaagattgggaccaatcaaattaatttcataatcctttaaggagtcaagacccaccagcttgcatattctatcatcagggcagtctcggtttattccttctcaaaatagctcttttccacacacacttgtttcaagtcagttcaggcaccaactgaaataaatccattgaccctgaaatagcccagctcccagatccagaaaattataaggcttttaaagagcatggaattgtagatttaaagaatggcagttatagcaaaaacctccttttcctccccaattgcctaatcaacatttagggccccctccactcacccgacctcaacaccttatattttatagagtaaatgtttatgttagtaaggtcagaagaaaaattgggtcattgttgagaaaagagggtaccacccttcttttgggggactggtcctcttcaagcttattataaaggtggtgtgatggggatgaaatctctacaagggactcacagtagaaattctggctttctggaaatctttcaaatgccatccctgtcacatggcatctattcccttctcatcgttaccaactccttttgaagctctggggctctagccacaccaggctgccctgtggctggcttctgccataagggcaggaacagaattgaagtgtgcgactgccatatcatttgctttaaaggaaaatgtcctggacttattctcttttctgttcctgagtccagcaggagtgtggctagagcaggccccagatttgacctcgaaggcaaggatgacgccttgtgggatgagcaagtaataggatgaaaggaacctgggttcctctgtcgcaccagcctggattgctcatttcagaattgggcaggagggacccctttccttagtctattcttgtgtccagcaactgtaacttaattccatcagctctaaatgttgccacaacttcatagaagttaaagtattttcatatatagtaatccatataaccactgcagttattttaggggtagacaggagtcttatttcagaagcccctcctaggtggagcctggtgactattaggccaggactctaccctggcggcttctcctctctccaccacccattcaggagcgttgagctgctgtgcaatggactgagctgttccaggtagtagtgagttctctgtgcctggaggtatcaaatataggctggggatgtcacaggaagaatctaagcactgcaaagaaagtgtgattagttgatccttcgtatcatttcaaagctttccccaaattctttgaattttagggcctcttctaaactgtttttctccctgaactttagaagtaatatttagaagtaaataatatatctgaaggagttcactgctatgaagaagatgtaaaataaaaataaagcccctaggcccccaagcaaaacaaaacagactcattgtggtaaaaagagaccccaggaaacattaaaaaccagattctacagctttggcaaggcaagaggtcagtcacacccaacgctctcccacctcgataactgcctcaagactttctttcctaaaattaaactaaaaccagttactgaaaaactatgtctggaagatttcttcctcaacttcaacagacaacctgacgtggcgaacccccccttccctcaacgcagtttccccctgacaagtgttcagccttacaaagcactccatcctcataactgaccacagaccacagccggttctggccggtttacagagattgcacaccaagcgtctttgtgccctgtgttccatcttttgacatatagagcccaattttactacattttaagtctccatcccaaagtgaacatgggttgtatgtaacatgtaacatatatgattactggctatgcatgcattagggcctctcataaatattcataagattatcctataacctactaaatgtatatgtaaggctcatcttgttgggcataaatctcagcctctcccttttttatctgaagtgcttgcttttggctttggccagaggctccagcctgcagattgtaaccctttataagaaattaagttctattttttctaaatgtatacatttcatggttttaagttgacaatgtagaaaaatggggggaaaaagagttaaatgaagaaaccagtgagatttctgaatattcaagaaaggtgaagtttaatttgcatataggcataacctacacctcacttggcaagtgttaggccacagcacaaacccctctgtccaatcacaaatgtccacaaatttgcaaagtaactggacacgaacgatatgcttctcaaactcacacacatattcgtccatcacacacacactcaaatgataaagaaatacattgaaatcctctacaaaagagatctgaggacagtaatcagatgacctcatgtgcggacagcactttgcagtttacagtctaatccatttggtcctcacaatagccctgtgagataagcagcacagggattactattcacaccgttttgcagatgaggaaactgaggctcagggatgtgtaaacaccagcctaaggttttccagttggagactgggcctaggactcagggccgggatgcctaggccagctctctttcataactggctttctagtgaaaaatgaaatgagctgtgtaaaaaccaacatcattaagtataatagaactattattttccttgagcagatcagactagtgctatcaatcctaatgttaatgtcatgctgcatggcagctgagatgaataattttctgaatcgttcatgtgtttatacctacaacaaaatgactgttttccattttggctctgcctcatcttaattttaagtcaccaatggccgctgagaaatgacacactgattagatttcattgacttaagtcttctattacacggtggtatctataatggagccattaaacttacaatctgatttcttactgaaatgaaaaagagttttatttattgattccctctgtgcacattagcctggctatacccttcagccataaatagtatgttctcttttatgccttttcgatagttgtaaaaataatacattttgcaattggatttttaaaaacctttatactttaaagtgaagagattttttttcaaggggataaaatcaaactttgaaaaaaaaaagctaagtaaaatctcttgcttttaaataaaagttaattttattgggaataatccctgtattgcattactcttttcagttaagaatttaaaagctgcccaatcgctgctggcccaaaagtctcgtcttatacaataacatgagagaaagggtgctgatccatcattattcactccacatgggaccataatggatttttctcttccaggtgattcagtttctctgagtttcatttgtttataagtagtactttaagacgtactgaaatttaacaaacagtaatgggacttggtatgagagccacttgaaaatattgcaatggccgtttaaaattccgtctttaaattccttcagaaaagcactaaggaaaagtgacgacgttttacttcatgcctgaatctgtcaaataatatattggattaggtaagagatttgtccctgtagcaaaactagatgtctcagttaataacgaaaaggcatcccctaaaagctccaagataatttcgttgacagtacaaaatgtgggcattcattcgaaagcatgaaattggatttttcttctgattttctaggttaattttacagtatacatgttcgctacttggctgttagaggttgacctcccatctcctcttagaaatgggtctccataatggactagaggcagatgcagctgggaatgcatgctttgtgtgtaggcagaagaggatgggtactttaacgaccagaaaaaacactgcaaattgctcttggggatttttaatttgaccaaattgaagggattttaaaatgtgcattcctctcccagctggcacacgaatagtgcaggtcatcaacagacactccctcagaggtggagctctctctcttgccctcttgcagctccaggaaggctgcagactccagaaagtggtgtaattctcaaacaaaaatgcgaaaggctagtgagtggcacacccctgcagtcccagctgcttgagaggctgaggcaggaagattgcttgagtccaggagttcgagaccagcctgggcaacatggtgagaccctgtttttcaaacaaacaaaaaccccctaaaagtcagcatagcaattgacagtgcctaatatgaccagtgcggggcagttccaacatcctgcaggaaataggcgcaaaagctttgtcactagttgaagaaaagctgcgatccaaaagggaaggagcatttggaaactcctgtcttattttttgttaataagaatggctgcagtgtctctggaacatttgggtcaaagaaatgagtccgaacttccagaaaaagtgcacacagaaccatccctttccctctgaaggactctggcaactccaaggcagagtagaatgcatgcacctttccacgtgttgtttggcccgaaactagtatgtgtgtggtcctctcacagatttgtcccggttttagttcacccttcaggactatgcttttgagccatgaaagctaacctttacttttcttctgcaagaccttgaggtgtttggtgcaactgatacatattatttcaaaccctcagtttctggagcactgagaaataaatcacaagttatgcgttgttaggatccaaacagcccatgcttctcatcatgcatcaagatgcgtcaacctcttatttgaaactaaagagaacaaacaagcaactttaaaaaagaaaaagaaagcatccataaggaaccctccttgggttgagtgctacactgttggctaatatgaactattgaaaatattttgggaatggtcttcaaatattatattttcttttacttagttgatatttcactatatagttacatacagagatggcacttaccgtgcagaaagtgtacattctctacctctatggtgcattaccaatgctagctctttcactgagtcttaagagccagcaggtggaatttattagtctgttagctctagcaacataattaaagtgcaaggaaagagggaaagcagccagacagatccatttttcattgtcagcatcaataagtttcatgctgctaagagaaaatgtcaggtgcaacaggttcagggaaatagaactatattttttctcttccttcttttaaagcagcagtctccctgagaagagaagagggaggtaaacaatgagatagccctatttcttcaacaactgacaatcttgggaaaaggaaggtcacttccccagcctcaggtagcaggactaacccttgcatttggttttgtaatgtaagagctgttcggtggttgggcccatttcccatgcacttataatattctcagagatctctcaacatcagtttttaaagaaagagatctacgaacagcatatggaagtgtgggttttgaaaagaaaatttcactaaactgtttaaaaaaaatacagccaatgttcatagtaagcctaaaaaaaggtctgtgtaaatgagaatagattcctgcagtactatgagtggggaaagaaaacaaacaaagcaaggtgcagagatgatttttaggtatagattttcactcagcactgaaacccatgattccccacagcacttggtggccttctgttccacagttttgtcggtgagatgggcgtgcacctttttgcagctgcctctccaaaagggctggcttcttaggaccaacagtctcaaggaaaagctccccacccacctcagccagccactgtctggaatcctctggggcacagcctactgcatttaattaaggaaatgttacatacaaatccatttgtgtttcattctttctttcctatcccattgcctaaagactggaaaggcagtttcagaaggtaccattcctcacatagaaatatttagaatgcactgacaaccatgcacatgctgtagactgaaattgcttatgttttggtccatctctgtagaggaagtgtcagcttttctgtgaagcttataccaaaaggaaatgtaatggaaccagtcaaatcctagaagattggtaggtgtgcccaggccagtaaagcgccagagaaacatc

SEQ ID NO: 3714 - DNA, 5536 bp, Homo sapiens
cttgctaagtaatgaaggtgaggaaaagcttaggaaatatttcttctcacttatttcacttcaaaatatgacatttacaataaatataaatatttcaaaaagtggatttttctttaccttcccactgattttaaaattcaatcctactcttgaatactaaagaggctcacaattttggagtgttaaaatttgggatttttaatgctttttgatcgtcaaaactacatagaaaatcgtttaagtttttagattgcaagtcatcaaatagtcttaaaaagatccatgtgtaaatgtatatttctagtttactagaaagatgtacatatactaaacttgaagaagtccatcaatatttagtatttatgttctcaatcccaggcctaaacccttctcttaagctctagatctgcactatccaatatggaagccaccagccactatgactctcaattcccaaacttgtatatgcaatgatggtatcattggaatggatggggtatgaactattttctaaaatttgggggatgtattaattattgtacatttatttaaaatcagtctcaattcattattatacctcagatcttaaatttacataaatctgaggaacataattctagaggcttaccatttttactatatcagaatacgctgattcaacaattacaccacgattagttgaaacatactcaaccagttcattcagtgttgctcttttaatttctttgctcttcaagtctgaaacagagtccatgaaatcaaacagtatacaacactgctgcaacttctgacagaaaagctcttgttgttcatttgaagtggcatctataaataaaaataaagaaaaacttagaaataacctactcagaagttacttttatatatttattaattttgtagaagctattcacatatgtaaaacttcttccaaaaatctagtgagaaatgtgcccatctataaccccatcattcagggatttatactggactcttctctctccctcattactcacaatcaatcattaaaaaaatttttttaaagaaatatggtcttgctacattgcccaagatagactcaaactcctaggctcatgtgatcctcctgcctcagcctccagagtagtggagattatgtgccaccatatccagctaatcattaaatgttactgattcggcgtctttaacatatttgaaatctattcttgtcattcccgctgccatttcagactctcaccatgcctcatctggactacagcaatgatatgctaattgctcctcttatctggtcccataaccattaccactcctgacttaccctccaaacaacctcaaaatcttgccaaaatgagaatcggtgtgttcaagttccatgtttttcaatgatactccaataattaaataataaagttcaaactcctctcggctgtatacaaagtacagctgtctactgtcaagagtcatctctcaaccctttccaacatgcctcttcattttggttaaaccatactctctgtagttccctgaagattacacaatgtttcctctgtctggaatgcccttcttcccacattcccaccctgggaacactacctacttacaaagtttcagcgtaagtcccttctttttttttaatttttatttttttgagacaaactcttgctctgtcgcctgggctggagtacagttttcagaagctttccttatggtactgaagctaaattggttggtttatccacttttacccaaatgtgttttaggtgcatatctctgttatagtatttactgtgctttacagcaattatattttacatactcagcacccctcaactaaaagcaggaaccaacggctaggcacagtggctcacatctgtaatcccagcattttgggaggccaaggcgggcagatcacttgaggtcatgagttcgagaccagccttgccaacatggcaaaaccccgtctctactaaaaatacaaaaattatccgggcatggtggcgcatgcctgtaatcccagctactccagaggctgaggtaagagaattgcttgaacccaggaggctggggttgcagcgagccgaaatcgcaccactgcattccagcctgggcaacagagacaacatctcaatcaatcaatgcagaaaccaagttttacttatctaattatctctgtctttctctctctctacttctctttctctttctagtatctaatacaatgcctggcatataataggcactcaaaaaatgggccggtgtggtggctcatgcctgtaatcccagcactttggaaggctgaggcaggcggatgacttgaggtcaggagttcaagaccagcctagccaaatggtgaaaccccatctctactaaaaatacaaaaattagccaaacgtggtggcgggcgcctgtaatcccagctactgggaaggctgaggaaggagaatcactggaacgcaggaggtgggggttgcaatgagccgagatagcgccactgcactccagcctgggccacagagtgagactcaagtctcgatttaaaaagtttattgttttatattctacttattacaaaaatatggacacactgtattgatttgattctaacaaatgttaaatccttttgtttctaaccttcaaaaccataaaacttcacttccgaactttcattctataaacaaggaattcaattagttcaatcacttaagtttactgaacttctgaaagtaaattttaaaaatcatattcaactctgatatttatctcataatatacaaaactatgcctctattcaaaaccagtacatactttatataaagatacaggcagaaatcttcataaagatgataacctaatcaagaatgcctatgcttcgtaattactccagggcaggaagctagtaaaattacctttcaattatattcaagttgctgtccttaaaaaagctgatttagataaggtactgctgaaccgtagtaggtcaggtattctaagcatgctcacacaaagtcacaagacataaggcacattcttttcattgatcaattattattaaataattttacaataaaacaaatgtggatatattacaaagaacagcaaaagtcacatgatttttgaagtaaaaatatgaagacttgaatttgctgcagttcatttgtggctatgccagtaaaataagatagctccacacttacaaagaacttgtattaacatttcctgttccagaatcaataatgactctctgctttatgaaggttaaagtctataagcctaagattggcattcagaatccatgtaatattgacatatatgacattttttactaccaatttggtaaagtttttgattcagggtcactttttttttgagacggagtctcactctactgcccaggctagagtgtggtggcgcgatcttggctcactgcaacccctgcctcccaggttcatgcaattttcctgcctcagcctcccaagtagctgggattacaggcctgcaccaccacgcccagctaatttttgtattttttttaatagagatgaagtttcaccatgttggccagcctggcctcaaactcctgacctcaaatgatccgcctgcctcggcctcccaaagtgctgggattacaggtgtgagccacctcaccctgattcaggatcaccttttatggaactgttcttaagtgggaatatttttatgtatccttaaaaaaaaaaaaaacattgaatttgcaactatttttaatactaagtaatatgctaaacagttatctttatcccagaattaaaattcattctattgggggtgaaaatgaaccactagccaacatacatgctacacataaccagcagtcttatgtttactacctttttttaatcccaaaatggccattagtcattctaagcagaatctgcttcttctctgtaaaatcagttgtatcttgaatggcccttttcttaaatcttctggggctttttacccttaaagttaaaatggttatgtgcatttaattttcattaataaatgatgtctgctaataatttatttcaactaacaaaaagatgtctgcttgatattggtacttagtttgaaaattagaagatggacacctctgcttatgtatgtactacacactaaacgagatacatgttgactatgtgggctataagaatccttctcaatccatagtgtacaggaaatccccatagttctctcagttattcagtaatatctttatacagttatctattttcaaagatatctatatccctaatatatggctttattttataatatatatctttataattaatataaattccataatgatgacttggtgaaacagttgccatatcttgagaggctgcgttctaaaagagttttaagatatattttagccctttttccctaacgctaatagtaatacaaactcacacaagatcccacttcaattatgtgatcaccttataccgccagtcctattctctccttcctcccactaccacctcctcaatgtgaatgaaaccagccctcttattctctgaaggccgtgtctttgttcaaagtcttttccctacctgaaatacttcactagatttcctcccctatctttccatatcctacttgccctttaagaacaaacttaatctcacattctccacaaaatttcccttaggtaggtcaggatacaatgatctctcccatctctcatgatctatagtgttcacaacttcaattacgtatttgagtacccattatctttaggcctatattcaacagatgtttctttcatcaaccaccaaaagatttcaggctcctcaaggggaaggattattcactgagcagggtttcctttttatttcttttttatctagggtagggtatataaggagttaataaatatttatttgatgcttgaaaaaactctgaatttgaagaataagatactgcactgaaatacagtctactgaacaaggagaagttcaaaattggtgctggatatcaacagcgacataaataatgaattattacaacatggctatgtttaagaattaatcatgccaggtgcggtggctcatgcttgtaatcccagcactttgggaggccgaggtgggtggatcacaaggtaagaagatcaagaccatcctagctaacatggtgaaaccctgtctctactaaaagtaacaaaaaattagccgggcatggtggcaggcacctgtagtcccagctactcaggaggctgaggcagaagaatggcgtgaacccgggaggcagagcttgcagtgagcccagattgtgccactgcactccagcctgggggacagagcaagaagactctgtctcaaaaaaaaaaaaaaaattaatcataatgaccatttttatcaacaatctaccttgatggtagaattaaatggattgagataacaatcatgaagatgagtgcatatatttcaaggtgaaatacaaatggaaagtatgtttttctaacactacaggctaagtagcctgtggccagcaaaaaagaagacacaaaatgact

SEQ ID NO: 3715 - DNA, 848 bp, Homo sapiens
actgccctccagcctgggcgagagagtgagactctgtctcaaaaaaataaaaatgtgtatctctgtcattgggattcctataagcttgtgcctagacaggatagttattttatctttaagaccctgttaaagcctgcctgaggtcttatctgcattcccctgtgggctgactcagcacctggttgccttgtattctcctgattatgaatctttcaacctctaggacatggaccattaacgtttagtatacttggctgtagctactttaagcttagatatctgccttcgaatattctaccttttttaaaataaaatataaatgtctagtgattctttcgttgttgtttttattttttggagacacggtcttgctgtgccacccagactcgagtgcaatggtgtggtcacagctcactgcagccttgaccttctgggctcaagtgatcctcccacctcagcctcctgagtagctgggactgcaggcgtgcaccaccatccttggataattttttattttttagagaaatgaggtctccctgtgttgcccagtctggtcaggctcaagcaatcctcccatgtcagcttcccaaagtgctggattacaagcataagccaccatgcctggctgtatcctgctttctgttataatagagtggattttgtcatcttgatagcccacacaacgttggtccgtttctttgatgatattatgctaattggacctgacaagcagaaaataataaacatcctacaagacttaataaaacacatgcatgacgggatgggaaggaaatcttgaataaaaattcatgattgaccacattcgtaaggtttttagggtctgattg

SEQ ID NO: 3716 - DNA, 2435 bp, Homo sapiens
aacggtcaccgggattcctggaagagacggggatttgggggaaacggagagggttctgcgaggagacgggaccagtgagacaggcaggaccgggtggaggcgtctctacgagcaggagggcaaggaagatggggcaagacgcggggaggctgcagaggaggagcagggtggggtttggagagaatggagcctgcagaaaggagcggcagaaactggcgctggaaggctcaaaaaaggggccctggaaaggacggagcggggacaggaaagggaaaggggcaggaggagctgggcagaggagcccgtgtaaacacagagtggcccatgcccaggatgagggacaggtgcagctttcattctctacctcgctgctcccagtcctagggctcggactccccagcctttccgcagccgcatccacccaccatggcctcagggccgtgacgcgcgtggggagggatgcggctgggggctgagcagcggccatgagtgtggacgggggagggcggcattcccgtctggcagctctgtttgggtttctgacggggcctcttcaaacctccaggggctattctgggcctgtccgagttgggaattccccagagacctggaacttgctctccacagccacagccttggccccgccctgtatctgtgctgccgccagtaaggctgcccctggggagggcggagccagaacctcacagcctcacagggcagagcaaggctggattgacggacaccaggccgagaagaaacccttggggttggcggcagttcttagtgagggcaattcattcaatccagagccagaaacaggattttatttaaaatttattgtaatggggtccgcgcaaaaggaaggggtggagggtggggtacatgcaggggacacaggaacacgatgacatggccagggccacaacttcttctgtcgtggggaagagggatgaaaagacaagaccagggctggagctggggtggaagaggggagggggacactggctgcattcccccgcccccaggaagcacctctaggccctggacccctcgctcaccctggcccctaagactccatctcttctctgcctctggccctcctggctcttcctcctgctccccttgactttttcccctgacagattctcaagtaggacgatgttcagggcctgaccccaaccccccataccaccttatgaaggtacaacctttgccggccctgcttctgcccctcctcaaacctcaccgctttccctctttgggacagctctgatccccctccttcctctcctccctccccctggaaaaaaaaaaaaaaggaaaagaaagcaccaactccccggggaggggctgcagacagcagggggagaggactggaaggagagaagaggaccgtcgagggaagaggctcacaagtccctgggaagacagggcatgggcttacagagaggagagggggtacgggcagtggctgctcgtgtcctctgccacccctgcccactgtccaggggacttcaacacaaccgaggggacaggtttgtgtggggtcaggtctgacagaagaggagcaggagaaacaaatcgttaaaacctagcgaattcccctaagaaaacatttcttcctcctttccttctggaggctccttggttggtagggaaataggagttggtgggaaaagaggggggagaggagcttgtaccaagggactctactccattctcccctctcccccgcaaccaacttggagctcaccagggttgggagggaagtggctgagagctcacaggcaccccctccgcccccgagagggagcccacagctgtgggaggggctgctactgctgccgctgctgccgctgccgccgctgccgctgccgccgccattggacaaacctcaccagtacctgcacaggagaaacaccacggatcacagcgcgatctgaatgggtgcgtgctggtaaagcccggcccgtgtactccacctgccccaggagctggagacaagaccttgtggctgcgcagcggaaaccttgccttgtgacccctggaactggctttcttgactactccttccccagagcagccaagttccactcccgctttccccacacattaccaggaggttcaacctctctggcagatcatctcttccaaccaggacttcttagagtctaatgatgttcattcaggtgtccccccgctgctcccttgacctcttgtaggaatctagacgccacgagctcttggctacagcacccttaacccgtatccgtggcaaggcgtctggccaggcgcccaccctctgcccctggccctcccggcagccctcggcatgtacctttgttgcagagctcacagacatggtgaggaccctggctgtgcaccttcatgtggtccgaaatataagccgagctcagcatcttgccacacacgtg

SEQ ID NO: 3717 - DNA, 248 bp, Homo sapiens
gtggcggcgaacgcggagagcacgccatgaaggcctcgggcacactacgagagtacaaattaaagaagatgaagaagtcttcaggggagattgtctactgtgggcaggtgtttgagaagttccccttgcgggtgaagaacttcgggatctggctgcgctatgactcccggagcggcacccacaacatgtaccgggaataccgggacctgaccaccgcaggcgctgtcacccggtgctaccgagacatg

SEQ ID NO: 3718 - DNA, 267 bp, Homo sapiens
gttcgtgctgaaggcctgtatcctaggctacacactgaggactctgttcctcccctttccgcctaggggaaagtccccggacctcgggcagagagtgccacgtgcatacgcacgtagacattccccgcttcccactccaaagtccgccaagaagcgtatcccgctgagcggcgtggcgcgggggcgtcatccgtcagctccctctagttacgcaggcagtgcgtgtccgcgcaccaaccacacggggctcattctcagcgcggctgt

SEQ ID NO: 3719 - DNA, 1181 bp, Homo sapiens
gcgtaaggggcgagcgcggagctggtacctttgcctgaggtttccgcgcggggctgtggcgccgacggatccatccggccagggggaggggccgagcccggctgcatgtaacacccggaaggcggcggaggacagcaaggtggctggccggcaggccaatggcggccaacgccacttccggccgccctccgagcatcgctcttcggcaacccgaagccacaggatggaggagggggatcccagcaaaggtagcgactaaggggacccaagcagaacgggagggcgacgtccggagcggcggcagagccaggggacgctgtgtgaggctggcaaagcggtgttcacctagttctctcgggctccgccgccgccggaggaggacaggaggccggcaaggcgacccccaaatcttcctaggctctgacttccgtctcctaacccccgcaaattccaacccggtcttggaaaatcccgcgagaacgggctcccgaattgtcattgggatctcgcgagaacgaaatcttcctttctgtgggcggagcaatcttcccgatgtctcttccctctgaggccagtagcaggaagggcctcgggagttgcgagtgtcgcgaggtttgaggtcgctcggtgggccgggcgctgtgcgaagctagaaataactgggggcatggagaatgcggtggctgtaaagggccgctgaggcggtggaggcctggcagagagcgtccccgcggtcgcggcttctggcttctctgtggagcttggttcttccgtggtggtgcagcaccccaggaacttcaggaaccagtccttccttggagagctccccgggacagccacgggggccaagtgaaactagcgcgttttcttggatcctacactttatagtgagtcataaatactttaaatacaaagccaacaacatttgctgcaaataaacgtaaaaatactgttaaagtgtaaagtgttttcctccgtaccatctgacgtttctggcggttcgttgaacgcgagagaacgctgagccgtctgcactgagcccgggagcatcttcagggcagcgccgcccacgcgcgaggtgaatgaaggacacggcctcttgacactcccaggcagcacagatagacggatcctggctagaagtgaccccaggatttttttattatcaagagagactagaa

SEQ ID NO: 3720 - DNA, 2919 bp, Homo sapiens
gtacaatggaagcccttctgccttgctcaagactggatgtccctcttttctaacttgcctaaacaccatcggcacacagcacagtcctttgagtgggtctcacactggacacagcatcgaggagcttctccacggggaagtgtgtgtgtgagagcctgcctgtgtgtcaacactgtccaagactcggagctgcgactcggtcgcgtggtgcggagtccagggctgagaaggcagcgcactaaatatctctgtatcaggtggacccagccgaactccgcagcagcccaggccagcgccccacctccgggtcaccggcatgatccgcctctccccgggcccccgcggccctggcacccgaggtcagcgggccgtgggtacagctcagccgcggaccctgctccgcgagtgcgggagctttggacttgaacgcgacgtgctcgcccggctcccaacaaacttgcaatttccgcgcgcaccccttaaacaggaactgttccccaaaccttgacccagctaccccgctgtgctctggcccgcggacctgtgtccgaacccgggctcggctgccggaaccggtttgagaaaacaaaagagttgtggggcagttttccctgtggggggcaggggcgcctcccaggtccctgcaccccgactcccggctgctcccctggcaactaatccggagaagggaagtggtgccacgagcccccactgcccggggagggagggagagagaagggggaactgggaaataaactgaattctcttactctgcctccgttcctggaccccagacacacccccaaagtattccacggttttctcttattatttttttaaacgccccccggcaaacctaggcagggatccttagccgcgaacagcaggaaggaaagaatccgagcaaatcgtgtcactttccgcacaatcgcggtgtttggcaagcccccggagctactccacaatatttactacccaagcgcacgcaggctgcagcgggctgcgagccgagcgcgcccgggaccggcctccgccaagccggccccgccgcggcccggccaccgccgctcccctcccaggatcaagcagcaagaacacggtggaaacaaaagcagagcgttcaccttgttgcaatatgttcagcaaaacaagcttagacggaacagagtgaggtgtctgggctcaggagtaaaagaaacaccttccttccctcacatccgtttgtggtttgtttaagaagaagaggaaaaaaaaaaaaaagaggggggaaaagcgctcaactctcccccaagccgcggcgcgcacccgtcggcgccgagcgcgcagcctgctccaccgccgcctcttggtcccgccgccgccgctgccgccgccgccgggcagctggacgccctatagggctcttggcagtccacgaaagacctggagtccgcctccccatttctccggtcggtgagtggcaggaggaaatcgccaaacatgttttcccgctttgcctccccaactcggaaacttgcaacttgccgtgtcctggaggttgagacaatttggggtctcttggctgccgtccaacagatttatctctgagggcagtgtccttggtgagaggtccaagtaggtgtgggcgacattgtcctccatctcatgagggagcagccctgcacactagggcccaaaactctgcgaaggagcttggaagttcttcatccgttccacttgttttgctactccacacacccttctaggacatgttgattgccaactgctctgtgcagctttcccatagctgtctgttcccgtgcatttcggagcaccaagcaaatacgagcagagagacctggaaaaaaaaatgatgaagacagtattaatgataaaattaacatggctgagtgaattgtcaatgcaagttcctttactaactctttgttaagttttgctttgtactccttacatcctctttctcttaagccattgttttaatttcttctcgttatcatttttaaaagtaacagaaatacagctttcttcctaccttcacgattgacttggtggaggttgggttgcaaagaggaagcagtaagaaaaaataattattctatacattcacaagtccttcaaggcacaaaataaaagtaagaaatagaaaatatgtcctttctcctaataaaggtctttataataaaatttaaatgaagttttgtgtttcataacagcttcccaaatactgttgtagatactaaaatgtgcctgtatgtatttccttccacaataataatagtaataataaacttttttaggtccaaattaaacatttctcagcttaaatttctatcctcaatccaacatttattatatcaaaacttgatttttaaaaataaaactttcttggaattcatcattgatgtctgtttgatggcctcgtgaacatcaggaagatgaaatgaaatggttcaagactggaacaataccattatctgcatcttgactcctgggagataatgatatctcctgctttcctctacagacctaccagttttctctgctttaagggaaaatccaaatgcatgagacctgtgcattcttctacataatcaagagtctggtttcttccatcggagtgtatggagttaaagtggtatactgtacatggcatggtgtgataggtgggaatatgagctactgggggaaaaagttcttacttctagccacttatacaaagagaggccatctcagtgtaatctgaaaaaatgctcactttataatgctgtatccaaggcccatcaaaaactaaatggatgtatttgtactaaaagttggggaaagttgaatatctaaacctctgagcaaatctttcttaatttagaaaataaaatagagcatcattgtaatacttttcagtttcctggacattcaactcca

SEQ ID NO: 3721 - DNA, 1638 bp, Homo sapiens
agacacagtctcgctctgtctcttaggcatgatcttggctcactgcaacctccacctcctgggttcaagtgattcttctgcctcagtctcccaagtaggtgggactacgggtgcgcaccaccaggcccagctaattttttttcgtatttttagtagagacggggtttcaccatattggccaggctgttctttaactcctgacctcatgatccacctgcttgggcctcccaaagtactggggttacaggcgtgagccactgcacccggctggaaaaatattattctagttgtttcaaaatgacaagtaactgttgatcatcttccgtttaaaataaaataatgttgtcttaatgtattttcgtgtctttttgaatatttatctaattttaaaggtcaaacaggatttatgcatcatccatcattttttacgtctgagccaccaagtatttatcagtgggtgagttcttgtctgaagggcgaaggaatgccgccttatccttacctccctggaatctgtgaaagaagcagacttgtagtcttgagtattgcactgtacatacttggtgatgagagctcagtttctgatgaatcctcacagtatttaaccagaataactgtagccccccagaagttgcaagcagaacaagaggaaaacaggtttagtttcaggcattctacgtctgtttctagtctagctgaaagattggttggctggatgactaatgtaggattcactttaagagatttggaaactcttccctttggaattgctcttcccatcagagatgcaatttatcactgtcgtgagcagcctgcctcagactggccagaagctgtctgtctcttgactggacgtcaggatctttccaagcaggcctgcgaaggaaacttacccaaagggaagtctgtgctctcatcagatgttccttcaggtacagaaactgaggaggaagatgacggcatgaatgacatgaatcacgaggtcatgtcattaatatggagtgaagatttaagggtgcaggatgtgcgaaggcttcttcagagtgcgcatcctgtccgtgtcaacgtagtgcagtacccagagctcagtgaccacgagttcatcgaggaaaaggaaaacagattgctccaattgtgtcagcgaactatggctcttcctgtaggacgaggaatgtttaccttgttttcgtaccatcctgttccaacagagccattgcctattcctaaattgaatctgactggtatgttaaattctgggctcaatgagaaaggaaaatgattaagtacatgcattaagtgtagttctttaaattagttaaaacaaaagaaatgctccctctatccccagtgatttaaaattttcctaatagctgctgtagtggttatcaaagctcaaatgccatgtgaaactaaactttgagagaagcagaatatagttcattactcatttttgctttttaatgaggtgatttcaagatctaaaaagtcacttggagaagttcagaaagatattattgataacgatgagacttgaattttaaataatcttaagtttaatatgtaaaaatatttagttttaaaatgtcttacgtcatagtttaaacagatgatcattgtataaatcaagaaatgtactaa

SEQ ID NO: 3722 - DNA, 1940 bp, Homo sapiens
ggcaatataatgctaccaccataaggtgaggctatcacgcaactataatagttctaaattcctatgaaaaatataatcagttaaaattttttgaactccttactttctaaataagaaatggctgagaatatgaaaaaaatgccaaggaaaactcagtgagagaagacatggaaagaaatagaaaaggacagcttagcccaacatgcagaaagaaaaaaaaaagttaaaagaaaacaaaaacaaaccttggcacaggagaatgaggatagtgtattcaaagtcatcttctctgccctgaagaaagcactactggataaatatgacaatgtttccttattttgtaatcttgggtgaggaactcttttaatttgggcctagagtcttaggttttcatttgcattcctcagtgatgtctgtcgccaagttacctatagtaccacctatcaggaaataaaactccttagccccacattcgtctacgggaaatacagcaggaatacatgttatgagggatttgttttatttttccggtcagcaacagtcagtgcctccctaggataaccccatatcttcctatactgctacaaaacatttcttaatatttttcatgataaagcttaatacatgtgtttgttagctaagttatataatatcaagcatggaaaagcaggtgggcctgtttcttttgttacacttcaacctcaattctaggtatattgtagttgtactaatcagacttaatctgcaatacaagtaagttattatggggaaggcagcatgttttaccaaagatcgtggatcgatttgtatttatacatatttcctcttctcatctgaaccattattggtttacatatatgattttggccctttttaggaactgttggccgatccatcatctcttacgattgggctctcttgttcttctgttcagcactctgattttccttggggaaaccctcccccacttttagttgatggtttctggtggtgccggttccacccctggctctgcgtggtggacatttgacccagacctggtcaaaaagagtatcagctgctcctggttatactaatcggttcaaggatgggcaaatcagaacagtgagactcaactgtgggtctttgggattacagcaaaaaagaatcttttttcccctgaacaaaagctagaagaaggtaaacctgaagatatttatggccacttacgggaaatcctgtctaagatgaatgctaacgcagaggaaaaccaagccaagatatggcaagaaactaaggtctgattgaattcttttagcccctgaagcagacatgtctgaaagtatgatttggccttccacagatacacatacaaaagtaagtaaaaaggaccatttaaacatcttggtgtaattcttacagattttgaaaaattttaaattcatccatcacacctggcccccatcagacataattagaatctctggcagtagggcctggaatctgcatttttagttattccctgagtgtttcaggtgatcagctaatttaaagacccattatgagttattgactaaaaattctcactcttctcgaacaccatcaacaggccatatggagtttacatactgcgctagaggcttcctagagagtagactataaaatagataaagtaggttaagggctacaattactctccttcttatttatttatttatttatttattcattcattcattctttcattcattcgagatggagtctcactctgtcacccaggctgtagtacaatggcacgatctcggctcactgaaacctctgcctcctgggttccagccattcttctgcctcggctcccatgaggagctaggattacaggcgtgtgccaccacacatggctacttttttgtatttttagtagagacggagtttcaccatgttggccaggctggtctcaaact

SEQ ID NO: 3723 - DNA, 2399 bp, Homo sapiens
ctggtctcaaactcctgaccttgcgatccgcccacctcagcctctcaaagtgctgggattacaggcgtgagccaccgcgcccagtcgttattttcctttcattgttgaccaggctcactcagtttttcctgtgaaagttaggcactgatcaggacaaagcatgcccctgggaaactggagcccacacgcatgtctacatccagtggtcagttctctgtctaccttccctgaccctccagcttcagtgacagggtgggacactcccgcttccatcacacactcctcacactgctgcttctcaagctgcacttttttttttttttttttttttttttttgagatggagtctcactctgctgcccaggctggagtgcagtggtgtgatcttggctcactgcaacctccgcctcctggggttcaagtgattctcctgcctcagcctcccaaatagctgggactacaggcacacgccatcatgcccaactaatttttgtatttttagtagagatggggtttcaccatattggtcaggctggtctcgaactcctgacctcaggtgatccacccgcctcagcctcccaaaatgctgggattacagacctgactactgtgctggaccgggcattacattttgaacccaccttcaactgccaaccccaatccacagcttgcttcccccacgggcttccacatgtccataagtggcaactccagaccttgggattatctctctctcacatgccttcatccaaatcgtcagccaaacttggctctacctgaaaagtatatgcagaatccaaccacttctcggcagctccatcaggagctcattgtctctcacattgcagcagcctccagataagtgacctggcttccactcagccccatttcagatcgagtcttgattctgcagcagccagaggagttctttttaaacgtttatcagatcaagtcactctgctcaaaaccctttcccgggccccccatttccaaggccccacatattctgtatcccatgacctctctgacctggtcttcctcctcctcgtctctcttctccagccccaccagcctcttctgtgttttttgactgggcatagccacactcagagcctttgcattggctatgggatgctccatggcctccttcagcctttggtcaccttctcagtgaggcctgcttgcaaccccctcccatgcccgttccctccatcccagcaccctatatactctgtgttttacttatttgcttactgtatctcctaccactagaacattctctctctgacagcagggtagtgcttactcctgtatccccactgcttggcacatggtgggcacttaataaatgtgctgaatcagctaggcattgtggcttatgcctgtattctgagtactttgtgaggccaaggtgggaggatcacttgaggccgtgggtttgaggccagcctgggcaacaaagtgagacccccatcgctacaaaaacaatattttaaataaaaaaaaaaaaaaaaaaaaaaaaacaggcggggtgcagtggctcacaactgtaatcccaacactttgggaggctgaggtgggcagattgtttccaccgaggagttcgtgaccagcctgggcaacatggcaaaaccccacctctacaaaaagaaaaaaaaattagctggttgtggtggtgtgcacctgtagtccagctaccagggaggctgaggtgggaggatcacctgaacccaggaggttgaggctgcagtaagctgagatcacatcactgcactctggcctggggaacagaatgtaactctctcaaaaacaaacacaaaaaatgcaaagaacccccacaagtatgaaattaatgactgaagtggaatgaagatacatgaaagaattcagaggaattagatccccaccaacccctagcctcttctgcacctcctttgcctgctgaagcaatgtgtcctcccctgaaagacaccatggacatcatgaaggagttaccctgtaagaggaagctaactcttctcatggcccctcctcccaattccttatgatttccagagcttttaactagagagatatttcagcatgtctggagaccctttcacaaagtcaagcccagagcaggaggctcacatatcaaaagagttgcaagactgttattttatgttggccaaaatatagagaatatgtgtgggaacagactgaagtcctagaccaaggagataagaacataagtttatattgggctgaatttatcaatatgggtgcacttagcaaggatttggattccatgcaccagctcaagctgttgggggttgttccacacgtctatttggttggctgaataaaaactggatcccagccgggcgcggtggctcactcctgtaatcccagcactttgg

SEQ ID NO: 3724 - DNA, 2108 bp, Homo sapiens
acaaactttcttatcttccatcgcggcgacctggaggtccgaggcttcgtgctgcggttgaagggtggggaatacgactaaaaactgcagcccagcgcgcgcgagacgacccaagacccacgcgcactcgcacgagcgcgtgcacagacttggagcacagaccctcccttcagatccgcagtctctagctccttccagcagtagattttagagtggccagcggagtcttatgcagccctttcaaatgcccttggggatctgccagcttccctccctgcacccagcccacctccccgacccactcacggttgaggaggccgagctgcaggagtgaggccagggcggtgaggatcatgaagagcagcagccctcccctgcgcccgaggaatcggaccaccacgcacatggccaggcaggacaccagcgcgatgctggccgtggtatagtagtcagcatagaagttctccaggagcggcaccttcacctcgtggcccatcatgctcctggcaaagcagtggtggatcccgtaccccgtcagcctgtggagacataccgagcggcagtgggtgggctgcccccatgccaggggctgcgctgcctcctgggagttcgtgctgtcaggtgaccaggagatgaagaagcaactcaatgtgtcatagaaaagcccatcatgaccgaaccacgagcagattacagagccaatgcaaaagaggagacgtgggagaaatatggaatgcttctcctgatggaggtccaggctcatgccccactaccatggctttaatagacaggtgtgggcacaagagcagtgagtccttttgttaaaacacacactttcatgggaatcctccaagacaaagcgctttccaggtactgactcatttaacccagggccgcaatccaacagccactgcacacccacttcacaggggcaggggggcagagcagctcgcacgaggctctcggcgggtaagcggcaactcagagacgcagcttttctgggcacttagggttctggaagggtggagatctatccataccagcctcaactccacccacacagcctggaggagtcgggcagaagccaggccaatggaagacatatagggtccacaggaaactgtttttttttttgttttgttttgtttttgagtagagccgtgttctgctacccaagctggagtgcagtggcaagatctcagctcactgcaacctccccctccctggttcaagtgattctcctgcttcagcctcccaagtagctgggattacaggcacctgccaccatgcccagctaatttttgtattttttggtagagacagggtttcaccatgttggacaggctggcctcgaactcctgatctcaagtgatccgcctgccttggcttcccaaagtgttgggattacaggtgtgagccaccgcacccggcctccgttttgattcttaatttatccctgtttcccctccactgccctgggtcaagcttctttattgccccacacgagcgtatcaacctgctggaaaaacgtgtctgccctgaaaacaggaacaaaggcgtggctgcaccctcccacggaggctgctgatggccatccatggggtgcctcagggctctcaggaacctttggggtgtacctgtgatgcacccgtggtgcctcgagggacccttcttatgtctgctcttggcaaccatcccagagccaaaaactgcccccttctctccccaaacaccctttcgtgcttcagggaaatctacgtccttctcatctaaccttgagaatgcatcaaggtcaactgtaacagaccccgtccctgccccatagggggaagccaccccttgccaggtgaatgcctttcctcttgggaaataggcagaggccccagcccccgcacaatggctttataatccagcaactgatttggttcagttagcctccagagttcctcttctggcctgctgagatagcagggcaatctcctaccttcttgctctggtagaaatgaagtctcccctgaccacaacaggtcatctgaagataacagagccagagagctcggttccccgtctccacaaaacgaatcattaaaatggaaactcaccatctt

SEQ ID NO: 3725 - DNA, 33563 bp, Homo sapiens
gcttctagtaggccaaactcccaggtgacccccgcaagaaacgcggtccggagagggtctggccccactgctggggcaagggctctaggcgcccggaccccacgcccgcagcctgcggagaacgtgccgacaaggacctgtagggccccactccccctcctccctccctcggcgcagcccggcccaggggtctgtcctcccaggcccaggaaaggaggaaacccacttccgccgcgtccatgatctcccgcggcttctcctgactcttgcggctggcgctggcgctgggcatcgggacacggaactgggcagtggacaccaccctccctcgcaggcttccgtaaggcaggccaaaggggcttctccctccctcccagtctccgccctcccgaccctggggtctcagcacacgcgctcggactccgcgtggaggtgcggctccagaaagatcgcgagagctgcggctatctcgagatcccggagcgctggcggccgcgcgcagggtctcctcccactcttgccccgcccctccgggagttttcccggagttggagggaattcccgggaattcgcggtagtttcgctggattggctctgggggcgggggcaggggttaccaggtggctggctgtagacctgggcgaatgccagctctcttcagcttcgtcccaactgcgacttctgctccattcttctaacagccctttcaactccgctcggctgtaaccgcagactcgtcactaaaacacccacctaagcgcgggccttggtttctcctctcttggactttcccgccttctctcttcccctgggcgacgtagctgcttggggacggaggaggcctcttcgcaatccattgccctgcttgttgggacagaggagtgcagttggcttgccaaggcagcatgggttaccagtccctgtgtaagtgaggtgtaaatacagtggcaacgacaacaagaaacgcatacaattgcattgattgcctggatctgttgcagtgttagggacagtgcatagtgttggttgcccaatgggcgaatatccccaagttaggcttttttaaaaaactgattttttaaaaaagctatcattcatgagttttgaatcgaaattgaaaataatttggagatttggtttaatactgtttcccctgccagagtttgcactccgtcgtttcaactgacttggtagtgtcttagtctggcacaaagtgttaaggggtgcacatagatcccagcgcaagtgaaaggctctctctggaggctcccccatggagtagtgagaagacagccatggtccttgcttgcctgtagctttccttctaattgcaggtggtatgaaattttattccctatttaattgatcaaagattatttacaaacatctactttgtgccaggcattctatcaggtgctggcaataaaaagataagtcctagttcctgttcttaatattacacaggtacctaggctgatagatgcgccatcttgatacatgcttccattattacagagtcaggaagagaatttagctcttaaaatggctgcctggaagtgacacatttcacattctcctagtttattggcgagaacaagtcacatcgtcattcctgagttcatgggggcaggagaatttactcattccttggggagcaacactgaatattcatgatcagtatcacattccgttaaaaaaggcatcccattatactcatgggattcgaatacagaagggggtctgtgaagttgcttcatcttggaattttttttaaaacttggattgcctcaatcaggtatagtcctaatgtatggactggttatcagaaatctgaatacaaatcccatctattatccctttgctagggtagcgatcttacctttccatctgtccatgaggcctgtccatgtacttctttcttactttggccccgttgccttgataaaagtattcttatttagtcctggaataagactgtaaatatatattcttgtttctggcctcctttcctgatagtgatagaaaagaagcatttgccagatcagtggccacatgtcatatgcctgaggtcttaagaatctgctgtagtaaagataccacagctgcaactgaggctgtgacttggttgaacttgcagtagtctactgtcaagttcctgaatttgtctggtttttgctggagccacaccggtgacaataggaatgtgatggagactaccaaccattacgtctttaagggttgcactgatctccactattccccttggggacatgttattgtttatgatttcctatcctagttgggggctgggaaagtgacttttagagatttcctcttagctttatccggtatggtagcctattccacagaccaaagaataggggaacagctctgctatggtgctctggctgctttgcaggatccacataagccatgtaggcaagggcgggaactgcagctaacctgaatcttggaaaaacatcttgtgatcctgctggaacatgagagggtggaaggccatctcccactcacttccctgtctccctgagaggctgttatgggatggtttcttactacctcctagattctgatgaggtgtgggacttcttgcccccttccctcaagggaaatgcagaatacaaaaatgtatataatatcttactgcttaactggagtctagaagtggctgttaagcaacagagtgtcccactactcatgttgcagtcatttggtgccttttgtttcagtgatgtccttaatgggacaagaatcacagggagctggcaactttggcttattcttctttctctctctcttttttttaatttaattttttttttttttgagacagagtgtccctttgtctcccaggctggtgtgaagtgtcatgatcttggctcactgcaacctccacctcccaagttcaagtgattctcctgcctcagcctcccgagtagctgggattacaggtgcccgccaccatgcctggctaatttttgtatttttagtaggcatggtttcaccatgttggccaggctggtctcaaactcctgacctcaggtgatccgcctgccttagcctctcaaagtgctgggattacagtagtgaaccaccgcacctggcctttttttttttttttttttgaggcagggtcccactccgttgcccaggttggaatgcagtggtgcgatcaaggctcattgcagccccgacctcccgggctcaaggggtcctcccacctcagcctttggagtagctgagactacgggtgtgcaccaccatgctcagctaatttttgtattttttgtagagatggggattcaccatgttgtccaggctgggggcttattcttgttttcactgtctatgtaagtaataaaccatctaaatctaaaagcagcatgttacagctttactgatggaatcattcaggccttgacatttccttacttgtcctgtgtgttcctgtcttgacaggaatcagcgtcggactctgccaatttccaatacaatatccatcccaaactatacatttagggagctggaaaatgacttttgggtaggtccatggacctagttgttgctgttaagagggttgaagtgccattgtggttcttttatttctttatttttttcaagactgggttatgagactagctaatttttttgttttttagtagacatggggtttcccatgttgcccaggctgatctcgaactctgggtctcaagtgatccatccgcctaggcttcccaaaatgctgggattacaggtgtgagccattgcgcccagccaccactttgattcttggtcctttgtatgtggttcttttccccctggaaaagaaagaagctcacaggacatctgctaagtagactacatgggtccttctttgttcctaatgctcaggaatttcataatatttatcagcctgggggtttaaatttatcattgtgctggacattgggccattccatctggaagctcgttagttctggggcattttcttgaaaaaagtctttgatgattctctaccttccatttcttctcttctctgtttcctgaattcttattaagtattggacttcctgagctggtctaatttccttataatttctctccatttttccatcttactgcattttgatatgcttttgggagattttttcaactttatcatatagtctttcaattgcgtttttcccattattgccatcatttaataatttcctaaagcactctttttgttatttgaatggtcctttaaaagaatagaatcctgatcttttaaaatgtatataatatcttctcatcttactgagcatattaataaagtgattttttggggaatttttaaaagcgttctctctacataacccctttcttacaagttgcttttctatttgtttatttttggcctctgtcttccatgttagagacctacctcaggtgttcagtgaatccttgattgtctgcttatgttaaaagtggggactaggcccggtgcggtggctcacgcctgtaatcccagcactttgggaggccgagacgggcagattatgaggtcaagagatcgagaccatcctgactaacactgtgaaaccccgtctctactaaaaatacaaaaaattagccaggcgtggtggcaggcgcctgtagtcccagctacttgggaggctgagacaggagaatggcgtgaacccgggaggtggagcttgcagtgagccgagattgcgccactgcactccaacctgggtgacagagcgagactctgtctcaaaaaaaaaaaaaaaaaaaggggagactaaaaagctgattagaagctctctgagcacttccatggggtttgtccattgtggattttactgcatgatggtctgggtgggccatttgatgggtgtcagtatttttagatctttccctttggctagtcagattgttcagggagaaagctcttctgatctgctgcatgaagaataaaggtctcactgctagtgttctgggaatatctggcatcccacatgtatttggtcaccgaattcccctagttgggtacagtacccagttcctgaagtcaaagacccaccttttaccttctctacagaatccatcatgtcagggtaggagaggactcttgccaaaagagtagagtatggagggctgcaggaatcagacttctcttgtaactttccccaaattgtcattatcattcccactccccatctccgtttccagaggtatttggtgctgcttgtcttgagtcttttgtgatttctgtggtatgagtgaggtcacttctcagctttcttgactgctcccttaggattcagcttttcatatctgctaagtaggttaccactggcccacctgctgctttttggcttcctgcatttttggggggattgtctcctctcctgttctcccatcctctcgattatagtttttgtggcattaagggcaggagcaagattagatctgccatcttagtgcagaagtcacttttcatgttttataacctcagtgtatacaaagtttctggttgatgactgtagttaccaaaatttataccaatgcttatacttttttttttctttttcttttttttgagacagagtctcactgtgtctcagctggagtggagtgcagtggcacgatcttggctcactgcagcctccgtctcctgggttcaagagattctcctgcctcagcctcccaagtagctgggattatagatgagcaccagtatgcccagctaagttttgtatttttagtagagatgggatctcaccatgttggccaggctggtcttgaactcctgacctcaaatgatccgcctgcctcagctgcccagagtgctgggattacaggtgtgaaccaccacacctggtcccagtgctcatacattctttcggcaagtatttattgagagtcgactatgtgtcaggcattagtctagacatttgggatacatcagagaataaagtagataaaggtccctgttcctgtggatcttatgttttagaggatggaggcagataataaataacaaaataagtaacataataagtaaattatgtaacgtgagaaaatgaaaaaaaaattgagcaagttaagagaaacaggagttctggggaggtgtggttgcagttttaaatatggtggtcagggtaggcttcagtgagaaagtgacattcgaagatttgaaggcactgagagatgtgcctgtgtacatatttggggaaagagcattccagggaagaggacaaccagtgtaagggctttaagatgggaggagcaaggaggccaatgttctatacctagggtaacatctttaagccctctgaagtgtgtaggattctttatcctgaatgactctagtttgccaatctttttaaaaaattgtgacaaaacacataaaaattatctttctaaccaatatttcactttctaatatcatgatttttgactattttagatatctcagataagtggaatcatatagtatttgtcctgttgtatattgccaagctttttgagttcttgtattgcaaattcattctggctccagccttgctgtcatgttgaatttagctattacttctctcacgcctggatgtaattcaaatcttaacacccctgtttaccagctgaatcaggtgggatgcctttggctgcaaataagagaaaccctgactcagactgtttcaaacagtaatgtattgctcatccagtaggaagttggggaaagaggagagtccaggtttggttgatccatgcattcagcaatgtcatcaaggaccgagcagttctttccttctcgctgctctggagacttcaccctgaggttggtagcaagacaactgcagcaagttcaggcatcacattcagttgtgacaacatcagggaaggagacagacctcgtactttcccatgcctctccctcaaatgtagaaaccgttccttaaaatttctgcagccagctttccttcacacctgattggccagaattggatcaacatgcttgtgttcaaaccagttactggtaagggaaatgggatcaataggcaatcaggcctacctcagaattttgggggtgggttgggagtgttgcctccactggagcacatgtatacctgggagaggggtggacatctaaataaaaccagattctgttaggatggaggaaggataagaatggatgctgagtagatagccagctgtgtccattacattagctgtgtgatctgaagagagtcatttgacgtcttggatcctcagttttgtcaagaaaataagagtcatggtgttttctcatgtaaggattaaagttcatgtcctttgtagggacatggatgaagctggaaaccatcattctcagcaaactatcgcaaggacaaaaaaccaaacaccgcatgttctcactcataggtgggaattgaacaatgagaacacatggacacaggaaggggaacatcacacaccagggcctgttgtggggtggggggaggggggagggataacattaggagatatacctaatgttaaatgacgagttaatgggtgcagcacaccaacatggcacatgtatacatatgtaacaaatctgcatgttgtgcacatgtaccctagaacttaaagtataataaaaataaataaataaaaataaaagcaaaaaaaaaaataattgaaagagaaaacagtccatgacacctacttttgctgatttcagtggttttcaaattgtggtccctggaccagcatgtcaacatcagcatcacctggtgttatgggctgaaggtgtagtcccacctctacctccccagttcatatgttggagtcccccaatatctcagaaggtgactgtgtttggagatagggtcttaaaagaggtaattaaattagaatgaggtaattggggtaagccctaatccagtatgactggtgtctgtagaagagggaaataggacgcagacacacacagacaagagggaaggctatgtgaagacacagggagaagagggccatttacaagccaagaagagaggcctcggaaaaaaaatcaaccctgccaacatcttgatctcagacttttagcctccggaactgtgagaaaataaattttgttatttaaaaccacccagtatacagtactttgttatggcagtccaagcaaatgaatatacctgggaacttgttagaaatgtaaagtctctggccccatcccagacatactgaatcagaaactctcagggtgaagcccagcaaactgttttaaaagcccaacaggtgattattatgggcagggctggcctagttgttaaggttataggaacctgtctagcctggctctaccacttactagctatcacatcctgactctaccacttactagctatgtgattggtgggtagttttaaaaacttttctgtgtttcagcttcctcatctgtaaaatggggataattctagtccctacctcttaggttgctatggtaataaataggtccatctagatagaatttagaacagtacctgatgcgtagttaatgctcaacaagggtgagctactgtcgagatacataacatgtaaatgttgaatctgcatctcacttgaaatggttgggtttggagaaacggatagtcaagcttattggaattattgttaaagtgaggacctgagaactcccttaactcccttgagtgaagttgaatactccacctgttttggcggcttgacactcttttttcttacttcctggtttatgattgtgatgtgggaaatataaattgtgccaagttctttggagtttatgcaaataatacatggcacacattgttatgttgctcttcattccctgtgaaggccttttgtcatcaactttatatcctgttcccatgagaactttacctttttctcctctttgcattctgttcttgatggattgtctagtttatcacttggacaacttatcctctttctctgacagcctatttaaaaccacctactattaaaaacagttttccatcaaggcatctagatagtcatttcccttgtttttcatctgccttttatctgaggcgatgccaatggttttacagtacgcagctgccactagatactaatgacattttcactgggcaagttgcatttcccagccttgtttctgtatatttgattgtctttagtattttatgtgagttgtaaacacactgggtagaaacaactcaataaatgacaaacagtaaaatgaatactaaaaagttatagtctcataaaatgagaacgagtggggcccctctcccaaatagaagtaagccagggacatcaggatgttatgaaaatgctaaatggctgctactttcccttaatatagtctttcagtcccaaacttgttgttttttgtaattctgccctgcaatatgcaattctctttccttctactcaccttctcaatcactctagcaaacataaccattcatttatcaccgaggcccaaaatcttggtgccatttcttgttgctttctcttctccccaccattcaaaaatctatcaaagtctttctgccttttccttttttaacattatccatctctaatgaatcttaaagaccatactttttgtaattgtgaactggaacattcaaggtaaatcataattcatttggtgagattatctccagtcttattttgtaaatccatgtatgactgcagccatatccagaaattttataaagggtgttaacccccaaccccaataaattataatgtaaaatacaaatataaagtatatcacactttaaaaagaattctacatgtgcgaggaggtagggaaaaatcaaaatctcagcaatagcaatttcaggactctcctggggctcttgtctgactcttcctattcatcactcagcctcctttttatggttttctgctttgctcactttaacacagtgcccttcagtgttcactacaagctcaccattgtcactatcagggagtatgtggttttatcatctaccttttaaggaaaagtttttacttttagaaaggcaccttactgataattattttctccaacctaatgtctttttttctattttcatttatggttctggttttatgtatgtatgtatgtatgcatgtatgtatgtatgttgagaaggagtttcactctgtcttgcccaggctggagtgcagtggcatgatctaggctcactgcagcctctgcctcctgggttcaagtgattctcctgttttagcctcctgagtagctgggactacaggtgtgtgcccctactcccggctaattttgtgtttttggtagagatggggtgtcaccatgttggccaggctggtctcaaactcctgacatcaagtgatccacccgccttggcctcccaaagtgctgggattacaggcgtgagccaccacgctcgacctctccatgtgatttttgacctaaaggaactatttttaatattctgaagaataatcctatttaagtcacatataaacaagttgtgctaaattaaaaacatttagttccatttacttcttcattttagtaggtaactttgtgatgcaaactcggattggtcttcctatttgagtcactcaatccaaaccttggtaggaaaatctggttcctctctcttcccgtagctgtggtggatcgtgtttccaaagatgtctgccacaatatcgctcatcccatatgttcttttgcaatgtgactgtgtcactccctcatcaagaagtagagtctagattcactccctttgaatctagactggcctatgacctattttgaccaatataatataatctccaaggctgggccttaagaagtcttcagcttctgtcttcatgtcttagagtgttctttcttggaaccatctgccaagctgtgaggaagctccagagccatatgacaagacctgatggaggataactgaggactttggccaacaaccccagctgagctccagttggaatgtgaatgaggccattttgagtgttccagcctattggagccctagccaacactctacaaactagaactgcctgattgacccgcagaatcataagaaatgtaaactgctgttttaagccagtacattgggaggtggtttgttatgcagcaatacctgactgaaacactggggctcctttgctcagcttggttttgaggccttgcaccacgttcacctgctcacctcatcaccctcaaacctctgcagggaaatacaacttactttctgggttttcacagtcattttagctcatggacaaagtggttcactcatcagtgactatgaaagtggccaaatgatgatcacaatactaattaagactttttgaatgcttatgatgtgccaggcactgttttaagtgtaatatatttattcatacatttaatttttagaacaactttttggctgagaaagacaggattcacttccagtgctttccaaagcagcattctctttgtcttaagtcagggaaggccttcaaattactttcattagaagaagatttaaaggaatgtttctgtttagggtttttcagtctaaacaatttttagaacaattttttgagctaggcactattattatttccattttatgataaaacaactaaggcacagagaggcaaaataacttgtaaaacagtaagtgggtcaaatcaccatcagaacccaagcatcggcccccagagccacatgcttagctactgtgatgtcctgcctcccataaataatatctcaagcttatttttatttttttaaaaaacgtttttgagtcaggatcttgctttgtcacacaagctggagtgcagtggtatgatcatggatctctgtaaacttgaactcctgggctcaaaagatcctcctcccttggcctcccaaagtgctgggattatacaggtgagccaccatgcctggccctacttgagttaagaaaatcctctaaggctttgattgcctcgttcatttattctaggttccaggctgtgtcccatgctggcagttacatttagaaaactctaatgttagagaagtctgaattaactattcctacattcacagttcagggtaggatagagtgtttgcttggttttcccaggtttctcatccctgtgtggccaccgcagagggcagcagagtgacaggctgagggtgcagagggggcagagaagcagaactgatggagggcccaggcagggcaggggtgggcggagctatttgcacatctcaggagtgagagctaggcgggagctcagccctaactctcaccaaccacccactgatggagagggcagcttcttccaatagcaagggctgtggctgccaaaactgtgccatttgacttgaagcggaggaaagtctccttgcttgctatgcaattgcaattgcagccttaaggcaagctccccacggccttcagatccctcccaggcagacatcctggagctgtcactgcaaagcttgtgattttgcttcaagcagcccttgaagttctcctgcttcctatttgcctgataactgccccaaggactctgaaggaacattttaaaagctaattataaaatttagtaggcctgcattcttacattgtattaagagtgaggcctttggagacagccctgggtcagagttccatctctgctgcttaattgctgtgtggctttgggaaagctgttttcttctcagattctcaatgttcttggctgtagaatgggttagtgatatttaccctgtgtgcttgttgtgagcaataagtaatcctatagtcaaagcccttggcctcatatataccaggcaaccatcagggtagctattaattacaaacatagaatatattgtggatctatgagaccattaacataccatgcagtcttagcatgtaagcagcaaagggtaaagctggtgtttcatgctctgctgtacaatgtttgcagaggaaaaaagacaatcaccctgatctattttagaaaaatgctatattttaatcgcttctctttttactttcttattttagttttgtcctttaaatgctttggagcatttaatagctcttctgctttcaacttctataaattcacaacttctataaatttaaaaagtgtctaaatcttgattaaatgctcttaatctgaggcttatgggtttccaggggtctgtgaactttttgaaattgcatgcaacattgtttgtgtctacacatatgtgcatttttgaggggaaatgattcataattgtcaacagactctcaaaggattctgtagttggacaaaagatatagaagagtccttggacaaaagactgaaaaaccctaaacagaaacattcttttaaatcttcttctacagaaagtaatttgaaggccttccctgacttaaagtggatgctgctttggaaagcactggaaaaatggatcctgtctttcttagccaaggactggtctcttttctccaatgtgtccctaacagagtggtgaggctggctcttcccaccagtacaggtaatgtggtaaagataggaccacgtggacgaagaggtattaccttctctaattacagctaacaaagacctaggcctaacctcaactgcaccttctgtctctgggaagtcacttatagagtagacctataattaggatttggtaccggaaacataattctcaggatggtgaatctctaaattatgtccccagagacatacctgagacaaaaccctaagggctgttggccgtaagagggtgtgtgtggtattctacattcagtagggatttataaatgaggatgatatcactcagaaggggcaggtgtccaagaggcccttttgacttctgcaatggggcctgacagccccgtgaactgagctccataatttatgcctccggcatagaatctgtgcaaagcaggaatggccgtatcagcatttggggatttaaagcagcttttttttttttttttttgagatgaagttttgctcttgttgcccaggctggagtgcaatgacacaatctcagctcactactacctccacctcccgggttcaagcgattctcctgcctcagcctcctgagtagctgggattacaggcatgcgccaccacgcccagctaattttgtatttttagtggaggctggtttctccatgttggtcaggctggtctcaaactcccaacttcaggtgatccaccctcttcggcctcccaaagtgctgggattacaggcgtgagccaccatgcctggctaaagcagctttttttatccacagacctctttcccaaattgtaaggaggattcagctcattgatttcactttattttaaaagaaaataattattgatgtgtaaagtaaatgaaaacacagtcaagtgggagtgtaattgaaagtaatttaagagttcaatggttgatgacttttttcaattatgatatctctttattaataggaaattcataaattaaggagtatgcaatataatcattgtggaatatattagggaaacatttttgatccatgcaagtaaattgagatagactgggtgcacctgttcctagtcatgcccagggaatatgtgaaactctggctcaggatgaacgtctgttggtgtcagcacaacaataatgaaacaaagttggcagtagggtggggaagtgtttggtgggtgggagccaccatctgcagccagctcccagcacggctgtgtgttcggatacccatcaaccaggaaagggagtctaaggcctccagatgattttcccctttcacaaaactgttgtaaaatgaaatacaaatccttcctgaatgttcctagcttttcttcctttcggaagttttcagtcaatgggaaacaaagccttattcaaaggattaaagccatagtcattctattgtttggggcttcaataatgtggctttccttccacagacagaattttcaattcacaaatcatctgaaaaacaggaaattttggagaaacatgcttatgataacaaacaagggatctatcgtgtggtatagaagtttacacaaagaggcatctgattttaagtttttgtttttttttttttttttttttttaccgttctgggcttctggctgcattctaggaagatcattccttaaaagaaatagccatatggcttataaggtaagactactcagttcccatcccaacccccagaagagaatggaggaagggaagcagactctggctatatttttatggctgcactccaggcagtactgcagaggcaacaggcaggctctgaaatgccttcttccccctgctatcctcaggcctgtgtttctctcttactccacccaagtcctgggcccttacatggcagagggagggagaagggccagcaacattggttaacaggaatagagaatgttcgaggaaggcagtggcaggcaatagccatagagagtcacagaaggttaaagaggttgtggaaacagtcatttgtttttcaagcagttccggtggggtttgagaaagcagcagcactcaactgtgagcagacaaactcactttggaaacctatgcagccacttctaagtaaactaccaagagaattattattttatttaggttcctcatttcagtgacaatcttttaatcctttgaactgtatgctgaaaaggacattatagatcctcctgaaagataatttttagtgtccacggttccctcaatatgatgatttttttccttggtccctatctttcaccattccctttaccttttatccatgcttttccctgattgaaggaagacagagtctatttgcttcctagcatcttcttctatggctcttgctactgaaagtgtgatctagattccagcagcagaacagcagcattttgcttctgagaagtgcagaatctcaggcaccatcctatgactactgaatcagaatcagcattttaacaagatccttggtgatttgcatgcatgttagtttgggaagggctgatctgtacagatctgccctataggcctgactcataacccacactccccaaaacctgcaagatcctacatttctggccctgtatacttctctagtctcatcccatgtcactctacctctcattcactagttccagccccactagtctttctcgttctggcctccaagcctttgtacttgctgttctctctgcctggagtgctcttgtcccatctagtatggctgactcttttatttcagcttaactgttacttctggctgtgagcggtggctcacacttgcaatcccagcactttgggaggccgaggtgggcagatcacttgagcccaggagtttgagaccagcctgggcaacatggcaaaaccccatctctacagaaaatacaaaaattagtcaggtgtggtggcacacacctgtggtcccagctgctcaggaggcttgagcctggaaggctgaggttgcagtgagccaaaattacaccactgtactccagcctgggcaacagagcaagaccctgtctcaaaaaaaaaaaaaaatttacttcctttgaggatgctttcctgacccctctatatgaagaactacctccaacccagctactctctattccattaccctgttttatatttttatggcacttactgttatctgaagtaattttattcattcatttttgggtctattttattcaggattgtgtgtccagtgttcagaagagtgcctggcacatcaaaagtgctgagttaatgtttattgggtaaatgaatacagttttgggaatcatgaacattgagaacctaggcccagacaattctaaggtaaaatatgtcaccctctgaaccaacccgacagctttcagctgattgacctaagaccagtgcttttgggtgcccggatgagcatatcaaagcctggtcccctgagcagttgcatcaatatctcctaggaacttgatagaaaggcaaattcttgggccttaccacagacctactgaatcagaaatcttggcaatagggttcaccattctatgttttaaggagcctgccaggtaattctgatgcactgccccacacaataccaacatcttaccagtgtggagaacccacagtgttcaaagctctcttacatatatcgctgttgttctggacttcataaaagccctgagaataggcatggcaggtgtcattatttcccctttacagatgaagaaattgagccctaggaaattattccatttgtgttggtaatacttgctttatcagaatcacttggaacgcttgttaaaattgcagatacctgggctctaccctagacctactgaatcagaatcattggggctggggctctggaatctagatgaaaaaaaaaagaagctcctaggacattctaaagctaaaagtttgagaaccaattgcaacaggaaacagtggaatagatatcagagcttatagcccctcattcctaaggcatgctcttagagagtcttgagaagagtaagtaatgataaagaatgatattgatctttagtatcttttagtgaaaatagttaaaacaaactggcagtaattctttcacctttattagaccctaaccctacttgctactgttgtaaaccagggagaatcaaactccatgacaatggactgtttctttgtatataatttagttgtgtatagaaccaactaactggacatcaactaaggggtggcaggttttcctgattagtttgtgatacaggaatttttatttattattaaaaaaaatttttttttgagacagagcctcactctgttgcccaggctggagtgcgatggcaccatcttggctcactgcatcctcacccactgggggcgatcttcccacctcagcctcctgagtagctagaactacaggagtgcaccaccacacccggctaatttttttttttttttttgagatggagtctcactcttgtcacccaggctgcagtgcaatggtgcgatctcggctcactgcgacctctgcctcccgggttcaagtgattcttctgcctcagcctcccaagtagctgggattacaggtacgtgccaccatgccaggctaatttttgtatttttagtagagatgggatttcaccatgttggccaggcttgtctcaaactcctgacctcaggtgatccacctgcctcagcctcccaaagtgctgggattatgggtgcgagccaccatgcccagtcctggctaatttttaaaaaacatttttttgtagagactgagtcttgctacgttgcccaggctggtctcaaactcctgggctcaaggggtccacttgccttggcctcccaaagtgctggaattacaggcatgagccactgtgcccggcctaaaaacagtaacttttaaaaatacttctccaaatgggcaagtaactcccaaatctcttctcctgccccagcttccctggctccaggcccatacattgaactgcatatggaacagttctcttctagatgacctgcgggcatcttcatcttagtatgtccaaattcattactttctttcccaccccatccattcttcttcctggctacactctatcagcgaatgactacatatatcacccactgtgtcatcttagccaggaatccaggcagtttctggattccttccatcctgtctctggatagctaaccagtcatttcattgtactccttagattgctctcaaatcaccaccccttccttcatctctactcaactccagttcaagccctcatcatctcttgcttgggttgtcatgatggcttccaaaatggtccctttgtcggtgcttctagttgacctcatttctcctcttccttccttttggctctatgcttcagtgctgtcaaattgctttcacttttttaaaaaagagttttccattttaatttctgagacacatgacacatctttgtcaatgttaggtctgggaaagtttctattaacttcacaagacagaaaggacccttctctccagcagtgaaaaattcaaaagaagagagcttcagggagttcagttgctacccagcagaagcttcaatttctaacaaaactgtgaagtttcaaataatgaaggggaacttcaccccaagatggtactcacttaggaacattattttccttcagctttcccttgaaatattcaacagcttttttttttttcgagacagggtcttgctctgttgcccaggctggagggcagtggcatgatcttggctcactgcaacctctgcctcccaggttcaagcgattctcctgcctcagcctccctagtagctgggactacaggcatgcaccaccacgcatggctaatttttgtatttttagtagagacagagtttcaccatgttagccaggctggtctcgaactcctgacctcaggtgatctgcctgtctgggcctctcaaagtgctgggattacaggtgtgagccaccgcgcctggcctcaacaactttcttctccccattaggattacctccattgtgggctcttttcgagggaggaggcactgcattctcactcccagtctaaagctgctttcccttctcggtgatgttttctgcttccatgcctttgtacatgctgtgtctgttctattgattttccttttcccatctcctgtgtatggcaaactcccacttgtttttcatgattctgctcaagtgttctttcctgtatgaagcccaagctgtccacttggagagacatctggccagccccccgttgttccagccatccccagttcaggcatcagacatgtggtgaagaagccatcctagatgcccagccccagctaccatctgatgcaaccacactgctcaccccgagcaagaactgcctgcaggagcctagtattatcctctctcacagaaccatggcagggaataataaattgttgtttgaagccactctgttttgtggtggtttgttaggcggcaataggaaactagaacaccatagcttttttttttttttttttttttagaaaataacttgatattcataagcacagctttttaagctgcttttattatttttccctttatacgagtgcattctgcaacataaggagatttctatctcagccctgaacaagatttatgatcttgatcaagtctctttataataatgtcacagaactttacttgcttcaattctaatatgaaggattgaactagttaatcactaaggtccactctagttccaaaattgtggcattctcttctaactatcagggaaaaattgacttattctttgttaagttgtagcttgcagtaaagttttttgggcatgagaattttcagcaaggtggtgagtgccaggaaagtgctgactcagcacaatgctgtctgttagccaggaacaaaaatgaggagcaaccataaatttaatcctttagctccttctccctgcaaaattcagaagatgttttatctgtaacaaaagacttgaaagaggattctcactttttcccttaaaagttgttactcaagtctgtaggtaacttcaggatttttgacagaagattcagatttgcatagttgactcagtctccggaagatccctacactcaaattctaagtttagggcaagtgaactgagtgattcctagaggaaataaactctcgcctgagaacaacagctgaaataaaatcccataagccaggaaaacagccacacaattacagtaacaggtggtcagtttcaaaacaaatttcaaggtctgactcgcctggcacctgctctagaaccacagacagcagtttgacactgtctgggtccaagttaggtcatccctgccacaccataaggaagattaactacctttattagcagagctaagtcatggtaggttagaggactgcttctctgtggtagtaacccctgtgttccctgtctgagaagagggaataagagagaatttgggaactggacaggaccttgcagattaaccattaggttggtgcagaagtaattgcagtttttgtccttaaaagtaatggcaaagtgaagccgaggggagctaagcagagatttgctcagaatcacatgacctgtagaagcagaacatccccacccccattttattgtgaaaaaattcaaacacacagcaaagttgaaaggatttttacaagacacagctgtatatgcatttcctggattctactgttaatattttattaaacttgtttattttctaactatccctctatccatccttctatcaccttatttcctggatgcctttcgaagtgaattgcagacatctgtactccttcccctaaagcagcatagtgttttatcatcatttaataatttaatacctcaattttgtatacattatggaaccaggaaacattataagaaatcactggaccccaaaaatgttaattagccttggctagcctgaaagagaacacaatttcctaaggtcctaactttaaggcacttgaggattcttactaagggcaaattcctgagatgacagaaatactagtcaacacacatcaatgcctatgtttttccctcctcctggaatcctgtgctttccccttcctgctccacctgttgaaatcctctcttcattcgtccaagaatgatctcagatgtctgcaaggaacataaaccactgttacacacgtattgttttaaggaaaaaagttactgaagaagtctgaactgtcacctccttcccaatccctttcctaaaccccgagttttaacttttctcattttaatgcccataaactttcattgctatttttcctccctcattctaccttgttgcagtttagtgtttatttgtttgtttatcacgactactgctcctcctcctaataatacttatggttaatttctttttaagggactatatcttaagactatgtgtcttctgcagttctttgcatagagtcaacgttgaaggacaagcaacttcaaatttccaagcaacaaaattatgttcgggtggttttctgaaagcgagatcttaagaaccacctgtatcagaatcccatgaagagcttgtttagtgtgcaaatttacagattgtcccccctcagaaatgctcatttaggagttcctgtcctttgcggggacatggatgaagctggaaaccatcattctcagcaaactaacacaggaacagaaaaccaaacactgcatgttctcactcaaaagtgggagttgaacaatgagaacacatggacacagggaggggaacgtcacacaccagggcctgtcgggggtgggaggtaaggggagggagaggattaggacaaatacctaatgcatgtggggcttaaaacctagatgatgggttgataggtgcagcaaaccaccatggacatgtatacctatgtaacaaacttgcatgttcagtacatgtatcccagaacttaaagtaaaatataaaacaataataaaaaggaaatgctcattcaggagttttggggtgggggttcaggaggctgcagccttaacaattacctctggtgattttgacacaggtagcacagcagccaaacttggagagatttgttcacagcactgcatcaccaaccttactttctgttaggcctttaatcactttttttttttttttttttttttttttctgagacagggtcttgctctatcacccaggctggagtacagtggcacgatcttggctcactgcaatctctgtatcctgggttcaagcaatcctctctgccttggcctcctgagtagctgggaccacagacatgctccattatgcccaactaattaaaaacattttttttagaggcaggctggtctcgaactcctgagctcaagcaatctgcctgcctcggcctcccaaagtgctgggattacaggtgtgagccactgcgcccggccttttaatcacttttaaaccagcaaccctaatctgcctgtcccttgaatggatccggataaaggtgtggcaaacaagcctcctgtcacagtggggtgtgacagtcacggcatcaccccttcaccacatcatgtgctgccagtcatcacttctgctgttgccaccaacccttgcgtttccctttgtcacttcccccttgccaccaccaacggccactgtccctctgctcctcaccctccatagctgagtcagatccagcattgggcacttgaggaagaagccactgtggaaggcgggatgagggtgttcccattctacattcacaagcccacagcttggagaagaagcacacctaattctgaccctggcttctgaagaagctctgcaaacctggctagaaagttgggcctgtggtttgaggttcctgctgcctttgattttacaatgagtggaaattgaggttgagtaacaggtctcttgcccaagtattaagggccaccacgaagcatacagcaatgaaggcaggagctgatgacatgtggttggttcccccctctaggccaagtatctttgtatagggaaggccgacatggccatcttcacggtttggtattagtggagtgtcttatacatactgaaatttgtttttgttttcaggtgctaaaaggataataccaaggaaaactatgggtgggggcagtgaatggccagcatgcctataatcccagcacttgaagccaggagttcgagaccagcctgggaaacaaagcaagaccctgtgtctaaaaaaatttttttaaaaataagctgggcatggtggcacgtgcctatagtcccagctactcagctactcgggagaccaaggtgggtggatagcttgagcctaggaatttggggctgcagtgagctatgattgcaccactgcgctccagcgtgagtgacagagtgagatcctgtctctttaaaagaaaaaactatgattcaaagtgttgttttatgaagcataacctgctttatgttttgagtttaatataacttgaaatcagtttctctaagacagtgccagccttgccatttttcagttcaacatagatttctctattacagtggttcccaaactttaggaggcatcaaagtcatctggagggcacaaaaacacaaatttatggatgtcacccacagttcctaattctctctctctctctcttttttttttgagatggagtcttgctctgttgcccaggctggagcacagtggtgtgatttcggctcacttcaacctccgcctcctgggttcaagtgcttctcctgcctcagcctcccgagtagctgggattacaggcttgcgccaccacaccaggctaatttttgtattttagtagatatggggtttcatcatgttgttcaggttggtcttgaacccctgacctcaagtgatccacccacctcggcctcccaaagccctgggattacaggcgtgagccaccatgcctggcctgtttctgattctctaggtctggaaaggggcccaataattttcacttctaacaagtggcaggatgctgctgctgctgctggtccagggaccacactttgagaagtatggtactgtgtggtacttaccggaccatttaccatacttcctgcctgcctaattgtgtcacaatatagccgtgcttctcaggcctagcaattcattagaattacctgtgaagcttttaaaatgtaaggtttggatggaatgctcagaccctaccttagacccaattaagcccacagctttgagggtgaggcttgggtattgttcagaaagatccccaggtgattctaatggataccgagggttgagaaccacaggcatatagcaaactctggccctattctaccttaacatatgattctcatttgacaaatacatattgaccacctaatatatgtcttgaaaatgataaagtatgtaagaaatggtccctgacctcaagcagagatacatcatatgcccaaatatttaaacaaaaagctggtgtgtggggtttgtgccaattagaggactaaaccattactgaaaacagaaggctggatgattcagggtaaatcaatgctgcacttgatcctcacattgtttgagataagttatgtatgcctctgctgcacatgaaacgtatccctttggtgggggaaattgctcatttattggttcgttgaggatgttccaactgattcaccatggtaggtgtgattgaaccatggaaatgatggaacattaaatcaatagctagtcagctggtgactattccttggctaagtatgctattaaggttctgtttcagaagtccctgtgctcaatggaggtgaacctttccagtggagaaatacaacatgaattatgtttagaaaatgcttcaatctggggttttaaataaacagtccttaaatatgtataaaaatctgaaattattttagaatcgaagggaaaaaacaaccgggtccaaaaaccaaaccatatttagcttaaaaacacgttcttatttgcatccactagaatacaatataatttaatgattcaatgacagctggcccatgaagggcagagtttctagaaaggaggaaataccctctttgggtgttacttaggtattaagtgtattatttaattcattgttttatttaatttggttatatcttttttttttgagattttgttttcatgttgggtgggtagtttttctaagaataagaaatcccaatgacaacaaaatgtcattgtttttaagagaaggagataaatacattttaaactgttatatttatttattttcaaaaaatgctggaggcatcatgttagcaattgcaggggataacatgaatatgacaaagctgctctcaaaaaacttaccactttgtagaagggaaagctaagtgcctattccaagcaaaatatgatatgatacatgcctttagagaggagtaaattttaatgaggcttcaaagagctggaagaagaggtcaaggttcaaagagcctaagataaggcacagaactggggttctggtacaatgcattacagcatggccaattttcaaaggccagctgttcccagtcaaacgaagatgaagctgagggcaggtgcaatcaatgggaaaatcaggccaccctctcctattttcccatagatgcagtttcatgatcaatagttttataatctcattttgggtagcaaaatgaaaatgaatctgaagcattctttctagtttatttcacactaataaaatccaacctgaaggattttatatgttggctctatggccgttagtatttgattaaggtgtttagcctcattagtaatcaaaggaatgaaaactagaataaaaattcagtcattgtttttggtttatcaaattgataaagacttaaaatggccaccaagcattggggaggttaggagtgataggctctctccttctatctatggaatattccttggctcaccatggctggagaacaatccacatccaatagctcatcaagtctacttccaggaatgtattccagaggaatagtatggacctatgcaaaaacttgtgtacaaaattattcctcagagctttgcttattattgggaagaatgagtaaagaaataaatgcccggccaggcgcggtggctcatgcctgtaatctcagcactttgggagccaaggcgggtagatcacctgaagtcaggagttcgagaccagactggccaacatggtgaaaccccttctctactaaaaatacaaaaattagctgggcgtggtggcaggaatctgtaatcccagctactcaggaggctgaggcaggagaatctcttgaacctgggaggtggaagttgcagtgggccgagattgtgtcattgcactgcagcctgggtgacaagagcgaaacttcgtctaaaaaaaaaagaaaaaaaaaaaagaaagaaagaaatgccccgaaacaggttaataaatttaaaagtattatgccaggaagggaacagtagcagtccactatgcctagaaactaagcctagtaacttagaaaaaaaaatcttccaagtgttttaggtaagttagtattaataattctacccaaggtcaatcccctcccctccatttcctcctcttcagatattctgtgcttctgccaaataggacaacttgctatttgtgtcctgaactgaccttatacactttcttgcctctctgcctttgctcgtgctttcccactgtctcaatggctttccttaatctctgaggtctcacctcttcaagacccaattgtgtaagccaccttacataatgttattatgatgtcccccttcctcatccagccagaaggatttacttccttctctgtatgctcatagcaatttgttcattttctattcttctcacccttgtcctgtgttagagttaccgaaatatatgtatatgtgtgtgtatatattttttgtcttgttttgttcctgttagattttgaacaacttgagggcaggggccaatcttgttcagatttataccccccagagttataaagcatgctgtgaaaatgattgttgactgaataagcgagtgagtgaatgcaaaagtacacttggagccaaatgcttatattctctgcagacatggaataaacttgacaagtgctaaagatgctctttgatttttgtgtggcatgagacctcaggctgaaacttctcatctgagccattgaagggagcctctcatctctccaccgagaggggagaccagaatggtaagccaaactgcagtctttcccactctcaacccctgtcaccccaatacttagtggaagagggataaattagagtttttaccaagggagaactgatgaagacattgcaacgaggtaagcgcttatggtcaagttatcagctcttttactgcctcaacgacacacatttgtccacaaaatgaagagatgaggactatccatatagttgaggggcaaaataaaaatagaaacaaagtgttctcagtggagaaaaaggaatttgaaagcattttaatgacgcacattgatttctaccctcccagattcaatatacagcaaaaactccatttatgttgatggtgcaaatgccttgagactgtcaatgaggaagttaagctgaacagccaaactactgttcagaatagtcaagcctaagtgttgctaaggaattttctgtccccactgagtacaactcatacctacatgtcctattatacttcacaatacacctgctggctttctcggcccttcaggaaatacctttgcttcctgaagaatgcaacaaacaacccaaaacaccaccacagccagccagctgacaccaaactgtgaactgttgtcccctctctgacagggttagatacttgagtgattaatatttgcagatagtgctaaggccaagttcaaaaaagaaagtcatatatatatatatatatatatatatatatatatatatatatacacacacacacacacacatatatatacacatatatatatgtagagtctatgtagtatggattcttcactgtatgtatgtataaattcttatatgcatgtattatattggcaaaaaggagatcattacttttttttttaaagttccctagtgggataaaattaaacctcactgatatgaatactttttgcagtaaacaacaacaaaaacttctttttaccaaggttcctctcctgccaagtagcagtgatttacagacccaacatgtgagtgaatgggaaatactatatttccagacttgggtaatgaataacctctgagggcttgaacttttctccgttcccacagactgtatccacagagcggtgctcttgccttgaaaggaaggatttgccccggtttggaaggaagtggaataaatagaactggaaatggcaaggtcacctttaatatcatatgaactgcctattaacaagcttcacaattgctttgtttcttcctcctcccgtgctataaacaggctcaggcagagcaaactcttggagcacacacagtgtggggaggaagctctcagagcagcaaggaaggagaggctgcaggctcaacagggcccatcaagcataccagggttacaattgtgttatggtgtggtggccaggagggaaaaatgcttgtttttcaaggaaggaactatattgtcccaaattcctgtgtataaaatataggacaaacaagttacagtgggaatatttaattggagcatgtggaatagatggaataattgcctttcacttggcttttccctgctctaagtagtatcacatggtggttacataaagacaaaaaagttattttaagaacccttctccttaggaccctgtttagttggtattccaaacacacagagcaagctcttcactggcattctgcttgacagatttttctttctttccaggctccttcaggcacattctgttgggcttccctctacctccccactctgctgcttccccgctctttttgaatttctccctgttgaggagagggaagaccagctaggaggtatggaaaaggcactcacgaggtttggaggacaaagggttaggcaacaggcaggtctggaatttcagtgccctggctttcaggaattcttagatagtccaatatataaatcatcttggaagatcttttgggagcagcactgtcattaaaaaacaaacaaataaaaaacaccaggctgggcctggtggctcacacctgtaacctcagcactttgggaggccaaggtgggaggattgtgagagccccagagttggagaccagtctaggcaataaggcaagacccgtctctacaaaaaataaaaattagcttggcatggtggcacatacctgtggtcccagctactcaggaggtggaggcaggaggattgcttgagcccaggaggttgaggctgcagtgagccatgttcacaccactgcactccagcctgggtgacagagcaagagcctgactcaaaaaaaaaaagaaaaagctccgtctctactaaaaacacaaaaagtaactgggcttggtggtacacacctgtaatcccagctactcagaaggctgaggcatgagaatcacttgagcctgggaggcggaggttgcagtgagccaagattgcaccactgcacgccagcctggccaacacaatgactctgtctcaaaaaaaaaaaaaaaaaagcatcactaagcttcgagtcaaagagaaataatctcatatggcttaagtgcggataatcaaaggtaacataaaccaaacaaaactgagttggtatttgtgaattgttatttatccttctctatggattctgcacattcagtcaaggtgtttaggaaaacctcctccctaccattttgaaagtgtcatagagctatgaactgttgtaatttcaaaagtgcaattaaaaaggtgtaagaaagatacagtgagtctctaaggggtagaaagaaaaccctaaagggtagtttctatcaaatataaattttggctacttctttacaattctaggatgatgtgagttctcatcattgcagataatgggtcagagctgagctgttgtgggaactgctagatggagctagagttgtcatgtggccaactattttgatctgtggctaacatgtaatatcaggagattctgatctctgtctggtagatgtgttaaattaagtgtctggggagtagacattgaggcatcagtctagaaattcaaacagatgtgctctactaaaatgctatgctagaatgaacctgaccaagctaatcatcctctaaagtgcactacaatagacagaagacattttctcctggactgtacaagggatagggtcggggaggatgagctctttcctttgtcctctgaccacctagaacagcatagctaatttgctttgtctagcaataagaaatctcacaatatatttagcagcaaggttgagtacacacatgtgcacacatacatgcactcacattcatttcataccttaacattttttttcaccttttaaaaaatatgaaagcagaggatctggattgagaaacttgccatgcttttctctcagatgttctcttttctctgaagacagcaggacctcatccaaaggtatcagctatgcagttgtgctgttatttcttttcaggtgacaaaatagcaaaatgttctcccatgatgatgaaactcagctttattttatttttttcttttcccttgtagctctgtttctggcaggaatctgacaccacttactccttgggtagaaactcccccaagtctgaactatgtgattgcctgagccctgcttcttgttcattaagactgctcctctgaaacggaattgatgaatttttagtggctattagaagcatttgggatccataggcatcagggtttgatgcatggccctcatctctgtgggctcctgtgcaatgattctcatctgtcttagttagaaagtgaattaatcttgaccttggcctcaggggtgtggttctctgccctcttacacatcttcaattcgcttctttatcagaagcacttgttttaggcccaggctcccccaattttaatgacatttagacatttgtctttaagttacattgctttgattttaatcaaaatctatatttctagtattatatgtttccagaaagttctcattctggattgtaatttaattacatggatcattaaagctttgaaggatgctaatgggcagaaaaaagagacttaacaaaacgaaagttattattaggaattacaaatcacttaacatttcaacatcactcgtcggatgtgggcattttgttgaaagagaccttgttttgaacagtgacagtgcagaagacctatggaagaaacaagcttccaacttgatttctattgttatgcatgcatagcaaattattaattctattctaatagggtaatagatttagaaatactattagcagaaaacttgatgtattaggcaatactacataccacattagtctaaccgctcaactgtaatttttcatccatactttcttgggatgtaaataaaattgatattatacaatgaaaataaaattgcccactagtcttgcttattctcttggtgggctgaagagttaaactgtggtgaatgctgttagataggaaggtaatgaaaacttcagttagcttaggattattcttaccagcaagcattagttaaaagttaaatttagcaagtggttacccaaatgttaaaggcatttaaactggctgggcacagtgagtggctcacgcctgtaatcctagcactttgggaggccgaggcgggtggatcatatgaagtcgggagttcaagaccagcctggacaacatggtgaaaccccgtctctactaaaaatacaaaaaattagctaggcgtggtggcaggcgcctgtaatccagctacttgggaggctgaggcaggagaatcacttgaacctgggaggcagaggttgcggtgagtcgagattgtgccactgcactccagcctgggcaacagagtgagactccctctcaaaaaaaaaagtatttgaaccattctttctgtgctgcataaggtattaataataaaacattacatgactgcatgtataattctacctaattgaattgagttttcaaattattttttgtgtgtgtcttagacagtggcgcattgaaagtactgcctgtccaaaatcaggaacagaaaagtatttcaattactcagaaagtagacatggctggaaaatcataagtaagtggttattaatgtcaagtttaaagctctcaggctcttctgtcaggccacgcagggcaaatgagatcaacaggatggtttcttgtttttttttgagacggagtcttgctcattgcccaggctggagtgagagcagcggcacggtctcggctcactgaaacctcctccgcctcctgggttcaagcaattctcctgcctcagcctcctaagcagctgggattataggcaagagccaccacgcccgactaatttttatatttttagtagagatggggtttcaccatgttggccaggctggtcttgaactcctggtctaaagtgatccacccttcttggcctctcaaagtgctgaggttataggcgtgagtcactgtgcctggcccaacagaatggtttctaataaaaatatttattaccattgcatcctaccccattcccactcagtgtgccccttacttaaatggccgccttcacccaggccactacagggagggcactgacttggaaggacagaacactcaccactacctagccttcaccctggtcatcagttgcacttgatatggctatagctggtatatttctataatgatgggaatcatagaaattgttagtattgagttgcaagtcattggtaatgttttccaaggaatgaccaagttctgtgataatatatgcacagacaggaaaaaatacaaataaatttaacagcacatataaaaatactatcaccttatactgttcattttgtgccatccaggcatgtaagggagagagaaataagataaatttgctggtgggagaagcaagcaaatagagagaagtttagaggcaaagaatttgggaggggctggtgaaaaagaaggggaaggaggaagtacaacc

SEQ ID NO: 3726 - DNA, 2296 bp, Homo sapiens
aggaagcgctcggtggtgaagtagcgcagggtcggcttcggggcgcgcaaagcggtgaggaagacctgcggcggcgggaggagagctgtggccaccgctgcgcgccggaggacgcaccgcccccactcctggagtccagcccggcgctcacctccgccacctcctcagggttctgcgccgcctcgcgaaagacttgcttgctgtgggcgaggtattggtagaagcggtggaaggtgtggatgtccgtgcggtccagcacctcctctgggctgcccaacaccttctccatgaaggcggtgtgcactgggccgcactcgatcaggctcaagctgctggccggagagcaacgagtgggagggggcggacgccagccaggccccagtcccagccccaaccccagtcccagccccaaccacgtcccggcccccgaccgcgagcagcaccgctgcgctgggaagtgaggcggaaagggcgctggggataaccagaacatttgaaacgcgggttcctgccggagcagccctcccaaatccatctgaggctacaagggagccctggtgtcaggattcgaatctagcggggtccctggccgctgtgtgaccttgggccagtcacctaacctctctgggctggagcttccccataacaataccaacacttcagcagctaggtcagcaggtggcacaatgcgtgccatgcgcccagcccaagtgcctggcacacagctaatgtgagccgggcagagagggccagggagatcgccccagagcggctcccgcaggacagggtgctcggcgtctctaggtcagagttaagagggttcggggaacgggggtgttgactcactggaccccaaagggcagcagcagaaccgccagactctcgcataagccttcgagcgcgaacttgctggcgcaataaacgtcattgaaaggcagcccttaggtggggagacgaggttcctgaggcgcagcggccagggggtcatccccgggcagacggtgcccctccaagctgacggcaccccactccaccccccccgcggaacctgccttcaaggctcagctccgcacacaaagaatctggagctgccgaggccactccctaccactcacccatcaatcctcccacgctcccggtcaccaacacgcgtcccgaaccgcgcctcttcatgtctggcaggaaggcctgcagcatccgcacagtccctactacattcacgtccagcacagaggccacggcgtcctcccccagcgcctccagcggccccagcaggcccaggcctgcgttacacactgcggagacaagaggcccgaccagcccgcctcagcatcaccctcagcacggcctgtcccctcgtgctccctgggcctgggaacatgttggtttcaacgcagggcggagaaggctcctaggagcccatatgcttccaggaggctcacccagcacgtccacgcggccctcagtcacgcgttcccgggcagcggccacggattttgagtcccttacgtccagctgcaacgtctccagggatcccggagggcatgccagggcccgggccgcctcccacagccggccctgtgttttcaggtccctcaacgtggcatacactggaggttttgggagaggaggaagatctgacttcccttctggcctccaagggctcctcccttctctccctccctgtccctgcctatctatacctttgaagctctgggatggatctgaagccagacgtacggccaagtgcaggccgatgcccgaggaacagccggtgatgagcaccacggtgcgggccatggtgagactgtggggagaggctggggctctgggcttgatatcacctgcttcgccccgccccgcctgcgggcccccaccccttgttgtgtctcccacgcaatctcaaggataagccttcctgcgggtccctggcccgctctccccaccctgttctgagccaaaacagacatgagcccactgcttggaacaacaaactgtcctggttgctggtcagagggaggggaggctttacaagcaggtgtgggttcccacgtgggcacagagtggccccctgggcagattcccctgggtatgcctctgtgccacaggagcgattatagtgaccgcagtttgctgcagaggctgtgaaagtaaaggcgttgggaggtgggagatgattgtatatgtgctggtttcgtccagggttcctagctcataactcacatgaccatggttacagtcttacgttgtcatgttggggtgcctcaggcctcaaaaaacagcctttcgtctctct

SEQ ID NO: 3727 - DNA, 6972 bp, Homo sapiens
atcctggtccactccgcagaggcccgagcgggctcgcgagggaacgggttctccgagtctggccggacttttgttcatcctgtagtgtcaagctcagatcaccacctctgtgaagccctccctgactaccacaggtggaacccctggggactgtgacagcctgtgtctgttcttccaccctctctgaatccaggatcagaagccctttgaaggcatgtcttgggtataaatcatctcaactccaaactcagggcttacaaggggccagagagttggtccaagagttgattgtcacagctggacagagcttgcatttccagtttttgtttttttggaaacagggtcccactcttgcccaagttggagtgcagtggtgcgatcatagctcactgcaacctcgaactcctgggcttaagtgatcctcctgcctcaccctcctgagtaggtaggactgcaggagtgtgccaccacgcccggctaatttttaaatgtttttgtagagactggtctatgttgcccaggctggtctcaaacccctggactcaagctatcctcctgtcttgcctcccaaagtgctgggattacaggcgtgaacctccgtgcccggctgcatttacagtattttgagcgccagtttgtttctgatttcctgctaactttgctccagttctgtagggtgtttgggtcactggagcctttgagacccgagagattatttttaacttttatatccccctgatggatgctgagcctggtctccctgggaccagggtgagtccagctaaccgaaggtcttcaaggggaggagctgaggacccagcatctcctggcagtgtacctggatgaagtccgaggggaggtgggtccgggttaccaaggagtccactcccttctggtcccaaaaatccagtcccccatacccctcattccaggtttcttggttcccagccgcttgagtccgatgctgccccctggtgggcaaacaccccaccgtatttgagagaggccaaactaattaaatacttttatttacaacaaaccaaaccgacctgcaagggagggccagtccccgtccctgcggcggtcgccgcagcagcagcagcaaaaggcagcggtggcgtgcaggtccagccgtctcggtgaccggtgtgtgtgcgcgtccccctccccgtggcgagggtctcagctttcgggcccccgccccgcccccttgccacccccgacttaagtaaggcacagcccgcgtccccttccgcccggcccggaaggcattcatgacggaggccggcgcagatgggaacaacaggcttttagtgtcgccccccgcagcccccgtctacccccgcagcccccgtctccccgctcggcccggctccggcgggaggagtgaggacgaggcggatgcgctccacgcacagctctgcggcctggcgcgtctcgcggcacagcgccgctagggtcaggaagccgtgcggcaggtcctccaccacgcgcagcgtcaccggctggcccaggttgcgcagtcgccgcgcgagcatgaccgagtcgtccagcatggggtccagcgcgcacgcctacgggacagcggggagggacgtggagagagggtgggggacagacagaccggggtcgggtagagcgaggaggggtttgatgaacaaagggagcgggaaatacggatacagacggagtggacggaggcaggagacatggtgggtgaggagttggggagagaatggagggaatggggggagttgtgggaaggatgggagaatgactttaactgcgatccccggcctctctccagcctctccctccccaccccgccaaacccaccttttttttctcttgattctccaagcccaaggggctgccccactgatcctgtctcttggtactcaaaattgcaaagtaaaacggaggcagccctgactcttgtcctcctcccgttcgttcggggcattgttctcccctggggacacgcctgtccctttctccccactccggagctctttttcccaggtgtacccgtgcccggtccccctcctccccgggtgccctgctcttctctaaatgcacctgtaccggccccctctgtcgctcaccacgatgtgcacaggtggcaggctcttgagcatgctgtcgggtgccagcagcggcgacatgaaggggttcttgactatgggtgaggagtagaggggcatctgtgtggcaccctggctggagcgtcgggggtggaaaccctcggggaaggcggcacggacgcccaggcctctgtccatggggctcagctcatttttggcctcagcctcttcccctgcatcctcaggtggtaataagaagttgacatcggagggtgtggaggggctaagtgtctcagctgacagcgacatctcgggggtgtccgacgacgtctcggagtttcccctcaggctcaagtccctcagggtcaggttcttgagggaatccgtgcccagtgggccctggggctgggccagtgctgcttcagacacactgcggcgcatcggctctgagagagggagagcagataggcctggctccgttagtttggttgtgtgtgtggctggcagggaatgccatgggaagggcagtcgcctgtggagcgctgtgaaaggctgtgtttccccagactcttgcctaggggatgggtggagttccagatgccccaggtggtcatggtgggggtcttggcagtggggcagtgtgttctagtgaaggatgtgtgtgtgtgtgtgtgtgtgtgtgtgtgtgtgtgtgtgtgtgtgtgtgtgactgggaagattaggtgcagtttacctctaggaacctattttttcttctagatcaaggaaatgaaaatagtccttggttcataggtggcaggactcagtgggataagatgtgggattaggtaccgctacccactggggatcataatatatcgttttttgtttttttttttttgagacaaagtctcgctctgtcacccaggctggagtgcagtggcaagaacatggctcactgcaacctccacctcccaggttcaagtgattctcgtgcctcagcttcctgagtagctgggactataggcatgtgccaccatgcccggctaatttttgtgttttttttttagcagagatggggtttcgccatgttggccaggctgttctcgaattcctggcctcaagtgatccgctcgcctcggcctcccatagtgctgggattacacttaccacaaggtgtaaatggatcaaaatgatttgaatagtaagcaggcccagtggcttgaagggaggctctgttcacagggagctaacaagtctccagggtgtatcacatttctaggggtctggcacctgtagccacatggatctgcttccccacatttcctttgtgttcttcagttttatccgttcacgtgaccaggcaagcaagtgcccaaacgatgctaaagatacacttccagcccacctggcgtgcccagcttggcctcagctctgttcattttatcagacccacactgcctaccatgagggccaagatgctacagttttagttttttactttttttttttttttttgagatggagtcttgctctgttgcccaggctggagtgcagtggtgcgatctcggctcactgtaacctctgcctcccgggttcaagcaattctcccgccacagcctcctgagtagctgggattacaggcatgccaccatgtccagctactttttgtattttttttttttttgagacagtctcactctgttacccaggcttgagtgcagtggcgtgatctcggctcactgcaacctcgtctcttgggttcaagtgattctcctgcctcagcctcctgagtagctgggattacagatgcatgccaccatgcccggctaatttttgtatttttagtagggatggggtttcaccatgttggtcaggctggtctcaaactcctgacctcgtgatctgcccgcctcggcctcccaaagtgctgggattacaggtatgagccattgcgcctggcccatttttgtatttttaatagagatggggtttcactatgttggccaagctggtcttgaactcctgacctcaagtgatccgcctgccttggcttcccaaagtgttgggattatgggcgtaagccaccacacccagccttacttgtctttataaatctacgaaggtgaggtgcaaaacaatgtgagaataactacttaagtactttgtggcccagagggtcactggaacagaatggacacaccaggggtgctggcatcttctaatagcacctactgggtgccatatattgtactggccaaatggttggaggcagacctcaccacagcccagtaagcgtactctttttttaaatttttttttttgagacaaggtatcgctgtgtcacccaggctggagtacagaggctcagtcttggctcactgcaacctctgctacccaggttcaagcggttctcatgcttcagcctctctggtagctgggactacaggtgtactccaccataccctgctaatttatttttttgtagagaaggggttttgccatattggccaggctggtctcgaactcctgacctcaagtgatctgcccaccttggcctcccaaagtgctgggattacaggtgtgcaccaccacacctggctaatatttttgtacttttactagagacagggtttcgtcatgttgaccaggctgatcttgaacccctgacctcaagtgatctgcccacctcagcctcccaaagtgctgggattgcaggtctgaaccaccatgcccagcatcttccctgggacttttgctgtgctaggctgtccctcctgcccaccctggctgggcatgtgacgggagtgaatcactcacctgctatgggctccgacatcttctgggacttgcgcccacttaactccaggaaggagttgagccatgaggaggcacccaggcggaagtctcggaggagcagggctgtgtcccgccgcaccagccccatcatgccgagggctttctggtctgagttggagtggtcctccgtctttgcacctgcagaatatatgtgggtagctgagttgttttcccctttctgggcccagttttaacgcccagaacttcaggcatctgtggtcccagggacccgagaatatccaatcgcttcaaaagggataaggaggctgggcgcagtggctcacgcctgtagtcccagtactttgggaggccaaggcgagaggatggcttgagcccaggagttcaagaccagcctgggcaacatagcgaaaaacacaaaaattagctgggcgtggtagtggtggtgcacgcctgtagttccagctacttgggaagctgaggcaggatgattgcttcagcctgggaggtcaaggctgcagtgaggtgtgtttgagccactgcactcagcctgagcgacatgacaccttgtgtctgtctgtctctctctctctctcacacacacacacacacacacacacacacacacacacacacacgaaaaaaaagggacaaggagtcttagattcctctgcctggcctctccttcctcagtcacaggagtcctggtccccagcccgtccctgcaggagtcagacatccatgcagtcctgtttccctgctgagggtgtgggcctcaccagcataggcgctgacacacttggagagcacactgaggggcagcaaggggtccatgaggctcagcaggcgggagggagaggcggcaggctgcagcattgtggccgggtaggctgccatgatgccatctggcacccgcaccccgtaggctgctgcccgaagagccacggtgaagcagaggttcccgcctgcactgtcccccgcaaggcagattcgttcccctgttgagcctggtttgggagaggggtggttggtgacaacctggcaggggcagaggcctggggaggagggcagggaggaactcaagctgggagaactgggctctccaaggtggggtgtggggcactccaaggcctagcagactgcagttttagagactggcagactgaggcacagatttgggctcatgtggtagacagagggtcaggatgactcaggacctggagaggcccagggaagcactgggaaagtctgtcggggctggaggttgggagcagggagggcaggtggtgggaaaggggagctgagctcaggcctgttgcaggaggggggcctcagagggcgggaatggaaggtcagggttcagggtcagtacagaggggctgggctgcaagctctgtgccctggggcatggccacactctgctctgtgcctcagtgtcctcccaagatgttgatcttcgaagagggaggtcagagaagctggactgtgggccaggaggctggtaggacaggagagcagggcctggagctatcagagggggacgacagaggcccagggagacaggacggtgggtgggaagtggaggtggaggagatggagagtctgggtgccacagttggggacagaggataaagtggctgaggtggaagattgggcaggacctgggtgagcaggagctgggaggtgtggggggagagaaaggtagagggtgtgaggctgaggctggaggagcttaaagcaagctgggtgggatgggagcaggcgcaggtggctgtgggggcctgaggctcaccaaggagggcgcagtgcttgatggcccagcagtaggcgaagaagcactcctccagcgcacgggggaagggggcctcaggggccagggagtagtcgatggagatgatgggggcgcccagctcctgggcccagctcttgaggtagggctcgtgggatctggaggtctgggccacaaagccaccgccgtggaagtgcactatcagggaccgcgagcggggtgcctgctgggggcgcggccacagctccaggctccgttggccgttggactttatcaggctgctgagctcctcactgtcctggg

SEQ ID NO: 3728 - DNA, 538 bp, Homo sapiens
actgcgaagcccagctgcgcgcgccttgggattgactgtccacgctcgcccggctcgtccgacgcgccctccgccagccgacagacacagccgcacgcactgccgtgttctccctgcggctcggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccggctctccagatgaaccacagaagcaggaatgtgggcatcatcagtgaaatctctgcatacagcagacaaagggctggtccagtggctgtttatgaggcagcgctaggagagctctgatccagactctccctgcagtgaaagggagggagcccttcatgaagtattgactgcttgagcaggaattgcttcaccagcacctaactgagtgcctctcgagctcacatcggttttccctcatgaggccacttggagtcttgct

SEQ ID NO: 3729 - DNA, 1486 bp, Homo sapiens
ggcagaaggggtcattctccctggagatgtggtcacgtcattaaccacactgggttagaatcatcagaagctgttcctgcctcttccgtcaagcaaggggctctggaggccagaaaatgcctatgaatcatgcccacacccccagagcccagcatggggcgggctcaggttaggtcaatcgtgtttgaagactgaataaatgaatgtcttcatttgctaccctcagaagcccagtccggaaaaatattccagtgcaaggtttttggcttgaatgagatcccaagaatcaccttcaggttgtcaggaaaatgatacagggaagggaaggagccaacaaagggtatgggaatgagcacataacactatggacagctggggaaccttgggcgatgatgcagaactgtttatcactaactctcaccaggtcagttgtgcatcaaggctactcgggggatagcactttacagcctactctagcaccacggtggccttctggggcaggggccagcaggctgcagctgctggatgaagcccccaggcagagtcgctggtcctcaggtgctcaagcttagctggaagccttcaggttgctgtgcaatggaatagtgagtacccagaggatatgtgcgtgtgttacagtgagtgagtgaatgaacgaatgaatggagaatcaagaaaagagccgcgtatcttcagtcattgagcagacacgggccttctgctgtgtggccctggacgagccatcatgcctctctgaccctggtttcctcttctataaagcaggaatgctagcccagcctcccaggagataaagggtgggaggtccccagagagtgagaagggttccacctgggctcccagactcaatctcagctccaggaagcaggacatggccccagtgagggttctctgtgggtgaagaagccacagaaggcaggcacagtgccctggttggaaccacaggggccccgaagcaaccacatcatggccaccacagcctccaccatcccacagcaatttccgctgctgcctctcccagggcaagatctcccaccagtggctggctgtcccctctgccagcacctgccccgggtgggccctgcagcatggccatggctgctgcaaggcaggctggcagctgctcctgtgtgcagcagcgtgtctgctttgaaaagccacagagactcctgtggttaggggctcatgttacagtagcacacgttcgaatcccagttctactacttgtgactgtgggaaagtaatttcaccccagtcctctctggtctcattgatcaaatggaactaacattctattgtcccctctggtggtctcaactccagcagtttgtgagatggttgccttcactgttttccctactgcaaaacccataaggacacagttatcttgcctcctgccccaaccccagggtcttgaacacagtaagtgctcgataaatgcttggtaaatacatgaattattgtctga

SEQ ID NO: 3730 - DNA, 1613 bp, Homo sapiens
agtgcgggccgtgaggggtgtgcgcgcttgagccggagcggggctcgcccctcgtcggctcccgccgcccagccggtgatcgctctccggccgtccccggcaccctcggccccccacggcggttggtccgggcgggggaaggagaaagtgagactcggtgtcatcaccaatccatcgccagaaggggaggaaactggaatccagcagcggcgagcagcagctggacggtaacatctggaaatggaaagccgacctccccctcctcctccacctcctcctcctcctcctcctcctcctcctcctcctctcacccaggatcacttccaaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagggcccgcctggcaggacgactgagcaagtccttggaaaaccagagatattagagcggtgaatcgcgctggtcacgttggacacctgcgcgttaggagattctggagccagagggagagaccccagaaactccccggtcggcgacccagcccgagacgcctggggtcccaagggaagctgaacgcccggtgggctcccgggatggttcttccggttctttgtgccgccttcacccagtgaaggagcctgtatccaccctgcccagtcgctgttgggctgctgcggagcttccgctgccatcttcggatcctgtgttccgcccggggctccaccagggcagggatggtggtgagggtcgctcgtgggtcccctggcagggagcagggtctggcactcacaagggcgcacgactaggacttgtcgaatgaatcctttgtcgcctttagcttttagtcctttgaagagaggtgagagtggaaatcaagagatttttttccacggggaagttctttttacaaagcgttgatttctcggcaccccgcggggcgggcaactgacacggcctccggtgcaccttctgcgctgtggagcctctggggctcagctgggcggtggtcgggtcgtggggcggtagggcgggagcgggggaagggaaaagcaaaagctggaaaagaagcaggggagttatgaaccagacatccagacctcctgaagggctcgtgcagacgtacaggcgggatcttctggaagtgagaattgtttttgtttgtttatctattgtagcagaatggggaaatggagagagaacctgaaagagccccaaactcgaggacctattgctccccaagaataacatcttccagaactagacagaaaactaggcgtctgggaaccctgaaatccttggaggagtagatcatcatgaccctctgtgttccttttggcaaatgacttgcttccattgtttgtttgttcaattgtctgtttgttaaataaataaaacccttttcatgtatctttaaaattacattggttctattattttatgattacaaacgatgctgcagtcat

SEQ ID NO: 3731 - DNA, 5373 bp, Homo sapiens
gccccgacccggctccggccccggcccctgcccgcgtccggcgcccgccttacgctgccttcgtagcgtagcgcccggcccgggccccgcggctacggcgcgcccggggcgcacgcggcgctgtgaatcgcgcgcccggactacggctcccacagggctgcgcggcgccgacggggcggaagctcggggcggtgcctgcgcgaggcaggccgggagttgtagtcctcgggtggcgccctcccagtccgccgaccgcccgggccacttctcctgccctcgctgctggagacggccgggcccgaggcctcggtccccgggaggcgccgcgctccaggattatcagggagtggggcggcccgaggaggagctggaactacaactcccagagggccttgcgaggggcacggaggggcggggcctgcagccgcggcgtctgcgcatcagcggcgtcacagacgcgtggggctcgcggggagccgggctggggccgtccgtgtcccgcggggctctgggcggccgctcgaccgaggacccacgactccgccccgaccccgccgtgttcgcgagacccggagaccccttcgcgccttccaggaccgcccctttcgcgacgctgcgtgctgtgcttggtcctggcggccaagagcggcggtggcaaggggaccgccctggcccgagacgcggcctggcctcgcagcgtcgcttgggcacagcctctctaggccccttcgtcctcggtcgcggagggacgccattaaacggccacgccgggctcaactgggacgcggcccacggcgcccaaccagggcctgggggagggaagccggggcgactcctgggtccttccaggacccttgcgcaggcctcattctctccccggaggtccccttcccgctgccctgaggccactctcctgccagcagctgctgggccggctctcgggagaatgccttggcgtcaagcttatcaggctgcagggcgggacgcgagtgctgagggcagccagactcccgctcttaggtgcacttgaggagcctgagaaggcagtggctctgcgggagagggagacacaggagcagggctggtccgccgagattccggagagacggttgtgggccgattctgtggcgagatttacaagtgggaggttgggtgacgattgctcctgggccagaaaatctaagccagtctcagcaagacctacaaggccagggccagtgctcctcagaggatattcatgctccaggaaagccaaggatgggcctccgtcatgctgagatgccgcagcagggacacctgtgtcccacgtggagctcggcttctagctgcagtcagtgcagaagctggcaggaggggtttatttctgtcctcggaagcttttggtaaggacacttcattcctgtgtcttggacacctccccctaggtctgctgccccctctgtggagacaggcagggcagctggatgtgccgtttgttcccagactatatccatgccaaagcatcccaagggcaggaaatgtgtccccgggggccagtgggggtctgggggcacagagggctgcagagtgagagctggctctcctctctgcaacttggacaaggctctgggaccctgtcctccccagcttcctcacctgcatggcaggatactggccaagtgtggctttcgaaccacaggagagggtgcagtcaaggcctcactcagggaccgcaggttctcttcccttcccagtccttccctggcactgcctaggtggctccctggccaggggccagtggtctagccagcaggccttataacctccccaccagagaggcagctgcagttgaacctgttgatctgatgctgagggccctgccagctcactgcagagtggccagttctggccagttttgctaggccaggcccatttggggtgaggagagggtgggagcaccccagctctccccagtagcctgtcatggtgaaggaggaagcccattcacccagaagagggcctcaggaggcgtcttcaaggtgactgaggtttccccgcacaaggagagtgctggagggaatgggtgcgatgagagaaatgagtcactcgtgcctccgtgaggccagcctgtgattgtcttgaagattctgagtcacaagacatcaggcacacaggcgtgaattgtaaatgactgcacagcagaaggtaagtgactctggattatccagaccattgaccgagccctgctccgtgccagtgcttcctggcctgaggacacgactctcacatccagacagacctgagcagctaacgcaagtgcgcagaagctcgccaagtgcccagaagagccaagaggcgagccatgaatcccccctggaggagaagaggatggggagggccaaacagaaagaactgaaactggaggcatctgttcaggcacccagagaaagcctcacgcgcacaaagcagcaaacagaacaaaccccagtgccatcatggagcccagacttgagcacacagggaccctggcgtggagcacgagggtgccaaggcccgcaggtggctgacttgtgtgctctggtgccatgctcagatttgatgggatgaccctgcaattgcctgctttgtgagccacacaggcctgggtcaaaaagacgacggaccaccagcctgggcaacacacaaagcgaaacctgtctccacttaaaagataattagggtgtggtggtgtgtgcttgtggtccctgctacttgggaggcagaggcaggagcatcacttgagcccgggaggttgaggctgcagtgagctgggatggcacatggcgctccagcctgggtgactgagtccgtctcaaaaaaagaatgggcggccggacaggtgaaaataacaatggacggggccctgggagaagttcccgcctttctctgggccaccacctccaggttactggactgccagcaggtagaggggccagggtgccatccggggggccgctgagggggtccagacttcctatacctgcccttcagcagaggcaggctggggcggtcctcatgtgaggggctctgcacccacatccggggggccgctgagggggtccagccttcctatacctgcccttcagcagaggcaggatggggcggtcctcatgtgaggggctctgcacccacgtccggggctcttgttccagggcaggggcagagccgctcctctctatcctgccgggcaagactccttggtgctcttccatcgggcagaactgaccaagactcagaacattcaatgtcaggagccagctggggacaggatctgccttgggagacttggcaggcccagtgaccatcccactgcacagctgggggtgggggcgacactccagagggacacgttcgggcctcctggggggtgcaggcttctgggcacgtccaccaggcatgcacaccggccaccccaccctgctctcgctcacccacaaggtctctggcagcccttccgggaatgtttccatttcatcctgtgtcctcctgtctcaaactcctttgggctggagaccccagtgggtcatcgaggtggggccagctggactgtggacagccccatgtttaaaatctagcgtggaaactgaggtgctcctagaccacagtggggtatcaggaggaggaagctgctccccttcccctccctggctctggcctggcagcgtggagtgagttcccctccccacctccagcttctccctctaggcagagatgggtcttactggcaccacacagacccctgggtaggtgggagagcaggtctttttcctgggaggaggaacttggccttggacacacccacaccgcccatgtcactcctcagttctttttttttttgagacggagtctcgctctgttgcccaggctggagtgcggtggcgtgatcgctgctcactgcaagctccacctcccaggttcacgccattctcatgcctcagcctcccaagtagctgggactacaggtgccggccaccacgcccggctaatttttttgtatttttagtagagacgtggtttcaccatgttagccaggatggtctcgatttcctgaccttgtgatccgcctgcctgggcctcccaaagtgctgggattacaggcgtgagccaccgcgcccggcctgtcactcctcagttctaactcatgaagcaatcagggttcttgggccctgtgacctggaaccattctgctgcacctgcactgagggttcaaggactcctcactgtaggccacgcctggtcctcttctggtcaccagcccgcaagcagcagctgggctgaggggactggcagacctgggtcctcagcttccctgggccttggtttctccatctccatctgcatctgagagtgacaggcaggcgggcatctcgcgcggggggcgggagagcgagagccgcagatgcacagtccgcttcctggatgctggaccaggtggtccagttttcaaggcttgtgtttttgggggactcttgatcagatgggaccactccccgcaggccattctttgtggctgcagtggcactgagctctctcagactccctggctgcccatgacctcgggagcccacttccgtcgggacctgcctcctcaccttcccgtgcctgtggtgctggtactgtgtctgccccctcttctgggggatgtcctcccaccaccctgcacatcactgcccttttaaattctttctgaaatggggtctcgctgtcgcccaggctggagtgcagcggtgtgatcacagctcactgtaacctccgtctcctggactcaagcaattctcccacctcagcctcccaaggaactgggactataggtgcgcaccacaatgcctggttaattttttattttttagagatggggccttgctatgttgcccaggctggtcttgaactcccgggttcaagcgatcctcctgccttggcctcccaaagtgctgagattatggcgtgagcctctgcgccctgccccccactcttctcttaatcccggggacgttttgacggctctcccgacatgggacgtacgtccccagaggcgtgtgacccagagccctgatgcccacacagccctgtgctgcccaatttgccccgccccacctgccccaccttgatgctgtctcagcagctcgtcaggatccagaacctggctggaaagctgccaggctccactgggcctggaggtgcaatcctacggccttggaagggtcttagtctgaccaagctgcagagccaggcaggtctgctgggttctgagctcagacaactgatggcctcggacgccttgagggaagctgggccaggcccagaagactcccaccccaccctgtggcccccctggaggaagaagccggcctctgc

SEQ ID NO: 3732 - DNA, 2904 bp, Homo sapiens
aggcacatgcgcagaatcatcgtggtgcacggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccagtgattctaccagaaaggaatgaagaacagaaccttcaggaattgagtcacaatgcagacaaatatcaaatgggagattgttgcaaggaagagattgatgatagtattttctactagccattgggaagataaaaggagacagaagattgaagcctttgccagccattctttccctttttgcttccaaactcctcaactgggaaccttcatatgtgcagtatttatattggatcatactggtgattataaaagttcctaggaggctagaagagccaaccaacagagaagggaaagcagtctgttctgaacatagggacataagttcattcatgccaagtatctttccagcatgtttctcccatttagaatatctagcatgtaaggcctttcaatattaatataagcccaatatcagctctttctctttgtatttcatctctttctactctcctatttgtattttgtgttcctatcaaagtgtcgtatctgggagatgacctgccttatcctgttctataacagttttgtttgctgctgtgtctttagaacagtgcctggcacacagtaagcactcaataaatctttgatgaatgaatgaatggttatcttttctctctggcaatccaaattcaccactccttaaaaattctacataagatttgctggctgggcgcagtgactcacgcctgtaatcccagcactttgggagactgagacaggtggatcacctgaggtcaggagtttgagaccagtctcaacatagcgaaaccccatctctactaaaagtacaaaaattagccgggcgtggtggcaggcgcctgtaatcccagctacttgggagactgaggcaggagaatcacttgagcccaggggggcagaggttgcagtgagctgagatcacgccacttcactccagcctgggcaaaagagcaaaactccgtctccaaaaaaaaaaaaaaaagatttgcctattccagcagacttctacccaatatcaatctagatttaaatcacttgattttccacatccctttagcaattatgtatagtttgcacttcattaacctacccttatttatgttacttctcacatacacccatatctcttctgtattttcaatcaaaagataatgcctcaaatgttatatatattgtatgtgccactcaacagtgcctcatatgctgcaaaaaaaaaagacagtaaacaatcggggtacctttttgtcttttaagccatattttctgggtcagtgtggtctttcaagggagtttagacaggctctattttttgttacttcactcctatagtatgtgactgtaaattgttccttcagtgttcaatttaagtacaaactaaagagaaacagtttcctaaagaaaaacattttaaagttacagagacacctatgtgttcgtaacatttctccagaaatatttgaagtaacgtaaaacttctggactggtcagtttaaatattttcttggaatttctatagaaatttctgtggaatggtgttatattggaaatattaattaactataagaagactcctacttcttcacagagaacaagcagggatatcctggattttcacagtatttaggccactccttaattgtctcatgaaggaattaaggtagtggaacacattcaagaattgcttaggtgtcaaaataagacaaagtgtaacagtttttttctgtagtagatttttaaatagttaaaagactctgccctctttatctatactgtattctggcaataataaagttgggcagcctatacataaaagcaatttctaacaatgccaaattaacagcagtttcttggccctttcctttccctccatgaaagttacaatattaggttatttcacaggtttcctccatgccccccatacccaacctaaaactgtgttaggctgtcaaagaaaacaaatcaggtaagattagtgtttgcctttacgcagtcattctaagtacacataaaatcatacataatatgaaaatacagcaggaagagaaacatcaaaccatagaactgagttttagttttactgacatttatatggcatacttcctgtttttgatttcagaagtgcaaccatgcagtgcttctatgaaaaactgaatagttgagtacagtttgaggattataacaacttatccaaaggaaacaaacagacctaacttactgctgttttcatttgtggaactgctatctttgttgtaaaaagttgagtatttttcaaacatcatttaataatagggtagcccctaaaacaagtaaggagctataagtctgagttgtgaatttgactagtaatggaataagaaaaccaagccaaactccatctaaatatgtatgtaaaggtaatgcttgtaaaaatttgctttttcctcattttgagatttcagttgccagttgactattggtatgcaaaattaacaattctgcctaaaggaggtaaacgatagaggttaattcttaaataaaagtccctttgtttcactatt

SEQ ID NO: 3733 - DNA, 656 bp, Homo sapiens
acgttcttttctttgttgccgttggggtgctggactttgcacaccacgtgttcgtctgtgccctgcatgacgtccttggaaggcagcagcacctgtgaggtggctgcgtacttgccccctctcaggactgatgggaagccccgggtgctgctgatgtcagagttgttcttgtatttccaggagaaagtgatggagtcgggaaggaagtcctgtgcgaggcagccaacggccacgctgctcgtatccgacggggaattctcacaggagacgagggggaaaagggttggggcggatgcactcctgaggagacggtgaccagggttccctggccccagtagtcaaagtagctcccctcactgtgtctctcgcacagtaatacacggccgtgtcctcggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagtctccaccagctgcacctcac

SEQ ID NO: 3734 - DNA, 2170 bp, Homo sapiens
ataccgggtctcacactgtcacccaggctggagtacagtggcacaacctctgctcactgcagcctccacctgccaggctcaagcaattctcctgcctcagcctcccgagtagctgggattacaggatgtgagctcacaatgactcaagctgccacatactgttgattgtgaaatgccagttgaagcatatgtcctgcgagcttaggggtgctacaagttgaccactgcagcagtaaagatgactctgaagaatggcgtgggttggttcctttcaaatgcacttgagcagcggtctccaaccacagggccacagagctggagctggatctaccatgaaagacttgtgaatccaggaagagagactgactgggcaacatgttattcagaatcttcctgtgccatccaggctggagtgcagtgatgtgatcatagctcactatagctttggccttctgagatcaagcaatcctcccatctcaacctcccaagtagctaggactacacacgcatgtcacccatgcccagatcatttttgtagagtcagagtttcaccgtggtggccaggttggccatgttggccagatggggtcttcttttgttgcccaggctggccacaaattcctgggctcaagtgatcctcccacctcgtccttgtagagatgagatttagttatgtcgtccaggctgatctcaaactcctgggctaaatcgattgtctcacctcagcctctcaagtatgttatgaaggttatatgttaggaagggtcccaggaggtaaacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgggaacatccagttgcaggaaaacaagcttaacacgcccactgattctacattatgctcctacctcccggcagcctctccaggcccagaactttctccagtcagcctctacagaccaagctcatgactctcaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaacatttggaattttcgtatacgtggattctagaggggtgacagcgaaacgtgactgcaggacaagttcgagcatcttaaaatgattcaacaggaggagataaggaagctcgaggaagagaaaaaacaactggaaggagaaatcatagatttttataaaatgaaagctgcctctgaagcactgcagactcagctgagcaccgatacaaagaaagacaaacatcgtaagaagcaatagtttctcttactattctgagagccttatcattctacatcccatcttcctgtgagtttgtctttgtagcatttaactctaattgcagttctcattttaaaaactggcttgcttattgtatattttccccaactaaagcgtgaactcctagcagggcgtggtggctcatgcctgtaatctcagcactgtgggaggccgaggtgggtcgactacctgaggttaggagttcgagaccagcctgaccaacatgatgaaacgctgtctctactaaaaatacaaaaattagctaggcgtggtggctgggacctgtaatcccagctacttgggaggctgaggcaggagaatcacttgaaccctggaggtggaggttgcagtgagcagagatctcaccattacactccagcctgggtgacaagagcaaaactgcatctc

SEQ ID NO: 3735 - DNA, 2957 bp, Homo sapiens
aggcacatgcgcagaatcatcgtggtgcacggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccagatgaggacacctgaggttcagattaagaaatctgccccaaagtcttagaactgtgattctaccagaaaggaatgaagaacagaaccttcaggaattgagtcacaatgcagacaaatatcaaatgggagattgttgcaaggaagagattgatgatagtattttctactagccattgggaagataaaaggagacagaagattgaagcctttgccagccattctttccctttttgcttccaaactcctcaactgggaaccttcatatgtgcagtatttatattggatcatactggtgattataaaagttcctaggaggctagaagagccaaccaacagagaagggaaagcagtctgttctgaacatagggacataagttcattcatgccaagtatctttccagcatgtttctcccatttagaatatctagcatgtaaggcctttcaatattaatataagcccaatatcagctctttctctttgtatttcatctctttctactctcctatttgtattttgtgttcctatcaaagtgtcgtatctgggagatgacctgccttatcctgttctataacagttttgtttgctgctgtgtctttagaacagtgcctggcacacagtaagcactcaataaatctttgatgaatgaatgaatggttatcttttctctctggcaatccaaattcaccactccttaaaaattctacataagatttgctggctgggcgcagtgactcacgcctgtaatcccagcactttgggagactgagacaggtggatcacctgaggtcaggagtttgagaccagtctcaacatagcgaaaccccatctctactaaaagtacaaaaattagccgggcgtggtggcaggcgcctgtaatcccagctacttgggagactgaggcaggagaatcacttgagcccaggggggcagaggttgcagtgagctgagatcacgccacttcactccagcctgggcaaaagagcaaaactccgtctccaaaaaaaaaaaaaaaagatttgcctattccagcagacttctacccaatatcaatctagatttaaatcacttgattttccacatccctttagcaattatgtatagtttgcacttcattaacctacccttatttatgttacttctcacatacacccatatctcttctgtattttcaatcaaaagataatgcctcaaatgttatatatattgtatgtgccactcaacagtgcctcatatgctgcaaaaaaaaaagacagtaaacaatcggggtacctttttgtcttttaagccatattttctgggtcagtgtggtctttcaagggagtttagacaggctctattttttgttacttcactcctatagtatgtgactgtaaattgttccttcagtgttcaatttaagtacaaactaaagagaaacagtttcctaaagaaaaacattttaaagttacagagacacctatgtgttcgtaacatttctccagaaatatttgaagtaacgtaaaacttctggactggtcagtttaaatattttcttggaatttctatagaaatttctgtggaatggtgttatattggaaatattaattaactataagaagactcctacttcttcacagagaacaagcagggatatcctggattttcacagtatttaggccactccttaattgtctcatgaaggaattaaggtagtggaacacattcaagaattgcttaggtgtcaaaataagacaaagtgtaacagtttttttctgtagtagatttttaaatagttaaaagactctgccctctttatctatactgtattctggcaataataaagttgggcagcctatacataaaagcaatttctaacaatgccaaattaacagcagtttcttggccctttcctttccctccatgaaagttacaatattaggttatttcacaggtttcctccatgccccccatacccaacctaaaactgtgttaggctgtcaaagaaaacaaatcaggtaagattagtgtttgcctttacgcagtcattctaagtacacataaaatcatacataatatgaaaatacagcaggaagagaaacatcaaaccatagaactgagttttagttttactgacatttatatggcatacttcctgtttttgatttcagaagtgcaaccatgcagtgcttctatgaaaaactgaatagttgagtacagtttgaggattataacaacttatccaaaggaaacaaacagacctaacttactgctgttttcatttgtggaactgctatctttgttgtaaaaagttgagtatttttcaaacatcatttaataatagggtagcccctaaaacaagtaaggagctataagtctgagttgtgaatttgactagtaatggaataagaaaaccaagccaaactccatctaaatatgtatgtaaaggtaatgcttgtaaaaatttgctttttcctcattttgagatttcagttgccagttgactattggtatgcaaaattaacaattctgcctaaaggaggtaaacgatagaggttaattcttaaataaaagtccctttgtttcactatt

SEQ ID NO: 3736 - DNA, 2955 bp, Homo sapiens
gcacatgcgcagaatcatcgtggtgcacggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccagatgaggacacctgaggttcagattaagaaatctgccccaaagtcttagaactgtgattctaccagaaaggaatgaagaacagaaccttcaggaattgagtcacaatgcagacaaatatcaaatgggagattgttgcaaggaagagattgatgatagtattttctactagccattgggaagataaaaggagacagaagattgaagcctttgccagccattctttccctttttgcttccaaactcctcaactgggaaccttcatatgtgcagtatttatattggatcatactggtgattataaaagttcctaggaggctagaagagccaaccaacagagaagggaaagcagtctgttctgaacatagggacataagttcattcatgccaagtatctttccagcatgtttctcccatttagaatatctagcatgtaaggcctttcaatattaatataagcccaatatcagctctttctctttgtatttcatctctttctactctcctatttgtattttgtgttcctatcaaagtgtcgtatctgggagatgacctgccttatcctgttctataacagttttgtttgctgctgtgtctttagaacagtgcctggcacacagtaagcactcaataaatctttgatgaatgaatgaatggttatcttttctctctggcaatccaaattcaccactccttaaaaattctacataagatttgctggctgggcgcagtgactcacgcctgtaatcccagcactttgggagactgagacaggtggatcacctgaggtcaggagtttgagaccagtctcaacatagcgaaaccccatctctactaaaagtacaaaaattagccgggcgtggtggcaggcgcctgtaatcccagctacttgggagactgaggcaggagaatcacttgagcccaggggggcagaggttgcagtgagctgagatcacgccacttcactccagcctgggcaaaagagcaaaactccgtctccaaaaaaaaaaaaaaaagatttgcctattccagcagacttctacccaatatcaatctagatttaaatcacttgattttccacatccctttagcaattatgtatagtttgcacttcattaacctacccttatttatgttacttctcacatacacccatatctcttctgtattttcaatcaaaagataatgcctcaaatgttatatatattgtatgtgccactcaacagtgcctcatatgctgcaaaaaaaaaagacagtaaacaatcggggtacctttttgtcttttaagccatattttctgggtcagtgtggtctttcaagggagtttagacaggctctattttttgttacttcactcctatagtatgtgactgtaaattgttccttcagtgttcaatttaagtacaaactaaagagaaacagtttcctaaagaaaaacattttaaagttacagagacacctatgtgttcgtaacatttctccagaaatatttgaagtaacgtaaaacttctggactggtcagtttaaatattttcttggaatttctatagaaatttctgtggaatggtgttatattggaaatattaattaactataagaagactcctacttcttcacagagaacaagcagggatatcctggattttcacagtatttaggccactccttaattgtctcatgaaggaattaaggtagtggaacacattcaagaattgcttaggtgtcaaaataagacaaagtgtaacagtttttttctgtagtagatttttaaatagttaaaagactctgccctctttatctatactgtattctggcaataataaagttgggcagcctatacataaaagcaatttctaacaatgccaaattaacagcagtttcttggccctttcctttccctccatgaaagttacaatattaggttatttcacaggtttcctccatgccccccatacccaacctaaaactgtgttaggctgtcaaagaaaacaaatcaggtaagattagtgtttgcctttacgcagtcattctaagtacacataaaatcatacataatatgaaaatacagcaggaagagaaacatcaaaccatagaactgagttttagttttactgacatttatatggcatacttcctgtttttgatttcagaagtgcaaccatgcagtgcttctatgaaaaactgaatagttgagtacagtttgaggattataacaacttatccaaaggaaacaaacagacctaacttactgctgttttcatttgtggaactgctatctttgttgtaaaaagttgagtatttttcaaacatcatttaataatagggtagcccctaaaacaagtaaggagctataagtctgagttgtgaatttgactagtaatggaataagaaaaccaagccaaactccatctaaatatgtatgtaaaggtaatgcttgtaaaaatttgctttttcctcattttgagatttcagttgccagttgactattggtatgcaaaattaacaattctgcctaaaggaggtaaacgatagaggttaattcttaaataaaagtccctttgtttcactatt

SEQ ID NO: 3737 - DNA, 5153 bp, Homo sapiens
agtggcggcgcggcggggaccgagagctgcgggcgggctggaggtaccccaccgcggggtggtgctctgactgcgggaaccgttgaagagctgcccccggggagtcagcgaggcgccactggtaagcggcagcggctggctggccggcgtgccggcagctgggctggcgagtgtgcgggcgccgggcgctggaggcccgggccggggcggtccccgcccgtctatagtctctgagccagccccttccctcccgggcgccgggtccccgcccacaggcccacctgcagggccccgtgctcgaaataacgcccagctggttggctttttttttttttttttttctttttctggctcttggtctcttagacatcttctcaagattatgctaagagaaatgactgcacccttttcctgagctatggcagtcagacctggcagtggtaactactctacagaactcccaaacctggcaaggatggtgcagattttggcagattatggctttgtccccacccagcactgatgatattataaaacctatactacaagaaatgataatggaagttcttcaactgagcaagaaatgatattaacagaaaacttggatcttcagaagcaaatgaagaacatcagaaatgcaactttcattgttagagagaggagagagagagaagccttgttggttgacgtcacttggttcatgaagccttcgcctagaagtgaagctgctgaacaaaccttgagaagaatcatctcctgcttcaatctgctgctggataggaactaatcagagagagagaggcggaagacggagaaggagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtttcccaacagtgatgtcacaagattgaccacattgatcacattgtagtattgatattcagtaaggaaagagacatgaagaaagctatcagatggaaagttgtttggtctcaaagattctgcctgacagcacattcctaggtaggaatttttagccatttattcatttagtcattatattgtatgcttcacatactgtcactcattcactcatttattcattctacaaataatttatggagtgctgcttgtgtgtttccactgtctagatattggggttactgtggtcaataagatgaagtttcttctgtcattaagtttactttctactggggagaagtaaacaaatatataagtaaaatattctcaattattgataagagctccaaacagggatggaggaaggaaaatgtgatagcatatacaggtagtcaggtagaattgagggcaacatacatataacagtcagggaaggtctccctgatgaggtaacacttgtgttgagaaatgaatcaccagaaagagccaggtgtcgtgttgtgaaaatcagaggttatagtgatcacagtgccagtgaggctggaatgtagtgagctgtgggaataaaggtaggcagatatcatttaaaaaaaaagtttaagcttctttctaatgtgaagagaagccactggaagatgtttcatttgattttagttttttaaattaaatacagacagggtctcagtatgttgctgaggctggtcttgaactcctgggctcaagcagtcctcttatctcagcctttgactccaagtgctgggattacaggcatgagccaccatggctagcctggaagatttttttggttggttgattttaataatccctccaccaccatgtttaatttgagactgtttcatattcagcttttctcctagtggagatttttatggaggacactagtacataaatggtattaaagcattattataaattctttatgctgtgtatgaatttatatttttggttgcattcttctgtgttgcccctaaattatttgcccttgctggcatatttaagaaacttccattatcttgaagagaaattcatggttatgatttattccttgatttaataagcattatgttctttttgagttacttactaaatttataaaagtagaaaatgcactgttcttcttttcttcattaggagcttatcttctactggagagacagacacataaactggtcattatagctgtggtagatggcacagtagaggtgtatgtttaatgttttttgactatagaaagcatgatatgatccttatgggtgggaaaggccacatcaaaaatattcactctatggagatttccgccccctgcgttttgaagcagagtataggtatcactatttgaacagtgatgctgatgctgcaaaaaatatgtaaaaacagtttatgttttccaactttataggaaaataaagtagtatctgtcttaagacacatggaaaagttgaattctcttggaagtagagagtgaaaaagcgttatgttgcattttgttactgttgtcctcttccccttcctttttccctcatcccttttcttttgtatttgtaagtttacataaggtgagaagataaaatgttaaaagttttgaaggcaggcttcatagcaaattttgccactatgttttttgagtattgggctgtatgattataaacaaaggaattgatttatctctgatcatgtgataatgtcctctgttggtcctcaactgggtgcctagatctttccccaattcaaaaccctaggtatagatatacaatgcttttttgccataatattaagcagacactttcataagtaagacacaccagagtggtacatgagaatgcctgtacaactggaatgggcaacatgaccatagagaaaatgatgtgatttttaagtgtgtttgccaagaagcaggaggaaggctcttagaaagttaaatctagtcagattcctaaaatgaaaatgcagttacaaataaatgcagagtaccacatgcaaggattaaatcaaaaaagactgtggtgttgtgcaaatatttcatatatacagtgagtattaaaagaaatgataaaaacagcagacatagcagaatttcaggtgaagatcagaagcctttctataaaattgacctttaaagttaattgcacatacaggagttcgagtccagcctgggcaacatggtgaaagccctgtttctactaaaaatacaaaaattagccagacatggtggtgcgtacctgtagtctcagcaaccagagaggctgaggtgggaggatcccttgaacccaggagacagaggttgcggtgagccaagatcgggccactgcactgcagcctgagcaacagagtgagactcctcctaaacaaacaaacaaacaaaaaagttaattgcacatagtatttactcatgaaaccagcctcttcctacagaagacaatttctaacatagaaaggatttcatgagactgaggaagaggacaataggctcctaaaaaaagatggtagattaacatacacacttacttcagctaactgttgaagccccattaattatataggaaaaaaaaattttcaaaaaggcataagcaaagaaacaggagaagaatgaataccaacaaaattctggaagctggagagcaatagataaatagtaactgatttatcagattgagagaaccgaataactgaattatcagatgacagtgaagaaagcctagaaaaaacagtttacacatttgaaactccgaaaggctcagcaattagcagttgtgtgtatctctagaatgggcaggagggaagaagaaggttatagttataggtacaggcgaagctctacatataaaaactatatgaaaatgggaaatgtttattaaacattcattaaacatacaaagtctgttcaattagttagattcctcagtctcctccacttaacacagacaggtaacagtgcctcatttatccctttatccagaagaagactgaaagtcagacctttggggatgtacagttcaatcacattggtgtacggtcatcaccaccatccatctccagaattcttttcatctttcaaaactaaaagtctatgcacattaaacaataatgcctcatgaccactttcccctggcccttggtgacccaccattttacttcctgtctctatgattttgactactgtaagtacctcgtatatgtgagatcatacagtatttgtctttttgttactggattgtttcacttagtatcatgtccttgaagtttcatgcatgttgtagcatgtgccagaatgtcctttcgttttaaggctgaatgatactcctgtgtgtgtgtgtatgccatattttatttactcattcatctgtggatggactcttgggttgcttttgcctcttcactatcgtgatatcgacattttaaagtgatatttttattttgtttattaaacatagattaaattttgctgtaccacatgtaaatattaaagattgctttcgtttgctgatgtttgaagttctttcaatgtcaacaaataaactggtttgtttttgtaatttttgtcgtaattcagaaaacataattgtatccactttggttattatataaaagtaattatcattactttttttcttaacattggtttttgaaataaaaaagacatcttgatgtgccatgtaaaaactttgagcagttacacgcaactgaagaatttagcgaagatcttcttccttcattggctttcattttcctattagttcacctcatgcttctattctttcaacaaattttaaaatgcaaaaaattcagaaccatcgtggtagctatctccgtgtgacacagggattgaacactctgatctgattgccactcactaacacacatggtatgcatttaaatttctcagcctgttctttctgggttactgagaaatactcttattttatttattattagaaatacaaatttaaatacgctattatttcattaaaaatatgaacacttagaaaattttccatttaaagtatttgattgtggctgatctgagagccctggtgtttacacctaattgttcacaaccagtgacagatttctttgtttttttctccactcccacta

SEQ ID NO: 3738 - DNA, 14717 bp, Homo sapiens
gtcttgcatggatacatttgagcctgcatgttgcgatctgtatccaatgattgtaacttctgtattgtatccttcaatgagaaaggacagctctggtgtgaggagtccctctcccttctcctaaactcttctacaaaacaggggtttccaacttccgggataaggacctgtaccaactcatggcctgttaggaaatgggccacacagcagaagctctccaggaacacatctttgaagacaaaatgcctccaagatccccagtactgtagctcttctcctgaagcaactatttccagccttgaaagttatcagctcaggagaggaagcactgcaagcagctcctgggccctggggtatggttgcagattcatcacctagctacttgtttgtggtgttatcatctttttttccctgacatattttggaacttgactacatctgatatatttctcaacagtaagtacagctacataaagcatttaggaaaaaaatgtttcttactaagagcatgagaatttagacgttatttatttaaaatgtatttttttttttttacctctttgttgccatcttttcttttggactttgttattcagagttaaatgttttctaggtctgtctttctttctccctgagaaaataggaaaatataaatatggatggtgtaaaaaactcacattatatataatagtgctttcaaaaattttatttagctataacttttccagagcctaacacacaaagaaaaatatgtaacacatagccttgcaattaccaagcctttgatggttaacctgggttcatcctagattttctttcctttcccgtgacattaatccaaattcatttgcctccccccaacattaattttaaaaagaatttacgacagtttcatttatatcccaaagaatactgtaagaataataataatgagggctaagacttaagtgcttattatgtgctagacactaacacaagatatttacatctactaattcatttatgagatagagacttttactacccctatgaccaatgaagaaacttcagcatacagatattgcaaaatgaagtgaagcattgcagatttcctctggttgtaggcagaaatcaatggcagcaatgcaagaatttggattgtcctgctcattatgatggtgacacactagccaccatcttagccctcaatgaaggctttgaggctgaaaatacagtgaaaatgaccaaagaccttattcacataggtttggccaaaaaattaggatctaagaaactaaccaagagattattgtccaaggggaatttgtatagagattcaagtcccagaaagccttagggttaggactaacaaagggttgattaaaaccctatttcaggaatatgctgttagattcagcaggtgatgggggtaggtagaaagacagtgaggtatgtgcaggagcatctcatgagtgccatgtttaaaggtgctgatcctttcctttcctttcctttcctttcctttcctttcctttcctttcctttcctttcctttcctttcctttcctctcctctcctctcctctcctctcctctcctctcctctcctctcctctcctctcctcccctcccctcccctcccctccttcccttcatcctttcctccttcccttcatccttccctccttccctctttccctcctcacaccatctccctgcatttttctttcctttctttctttatatggcctggccacaatttgaacttgtccaaccataaatatcttagacaaacaaagactctttttctgttcatctatgtctttggtcctgttgtagtcacctttcatcaaagtccactgaggacaaacaaattagaggtatacaagtagtttagttccgtttactcgagctctacttactagaagatttggggcttaagatctgctaatactatagagctcttgggacttcctttgtaattattctttgcaaattgtcttgctcaaataccccacaggaagtagtgtggctattcttggatttcctacccaaatactaaaggttaacaccatgttatagaagttgagtaaagtgctcctccgtccttaaggcaactgagaagacttcagtttcaatgtaactgatcttcaccttcaggagtttgaggaaggcagagacatttatagactcaatcctagaatgttgagagggtatgaagagtcataattcctataggtctccctagggaaaggaggaactcacttagttcttcttgagagatattctgtctgggagaatcacttggatggatgagttgaccccagcaggagtgtagtgtggacctcccagagctgggagactgagggaattggtaagcatccagttgaagttcctgaattaggggaactttggttgagaggttctctctaagttgagtgtctctgaagaactcacaaatgaatatggctcatgcatccaccatatctaggagacaccaaaatctataaggttggtgcaaaagtaattgcagtttttgctattccctttttttttaaaaggcaaaacccacaattacttttgcaccaacctatatagtatgaggaccattcctgctcctgtccacttccttctcctcctcctcctagacccaaattagctgaaagcaatagacactgagtggagttggagaggaagtgtggatgaaagtaaatgctgacttcacccagcttccctaccacataatttccagttttaatattatatcagctcacgctttttaatattaaatgagatattaccgctaaaagggactagcatagctctagggcttacctaagacttcatccattggcaagaaaagaactatttgagagaacaggtttgaaaaggaagtagaaggaataaatgtgatttctgcttagacttaacaaatccaagtattttaataaaatagttaaggtagagaggcttctatagaaaccagtagaaacatgacggaaaaaacatcttagacctgggtaagtacaaactggaatataaccaagatgacagataggtatagaaataaaaatgatagagatgctagaaatattatatgtatatacttatttatagtagagttatatttaaagttacttatacttgaaaatatatcatttacataaacatatatatctatgtatatgagtgacagacaaataatcagaagtaatgggaaaaaatatatccaaatatgctttagctctagaggaaaaagtgctactatctctatagtgccatatcaacttgccagaagtattttacaagatgcaaaaataaataaagaaataaagtatgcaagagaagcataagtagaatgggagatggaaggaaataaaagagagacaaagaagaggaagaaaaggaggaatgcaataagcataaaattcacaagatctgatgaagagaatggactgtcacgtcttttttatcttcacagtgtggcatatgctctgattgagtttggttcactgcctgtaatcccagcattttgggaggccgaggcaggtggatcacctgagatcaggagttcaagaccagcctggccaacatggcgaaaccctgtctttactaaaaatacaaaaattagcttggcatgatggtatgcgcctgtaatcccagctactcgggaggctgaggcagaattgcttgaacctgggaggcagaggttgcagtgagctgagatcgtagcactgtactccagcctgggtgacagagccagactccatctcaaaaaagaaaaaaataaataaaataaccccgtgtttctcaggcttagatctgatgtggcaccagtactctggcttccatgtaattgattcaagttctctctgtctgtttctccatgttctgtcctggactgtattagttacaacacacctttctaacacttcctcctgttccctcatttcctaatcaaggctggcatgtctctgcccacatatctctgtaatgcatctcagcttccagctcctgtccttgccaaagagtctcaggtgacaaaaaggctggatctgaataaatggagagtctgagttttcctccacatttaagggaatcagtgactttggaggcaaacataaagggcaagtaggcatattgctatttgtcacccataatcattccttcttccataagaatagacttacagctgaaccaaggactgcccggccagcgttatatttctcagcctcgctttgcagctagctctggctgtgtgaccaagttttggccaatgggatgtgggcagaagacttttgagtctttctattaaaataaataaatggctggttcttttgtcaatttttttttcattcccactggttgggagacaatgtcaaccagctcagcccttgtggacccacagttggaaacctcatgttaaggaaggcagactgcctaccacttctgggctcttagattatttggtttaagccactgtattttgggatctgtttgttacaatgacttagctggtactctaaagaatccatgaggtctgaagctaccgtggcccataggagattctgaggctgcagcaaagatggggtctggcaggaagaacaggaccacagcgagttcaaaggagtaaatccccacatttcttcttacctctttggagaccatttactttagatctatgccttctcttttttcctgcaaacagaaaagaaagaaaataatcctttagaactataaacaaagatttacacactttatatgtcaatagtttacaagcattgaattttgttttccttctacttttgcggggctaagtcctcggccaccaacatcccatcttggttgttgtcacgcagaaaccaataaccacaaagcaacctgtttttacacagtgccaatcatttacactatgcttgtacatatccatatgtggtcttatcattcacaataaagaaagtttttaaagtagctgaaatcaagcagaaggtgacagcagcagcagaagagtaccaagagggtcaagcaacagtaggtctaagaaatcaccagtgatggccgggcacagtggctcgtgcctggaatcccagctctttgggaggccaaagtgggtgaatcacttgtaggccaggagtttgagaccagcctgatcaacatggcaaaatcctattacaaaaattagcctggagtggtgccatgtacctgtagtccctgctacttgggagtctgaggcaggacaattgcttgaacctggaaggagattgcagtgagctgtgatgacaccactgcactttcagtctgggccacggagcaagactccgtctcaaaaaagagaaataaaaaaaagaaagaaattaccagtaaagtacacttggtggaattcagaggcatactttgaagagctaaagctgtaattgtgtttataacagccagaacttaagaaataagtagaaaaaaaaaatcagagaaatgaagacaaatttagaaggcaaataaaggggattagacatttcagaaattaaagtgaaggacatagattacagaaataggtaaaggaaacaagaaattttaagaatgattaaacaaattagaaaataagctggttgcagtggctcacccctgtaatcttagcactttgggaggccgaggcaggtggatcacctgagctcaggagtttgagaccagcctggccaacatggcaaaaccccatctctcctaaaaataaaaaaattagctggcatggtggcacatgcctgtagtcccagctacttgggaggttgaggcaggagaatcacttgaacctgggaggtggaggttgcagtgagctgagatggctccactgcactccagcctgggtgacagagtaagacattgtttcaaataaaataacataaaataaaaaatagaaaataatcaatgtaagtgaacaaattattggagttcccaaagaagaaaatcaaaataatagaataaatacttgatgaaaaaagtctgtggaattataatataaattgaaatgtatacatcaaaagtacctatctcttcaccctgtgacagagaaattgacccaaaacagccaacactgagatatatttccaacaaatttattggactttaaagataaataaagaattgaatgggcggtgtaggcaaaaagttattttcaagggagacttattggccacagaattttccacagcaacatttaatgccatgggagagtggagaaaaacctataagatatttctagaaacaaagaatgagcaaactatttttcaggtataaataacacaaacacataattttgaacagaaaaattcttggaatgtagtttctgagtccttattgtgaaaattactagaagatatacttcagcaaactaaggtagaactgaaaaattctggcaaaaggacaaaaataaaagtgagcagtagggtgacagatgagaatatgaaatgcatatgctctgacaatatagaaatagtataataacaaaaaatatgagaagggttaggtgcagtggctcatgcctgtaatcccagcactttgggaagcataggtggaaagatcgcttgaagccaggagtttgagaccagcttgggcaacccagcaagaccttgtctctacaaaaaatttgaaaaattagcaagctatgttggtgcacacctgtagtcctaactactcttgaggctgaggtaagaggatcactggagcccaggagttagaggttgcagctaatattgcaccactgccctctagcctgggtgacagagtgagaccctgtctctagccaaaccaaaccaaaacaaacaaacgaaaaacagggaggagagagcaaaaataggctgtagggcaagttctttgtttattttataggtaggaatccaaaggtattgtgttgacaaatccaagagtagatgtaaagcaaggttaatggctgaaaggtaaacatggtaatggcacagcctaaaattggatgggagaggaaaaagactggacaatggaatggcacacaggctgattttataaatcttctgggtgggaaactaaaggatactgtctaaaatagagcaccaaaggaatcatataaaggtaatcctaaaagtaatcactagaacaaaaaagcaaaccttctttaaattggaagtatacactcctaaccactgaaaaaataggaaatgagtgtgggctgcttacccattcatttatttcaaggaaaagactcagaggtggctcacatatcttctgcttatatgccattggctagaacctaatgacatggtcagagcgaactgtaaggaaggctgaaagtatcgttatatggtttggctccgtgtccccacccaaatctcatgttgaattgtaatccttgtgtgttgggggaggggcctggtggaaggtgatttggatcacgggggcagattttccctttgctggtctcatgatagtcagttctcacaagatctggtggtttaaaaatgtggcacttcagcagccagcactgggactcacaactgcctaacactctaagttctctgggcaggggaagggtggcatccatctctatagctccaggccatgcttctcctctgctggagccagggaggctggatggcttggtcccaagatgtgtccctcacagcccaacacactggctgtggcctactacagccagagtgcctcttcaggcctgaccctgactcatccttcctcactgggtggggcttccctgcaggaactccaataactccagccagaggctcagggacagaacccagatgtccttgggcctgagcccatagcagaaaggccgcagtctccatgaaccagcagacttagcctttcctcctggtagttctgaggaatccgtgcagcccagacaactgggtttcaccccgcccccaaagcacacctcctacaccaagggacagtcaatgtgcttcattgaataaagcctccaagaaatatgggactttgtaaaaagaccaaacctatgactgattggagtacctgaaagagatgagaagaatggaaacaagatggaaaacatacttctggatattatccaggagaacttccccaacctagcaaggcaggccaacatgcaaattcaagaaatacagagaacaccatctagatactccaagagaagatcaatcccaagacacataatcatcagattctccaaggtccaaatgaaggaaagaccagagagaaaggccaggtcacctacaaagggaagcccatcagactaacagcagacctctcaacagaaactctacaagccagaagagattgggtgccaatattcaacattcttaaaaaaaaattttcaatacagaatttcatatccagccaaactaagctccacaagtgaagggggaataaaatccttttcagacaagcaaatgctgagggattttgttactactaggcctgccttgcaagagctcctgaaagaagcactaaaataaagaaaaagccagtaccagccactgcaaaaacaccctaaaaaataaagaccagtgacattatgaaaaaactgcatcaactagtgtgcaaaataaccagatagcatcttgatgacaagatcaaattcacacataacaatactaaccttaaatgtaaatgggctaaatgccccaattaaaagacagactggcaaactggatagagtcaagacccattggtgtgctgtattcaggagacccatctcacctgtaaagacatgcataggctcaaaataagggaatggaggaaaatttaccaagcaaatggaaagcaaaaaaaaagcagaggttgcaatcctagtctctgacaaaacagactttaaaccaacaaagatcaaaaaagacaaagaagggcattacataatggtaaagggaaaaattcaacaagaagagctaactattctaaatatatatgcacccaatacaggagcacccagattcataaaacaagtccttagactcccacataataattgtgggagattttaacaccccactgtcaatattagacagatcaatgagacagaaaattaacaaggatattcaggacttgaactcagctgtggatcaagtggacctaatagacatctacagaactctccaccccaaatcaacagaatatatgttcttttcagtgtcacatggtacttattctaaaattgaccacataattggaagtaaaatactcctcagcaaatgcaaagaactgaaatcataacaaatagtccctcagaccacagcacaaacaaattagaactcaggattaagaaactcactcaaaaccacacaattacatggaaattgaacaacctgctcctgaatgactcctgggtaaataatgaaattaaggcagaaatcaagaagttctttgaaaccaatgagaacaaaaagacaacgtaccaaaatctctgggacacagctaaagcagtattaagagggaaatttatagcactaaatgcccacatcggaaatctagaaagatctaaaatctataccctaatatcacaattaaaagagccagagagacaagagcaaactaatccaaaagctagcagaagacaagaaataactaagatcagagcagaattgaaggagatagagatatgaaaaactctccaaaaaaaccaggagctggttatttgaaaaaattaacaaaatagatagaccactagatagactaataaagaagaaaagagagaagaatcaaatagacacaataaaaaaagataaaggggatatcaccaccgaccccacagaaatacaaactaccatcagagaatactataaacacctctacacaaataaactagaaaatctagaagaaatggataaattcctggaaacatacaccctcccaagactaaaccaggaagaagtcaaatccctgaataaaccaataacaagttctgaaattgaggcagtaattaacagcccaccaacaaaataaagcccaggaccagactgattcacagctgaattctaccagaggtacaaagagtagctggtacctttccttctgaaactattccaaacaattgaaaaggagtgactcctccctaactcattttatgaagccagcatcatcctgataccaaaacctaggagaaacacaataaaaaaaggaaacttcaggccaatatccctgatgaacattgatgcaagaattctcaataaaatactggcaaactgaatccagcagtacattaaaaaacatatccatcatgatcaagtaggcttcatccctgggatgcaaggctggttcaacatatgtagatcaataaatgtaatccatcacataaacagaaccaaagacaaaaaccacatgattatctcaatagatgcagaaaaggtctttgaaaaaattcaacatcccttcatgttaaaaactcttggccgggcgctgtggctcacgcctgtaatcccaggactttgggaggccgaggcggttggatcatgaggtcaggagattgagactgtcctggctaacacagtgaaaccccatctctactaaaaatgctaaaaattagccaggcatggtggcgggtgcctgtagtcccagctacttgggaggctgaggtgggagaatgccgtgaacctgggaggcggagcttgcagtgagccgagatcatgccactgcacttcagcctgggcaacagactgagactccgtctcaaaaaacaacaacaacaaaaacaacaaaaacccaaacaaacaaaaaaaactctcaataaactaggtattgatgagacatacctccaaataataagagctatttatgacaaacccacagccaatatcatactgaatgggcaaaagctggaagcattccctttgaaaactggcccaagacaaggatgccctctctctccactcccgttcaacatagtattggaagttctggccagggcaatcaggcaagagaaagaaataaagactattcaaatcgggagaggggaagtcagattgtctgtacttgcagatgacatgattttgtatttagaaaaccccatcatctgagccccaaaactccttaaattgataaggaatgtcagaaaaatctcaggatacaaaatcaatgtgcaaaaatcacaagcattcctttacaccatcagtaggcaagcagagagccaaatcatgaatgaactcccattcacactcactacaaagataataaaatacctaggaatacagctaacaagggatgtgaaggacctcttcaaggagaactacaaaccactgctcaaggaaataaaagaggacatgaataaatgaaaaaacattccaaccttatggataggaagaatcaatatcatgaaaatggccatactgcccaaagtaatttatagattcaatgccattcccatcaaactaccattgacattcttcacagaattagacagaattagaaaaaactactttaaatttcatttggaatcaaagaagaccccatacagtcaagacaatcctaagcaaaaagaacaaagctggaggcatcagcctacttgatgtcaaattatactacaaggctacagtaaccaaaacacccccatggtactggtaccaaaacagacatatagaccaatggaacagaacagagacctcagaaataacaccgcatatctgcaaccatctgatctttgacaaacctgacaaagacaagtaatggggaagggatctcctatttgataaatggtgttgggaaaactggctagccatatgcagaaaactgaaactggaccccttgcttatgccttacacaaaaattaactcaggatggattaaagacttaaaatgtataacccaaagccataaaatccctggaagaaaacataggcaaaacactgaggacacaggcatgggcaaagacttcatgacaaaaatgccaaaagcaattgcaacaaaagcaacaattgacaaatgggatctaattaaactagagagcttctgcacagcaaaagaaactatcatcagaatgaacaggcaacctacagaatgtgagaaaatttttgcaatctatccatctgacaaaggtctaatatccagaatttatgaggaactttaacaaatttacaagaaaaaacaaaaccatcaaaaagtggacaaaggatatgaacagacacttctcaaaagaagacatttacgtggccaatgaacatgaaaacaagctcaacatcactgaacattagagaaacgcaaatcaaaaccacagtgagttaccatctcacaccagtcagaatggcaattattaaaaagtcaagaaacaacagatgctggtgaggctgtgaataaataggaacacttttacactgttgatgggaatgtaaattagttcaaccattgtggaagacagtatggtgattcctcaaggatctggaaccagaaataccatttgacctagcaatcccattactgggtatatacccaaaggaatataagtcattctactataaagacacatgcacacgtctatgtttattgcagcactatttgtaatagcatagtcatggatccaaaccagatgcccaacaatgatagactggataaagaaaatgtggtacatctacaccatggactactatgcagccataaaaaggaatgagatcatgtgctttgcagggacatggatgaagctggaagcaatcatcctcagcaaactgacccaggaacagaaaaccaaacactgtatgttctcactcataagtgggagttgaacaatgagaacacatggacacagggaggggaacacatagggcctgttgtggggtggaaggtgaggggagtgaacctagaggatgggtcaatcagtacagcaaaccaccatgacacatgtatacctatgtaacaaacctgcacattctgcacatgtaccccggaacataaaaaaaaatgtggcacttccccgtagctcaccctctctcctgggttgccatggtaagatgtgcttgcttccccttcaccttccgctgtaattgtaagtttcctgaggcctcccagccatgtggaactgtgagtcaattatacctcttttttttaaaataaattacccagtctcaggtagatctttacaacagtgtgagaatggactaatacagatagtctcagctaggtagccactagctagttgtaaccactagaagaaaaatgcaaatcttccttagtatcagaagtacacacatgcacataaaatgaatagaagacagaatgcagagtgttgacttttaaaaaacccaaatccctagaacatataatataaaccaatgtgactaaaacaagatcaaacgtcttggttctatcaataaaagtaaatgggcttaactcacttatttaaaaaagaaattttgagagactgaattacaaagtaaaacccaacattttatcatgtatacaagactcatttaaaaacatacaaaacattgaaaataaatatataggcaaagatatattcagtatacatcaataaaagaaatcagggaccatgtaattcaggccaaaaagttttaagaaagtagaaattataggagatgcaataagaaatgggtagaaacacactattaatagaagactttatttttgtttcttttagcccatgagagatcagtgtagaaaacagaaaaggatggaagacccaaattatttgtttaacaggatcaatatgattgatacatgttgaactccatagccagaaaatagagtatacacattttccccaccctctcttaaataactgagtcaaagaggaaatgcaaatacaaattgcaggatatttagcaaatgacaataataaaaaacattgcctatgagaagctatggaagactgttaatatagtgcccaaagggaggggaaaagtcttagctgggtgtggtagctcatgcctgtcatcccagctacttgggaggctaagatgggtgtatcatttgagaccaggagttcaagaccagcctaggcaacatagtgataccccatctctaaaataaaataaataataaaataaaataaaataaaataaaatattgggacctggtgccatgtgcctgtatcccagctacttgggaggctgaagcaggaagatcacttaagctgaggagttcaaggctgtagtgacctatgattacaccactgcactccagcctgagtgacataccaggatccctatctccaaaaacaaccaaaccaaaccaataaatagccttaaataatgaaccagtgggaaaaaaagacaccagttgaattaaacatatgcctcggaaaagttagaacaagcacaaaaaagtaaagcagattgtatgattatatacctggaaaacccaagggaagcaattaaaaatatactatcataataggaaaatttagtaagtttcaaaattaagatatagaaatgagtagctttcctatatgggagtaaaaaccagttaaaagatataatgcaagggaagacctcatttataataacaacgaaagcacactgccaccaaagctcagactaagtgtaaagaaagtctgcatcacccacccacatgcaggaaataaatgtaaaagttccactgagggcacagaggacccttgaacaaatcgatcatcatggcgtgttcttggggaggcagtctagcatcataaagatgggagttctccctatgtttatttataaatttaacacaatcccactaaaagtaccaatagatttttaaaaagttgagtaaagctaattggcacacaatcttcattattcac

SEQ ID NO: 3739 - DNA, 1496 bp, Homo sapiens
acatttttattttaaacttatacagacaaacatcagatgccatgtggtttgtctctgaccctttgcgctacttcatgacagctttactgagtgaagcctgaatacccaatcgggaaggcaagatgttcttgtcttttcccaactctcttcaaagtttaacagccttggaaggagtcttagaacagcaacaaaagcacaatttacagaaaaatggaggtgctgctatctgtttcctcgcaggtttattcttaataactatgtccattttcacatggatgacaccactgagatgatgaatacctgtattgattgattgatgaagaacatttatctttttctacctacttttggaagctagcttgcaaaatctactgcaacattcactcttcatgtatccttctattacctttggtaccctgaataaccttttaaaaatttttgtacttttctaatatgaagagaagtagcttcatattctatgctagttttctgaggtgcttgtgctgactcattttttaaattatactaagatatagagcatggtttgagagcagtaatgagattctcagaaaatatgaaaactttcctttctgactagttagagaaaggttggggaagacaaggggaaatacatcaatgagccaatcaattattgttatttgttgggattaatttggtgactaatatttttaatgcccatcaggctactaaatgtgaatttggctttaccctgtaatgataacaggacaaacccaacgggtttctaacattgcttgttttcccctggtaggggatttctttgcatatgggaaatcaggccgaagttgccagtaacagccacatccatgatttgtattaaaaataactattcatcattctgggctagagctctgcttaccatggctcacctgggaagatattctgattatgtatctaatcattatgatgccacctttcgagaggtgagcagacaattaacaagtccttcaaattatgttcaaaacccagagtttgagaaaatgttccaacgccttcaagtgtgaagataataaaaacattacctaatgcttaccgttcactgacagtgtgctgggcagacattgttttcagctctggccttgtgttaactcgtgattctcagaggagtgggtattattcccagatggaagatgaagaaatggccacagagaagttaagtaatttgtccaaggtcacattactgttcttggcggggctgattccagagactgcatccctaactagtgtacagcaaaagcgagctggccactgccactttgttataagacattttgtttctttgaggcttgtatttctttgtgttcccaaatggagtctcgttggtttttgaatagaaaatatttttatatgtttaggatttttttaaatgttgatgaagatggtgataaatatttttccaattaaagtatatacttctggtggaaattatattaaagaagagaaagtcttaattttta

SEQ ID NO: 3740 - DNA, 4999 bp, Homo sapiens
tgagatttgggtagggacacagccaaaccatatcacaggcctagctggtcttcaggttgcagttactatctgaactcccctgaatattggccaattagtactgtccttttcctaaggtaataacctcaatcaggtttgacttcccaatttgagcagaacttcagaatcattcagttaaaacactaagtatattctgccttttgctctttcatttgtctatatagaactgtacctatctgtatgtctttcaagatccttcaatatggccagaggaaagtggtgggagatggaggtgcagaagagggaccaatttccacaaggtagtgagagggggcttctctgggtccattagacttaatctgaagttagaatgttggaaagaaaccagtcaggtgaagagtagcagagggtgcattccaggtggtaggacccacatatttgacagttctgagccatgggagagtctggagtgtgaaaaactgaacagaagccaatgaatcagagctcagacaccagggagaaagagtaggaagtgattaatttaaagggactgcaaaggagccagttcttgtaaggtgttgtaagtcataggaacattaaactcacactgtttttctgtgctgtaactttaagtgctataaatttagagtgtaaaataactataggcccccctaaagactgaaaaattggtacagaaagaagaaagtttacaacaagccttcagtacattacagtttgtaaataaactgtctttattatttcaacttgttgatataaccttgtctctggaaaaattgatttttttggtctgaaattgtttagttttcttgggtttacagagaatgcatcatgattttccagttaaaatattattttcatttagtggcttttcacttagcagtagggttttcaggagtgaattaaacataataacgaggaaaaggtatatttctattcagtagcagataattctagtatctaaaacatttatatataattctgtcagttttctttttctgctggcactcaactcattggactttatttgttttttagagacagagacagggtctcactatgttggccaggttggttttgaactcctggcttcaagtgatcccacacttcaacctcccaaagtgttgggatcacccacatgagccacttataccctgccactcatcagaggtacttaagatcctcacccgttttatgattttttgaactcgagcttatgttcagtggaattttataggaattatttgaggtctggatagaagaatattccaccaaagagaatataattttaatccttctaagtgatttatctctgttgactaataaccgctttaaataattggcttgaggtttttttggatatcagaggaagtaagtctttttattctacctagcatctagtttttgatagacaagtttccttattatacccctcttctggttggtttggcttctcattgttgctattgttgttcacttttcactgaagatataaggctttctggtttatgtgtaggtctcctctcagcctctgcatgttgggcagtctcttttgtctcctttctcgtaagccccaatgcagcttttattaaaaggaagctcaagttcattaaaaatcagcagaccctttcagggtaggtgcttacgtcagggttctcttgcctctctggattcattcattcacttcatttatgtttacctctaaagcattttctttcttggcagcacagcaatacatttttttttttgtattcaacattttctgttatttttcaatggtaagtttatttagggcatctccatttttttcaagcttttggaatcttttgctttcaattactcttaaatacagcaaatttatattttgctacaggttccactctgagtcattttttcttaatagattattacatcccatttacctttattgaaaatctttctaaagtagtttgtagagggaaacattaatttgttcaggtaaataaatacagtaattctagtatccaataagaaattacaaattctagatatgtgaaactaattaacactggaaaaaagtaaaaccccataaccttatagaaatgtgttgttcttgtggtggctcatgcctgtaatcccagcaccttcagaagctgaggtgggaggatcagttgaggccaggtgtttgagactagcctgggcaacataacaagaccctgtctctacaaaaagaaaagaaagacatgtattagtctcagttaaagcttgtataaagcaagcaacaaaaatgctcaaatatacaaatgcatgggtaaataaagccctgaaccttaatgtgggaaccgtaaaagcaaatgtgaatatggcatttcaagactacataactgagaagcaagccaaactataaaataaattaattcctgtagaataaatacagagaaagcaaatgtaactgtaaaaatggagcaaaacatgttgcaaaatcctgtgaatgtgaatagatttctatatagccatagaacttgtagattaacaaatggttcaagaagaactggtacaatggagacagaaaaatgacttccaatgttacaactgcttatagaaaagataaatattcacttatgtacaacaagcaataaaaaaggaagacgtctaatagaaattggcttttgaatgaccgtaattattaacaagaaaataattttagaagtatcagataggttctattcttcattctcaaaatctagactaccatttctgctggaatccagattatatacttcatctgtgtcactcattgcattaagagtcatcagtcctttaaaccagcggtccccaacctatttggcaccagggacaggtttcgtggaagacaatttttccacggaccaggggcctgggagggatggtgtcaggatgaaaccgttccacctcagatcatcaggcattttctcataaggagcacgcaacctagatcccttgcatctgcagttcacaataaggttcacactcctataagaatctaatgctgctgctgctgtgacaggaagcggagctcaggcggtaatgcttgctcgcccttcgctcacttcctgctgtgcagccccattcctgacaggccatggacctgtaccggtctgcagcccaggagttggagaccccttcgttaagagatcaaccaactcttcaatatgtcaagatttatgtgggtaattatatcagaggagagaaggctctggtcttgtcctcttataagggcactaatcccaccatgggggctctactgtcatgacctcatctaaacccagttatatcctaaaagcgccatctccaaataccatcacattgaggattagggcttcagcataaaaatttgggggagatacaaatattcagtccatatcagcatatggatggtggttggaatatagaagaataagactctccaggtagagggtatatagagtgctaagaacagaacctgggtgtgacttgcaattggagtgcacacagaggaagagaagttgagtaggagtctagagggagtgatcagaaatatgagggcagaaccatgctcaaaggaactccaaagggcttaaatttgagcgacagaggtactcagagaacatttgcttttgggagtctcatcctggagaagatatctttgtatctcttatttcccaccaaactaagtgaactttcatcagttatttctagtcaaaaaggtaaatgtgaaatattaagtagtccagttgaagcagacctttcattatttgatcattgagtgacctatagcctcagttccaaattcttaagatagggacaaagttacctgttttataataaagcttaaaaaaaaattccctaccctgctctgtcccacttgacctctgaaatctcctagttggtcagctaccaggaacaggtaatggttgtgttgaaatcggcccactttccatacttttgggacatgttttaaggcttcatttgcaaatgttaagatcttagacagtgctagttgccaagagccacctacaaaggtaatgccagtcctcggacccaaatcccaggggactctaggtctcaggtgcagagcctaaattaagaaccaactcagtaacaaaattctccttaatccttggaagctaaagatccagctttgaaaaatgtatttccatgtaatatattgatacttttgttgtgctcattatatactataaaacacttgcaattcatttatgctagttgagtctctttatttatttacttattttgagatggagtctcactctgtcacccaggctggagtgcagtgggacgatctgagctcgctgcaacttctgcccctcctccctccaggttcaagcaattctcctgcctcagcctcccaagtagctaggattacaggcacacgccaccttgcccggctaatttttgtatttttagtacagacagggttttgccatgttggccaggctggtctcaaattcctgacctcaggtgatccacctgccttggcctcccaaagtgctgggattacaggcatgaaccaccacacctggtcttgttgaggattcttgcatctatgttcatcagggatactggcctatagattttttttcttgtgtccatatctagttttggtatcagggtaatgctgccctcacaggatgagtttgagaactggtatgagttcttctttaactgttcagtagaattcagcagtgaagccatcagggcctggacttttctttgatgggagactctatattactgatttaatctcattactcatagttggtcttttcaggttttctatttcttcttggtccaattttggtaagttgtatctgttcaggaatttatccatttccatttggtttccaatttgttggcatatagttgttcataatagtctctaatgatcctttgtatttctgtggtatcggtttaatgtcttctaggcccctgctgctttcaacaccctgaagggtacaaaaaa

SEQ ID NO: 3741 - DNA, 3837 bp, Homo sapiens
tagacccagaaaggtggttacagcactccttcctgcagagcccagatgtggtctcagaaaaagtgccctagacagctagcccccagtggaccccaagatattcctggttcgaagatacattttttttttttttttttttttggtagagacagtctcactttgttgctcaggctggtcttgaccactttggtctcccagagtactgggatcacagatgtgagccaccacacccagctcaggcacacattcttgtacttggcaatctcctccagtgggaatccttacactcatcatgtcttaaatatgaaagaaaaatacaaaatggacttttggtgcctcccttacctaactcgttcatgcttcatgaagaattcttgtggttacaaatgatgactaggccgggcatggtggctcacacctgtaatcccagcactttgggaggccgaggcaggtggatcacctgaggtcggcagttcaagaccagcctgaccaacacggtgaaaccccgcccctactaaaaatacaaaatcaggctgggcgcagtggctcatgcctgtaatcccagcacctttgggaggccgaggcgggcggatcacgaggtcaggagatcgagaccatcctggctaacacgatgaaatcccatctctactaaaaatacaaaaaacttagccggggcttcaagagggttattatcctgaatctcttttattgtggtaaaatacacataaaattttccatttttaggtgtacattgtgtcattaagcacattcatgttgttgtgcaactgccatcatccatctccagaattttttcatcttccccaaatacaactccattaaacactaactctccattcccccctctcccccagctcctggcaaccatcagttcctggctgtatgaatttaacgactctaggagcctcatgtgagtggaatcataacagtatacacccttttatgtctggcttatttcacttagcatggtatcttcaaggttcatccatgttgtagcatatgtcagaatttccttccttttaaggctgaatcatattccaatgtaggtatacactacatttcatttatctacttatccatcaatggacacttgggttgctccttttagttattgtgaatcatgttgctataaacatgggtatacaatatctgtcagagtgccgcctttcacatcttttgggtatgtatccagaagtggaaatgctggattatacggtattcctaggtttaattgcaatcttaccatctcacatacttcacctaaactgaaaaatgtaacgaatataccaaccaaacacacacttcaacaccccacaggcctggttgtagattttgaggtcaaggttgggtaagtataaaacccaatgaatttttataaaactagtaacggggaaaacaggaagatcagggaaggtggtgaaatcttcaccaaggccaatgattgcacaacacataacttcttgaagcacttttttccacctgctcaaacactaaacataaggagtgtttcaaattacttgaggattcaccaatccctaactttcccttcctaaaagttcttccagagtttctgtcagaaattccttttaagaaaactccaaagaatttcaggagtggtagcataataactggggagacccctctctctaattaatcaaaaacgtagtgtagcttatatagcttagagaaattgtggatctatgaggacatgtgaaggtactgggctataatgtggtcaatgtgtctgaaaaaataacagttctgggccaaccaagtgtggctcaagggatcactactaagaatggttcctctttgggtagagcagagggaagagacactaaagggaactgcaatcaccagcaaaggaacacagtgaccatcaatgtctgaggactggcacaatgaaggataagaaagaacctctctgtacgaggcctactccctttcagttccctttcttccccattgtgtcccagtggaggacctgataatacacctgacccatatctaagacatgcagttggcagggctgatagtaggtaaggttcacagtatgttaaaaagtcacacgaggccgggtgcagtggctcaatgcctgtaatctcagcatttgatagaaataaaataatttacattttattttcatgtaaatgtgacagcagcagcaataacataggcattcagtaaatattcttttgaattaggccagatcctaaatatcctgaaagaaacatgacatgtcactatctactccttcaagacaaagatatactttttttctttcttcacttcagtaagctggtctacaatgatggacttttatttatgcaacaatttcaatactgttcaacatattgggctttttttttctccctgtaagtagaatctgattttgaaatctagtagtgtactgacaagtgccaagctgttctaattaggttacctttcacatttataaaaatggtacgaagttctctgaataccattccagaaatactaattcatacttacctattttcagtctcctaaaggttccaaagatcttaatatatgttcactcagcacaacatggctgcatttgctcacaagtcagttttatatgccagctaacttcggaatgatccacccctggctaaacatctctaaaaaccctgatggtctccaattaatctatgattgccttattactacagcactgccatttgaaaatgctgggtctcagattttcaaattcccttaatggacagctaaaggagccaataccaaagacttgcaatgacctccaattctacagccttgggctgttccaggaacacaattacactccacttccctgcaggttccacccttctcgaagcttctattcctacatctgtaaaatgaacacatttctactaactagtaacacatgccacagtggcactgcactcattaagtgctgtgttgtatactgcaatttaatttggtgctgtttatatcttatttcctcaagtcaacaggactctttctaaaaaagtcagaaactgttttactcatgtcccttcacaacacttagtggtcatttccacaaaatgctagctcaacagatacttgattgattgattaattgatgaacctctccatttctcagggagcctctaaacagttatcaacaagagtatgtttaattccagtctctgtctatatggtcttaggtgaggtgtttggcagtttgtcatctataaaataaagggatagcaccgaatagctcctaagttccttccagtgcaatttctgaatctcattagacaaaacaaaacccaaagacagcactacctctattcacgttagcattgtactttttttggaggaaagggcttcctgaaacaaccttctctatctagagcagattctgcagagaggcccctctttaattcatattctgaaacgtgcttgttattgttgacgtacaaaaacttatgaataattcaataaatgaatcttgaaccatcctatttatcattcagtggtctaggtacccaactctagaggaaagcttttctgaaatacacggtaagtatcccccaaccctccctcaaaggaaccaattatgaacactatacagtcttctctcccttctcactccccatgtcaaagttcattgtgttcctcctgcagctgatttaaaagttgatcttttcaaggagctggattcctaaggtagttctattttgagccttcttcctgttctgaagctaaagttggaagggcttaggtggtgatgtcatggaagggagactgttggtttttataggagggtcttctctggcaactctgggg

SEQ ID NO: 3742 - DNA, 29160 bp, Homo sapiens
gagatccctccgcttccgcgccggaaactgggctttgctttggagtctcgggcggtggcagctccgattccacagcctgaagactatgagctcggagggtccgcgaagggccgcccggcctcggcccccgcctcctgcgcgtcgcctgacagcattaccgtttccacagtgacagcgtttcctccggcggccctcccgccgcctccagggccatggcttcgtcccgggcaccccttccgcacgtcacttccggaagcgactcgctctgacgccgtccgccctcgttgccatggagacgcttgcgctttcccgggccgcacttcccacccgggtcttcagaagcccgtggccgctgggtgagcccctgcgtgaacgcacacgcacgcacacggcttcaggttgccccgcggcgccgcgcgcgatatcggctcggatcccgggaggccgtccgcccctttttcagcggatagctgaggccaggtaagtgaccgcgcgaggacccgggaactccgtgacgcccgtcccgcctctgctgtccccgccgcaagcgctgcgctctgcacggcgagaggggcctcttgccctgttgagagccggcgggcacggcacttctgcgcttggaaaagggtggtccagcactgcaggtcccactccttggcccggtcagcgtccgcctttgctgaaccccgaaaggattcaccaggtccaggacagcccggcagttgcctcaggagcacttactgagcgcctgtcgttgacgcccccacctcgatggcagctcaggggtgccctcaagcttttgagggcaggtgtcgtgtatttaaattcttcacagtttagcgggctggactcacgggggtgctgcagacttggacggggtttcatctgggtcggaccttgctgggcagaaagcttctcctaccagacaaagtacggcgaccttggggggtcttggttcttacctcgtgttcctcattgaatgagtgttggttcagtgctctcgctgtgccaggtgttgtgcgaagtactgtgagggagaatatgtatttatttgtggggagccgactttaaaccggtggttgggaaaggcctgagaggcgatattgaagacacctgaagggtgagtgaaagagcacggcgggtgagtggagcagctttctcgtgcaggtcccggggtgggaaagaggttggtgtatttgaagcactgaaaggcagccactgaagctgaagtgtagcagtttaacccatggttttatattctcctgggaggattcagaagggtgtatgtgtgtatgtatatataatagcctgaatataaacgtcaagggtgttaggttttgaagggaaggtgaaggttaaagaatgacgcacagtgagattgccggcgcgcgggcggctctacagcaacacaggtgtattgcaaacacctgtcgggggccagcttaatgccagagcccaccagcgattacaggctggggtactcataggcctgggcaggagggatctaggcagtatggcttgctgtccgggaagatgttaacgtgttcccaggatgaggtggttccggcagaatgtggtgttcctggcgctttgtcccagcagaatatgttaagaggcaggctgtttctcatggctcgaacccccgtggaatgtttcactttgaccaaggtctacaaaatggaaaggggcttacaaaatgacgcagtttggactaacaaaggggaaaatacagaggatgaaattagactctagaggttgaggctcaggaaaggcttcatacagctttgggaactgacaaggctttgaaagcagggtcagttttcagcgaatgagcgtcacccactgcaccctgcgcaccctgctcccctgctgcggtgtctttcccaccagagtgtagcaggacaagccgcagacaaaacccctcagacaccgagttaaagaagggctttattcagctgggagcttcggcaagactcacgtctccaacaaccgagctccccgagtgagcaattcctgtcccttttaagggctcacaactcttcaggggtctgcgtgagagggtcgtgattgattgagcaagcagggggtacgtgactgggggctgcatgcacccgtaattagaacggaacagaacaggacagggattttcacggtgcttttctatataacgtctgtaatctatagatagcatcactgattaggtcaggcgtcgatctttaactaccaggcccagggtgtggtgcaggctgtctgcttgtggatttcatttctgccttttagtttttacttctctctttggaggcagaaattgggcgtaaaacaatatgaggggtggtctcccttattctccctctctgagaatctcactcagtagtgggagttgtcacttttatttttactacctatgttttcttgcaagacagatcgatagtgattcatatagtacagttgtgctgaagcattttggtgaactaaggtagcgatgaagctttttatcatttgaagaagtatgggtagcaaacaagggagcagaacgcaggtttctattgctattgtaactcctaatataagagttttaaatctttttagtgctgggaaccattttccaaacatggccccaggaccaaatccatgccacacttgcacgggcacatgtgccagttttgtcatatttctaactgtgtcttcaactaattgccctcgatcatctatgtgtagacagcaattagtaaggttaaattttttacagacctctccttcagctgctagcaagtagtcgagagccaatctattttgatagatagcatttctcatctgagtttcttgccaggccagaatagtcaaggctctgccggtcttattagtgattatttctaagacagcttgtaaccgtatgattcggttgagcatgtaaatgggggtcgggtatccctaggagccatcttgtgcctaagtaccaggcccataatattgtatgattctttcagggggccatgtattatcttttgaattttttatagctatgcttctctttttgcgggaagcacagacagggaagcccaggagttcgcctgtctttatgggcagtaggaagaaagatggtttaatagtgccaataacatgactacctgcccactggtcgggtaatttggtgtaaactctatgcctacatatccagtataatccagtgggggctgtccagtccctgtgggactccgggtgggttcacacagtttgcaactttgggaatttactaaatggatttttcttagtgtggtttgaactccactaggtggctgtttttgtagtagtattatacagtttttgcctaagcagctgagtcttcccacaggaaaggtgaagtccttccccactcttgctatatacagtattgtctaatgattgaggcttttaggacccagaagttatcagggtgattcttttgagccgggaattcatcaggaactgggtctgtaggtactaattctcgggcttcccgtggccattgatctcccattacagttcgtccacacacataacatgaagtgacattgagagactgggccacatgctcggctaattgcaaaaacaaatgtcttgtttttcctggaatttctggtgcaggcacattcagttgatcatagaaggtttgaaatactgtctcaggagagcgtttataaatttctcctcaaaccatgatatttactcaaggatccagttcagccccattgattcctagggttacatgctccccttttttccagcgaggatcaagggggttggttattactagttctaaggggttacactgaccactggtacaggaagggccactttttcctttttgaaggtggacaggatcctttttattttttatttaagtagcctaaatgacacaagaccagtatttacatttatttccacacagttttaatttatgacaaatgtacttattttttgtcatatggcctcttttctaattaagggaaccacattctatttttaacttattactattaatgacagcacaggcatcaaactttaaagtgacttgtttgggcacccctttttctttcattttggctaacactttactcgtatcgtttatgagtccctaccagtcctcagtccttaatcttatttcaaaagctgtggtcatgggagactcaggtcataacacacatcaggttggtcatttcttgggctacataccttgcatagaatagcattatacaaactttttttttttttagagtcctggtacacttacaataatcataaaataataggactgtggcaactttttgtcctacctcagtgacttgatgtatacactgggaacagtcctcagtctgaggaaggtcagttgaagtccttactgtacaagtccaaattttaaggaaaatgagtcccacgatgagttttctcatgcttcggccgtgtgtggaccagtcagcttccagttgtgactggagcagggcttgtcgtcttcctcagagtcactttgcaggggctggcgaagctgcttccgtccacgtaccactcacagcctactgatgttcaaggatggtctcggaggttgcgcctgctagaataaactgagtccaacacctctacacagttatgttcaactgggctctctcatatcaggagcaaggtggcggggtttagcgtgttgcaaactgcagtggttatgtggggattttcacgtagcaagctttggtacttggttaatctagcatttgttaaccagtgatgacctttggtagtcattaaagttaccacagcgtggggggcctttatattcaggttttgtccaagggttagtttatctgcttcttgtgctaacagggccgttgctgccagggcccttagacacgggggccaggctttggaaaccccgtctagttgttttgagagataggccactggccttagccagggtcccacagtctgggttaaaactccaactgcattttttctctttctgacacatagggtgtaaagggttttgtcaggtctgatagccccagggctggggcctacgtttttcttttaactcatgaaaagcttgttgctgtttgttgtaatagatgtagtttatccaatttacatttttattaactgtcatctaccaaaatattgactcaaatcctgccgctatttgatttcaagttttaaattgatctagtattccccgtgggactccaattgcgtctaaatggaaatgagagtcgaaagacccataaggggcttctcttgctttacgatgtcttatttttcctccctctggttgatggaatgccagggtgaaagggatagccaatcggactaaagtacaagcgccactccagttattcggcagagtgcccagtaaaggtccaccacaataccaccacacatccgctcacatccactcagggatgaacaagggctggctgattgataggctcttgaaaatttttaagctcactgcatcccttcaggtttccaaggaatgctaagtttcctccctgtcatgagagacacgaagtgaacttagtattgggagacggcggctcgatggccctcgggggctgacccgcaaggcgccagactttcggatacagcagagagagcttggcacaacttattactccaggctgtagaatcctggagaagagctaccatgcagccacacctggtcgactggaggaccaccttagtggaaaggggacaatcaggacctctggcctgccatgtgcacaagcgtaacagttgcttttgtttaacgtgcggatggaatatttgatccatttcaaccaggcatttgcatcttggtatgctgtcttaattgccaaagtttgttttaagtctttaactaatatgaacttctagtaaaatgaatgtatgattttgggaaattacaaaaactggttggggcagtccattcttgctctttagtggtccacagaatgttggaccaactacggcataaaagctctacattggggagcaagactcctggttgacactggagtctttattgaaattcccccggattaaatggtcctaatttactaatgcccagtctgaggagagtcaggagggacagaagtacttttctgaagtagagagctgtcttcgacttggcaagtccccacagggtataacaagacaagcattaaatgcaatagtttgaggtgaaattgatttggttgtgttaataaccagatggtcagcaatagagcgaggaaagaagaaagagtaatagaatagataaaagagttaaatatttcttagctttagtttggtagggttttccccttggactggggcccacgactccggagggggtggagctttgactcgggtgtgatgagtccatcccttttccactgtagggacagcagtctcggtggttagcagcacaaggtcgggtccttcctaggctggcttgttttctttcctccctttgttttctttctttcctttgataagaaaaacttttcctttgaaaaatttgttttctttcctccctttgataagaaggtgatcttcaggctggtgctggtttactggaaattctagggctggcacctgtgctaaaaggcttttagttttgagggaaaggaaagtggaagacaaaccaagtatataatttctaagaaattgattttttgtttcaaatgtggggacatcaagagtggactttataggctttggtgcctttttactgagaaatttcctttaccacctatttttattagtttttggaccaaagaaagccaaacactgttttatatttaataatgctttctgtatgatttttataccagataagctaaatttcacctttatattagtgtgctattaatgttaaacttagttttaataaaactttgtatacatatttattcaatttttaatgtcagaccgtaaggtaagatttttatagactctttttaaccttttataatctttgttaaagagcaagttagtgctttaagaaaaacccattgtgtttttactttaatgtccagttcacagaaaaactggatgatacccctttaactttagctaatacgtttacacacagaatttttttataattaatgttttaaaacttgcttaaaccttcaaaacaatttttttaaccttttaatctaggtaaaaatttacattcttatgccttcttataatccttttaccaaaggtatatttacttttcttatacaccttgtgttagcgcctccgtgtgaaaagcccaccaaacaggctttgtgtgagcaacaaggctgtttatttcacctgggtgcaggcgggctgattctgaaaagagtcagcaaagggtggtggattatcattagttcttacaggtttggggtaggcggttgggttaggagcaatgttttgccggcagggggtggatctcacaaagtacactctcaagggtggggagaattacaaagaaccttcttaagggtgggagagattacaaagtacattgatcagttaggatggggcagaaacaaatcacaatggtggaatgtcatcagttaaggctattttcacttcctttgtggatcttcagttgcttcaggccatctggatgtatatgcaggtcacgggatatgatggcttagcttgggctcagagggctgacattcctgtcttcttatattaataagaaaagcaaaacaaaatagtggtgaagtgttggagcagtgacaaattttgggggtggtatggagagataatgggcgatgtttctcaaggctgcttcgagcgggatcaggggcggtgtgggaacctacagtgggagagattcaactgaagaaagattttggggttgttagaaggagcatttgtcatatagaattactgatgatggcctggatgcggttttatatgaattgagaaactaaacgaaagacacaaggtccgaataaaagaaggagaaaaataggtattaaaggactaagaattgggagtacccaggacgtccaattagagagtgtccaagggggttcaatgttattgtttgcttggttggcgagcttttgggctctatccttgagtttttttatgttgtcatatagcaggccagattgatttaggtaaaaacaacactcttcatttaaaaatatacagagtcctcctttttcagcagtgagtaaatcgcggccttggccgttctggaggacaactgcagctaaagagttaacctgggcttggagaacagataaagtttgtgatctatctgtagtgctagcagagaagtcattagagaggctgcggactgttgtgacagaggttgagatgcctgctattccagttccaagtgcaatactggaggcagaaagtcctagaccaataagtaaagggattagtgggatgactcttttttgttgtgttgatgtcatgagggggacaggcagttgttcgttcccatctgcaaactggattttggaggtaaggaagactagagtacatgtgcccatccatttggcaggtaggcacatgtaggtggaagagccacataaaaagaagagaccttgtgtcaggcagaactggaaatgtaaagtgaaaaggtgagagggtgtactgaaagaggaatcctgcatccagaatcctagcgatccagcaagggcagcagccgttagaggttgtaatggggattgatggtgcaactgcgtagagggaggggtttggttttcatggtgtatgagaaagcgcatagtgtctacaagtaacctttcgctgctattcatggggcagggtataagcaagcaagaggaggggctaggaggagattcagacgagcaggggagggtggtagccaaggatggggtgagatgcagggtaggtgtcttcctaaacaatagtgactgccaatgttttttagtttgtcaataatgatagagggcttgtcagtaatgcgaagttggaatgctcccatctgtttggtaatgtgtgtggctgggttctggagacaaagagtaaaggaacatttggacggtggaaggttgcctaaagggattccagcaggctgttgtcgggagatgcataaagaaacggcaacagggatagttgtttgtgtggttggggtccaaatatgggaggagtggaattgacataaggagaaagatgccgtaagtagatgcggagaagtgtggcagctcgttggtgtgaaatgtctggggagttctcaccaaatctgtctagaaaataaagaagttcctcaggcgggtaaagatgagggttattaaaggaggttctgagttgcagggagacgggagaggtagcccagtcagcctgtagagcagggatggctgtgtaaaagcaggaggaaagggaaacgcgtagccaacaattctttgctagaaaaggattggaggcagtgaggagagagtgggtgagattgatagtatgctggaggtaactggggagaggtagagagtggcataagaatgggaatgagaataagagtgaatataaaagtaaagaatagaacttcatcagggtggaagtgttggagggtgccctgccaccaaagatcatctatccactccaagcaggagtcaagagtggcggtttggggatatcaccaggagatatcagctgtgatgtcttggagaaacaatgtaaactggcagtgtaaacaagagcaggtcatttatgagtagttgagaatggtgaataggagtatgactagacagaagatagtagggatgacaggtttttggggcacagtccaagtagtgggggtgactgcgtaaagccctgttgcgaagagtagggtaaggatggatagacctaatagaatgaagggatgtattaggctcataagggttattgttcttcagaaatgcgagtgagtttaagggaagtaggggagagtacttgcgacttccaggaggaagaggagatatcggactggctgtctgacggacacagctttattctggaacggtgaacccagtggggagggttctgcaggcagatggtggttgggggtactatagatgtttaagtagggtccggtccatcgaggttgtagagtttgaggggtcagattattaacaagaactgaccatccagctagggtgtcttcatgtggctgggaatctggagtaggcaagagaagattagcagcctggcgaatttcctgtctagcctgctgaaagactggaagatagttgcctagagggctggtgtctgggatgaggttggggctgagcaagaaagtgcgtccacataaaagtttaaatggactgtaccgtgtagcttcttgaggacaggctctaattctgagaagggcaagaggtagaagtactgtccagtcctttttaagctggaggctgagcttggtgaggtgtgtctgtaaaagaccattagtcccttctacctttcctgaagattgagatggtaagggatatgaaggttccactgaataccaagagcctgagaaactgcttgggtgatttgactaataaaggccggtccgttatcagactgtatagaggtgggaaggccaaaccgaggaattatgtctgacagaagagaagaaatgactgcggtggccttcccagaccctgtgggaaaggcctctacgcatccagtgaaagcatctatccagaccaagaggtattttagtttcctgactcggggcctgtgagtaaagtcaatttgccggtcctgggcaggggcaaatccccgcgcttgatgtgtagggagggagggggcctgaacaatccttgaggagtagtagaatagcagatggaacactgagaagtgatttccttgaggatagatttccacgatggaaaggaaatgagaggttctaagagacaggctagcggcttgtaacctacatggaagaggttgtgaaatgatgatagaatagaatgggcctgtgaggctggaaggagatattttcctttgtctaagaaccatttacattgtgtgggaagagattgataggtggaagtttcagtgggagagtaggtaggagtgaccgatgagaaggagaaaaactggccgtgagggacagaagttggaaaactaagctgcttctttagctaacttatcagcataagtgttgccctgaatgatgggatctgatgccttttgatggctcttgcagtaaatgactccagattcctttggaagtaaagcgaccttgagaagaatttttattaaagaggcattaatgatggaggacccttacatagtgaggaaacctctctctgcccatataacagcatggtggtgcatgctgactctatggaaggcatagagtcagtataaatattgacacgtactccttctgcaagagtgagggcttgagttaaggcaatgagtttggcttgctgagaggtagtggaggggggcagagtggtagcctcaatgataggtgtggaagttactatagcatagcctgcctttgctggtgagtggcgattaggcctggtggaactgccatcaataaaccaagtgtgatcagggtgaggaacaggaaagaaggaaatatggggaaattgagtaaatgctaggtggattagagagatacagtcatggggggtcaggtgtggtatcaggaataatgtgggggctagcctaaaacagtaaggtcaagttgtttggacagaagggctgcaggggccgttcctggctcttgtgtaagaattctgactgcacaaccctgcactttggctgtatgtaatgaaaaagtgttgggatgagttagggagagctagtgtgggagcagcttctagggctgttttcagggaacggaaagaggagtggcgaaaggatttaggatctgtggggtcagctgggtttgcttttgtgagtttatatgatggtttagtcaggatggtaaagctaggtatccaaaggcggagtatctaaccatgcctaggaaggaaaggagctgttgctttgtagaaggggtcggggtttgggagattagctagacacgatcagcagggagagcactgtgttttcatgaagaattaagtcgagataggtaaaggatgaggaagaaatttgggcttgactgaagtaacggggggggggggggctgtccgtgaagccttgtggcagtacagcccaggtaatttgctgagcctgatgggtgtccgggtcagtccaagtgaaaatgaagagaggctgggatgaagggtgcaaaggaatagtaaagaaagcatgtttgagatccagaacagaatgggttatgtagattatgtacatatgtagatatgtacatatctacataataatatatgtagaggggttctggagggaggtattgaggatagaagagtatatggctttggcgccacagggtggataggcaagacaatttggttgataaggtgcagattctgaaattaacctgtaaggcttgtccagtttttggaacaggtaaaatgggggaattataaggagtgtttatgggttttaaaaggccatgctataacaggcgagtgataacaggctttaatccttttaaagtgtgctgtgggatgggatattggcattgagtggggtaagagtgattaggttttaatgggatggtaaggggtgcatgattggttgccaaggtgggagtagaggtgtcctatacttgtggattaaggtggggagatccaaggggagggtgtgaaggcggctttgaactggagaaaagggtggcaatgaggtgtggttgtaggctaggaatagtcagggaagcagataatttagttaaaatgtctcaatctagtaagggatctgggcaggtggggataactaaaaaggggtgcataaaagaatgttgtccaagttggcaccagagttggggaatttaagaggtttagaagcctggccgccaatacccacaacagttacggaggcaagggaaacaggcccttgaaaaaaaggttaatgtggagtgggtagcctctgtattgattaagaaagggacagacttatcctccactgtaagagttacccaaagtgtctgtgatggtccaggggctcccgaggcgatgggcagcgtcagtcttcagccactaagccgaggagatctgggaaggagttggccaaggaacgttgggtttgggctccaggtgctttaggagcagcggcgatgtgagtcggacagtccgacctccagtgggggcgcgcacagacagggcacagcttaggaggaatcccaggctgcgggcattccttggcccagtggccaggcttttggcatttgaagcaaggcccacgaggatgttttgaaggagcccctgggagctgtggcttggatgttctgaagttcttgtatgctggagacgtggttgtgggctgtcttacagcagaggcgagtagctgtaactcagaaatgcgttgctgtctggctacctcctattattgtacaccttgaaggtgaggttgattaattcctgttgtggggtatgagggctggattccagtttttgaatcttttttctaacatcaggagctgactgggtgataaaatgcatattaagaataaggcggcctcctggcccctctgggtctagggcggtaaagcgtctaagggttactgccaagtgggccatgaactgggctgggttttcatcttcacctcgggtagtttcttgtttgtcataattaacagctttgtaagctgcctttttaagcccttcaactaggcaggaaaccatgtaatctcgcgtagctatacctggggaatctgcctggtagttccactggggatcttctcggggaactgctctgatgccctcctggaggtctggctcgtgaagccggtggttgtcagtgtgagattgggctagagaaaaaactctttcccatttatctggggagagggtagaagttaggatgacatttcagtcactccaggttaaactgtaggacagagttagatatcggaattcctgtatgtatttagtggggtctgatgagaaagagcctaaacgctggctgatttgggaaaggtctgatagagaaaaaggcacatgtaccctgacatatgccttcagctccagccacctctctatgaggaaattgttgggcagatgggggagagctggtcgcagaaagaaactgtaaaccggaccgggtgtgggagggaggtaatagaagggttatagggtggggagcagaggctgaagaagagctggagcctgatcagcctggcggggagcgagctgaggaggagcagcctggggaggaggtgaggggtcagatgggtcagcagaaaaggaagattcacaagactcagcaacgctcgaggttgggactgaagggacaggcgggagggaaaggaggaggatttgggatgagtcacagtgggaacagagactagggagggaacgaagtctgaaaaatgcctggacgtaaggcacctcagactatttgcccatttttcgacaaaaattatctaggtcttgcaggatggagaaatcaaaagtgccattttctggccatttagaaccattgtcgagttcgtactggggccaagcggtgttgcagaagaaaataagatgcttagattttaggtcaagtgagagttgaagaggttttaagttcttgagaacacaggctaagggagaagaaggaggaatggagggtgaaaggttgcccacagtgaaggaggccagtttaaagagaagggtagagacacggagaaggggggtagggagcagccgtgggctgcaatgtgggtgagcagccaaagcaggttgtccccgcaattgacttgccaccaagggaatgtgggtgaatgaccaaggcaggcatccccacagtgattagacaccagtggagtgtgggtgaataatcaggcaggcgtccctgcagtcattaaacaccaggggaagactgtcttgccgagtccgtgactggcgccggagttttgggtccacggataaaatatgtctcctttgtctctactagagaggaaaaagaactggaattggaaggacagggagactgaagggtagcgagagaggctggagaagagagtgaaaagaccacttacccgatttgaaattcatgagatgttccttgggctggttggtctgagaacccgaggttgtacgtggatctcctcatggagtgaggatgaggacaggggaccggtctctgtaaggagtactcccgtcccggatctttggtaccaaatgtcacgcacgtcacacgcatccgtgtgaagagaccaccaaacaggctttgtgtgagcaacaaggctgtttatttcacctgggtgcaggcgggctgagtccaaaaagagagtcagcaaagtgtggtgggattatcattagttcttgtaggtttgggataggcggtggagttaggagcaatgttttgcaggcagggggtggatctcacaaagtacattctcaagggtgggattacaaagaattacgaagaaccttcttaagggtgggagagattacaaagtacattgatcagttaggatggggcagaaacaaatcacaatggtggaatgtcatcagttaaggctattttcacttcctttgtggatcttcagttgcttcaggccatctggatgtatacgtgcaggtccctggggatatgatggcttagcttgggctcagaggcctgacacttgcacataaactgttttttttttctttcaatagttttacatttaggaggcctagttacttttaaattatacaacatttcttgcataattttttataacatttttctctttcacgactttcgcagacaattcttcgacatgcctcaactttctgacttattacaaacatttctttctttaaacaaccagttaatttatttcaggacaagaatttaccatataacactctttttatgtaaattctgccccttctttttttttttcctgaagatgataaccattcttttccaaagcgaacttcttttatgtctgtggactagactgtctgaggccacaagatcagaaattactataatacatgttacactgttaacttttagcaaactttacttttgttgaaaaccttgtaagcttgggattttaattatcctttgctattagtaagacctcgttttgtcaaaattaacttagaattcgtatagatggctttttttttttcctttaattacctgggaggaaccatagatcatcctttcctgaagggagttcctcctaggtatggtagggcctttgtacggtaattaagatttagatcccctgttaggaaacctgctgggttaagggaattttcagtagttaaagttaaatcatccttttttttttttccttaggctacttctgaactggtgaggtgtgctcacaatgaggtttcctgtaaaagttatttttttacttttttctgttagcaaagcagttgcagctacagattgaatgcatttgagccatccacgggttactgggttaaggatttttgatgggaaggcctcagtgctttcgggatatgcccttgtttacactgacaacaaagtggtattggagtgttacagggttacagagaatactttcaattatcaattataggttttaaatttatcttggcttttaaaggaatagggtacagtgttgttgttgtttctaactacttgtatatatatctctttttttctttttttcctcttgattttctgtctctttctctttgactttccttttgcctctgtctctttctctctctctctctgactccctctttgtctgtctcttcctctttctctctctgctggtctttccttgcctctgccagccacttatgctgctgttctctcaaccactgttggggcgggcgggtggggagtctaaaaccagctgtaaccaagtgtctgtgtacgggaactggtgtgggtaccctggcttacaggttaccttgtgccatacctttgaaacaagggacctgtccaggcttcactctgatggccaacctacctctaatgctggccagtctatcttacacaaagttttaagttttcctggtgtcatagtactccatagtctcccttaaatcctttcctgaaatttttcagcatagttcctagtggggtggtcttactttgtgcttgacccatgcttcttcaagacaaaacattacgctcaccctacacgcataccacaaaacaaagaacaggtaaaaagggcacacacacacttttacagtttacaccaaaccaaaatcaaaaccaaaatcagagtatcaggatatccaagtcaggtcaaaaccaaaaccaaagtatcaagcaatccaagtcaagtcaaaaacaaaaaccagagtgccagtacaggcacgccgtgggtgatcaggccacgcttcccctcaaatggagtgggcaagttccaaagaccagtcttaccaagtttcagatgtctggactccaagtggcagttccttcccggtgttcagccactgcgttgatcctcctcgggggcctgctacacactgctctggccaggcattccactggggcaattgcctgcctgagagcgctctcaggatccatgtcgctcaagctggctggagtcctccacagggatgctccacagggcaggcctaagccgtctgaggggctgcctcaaccatccattaatcacctagattcctggtcagggaaccaagaaatgtagcaggacaagctgcagagaaaacccctcagacacgagttaaagaagggctttattcagccgggcgcttcggcaagactcatgtctccaacaactgagctccccgagtgagcaattcctgtcccttttaagggctcacaactcttaaggggtctgcgtgagagggtcgtgattgattgagcaagcagggggtacgtgactgggggctgcatgcacccgtaattagaacggaacagaacaggacagggattttcacggtgcttttctatataatgtctgtaatctatagatagcatcactgattaggtcaggcgtcgatctttaactaccaggcccagggtgtggtgcaggctgtctgcttgtggatttcatttctgccttttagtttttacttctctctttggaggcagaaattgggcgtaagacaatatgtggggtggtctcctcccttaagagcactgacagatatttcacagacgaggaaactgaagcttagagaggtcgagccacttgcccatggctgtagaactggcaaatgggagagccaggacccacattcaggcctgtctgggctgggctgtgtgtcagctttgttgggttccagagtggtcagggtgaaggagcccttggatttggtaattaggagtcactcatggacctgtggcgatggggcaaagatcgtgggttctgaggaagtggctgtcctctgggttgaggttctgttgcgcttcagggcacaggtagcagtgatcatgaaggaatactggggaaggtaggacccttatagtaagtttaggtgtgaggggaagcacagcagggctgaaggcgttttttatgggctgtggagcacctgagcaggggcagcctggtggagcacttgctggacccagggcccctccagtctctcctgcttccccctgctttggccccaggttgctttcgcatacacccccacctcctcaaaagggctatccccagcatatcctgcagagagggtgattaggtgtgacttctgaccaaagttgctctggttggggggggggggtgggggggaaatgcactttcctggcgcttgtttttccagctggaaacgggattcgtaatggtaatggttgaacttaatgaacgtgataggatgagaataatgcagaatgcaatataaatgctaatcatggcttggattgttactcagctcgaggctcaggttttctccagccacctccccagttatgcaaccttcacactttatgtatcaaatcagaggtgttttccttcagcacactagtgcctgtgtgcatggctagacttgggtggctttacctacttggccctgagctgacattttcttcccaatatttatcactggaagtttgtttctaaattggaattgcctgaacatacaggagtaactgaaatagctcagggccgtctcggttaacacatgcacaaagtctcataactattcatgaaaggcaaataatttgcacacacaataaggtccttattttatttttttttgagacagggtctcactctgtcacccaggttggagtgcagtggtgcaatcatagctcactgcagcctcaaactcccaggctcaagcaatcctcatacctcagcctcccaggtagctgggattacaggtgtgcacacctaattttttcagtcaggtctcaaagagaaggagataatgatcagttgtgaagattttcaggtaaatcaccaccaaggtagggctgaaagcagaaagaactctgcagcagggaactgtccagggaggcgggtatgagtgggagtgaggatgaataaagggttgggagggggaaggtcagggttggtgatgaggcatccatggcggaaacgggaactgcagggtgaggtgaggctggcgcagggcagacaaagtgagtcttccggtgcaggccagcatgcctcctcttcttgctgtggttctagaccacaggtttctcgcctggaagaacctttcctttttggaagagaaaatgcagttttccccctgaaggggcatttttagcactccaacgtcagtgggctcctggaagggttactgtttatctcttaccccgcaagtggactcaggggtgaagttagttagctcctacctgtaccccgttagctgcagccccgctgtgtccagtgaagtcatttcaggcagggcatgggggactccttctgaggcagaggtgtaagcgtttcagtcccagatcggctacagggagtggcgctcagctccactgtggagtcgccaggatgctgtcattttgtccagaggaaaagtccaccgtctcacatgtgaaggcagagcctgttttctgtgtgcacagtctgaacacactacttcatgggtgcttctaaaggacatttccacaaagaacacaaacgattcccaaaagcctagctgatgtctatgtgccataaatagaagctctgcccccagagagaagagttctttagcagcaaaactccagtttattaagacaggtgtgacaagtaaaataaaattcattttttttttttttgcctctgctaggccagtatatttctgtacaaacaagataatgcaagatttgacagttaaggctttgaagcacagcacacaaaatgaaacaatttaaaaccccttcataaaaatgggaaaaattcccaggccaaaggaaaaaaaaagccttcacagaaagagactgacactcgactccccccctgctgaggtgtggccagtgagtctgggtgtgagctgccacctgacagccagctctgaggtatcaaaggagctccgagtgcaagttgaagacttcagcaagccagcccccggcccccacacccgttcataggcagtcggaatgcagatctcggtggcaggtggctctgcacagtccagagtgataaaacaatcacagatgactaaatgccagggactgtgtgaagtcagttactgcctgcagtctgggtcactctgcccttcatcagacactggtggcaccatgacagtgaggagaacggagcacagttccttccgtgcctcctgccggcgctgctcaaggtgtgcatggctgagtcctggacaagcattttgtatttttgtagttctcactccttaggcccaatttcaagttaagtcgttaactcatttagaatgaatattaaggatactgcctctaacatatcaatagctgtgctgagctgtctaggaagagaaattagtccagagaggtcctaagtatcaaagcagattttgtaaagaaaaaaggcaacacgtcagtgagaaaagcagcacaagatccgggctcggggactcttttccctctttccgaaacataactggttttgtatgtgctctgagtcctagtttttatgtcttggctgagaaccacagaaaggactagatattcatacatgcgagagcacactgagactgcatgtttatttggcataatgctagaaaaaagtccgcaaagaactgccagaaccaggcctgtgaccaagtttacagtcatctagtttctctcacaatttcaaaatgtcagatcagaagaatctttggcgattaatccactctccattttatgcgtgagaaaaccaaggccctgatggtgtccctggtccaagtccagtgcctttcacaatgaggcttttggctcttaccctctgaagtggggcagtggctcactgtgaggggagagggtcagatcttgttagtttgatcttaaggcactcacaaaatgccctgatttttcttgtctttgtgagaagacaaaaaacagtctggtagtttttcacatcatcgtgggaacccagaaatatatgtacagtactcagaatttaagggaatggaagaaagaagaaaatgagattctcttttgtgagtacagaattagaagaaaaaaaaaaagaggggtgggcagtgccagaggcgaacgggcacaggtcattactgcgtgtgtggctgagctacaagtctcctggaatgtaaacaatgttggtttatttccaatttcatctaatcttcattgtcatctctcaatgaacagtactcataaaatgatgagaaagtttcagaacatgtatgtacatggttcagaaacagctcggctttcaaaaagctgtcagctcaggtagcacgccttggtcttgaattcggtgctacgctgacagctctccttctgaatgcaaaggcaccagtccatgatcaagtccacgccgcagacgaggagagaggagtcttctctccaaagtcatccaaagatagctgaggaaataattctatctcatttctcgattccatttcagcacagcagctgttttccacactgagacacagctggcgagcagtatctcttctgggaactgagatgccatttcaggaagaatttcactttctttagtttgcatgtaacttacgagagtgtctctcaggctgaaaaaccaaagaagagagcatttaaaacagtctcctcagcatggtggctcacgtgtgtaagcccagcactgtgtggctcacgtgtgtaagcccagcactgtgggaggctgaggtgggtgggtcagtggaggtcaggagttcaagaccagcctgggcaacatggcgaaaccctgtctctagcaaaaatacaaaaattagctgggcacgtggtggtgtatgcctatagtccgaagctactcaggaggctgaggtgggaggaccacttgagtccaggaggtggaggctacagcgagctgagattgcacaactgcactccagcctgggccacagtgagatcctgtctcaaaaaaaaaggctcccatataacataaggggaccaatcagtcccctcatgttactttttcccgttgtcatcagcagaaccaaaatgctcgttaagacttaaaatcctaggccaggcgcagtggctcacgcctataatcctagcactttgggaggctgaggcaggtggatcacttgaagtcaggagttcgagaccagcctagccaacatggagaaaccctgtctctagtaaaaatacaaaaattagccaggcatggcggtgggtgcctgtaatcccagctactcgggaggctgaggcaggaaaatcacttgaacccaggaggtggagcttgcagtgagccgagattgcaccactgcactccagcctgggcgacagagcgagaaaaaaaaaaaacccagaaatcctgaggagcagtttaaggtcaatgacctgagctcctgaactgggactagcatcctgggttcaaggctctggtgcctgactgctgcttcccacatgcagtacacaaacacgacagaagcccacggagcaagccctgtgctggccccttcacatgactttaggccctctagcaaggtgatgtttatttacagggttgcataaacaaggcctcaccattcaaaaaaccttgtattctattacatgtttcacattaacaaagactggaaattctctaggaaagggatcttttttatctacatgaaaagcacaggctagtaaagacttgttgaaaaagttgaaagaacataaatgtatatggtatatgccacatagcataatggaggaagatagcaaataggaaacatattggtgaggaagactggagtttgatgatctagtcaggaaaacatcaagttaaatccttactttacacctaaacataaactggtgaataaaacaagtatgtgaaagcacaagaagagagaggacaggccgggcgcagtggctcacgcctgtaatcctagcactttgggaggccgagacgggcagatcacttgaggtcaggagatcgagaccagcctggtcaacatggtgaaacccgtctctactaaaagtacaaaaaaattagccgggcaggtgcatgcctgtagtcccagctactcgggaggctgaggcaggagaatcgcttgaacccaggaggcagaggttgcagtgagctaagatgacaccattgcactctagcctggatgacacagcaagactccatctcaaaaaaaaaaaaaaaaaaaaaaaaaaaaggctagtttataatcctgggataaggaagatcctagtaagtgtttttgtatagagaccctttataggaaaattctgtcagatttgacttcataaaattaaaggctgaaatagagcactgtggcacacggcagagaagatgaacccctgttctatgcaaagagctctcacaaccattacagagacaaagcgcaaaagaaaaagatacgaagaggtaatttaggctgggtgtggtggccaaagcttgtgaatcacttgaggtcaggagctcgagaccagcctggccacgtggagaaaccccgtctctgtactaaaatagaaaaaattagctgggcgtgatggttggcacctgtaatcccagctactagggaggctaaggcaggagaatcgattgaacccagaaggcagcggttgcactaagccaagattgcgccactgcactccagcttgggtgggagtgagacacggtctcaaaaaataaaacataaaggcaattcagaggatgatatacaaatgggtgataaatataaaaaacatgttcagcctcacggtaaatggggaaatacaactgaaaatgagataccattttggcctttagattggcaactatgtaaaagatggataatatccaatgttgagtattctcatacactctttatacattggtatagctttttctattcttttttttgtttgtttttgagatgaagtctccctctgttgcccaggctggagtgcagtggtgcgatctcagctcactgcaatctccacctcccaggttaaagcaattctcctgcctcagcctcctgagtaggtgggactgcaggtgtgtaccaccatgcctggctaatttttgtatttttagtagaaacagagtttcaccagttggccaggctggtcttgaactcctgacctcaggtgatccacccacctcggcctcccaaagtgctgggattacagggtaagcctccacacccggcctaggatagctttttctatcaaatttaaaatgtacctctctttgacatagtctacttgttataaaattagaatatatgacttttaggctgggtgtagtggctcacgccttttcattctagcactttgagaggccaaagcgggcagatcatttcaggccaggagttcgagaccagcctggccaacacagtgaaactctgtctctactaaaaatacaaaaattagccaggcatggtggtacacgcctgtagtcccagctatttgggaagctgaggcatgagactcgcttgaacctgggaggcagaggttgcagtgagccaaggttgcagtgagttgagattactccactgcactccagcctgggtaacagggcaagactcttgtctgaaaaacacttgtgtaattgcttaaagaaaacccagtagagattaaaaccaaaaagccagtcctcaggtgccctggtaatgacaaaaagcaggaaatgggattctgtggtaagaaaagaactatttttgtgtctatagaagatcacaggagagacagcacaacattgtgtctgccccgccccataggtgtgcaaatccatacctccactgagggcggaagcgctcctcggtttgggtttgggggttctttagtttcaagattatcatttcgtgcagctctagcaggaaggcgtctaggccagtctgatttaggaatgtgctgaggagcttagcattttccgggctcagatccgctttgtaccttgaactgatttccccaaatggctcctaaaacgacggaagagcaaatgaagcattaaagcctgcagggagaagggagcgcagtccctctgtccagcagagaggaagagaccagacttactttgtgcagccgcagcagctgttcagacttatgagcagacaggaactgccagagggcaatggtgtgttttaactggcatctgtttaaggcctgcagaaggaatagaattcctgagtgggggctgaggtctcacacccccactcatgtcgtgcaccagggagcctgagtgctctccacacaggcattcttctcttcgttctgccctgtactaatgtgatctccctccttgtgaaggccatctctgtcctatctaccagttccctcctgcggcacctcacagcccgctcacatcacgctgtttgcaggggcctcatgtactcagtcacatttgggctctatctagactgctggcatttctagcgcgtgtctgtctctactgtccctggtgtgtcctgtttatgctggactgactgggtgagcagttgttcttgtctccccatccttttcaggagcgcctagagtggcactccctgaatgctcctatccctcgcgggaagcaggagaccagggtgaggggctgtgctgatttccttttcggtgtgagacccacctttaacacgtgaatcgtctgatcacccatttgcaggatgtcttgagtatacacattcagctgcatgtttggatccccaccagctgtgctcagaaaccccagagtgacttctacgacagacagcacttcacaggcatcgctgtaggactgcagctgtccactgatggcactaatgaccgagctggggagggagtcctgggaaatgaaaagcaggagagggatgtctgtgggctgggtttctggcatctcaccacctggtaagagagccgagccccttcactgcccaagccacatgcggggggccaactctctaacagctgacacttgggcgcacggtgtgcaggcagttcctggaggccatggagacacacaggtctacctatcagtacccgcatgcggagagcaggaacaaatcggttccatggacttcccgcttcagcaggcatggccatgcatcaacatcattcctaagaatcaaacccacaagatgtcaatctgcttttactctacaagaaaacttgctgatttgctgtcttgcttgctctctgtaagggaggccgcagaaactgtgggctcacagcaaacacccggggcaaggctggagtaggcctaacacggagggaaacacactgagaaggcagaaagccccgtgcacaggatcaggtttatcgggatcacctgtgccattttgttcttgatgtccataaagagatgttcatagttccagtcgtgtctgtacaccagagtgggtattccctaaattgggaaagaaaaaagttttttaaaattaaatccatcgtggacatttccagcagatgacaaacagaatctgcagccggaaaactgcagcgtagtgccgcgctgccctgtgtatcccttggctaagagcgcccctctccgtcattaacccaccatctatggaaatagtaacacaaccgggaatccagcggagtcctcacagccaattacatgacaagatattgtcacatcatcgtggcctgcttcgccacaggaggcgctagggcaacaggtatttgtgcatatcccattcatttattcattcagccactaaaggcacagaccatgcacaggcagtcactctgccagaggaaatggctgtgagaatgaattaaaaacagcctttgggaggcagagacgggcagatcacgaagtcaagagatcgagaccatcctggctaacatggtgaaaccccgtctctactaaaaatacaaaaaaattagccgggcatggtggcgggcgcctgtagtcccagctactcgggaggctgcggcaggagaatggcatgagtgaacccgggaggtggagcttgcagcaagctgagattgcgccactgcaatccagcctgggtgacagagcgagactccgtctcaaaaaaaaaaaaaaaaaaaaaaaatccatgggctctcacagttcctggcccagttgcgggtggtaccgtacataagtacagtagatatgactgcagctggaaggaacaagtgcgtccagtcaaagaacagagatgggaaagtgcctgctgtgtggcttcagtgcatgaggtcacgggatgcagttcagggaaatgggctaagtggctggaggcagggctggaaggttgggctgggccgagctacagggcctcccataccagacaacagagtgtcggctttatcccatatgccatgagaggccaggcaggtccatccggcacaggatgaagagagccagatgtgggttttaggccgtggactgaagaacctggaggtgggcaccagttaggagtggctagcagtccaacgtacaggatgcttttaactacagggtgggctttggcagtcaggtgaggacacacagaaggcacagctaatggcatctgctggcaggttacccatggaggctgaaggaagaggggctgtgggggtggtggtgccattaactggtagaatcaagacctcaacaatcagctgggtgcagtggctcacgcctataatcccagcactttgggaggcctaggcgggtggatcccttgatcccaagagttcgagaccagccgggcaacgtggtgaagccccatctctaccaaaaaatacacaaattagctgggcatggtggtgcacacttgtgatctcagctatttgggaagctgatgtgagaggatcgcttgagcccagaggtggaggcttggcaccactgccctgcagcctcggtgacagagtgagaccctgtttcaaaaaaagacctcaacagttccttgggggactgaggtgcagatggccctgcaggagagggctcaggagagccctgcggcccggagatacaggtggcgtggtggcctcgggagctgcaggtgtgagggaggagatacagaccagactgcagggtgaggtgctgcttccctctctcgagaaacacaccaagggctgcttgttcacaacagacacaccaaatgagcagcagtggcaggagtcagccctaccttgaggctcagccggggcttgccctggaggaagcggctgacgatctgccgctgaatcttctccagatcgaactcctgcacggtctctctgccctcctccacctggtactggcagttggagagaatcagtggagtcaggtcccgctccacttcataactgatgacatgcagttcagtgacctcggcggcatccacggaatagctgaggggcagaaagacagcgctcagcgtccaggccaggcatgcgggcctagggctctatgttgcagggagcaggctcccatttctcacagttggagcagtggaaaaccctacccaagtatggggcgggtcactggtgggggcggctgaaggagtgagtgtctgttagggaaggggctgaagcttgcttgtgtctgccccactgggcttagggactctgggctgagcaggcaccacttcctggtggctcgtgcacaaacctgttgttttccttggagagtttttccacggcgtagacaatttcattgtgtaggcgaatcaagtagctgacgagagcggtagcacagaggcccaggccccgtcggcgtggcaagaggatctcaaactcagtgtccagatccaagtcagtgctgcagtagtctttgggtaggttgaggggaca

SEQ ID NO: 3743 - DNA, 2794 bp, Homo sapiens
ctgagacagtgcctcatagtgccatctacatggaatatgaagtcaatcagaatgtctctaaatcctggctctgttgggttttggctgtgtgactttgggtaagttacttaacctctctgagtcacattttccacctgtgttaaaggaggtaatcacagcaaatgcaaagggtggtgctggatatcagggtgggcacctgctaagtgatgctttcttctgtttaacgttgtaaaagatgtaaatgagacggtccccaaatgagggtagattttactcccctctagctcaggtggcgcttgtcggggagatcaagcagtttctgttcctccctagtaaaagcaggaaggctttcctgggcggggtcctctgagtgctggaagagggggagggtgtccactcagtgaggaggcaggagggcagtcttgcacacactgggcacctctgggcctccagcactggatgtcagctgtgcttgttgaatggatgtgctgccctcaagccccaaatctgttctctgcccttctctatcctctctgtgccctgggacgctgaccctggcagtacctcacccagtgtctttatctgggctctcccaaaagcagagccccagaaaggatgtgagggcagcctgtttcttggggagcttatggtgaatgtggagctccccatgcaggccccccttccaggagggactgattgcccccctgttggctccttcaggatttgcctcaactacagagacagcatggaacacgccctcctaggctgcccacatcctcatctgcatgggggcacagaagcctggccattcatcccatgggagactcaggacatgctcccagcaacctgatgggctgcccaaggcttggctgatcctgcatccctgcatcacatctcagcttctccctctgcccaaatctacttcctccccattcctttcacaggcattgattccctgataaacaccttgcaccccatattccatctcagagtctccttgcagagaacccaacctgtggcagagctggtctcaggactcggagcgagggagcagggaaagaggacaggaaagcagggagagtcaatttaagggtatgttgtctgagacaaagattctgctaggacctctgagatgggtacaagatgcctggagccattcactgggcagtatctgtccatcagctcccaggccccacagaaccggagctgcctgtgagggctttcactgccctgcatttctgggcttcacatatgcactggctgagagggctccctgtcttcaaggacgatcctgagcagaaagtgggtgcacttgaggtggcatgctgttgcgagagtctgagctttatgagaagcagacccagggggcatggtgtggggcatcccaaaggacctgccatacattaggtgccttggtcttggggaggagccctcgggagttctgagggtgggagaagaggtaggtggggttaatcctttcccattccctccctgcctcagcaccatggctcaggcagtagcgctgccagctcctcctgggatcagagttatggccctgctccccttgtcccttcaggctgaggaacataagggcttcccatggttgctggtgtctgagtgcctcaacctcccttgctggttcctttcccctgcccacacctttgtcaatagttccccccactgaagtctctttggttgagcagttggtggggatgctgactgataaagtggtctaggccactgctcactgcttaaagccttgcttcagagagaccttccagggccctgcagctcccccttctccaacccctccaacccctccaacctttctctctcccagctggtctgggttccctacggcatctacttgcttttgaatctatttcttatagatacatgtgtgtcctcctctttcacagccttaccttttcatatggaggaagaaaaaacccatttctataaagctattaaatgttttcctttcacaaacaccagttttgtacatcagaagcactgcctttcatgcctattgaattctcggaaatgggcttcgagtgcctatttcaggagttgaaatctgaacatcagctctttcttcctctctgcattcctgccacacagtcctaatcctctccagtgtgatggatccctctggctgggtagaagggagatcatttaaaggaaatttgaaaaagaaaagaatagtattccatttcaagagatttttctcctgacacagttattttcaacaggtgacaggtattgatactgatgaaagattcttgagtgaatacaaaccactccccacccccatccccagcatacattctctagaaattccagaatgcccagtgagtggattcattccacatatatttagtgcctaactacatgccaaggagctgggtgctaagaacaaaaaagtatgattcctgccctctgccatagagtttgtgatctgtgttgatgcattaaagattaatccaatgattacacaaaatgtgatgttgcaattttgcctttgcacttgctgttccctctgcctggaatgcttgtccctgcaaggtgtctgcctggcttcctccatacttcctctaggccttttcacaatcatccctcttcacttgtggccttcttggccactcactctgtcaacattcctgctctttttttctctctagcatacttctctgtttatggaccatccctcccagaatgtaagcttcataagaatacagatttttcttttcataaaatcttttattgttctctgcagagaacaaaattcccagag

SEQ ID NO: 3744 - DNA, 1915 bp, Homo sapiens
gagaggtagtttgggcaaataactgtggtttggaaggaggcacaaagaaggaacagcattagcaacactgtctcttacccatctttcccctgaagacatcttagacacacaatgcacaaaggacagtgatcaatggtcacagagaaatgaataggagcaggcacctgaaaggctacaaacctcttttcacagggacacagcttatgtgctcatttgattccacacttaagaaaatactagtataactttcctgaaaataaaaaataaaaagataacacatttgcttttttaccacaagccggtaagaactgagtttctaggtccggtgggctttcaccagccaagtcctggactggtctagtcttggaaacaaaagcccagtttcaggtcccagcctcctcccttcaaaagggcatggatgtccatagaatcgaggcaagaaatagagctctccaagactcctctctgaggcagagacccccagcctagacagcagcttgtcagctaggcttggggtgacaggctgcagcaaagtcccaaagactcgcaaacattccaaggccacatgaagcacagtacccagccagggagcatccactgggctctcccagttcagcttccatggtgcatgcctttggacaaaaccattagtttgccggacacagctggacacggcctccagagccttatatatccgaaagttatcatagtggtctgctacctgctttggcaaagtggccactgcgctcaccagagcataatcctctgcctgagcacgaactgacggccccaccaaccctggctcactagggaagcaggtagtgcagaaggctgggtaggtctcagaaggatttattcttttggcagtgcatcggttcaagagacctcccaaggcatctgccagctcggagttcagcaacttaaccaccttttcatcatagtagtcacagtcccagttggggacgccctgccgaaggagaaagtagcggaagccatccacggtatagcggttaaggcaagtcctaggatccaccacgttgcccaagctcttggacatcttttggccacagactgtccagtgggaatggacacagatgcgctgtggcgggctcatgccggcccctaacaggaaggcaggccaatagatggcatggaatttgagaatgtccttacctatgatatgagaggtggccggccaccaagatttgaactcagcatttgggtagccaattacagtgaggtagttgaccagggcatccagccatacatagatggtctgcgaatcatccccgggcaccggaatgccccagtgcaagtggctacttctgcgagacacggacaggtcgggcagctcctcgtccagccactgaagaactacgtgatgaaatggttcgggggtgatcgcctgagggttgccccgcagccaccgctggagtggcttccggaactgggaaagcctgaaaatgtagttttcttccttggtccaggagataccggcctcctggaaaagctgctggaactgctcagagactcggtcgcacagctcggtcggggccaggcccgcggtagctgctgcctgctgaatcttcagcccgtgctcgtcggtaccagtggagaatcgcgtggcggccgtgctgggacctcggaggcgacggtggcggcatagggcgtccgccagtagtgccgagtacaggtgcccgatgtgcggcgccgcgttcacgtagaaaatgggtgtagtgaagtaggcgcgcacatcacaagcatcatcgccggcactgagggagcccgaactgtagtagcgtgggccgaagtcctccaggagagacagcctactagcccccgtgcgtcctagcaggcggaggacggacgttcgcagcatggtgcagaccggccgcaagcggaggaggcggcgttc

SEQ ID NO: 3745 - DNA, 374 bp, Homo sapiens
gctccgccagaccgccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttc

SEQ ID NO: 3746 - DNA, 253 bp, Homo sapiens
acacatccgcctgtccgtcgtccgtccgtcagtctgccctgcccgcctctggctgggctcagtccttccagtccttcttgatggtgagattccactcccaggacaggtggtcggtcttgtcgtcgtctgtgaagcgggacttgatgctgtagctgccccgggccagcatacccttgggtgcctcctccacgggggtcaggaactcgtactcctcggcccggggcccatagctgcctaccatgtagtcagtctt

SEQ ID NO: 3747 - DNA, 724 bp, Homo sapiens
cgctcagaatttagaacagcacctggcatatgggtctcactcttttgcccaggctggagtgcatgggcgcaatcttggctcactgcagcatcgacctcccagactgaatcgctcctcccacctcagcctcaggagtagctgggactacaggcgcatgtcaccatgccaggctaagttttgtgtttttggtagagacagggtttcaccatgttgctcaggctagtctcaaactcctgggctcaagcaatctgcccgccgcagcttcccgaagtgctgggattccatgtgtgagccatcgctctcagcctgataattttcttaaaattgccagtgctactgtaagagacatagttaagtttatattaaaaggaaaaccaaggtattgcttagttgtcataaagttgtgtgaagattaagtgaaatatgttagtggttttctcacagagtatacacacagagagttacactttacacagaaatctatatatcccacaagtaaactgattttaagggaatcattttctagtttcccaatttccatatgtatgatgtcttaaattttgtatgcctgagaaacaatgcaatcaaggcatcccgctggttcttctgtctcaactcctctgtttcaacagtctttcccttactttcgaaaaaaagcatatttttcattgatctcaaatattacaataacatatacatagaatataaaaatttggggatacca

SEQ ID NO: 3748 - DNA, 1407 bp, Homo sapiens
ggatgatatatgtgaaagttcttagtaggtacagaaattatactaaaaaagacaaacaaatccacatgctatgatgcagtgtggactatctttggtcacctacatgtcaaaggtggtcttaaactgctctggtttggtaaatgttggagtagactagaagtcagagagtacggaatccacccttatttgctctcaggctttggtttacaatgagctcaagtgtagggattgtgtcaaatgattcctggaatcctttacaatttgtaaaattctatgaattcgtgaagtctgcaaaatgtgaatccgaggtgtatgtattgtagagcaactattagaccatttatcacattatacatatatatataaaattattatttttttgagacggagtctcgctctttcgcccaggctggagtgcaatggtgtgatctccgctcactgcaacctccacctcctggcttcaagccattctcctgccttagcctcccgagtagctgggattacaggcgcctgccaccatgctgggctaatttttgtatttttaataaagatggggtttcaccatgttggtcaggctggtcttgaactcctgacctcaagcaatccacccacctcggcctcccaaagtgctgggattacaggcgtgagctaccatgctcggccctatcacattatattttacagaagccatcatcccatacctttgagtccagccccagaaagagcagtcccttgcataccatccagcatgaccttgggcatcctttccccactccccaccatagctgtttcggctagagttggaaacctgtccacggtaggccccttggagtctcctgctggacacttgggattagaatggagacagtcaagttaacagacagtaatgctggacctggacggtcactagcacgtgttggaagctgagggcaccagccagtgtaagccactgtggatggtgtaataggagagcaaaggaaggcaatctgggaatgggttggatggggagggagaaaaggtgggggaaagagagaaatgtaaaatgagggaagcagaggaagagataacatggcaatgaagaaagtaacatctttggtcattttctgttccaatcacccacagcaggcctgtcagttctctcttaccttctgttctcttttacctaagtagattttagtggcttttctattcttgatctccaaccatgccctaagacatatggtaacacagactgaggattctctgacggcagggctttgtctcattcctttttggaacaagcacaaagtagatgctcaatgaatttatattaaaatgacatgaaaatcatatgtttgtatctgaagtgtcactgatggcatttatatgaaaaaggttaattaaaatagataattatgtttcaacagg

SEQ ID NO: 3749 - DNA, 651 bp, Homo sapiens
tggagattgagttgtaacccaacccattgacttcatcacagctttcttccatgtagaataacgaatttcactttctagaattagaaggtagaaaaaacacataacgaaaggtagtttgctgagatgttcttagtaccatacttatgatcactcaacattcttgacaaattattgcacacattaaactgcagtagggctttagcaggactcagatttgaaagcacatggttgctgatgactgccagtgactggaagacatgcttgcttggaagttggagtgaaacaggacacagggaggctgggtgtagtggctcatgcctgtaatcccagcattttgggagggtgaggagggaggatggcttgacctcaggagtttgagaccagcttgagcaatgtggtaaaaccctgcctgtagtaccagctacctgggaggctgaagcaggaggatcatttgagcctgggagccagtaaatgagggctctactcttggttagttagttagtattaatctactagcaggctgttgaaacctctcaatacatcacattatttctctacaaaatggagattgggctacgtgattgctcaagttcattagtactttgctattattgccattattaagaaatgactaatatattcttccaatag

SEQ ID NO: 3750 - DNA, 820 bp, Homo sapiens
cccgggcagcctgcggggggcagcgaggcgcaaagaccatgccccaagtgccgagggaaagtcctgagatgcgcgacttgggacgctaggggccaagctccgacgcggggctgggtgcacctggacgcacctcacacgccgcgagctaagcagaaaagggaggcaggctgccccgacaccccactactcaccgctaggtttccgtctggcgccgatccggctgcgtcacgccggccgaacgacaccccgctgagtcgccgccgcagggaaggtaccttcggccccaacgggaaaagccaatttccagtaattcgcgcccgaccaccggggagagatggagtcttgcactgttgcctaggctggagtacagtagtgcattcttggctcactgcaacctccacctcccaggttcaagagattctcctgcctcagcctcccgagtagctgggattacaggcgcctgccaccacgcccagctaattttttgtatttttagtagagacagggtttcaccatgttggccaggctggtctcgaactcctgacctcatgattcacccacctcagcctcccagagtgttgggattacaggcgtgagccaccgtgcccggccaagatgaacattttttaaaaccaatttttcaggtataacataagatttctagccaaaggaaaattttgttgtattaattctaacatttgctgtgatttggtattatgtggtatttcttttgtgctctaaccaaaatcatgctagatttagatgccaataaatgcacaatttgaattgaaaacagtctttttacctcccaaataattta

SEQ ID NO: 3751 - DNA, 2035 bp, Homo sapiens
tctcaggctgctgtgcggctggttgcagagggccattctagaagagtggttcgctaatccaggagccaaatgggaaaggtctgaaaggcagggctcagggtgattcatccattcatccatccattcattcgcgcattaaagaaatatatatatcatatatgcattgggggggctatctgtgtaccaggcagggtggtaggctctagagatacaatcttgagtaagataaacatggttcccaccctcctagagctcacagttgagtagaagaggcagataagtagatgggcaattacaatacactggtggatgatgagcaggagctgtggagtcaagagcagggatggaaaagacaatagagggagcagtagttcaaaaccagaagctggttcaaagatctctaggagttgctacatgggcatggggccatggtttccagccaggggcacttttgtcctccagggcacgtttggcaatgtctggagatatttttgacttcacaactagtgggggcagggggtggtggttatgagagggactgaggcaccgttagaaaggttttctccccagtaaaaaggggcacaaaaggagacacatcctcatcttctgcctcttaatattatggaacaatgtaatgactggggctgtggctgccatcttgtgatcctgaggcgatcagcctgaggaagaaagccagcacacagaggacggcagaggaagtggggaggacctggttcttggtgaagctattgaggaagaaccaaccctgaagtcaccctaccaccagaggagacagcttgtgactcagggccatacattccttgtagcgtaagccatctttggttgggtcctgtgttacccacagctccaagcctccttgccggcgaatttcattctgctcctctgaaaccggttttcactgccatctgcaataaccacggctgccgtgcacaggcaccacatctaagacatcatacgtttattatttattatagcaattttcccacagatggcagtaaagtgttttgttctaataaaatcagtgtgttacagtagttttctgatagaagtaaattaccttgaggaaggggcacctttttctaattcacacaagggcacaatctagccttggtggttaaatctgtgggcgctcacccttcacgactcagctgtggctgacagcacggacgttctctgcttcttgatcaaccttctgtctgtacccagcttctgtgataccacagtcgcctggtggtcctcctctccctgtggcttggcgtccctctctgttcgtctgtgatgttccccaggtctctttccctggcgctgttctcgtattgtatggctcctaggcaccctcacctgccccactttctctgccttctacaggtgaatgaacccggaatccctcactgtagcccagtttctcccctccgctgcaggcgccttagtgtactgcttacgcactggcactatgaactcaaaccctcccactcaaagtctccatcctccaccccattataaaactcctgctctatttttccctccacccatctagtccctggagctgcacttgtgggaggcatccttgaggcctatcgcctcttactcctcatatccaacacatcaccaaatcccacaaattctgcttcttgaatctgagtcaagctacttcttttcccattaccaccatctccacttatgatcaggcccctagcaggccaacgtcattgaaacccaaatgctactgcctttggccattcctctctctcagatctgcgcctccagggctgaaatcacatctcaattcttaatgagatgtctgcttccttcactgaagggactttactaagtgtttcattgcaagttttctttaaatagccaggctctcagagccatttcaaatagggttttatgttcctaaattcagttagttctcaacatttgagaccaattcttgcagcaaggtggagaataactctcatctgtgaaagaaaagcggttcaataaagcttgataagccttttgtatccgg

SEQ ID NO: 3752 - DNA, 216 bp, Homo sapiens
aagactatactttcagggatcatttctatagtgtgttactagagaagtttctctgaacgtgtagagcaccgaaaaccacgaggaagagaggtagcgttttctcctgaacgtgaagccggctttctggcgttgcttggctgcaactgccgtcagccattgatgatcgttcttctctccgtattggggagtgagagggagagaacgcggtctgagtgg

SEQ ID NO: 3753 - DNA, 549 bp, Homo sapiens
gagagttgggagtaaacagccccgaatggagtgcccaggcgtgttcgccgcggaggcgccgttatcccgggcccgccggccctgagctcccggcggcgcagattcatacttcttggattgaatccctaggggagattttaggaaagcaggcgacctgcctctgaagagtgtggcctctggagccaggctgaccacctgagttctcagcccagctgttctacttgctggtgttgtggccccagattggctcacagtggttgattgatcaaccccattggacgttggttctgtggtacaaatggagtacaggactcagtcgtcacggcctgagtgagagaagccttatttccaagatggagaagaagcggagaaagaaatgaaagcctctcttcaggctgaaccacaaaaggccatgggatttaacttttatttatgttgggcaagactgtaagatggctgattagtaatgttgcagcttttagctgaaacaaaaattcacttttaatcaagaagaaaaaagtgtgatttgaatatatgcaattttatgat

SEQ ID NO: 3754 - DNA, 2311 bp, Homo sapiens
atccgcagcaggggcaggaagcgctcggtggtgaagtagcgcagggtcggcttcggggcgcgcaaagcggtgaggaagacctgcggcggcgggaggagagctgtggccaccgctgcgcgccggaggacgcaccgcccccactcctggagtccagcccggcgctcacctccgccacctcctcagggttctgcgccgcctcgcgaaagacttgcttgctgtgggcgaggtattggtagaagcggtggaaggtgtggatgtccgtgcggtccagcacctcctctgggctgcccaacaccttctccatgaaggcggtgtgcactgggccgcactcgatcaggctcaagctgctggccggagagcaacgagtgggagggggcggacgccagccaggccccagtcccagccccaaccccagtcccagccccaaccacgtcccggcccccgaccgcgagcagcaccgctgcgctgggaagtgaggcggaaagggcgctggggataaccagaacatttgaaacgcgggttcctgccggagcagccctcccaaatccatctgaggctacaagggagccctggtgtcaggattcgaatctagcggggtccctggccgctgtgtgaccttgggccagtcacctaacctctctgggctggagcttccccataacaataccaacacttcagcagctaggtcagcaggtggcacaatgcgtgccatgcgcccagcccaagtgcctggcacacagctaatgtgagccgggcagagagggccagggagatcgccccagagcggctcccgcaggacagggtgctcggcgtctctaggtcagagttaagagggttcggggaacgggggtgttgactcactggaccccaaagggcagcagcagaaccgccagactctcgcataagccttcgagcgcgaacttgctggcgcaataaacgtcattgaaaggcagcccttaggtggggagacgaggttcctgaggcgcagcggccagggggtcatccccgggcagacggtgcccctccaagctgacggcaccccactccaccccccccgcggaacctgccttcaaggctcagctccgcacacaaagaatctggagctgccgaggccactccctaccactcacccatcaatcctcccacgctcccggtcaccaacacgcgtcccgaaccgcgcctcttcatgtctggcaggaaggcctgcagcatccgcacagtccctactacattcacgtccagcacagaggccacggcgtcctcccccagcgcctccagcggccccagcaggcccaggcctgcgttacacactgcggagacaagaggcccgaccagcccgcctcagcatcaccctcagcacggcctgtcccctcgtgctccctgggcctgggaacatgttggtttcaacgcagggcggagaaggctcctaggagcccatatgcttccaggaggctcacccagcacgtccacgcggccctcagtcacgcgttcccgggcagcggccacggattttgagtcccttacgtccagctgcaacgtctccagggatcccggagggcatgccagggcccgggccgcctcccacagccggccctgtgttttcaggtccctcaacgtggcatacactggaggttttgggagaggaggaagatctgacttcccttctggcctccaagggctcctcccttctctccctccctgtccctgcctatctatacctttgaagctctgggatggatctgaagccagacgtacggccaagtgcaggccgatgcccgaggaacagccggtgatgagcaccacggtgcgggccatggtgagactgtggggagaggctggggctctgggcttgatatcacctgcttcgccccgccccgcctgcgggcccccaccccttgttgtgtctcccacgcaatctcaaggataagccttcctgcgggtccctggcccgctctccccaccctgttctgagccaaaacagacatgagcccactgcttggaacaacaaactgtcctggttgctggtcagagggaggggaggctttacaagcaggtgtgggttcccacgtgggcacagagtggccccctgggcagattcccctgggtatgcctctgtgccacaggagcgattatagtgaccgcagtttgctgcagaggctgtgaaagtaaaggcgttgggaggtgggagatgattgtatatgtgctggtttcgtccagggttcctagctcataactcacatgaccatggttacagtcttacgttgtcatgttggggtgcctcaggcctcaaaaaacagcctttcgtctctct

SEQ ID NO: 3755 - DNA, 4968 bp, Homo sapiens
ggaacagcctagaagcagggcctggaactgcaggatacactcccctcctgctacctaggcaggcgtgagggtgtgacggccgcgcattcgccagacgagagcgatggctgagaacgccgcaccaggtctgatctcagagctgaagctggctgtgccctggggccacatcgcagccaaagcctggggctccctgcagggccctccagttctctgcctgcacggctggctggacaatgccagctccttcgacagactcatccctcttctcccgcaagacttttattacgttgccatggatttcggaggtcatgggctctcgtcccattacagcccaggtgtcccatattacctccagacttttgtgagtgagatccgaagagttgtggcagccttgaaatggaatcgattctccattctgggccacagcttcggtggcgtcgtgggcggaatgtttttctgtaccttccccgagatggtggataaacttatcttgctggacacgccgctctttctcctggaatcagatgaaatggagaacttgctgacctacaagcggagagccatagagcacgtgctgcaggtagaggcctcccaggagccctcgcacgtgttcagcctgaagcagctgctgcagaggtgggtgcccggtgtggacggggagctggtggggtccaggggaggacatcccgtgagacgtggagaagcttctttctccctctcacccaacaagcctgtttctccctggggtcacgctgagcaccaggcttcccagggtcttcagggacgttctctctttccctctgcccctgctccagccatgccccttacttccaataccctccccacacctctcacgcacccgcctctctcccaagcacatgctgcttccacgccttctctcccctctgggactccagcctgggctcccttacctggaattctcccctgtgcttgctcactggcttccccactccttggggcctcagctgggaaccctgccctgacacccccaggcaagctgtccctgccctgcaggtaaccacactgtccaataagagcctattgattcctctgtttcccgaggcatgtgaactccgcaacccccactatggctgatttggtcatctttgtgcctcctgcatctggcagtgggcctggtaggtcagagctccacacatatttgttgtctgaaggaggagaagccccccactgccccaccacacgcacgcgcacacacacccacacacacacaccctgccgctgtaaacatgcaatcgaaacacgggacacaggccaggcgcagtggctcacacctgtaatcccagcacattgggaagctgaggtgggaagatagcttgagcccaggagttagagaccagcctgagcgagatagcgagaccctgtatttaaaaaaaaaaaaaaaaaaaaattagctggtcgtggtggcacacgcctgtggtcccagctactcagcagccttagttgggaggagtgcttagccccaggaggtcgaggctgcagacagccatgatcatgccactgcactccagtttgggtgacagtgagaccctgtttcaaaaggaaaacaagggccgggcacggtggctcacgcctgtaatcccagctactcaggaggctgaggcaggagaatcgcttgaatgggaggcagaggttgccgtgagccgagagagcaccactgcactgcagcctgggcgacagagcgagactccatctcaagaaaaaaaaaaaaaaagaaattacataggtgacataatacataatgattgtcaatttaaccgtttgtaagtgtgcacttcagtggcattaaatacagtcgatggaggtgaggagaggagggagacatcccaggcactggctgctgcacagggaaaagctcgaagtcagctcggtgcatctgttgagagggggattcctgatagaggctgtgaagattaaagaggggaggggcaggatgacaaaggttctcaaaaaacagcgtcccatctggaggcctgtgtcactggagacttgtattaatagaaacttggccatctctgccagtgaggggctgtaggaccttgggcaaggtgcttaccctctctgagccttggttgtctcacgtgcaaaaagaaagtgctttcattcgctcagctggtttatgagcagcttggctaggggagccaagccctgggcctgcctttgaagggttgttgtcgagactaggtgaggtcatgtgtgttgagtggcctcgcacagtgctgtcgcttcaggtgctcatggcctgtgctattttgtgattgttaaaatatggtagaacattggacacatgtgagacactgtcattagaggtggggatgctctaactgcagggagaccgctgagagctgctgcccaggcccaggccaagagatgaggcttggaccagggcgtcagccaatggtctgggaatgttaacgtgtttgtctttgatccgtgtgggatttgttcttgagcatggtgtcagatagtgattcattttcttttttttttttcatgttttaaaagttctatttttctttattattattattattattattatattattattattattgatacagagtctcgctcttgttgcaaaggctggagtgcaatggcaccatctcagctcactgcaacgttcgcctcccaggttcgagtgattctcctgtctcagcccccaagtagctgggattacaggcacccaccaccacacctggctaatttttgtgtttttagtggagatggggtttcaccatgttgtccaggctggtctcgaactcctgacctcaggtgatctgcctgcctcgacctcccaaagtgctgggattacaggcatgagccacagtgttcggtctatttgaattgtagagacagggtctccctctgtcacccagactggagtgccatggctcaatcatggctcacgcagcctcaacctcctgggctgaagtgatcttcccacctcagcctcccgagtagctaggactacaggtgtgcgctatcacacccagctaagttttttacttttgtagagacagggtcgtgccatgttgcccaggctggtcttgaatgcctgggctcaagctatcctcccgcctgtttcccaaagtactgggattataggtgtgagccactgcagccagccattgtaattgtttttctagatgaacagctagttattccaataccagctgttgggtggtcctccctacccactaaggctcactcactggtggtttgtcccttgtgtgtgctgaccttcgtggtgggagtttattgccagatcctagtcaatctgacttttggagatgcccctttccctgtccttagggaccatgtcttatgtgacctgatctgtagtgggatctgtgatcacccataatgctggaaggaggaggcttcccagggatggaaagacttcgttaggacataaactaaattgcagaagatacacattccaagatggggctggcccaaaattctttttttttatttttattttttaaatttctggccaggtgcagtggctcacgcctgtaatcccagcactttaggaggccgaggcaggcagatcacttgaggccaggagttaaagaccagcctggccaacatggtgaaaccctgtctctaccaaaaaatacaaaaattagccgggagtggtgacacacacctgtagtcccagccacttgggaggctgaggcaggagaatcgcttgaacccgggaggcggaggttgcggtaagctgagatcacgccattgcactccagcctgggcaacaagagcaaaaaaaaaaaaaaaaaaaggttctataaattcttctcatatttttatttaacatccacaatgtgatttaagatgtaatcaacataaagcttgattgcattattttgcatgctgttttccaaatccagcttcgtgtcacacctacagcacatctcactcaagctggccacatccccgccatccagacgtaaaacagtcacaagacagggcaggcagggccgcggaggaggctggctggggccatcacggagtgcccatcctgcactgtggtcccagcaagtttctttctcctggcaagaagcctgtcccaggctggcaggggacagcgtgaggtgcagcctatggactgggaaaggggtgtggaagggccacacctaagtcctaaaatccaggcccaaaagtggcccaactcacttctctgactttaatcacacagccatacctggtggcaaaggagtattggaaatggagtcaggctgggtagccacgagcccaggaagaggggagaacagacttggagagggcaggagtctctggccaccaggggctaaagagccttcgatgaggcagtgatgtggggtcctgggctcagacccagggtgggtggctaaggtgccctcgccagggcttagccaccccaacagagatgggtttcgtgcccacgagagtgcctgtgccttgtgacgagaattcaccatgtttttgtctctgcaggcagagaacagcattgacttcgtcagcagggagctgtgtgcgcattccatcaggaagctgcaggcccatgtcctgttgatcaaagcagtccacggatattttgatccaagagagaattactctgacaaggagtccctgtcgttcatgatagacacaatgaaatccaccctcaaagaggactacttcggatacaatcacagcaaccctggcctcggccctgccctgtccctgccatgcaacttcacaactcagctggcctagacccctgggaggcctccaagtccctaagcggttccagtttgtggaagtcccaggcaatcactgtgtccacatgagcgaaccccagcacgtggccagtatcatcagctccttcttacagtgcacacacacgctcccagcccagcctaggatggtagtcaggggaaggagcgagattccaacttcaac

SEQ ID NO: 3756 - DNA, 4359 bp, Homo sapiens
ccgagtgggtggggccggatgtgcaggccccgcccggcgccaggttccgggctcgggtcaccgcagcacgtccaggccgccgcgggtgccgctggggccgccggattccgagagcggcgccgggctctttcgggcccacgacggccccgaccgtcctgaggaaaccgctgccgccgaggaaaggccgcaaaaactgttccgcccggaagggagaagagctgcggggcgaagccagggctcgcagggggcagcggcaggctgctcgcgttcggcctcgtccactcggcccgcggagagcgcggggggcgctgggaaccgcagtcacgcatgcgccgcctgccaccgagcgccgcggggcccgcgcgaggcgtcctggcgggcgaggggctgggggagggggggggggccgtgcggtggactctcgcgagagcgcgcggcgcggtgactcgtcgctgagggactttaagattgtagaggggcgcggagggtcctccccggggcggagggacacagagggattctagggaacctgccgtcgcgagtcccgcttcaggcggagaatctaggcggcggcggggcctccctgaggcggaggagtcggcaccggggcctggctgccggggaaggagagcacgggagcggggactcctgtgtctggcggagggacacggcgttccggtggagggatctgttccttgtacctggtccagggttgcggtcggggatggagcggttaccccgaccctgcgggaccttcttcctctggcggaggtgcacggcgcggcgtggtgtttttctggcggaagtatctgtgcgtggccccaggcccttcccggcgcggtctcatctggggccacttgttggccctcgcgttggggaggttcatgtggtgcatcctgatgagaaggggggtcacaggggtctcggggccagggttcagccagccaggccccagcttgctctcttctggtgctgcccctgtccctgaattcatagacccggctttccctctcttgagcacctactatgtgccaggctgcgctttgcgcatgtagcagaggcaacagtgtcacctgggaagctggtttcccccaaaggaactcttgtctgtccgttgttgcagagccagcgcatgagaccaagtgtgagtatcaggcagtgcagccttcattcagtggccatggaattggagaagtgggagggtagctcgcaaatcaagctctcagctcttggaaactgagaagttacaggtaatagggagtgttgacgaaaagtaaaaccgtgcaaaatatttgaagagatttattgtgagccaaatacgagtaaccacagcctgtgatacagccctctcgaggccctgagaacatgtgcccaaggtggtcggggtgcagcttggttttatgttttaggttggcatgagacatcagtcaaatacattaaatacattggtttggtccaggaaggcgggacaacgcaaaggggtgggggtgggggcttccaggctataggtaaatttaaatattttctagttgacaattggttgagtttgtctgaagacctgggattgatagaaaggaagtgttcaggttaagataaaagatagtggagactaaggttcttttgaagtcttatggtggctgctcttagagataatagatgacaaatgtttcctattcagatcttcaaaaggtgttagacttttagttaatccgtttaggattgggagggcctggaagaaaaacatctagctatgttaatagatgttctttacagatgcacattttaccccacaaaggatagcttttgggggaaaatgctgtcctttatggaagaaattgcaaaatagggcaaggaaacatgttttggggtaaaatattttgactttctttttgtcacgtaatgttatgccagagtcagaatggaaagtaagtcatcatatataggattaaataaaacccatctgatgagaatttatggtttgtaggtcatgactccccagatcccttagataggaatttgggcaggattaaaaaaatcaagagtttaggctggtcgtggtggctcacgcctataatcccagcattttgggaggccaaggcaggtggatcgcttgaggtcagaagtttaagaccagcctggccaacatggcgaaaccccgtctctactaaaaatacaaaaattagctgggcatggtggcacacgcctgtgattctagctgattgggaggctgaggcatgagactcaacttgaacccgggaggcggaggttgcaatgagctgagattgtgccactgcactccagcttggttgacaaagtgagactctgtgtcaaaaacaaaacaaaacagaaaaaaaaaacaaaagaatcagagcttagtcgtcaggtgtccttaatgaaggggctgggcattaagagcaaggcgaggaggcagaaggaaagcttgagcccaggaattggagaccagcttgggcaacatggtaagaccctgtctctaaaaaaaataaaaattaagaacaagaggaggaatattcatgttttttcttgggaagggaggtagattttcctggaatcaaggagctgcccctttttttgtcctttttttggtctcttcgggtcatcacggtgattgtcaactgtcatggcaaccagtgggaatgtcatttagtactgaagttggattagaatgaagctagaggttcttcagaggtcgagtaagctaagaaggaacctatgaccacagacaacctgttttctaaaaataagcagagttaaatctgagtaggaatttagctatgtcatggaggcattgcattgggtaacaaaagccaggtaggcgtccagctaagtcccctaggccctgcaacgggtaacagcagtactgactctatgttagagaaaagcttgcttgcttgagtataattattgttttgcctgagtttgtaaactattcactaaaaacagccacagaaaaaaacaggaccttcttcaacagataaaacacacagacccgcagctttgggaacaggctgatggcccctgcacagtctagtcacaaggcattgaccaagaaagtaatgactaactgcccatctgagactgcgcatgattcacaagaatgtttctttgttttgttttttgagacagtcttggtctgtctcccaggctggagtgcagtgatgttggttcgctgtagcctctgcctcctgagtagctgggactacaggcgtgtgccaccgcacctggctaatttttgtatttttagtagagatgatgtttgactatgttggccaggatggtctcgaactcctgacctcaagtgatccacctgcctcggcctcccaaattgctggggttacaagtatgagccaccgctcctggcccacaagaatgttttgatcattatttctcctaattttccttaaaatccctggatctagaggcacaactgagaaaggtggtctttgaatgctagtgcactgccttttgcaggttgctggtttctcgaataaagctaactttgctttcaccaaagcttgtcttttgagtttttggctttcaggcgacgagtggcctggacaccagttcggctacatgtatgtcagtgggcaaaacaaaaatccttattctgggaggtagatagcttattagaaaacacaacctaatcacttgtttcccaaatgttaaaaattgagccaattttagccccagaagcttagggtaccatgtacataacaggcattacctgagggtggggcagagagaatcagtggggtacctcgtatatgccaggggttgtatcagcatccttacacagctcatttttctttttaaataatacttattgaggacctatttaatgccagatatggtggtaggtagggagcaaaagcaggattcccctcccattattgagttttcagtctggtgggagaggcaggaattaaataagtaatccacaaactcaagtacaattctaagggagatgggtgccaccaagaagagacatggtgctgagaacctatgtctgtcagagggatttgatctatttgggaggtctggaaaggtttttttgaagaagcagtgctaggggtgagatccaaaggagaagagctaattaggcaaagcctagtcctcacaaaaatcctataaaccagatatgattaccttcattttagagtttagggcattgagacttgagcaaggtgatgtcactgcccaaggttacatcagattaaatggcaacccaggattcagattcaaataagagtagggttctttatattctccttgggctatttggtggttttaggagaggcaagtatcacaaacagcttggggacatgagggagcaggaatcac

SEQ ID NO: 3757 - DNA, 10054 bp, Homo sapiens
gctagttctgcccatgcagcagagctccacaaaagtgcgggaatgtctgacagggaagaatcagagaaaccttcaccagcagcccgacattcacctggacggacagtgcacttttcttacgtctgggcagggaaggcagggcgcaccatctaccgcaggctaggatgatcaccaaccgccccaccgcaccctgcgccagccctacggcgcccgcgggctgcaagtagcggcgacccaggagcatgcgcgctgccgcccctggcctgccaggacccagagggagcggagcacgcgcctttgggaatcttcggtgcgccaagtctgttcgccgccggggtctatcacccccgcccctcgcctctgcccgtgagcgtgtgagttgtagcgtaccctggggtctgttctggaggaggcctgagagcggggttgcctggggcgtgggtctctcatccctctcgtcctggtgaagaagaagagtatacccagcggcagctggcttggctttttcagaggaaacagagactctcagacatgaatactgtgacactgaccaccaggccaacttaacatcagcagatatcctgtctcagatgaagagaatggcctgtccagaagacagccaaatacatccttcaaacagacttcactgcaggagacagagtggattcatcctgtattctccatgtagacttccatcttcatgagtactccaagaagatggttcagttgactattgcaaaggtaaaaatccaagagatacagatacagaataggacagagagacatatttttaagctattgattacaattatggtatgcctatagattgcagaaccgaggagaaagggaacattatgatttaccatcaagaaaaacttagaattggtgctgagtagttcattctaagaattaccatttatctgtatttgcccccattttcattgttactaggccaaaagtcatttcataattaataagttggatgtcaaaatcaacttgtgttattataaaattagcaatctacattatgtgtttctttacatttttataggagtatttataaatatacctaagaaaactgacaatgtggagtacaaatgttgcattttcaaaactgggaatctgtttattgaggctctatttttagttatgtatgataatagactgcatttcaggtttcaaaccttgtaaaaataatttccttatgatatgtttactcattttgcaaataattattgtgtcatatagcaagagattgtacttccattcagctggttaaagtacaaaatcattgatatggtttggctgtgtccccacccaaatctcaacttgaattgtaccttccagaattcccacaggacccagggggaggtaattgaatcaagggggctggtctttcccatgctattcttgtgatagtgaataagtctcacgagatctgatggttttatcaggggtttctgcttttgctgcttcttcatttttctcttgctgctgccgtgtaagaaatgcctttcacctcctgccatgattctgaggcctccccagccaggtggaactataagtccaattaaacctctttttgttcccagtctcaggtatgtctttatcagcagcatgaaaatggactaatagtaccagtagagtggggcattgctgaaaagatacccgaaaatgtggaagcaactttggaactgggtgttgaaataatctggagggctcagaagaagataggaaaatgtaggaaagtttggaacctcctagagactgtgaatggcattgacaaaaatactgatagtgatatgaacaataaggtccaggctgaggtggtctcagatggagatgaagaccttgttgggaactgaagtaaaggtgacccttgttatgttttagcaaggagactggcagcatttcacccttgccctagagatttgtggaacttagagcttgagagagatgacttagggtatctggtggaataaatttctaagcagcaaagcattcaaaaggtgacttgggtgctgttaaaaacattctgttttaaaagggaaacaagagcataaatgtggaaaatctgcagcctgatgatgcagtagaaaagaaaaacccattttttttaaggagaaattcaagctggctgcagaaatttgcataagcagcaaggagcctaatgttaatccccaagaccatggggaaaatgtctccaggtcatgtcagagaccttcatggcagcccctcccatcacaggcccagaggcccaggaggaaaaagtggttttgtgggctgggcccagggtctctgtgctgtgtgcagcctagggacttggtgccctgtgtcccagctgctccagccatggctgaaaggagccaacatagagcttgggctgtggcttcagagggtagaggccccaagcattggcagcttccatgtgatgttgagcctgtgggtgcagagatgtcaagaattgagatttgggaacctctgcctagatttcagaatatatatggaaacacctggatgtccaggcaaaagtttgctgcaggggcagagccctcatggggaacctctcctagggcagtgtggaagggaaatgtggggcagagcccccacacagagtccctgttggggcactgcctagtggagctgtgagaagaaggccacagtcccagaacggtagaccccagaatggtagaccccagaatggtagatcaaccaccaacttgcatcttgtgcctggaaaagctacagacactcaacatcagcctgagaaagcagccaggagggaggctgtactctgcaaagccacaggggcggagctgcacaagaccatgggaacctatctcttgcatcagcatgacctgaatgtgagacatggagtcaaaggagatcattatggagctttaaaatttgactgccccactggatttcagacttgcatggaccctgtaacccctttgttttggccaatttctctcatttggaacagctgtatttacccaatacctgtaccccccattgtatctaggaggtaactagcttgcttttacaggcttgtaagtggaagggacttgccttgtctcagatgagactttggactgtggacttttgggttaatgctgaaatgagttaagactttggggaactgttgggaaggaatgattggttttgaaatgtgaggattatgaaatttggaggagcccagggaggaatgatatggtttggctgtgtccccacccaaatctcaacttgaattgtatctcccagaattcccacatgttgtgggagggacgcagtgggaggtaattgaatcatggaggccagtcttttctgtgctattctcgtgataataagtcccacaagatctggtgggtttatgaagagtttctgcttttgcttcttcctcattttgctcttgatgccaccacgtaagaagtaccttttgcctcccacctgattttgaggcctccccagccatgtggaactgtaagtccaattaaaccctttttgtttccagtctcagatatgtctttatcagcagcatggaaacgaactaatacaatcatagtttttaaaaaccaatctaaatgtaactattgaacatgattagctgtttcatccctagtagagtgacagaaggaaacatccatagacaggagtaataagaaaccagctaaacttctaaaccatttttaaaggatgcgtgtgagctggcataacctacctactctttcctatgggcctctactgagagcatggaggtaatacatctaatacactgaagaccagggcaagagagctggaagaaatccctcttaagcactccaggccttcactgagtatgaggtgctggtctccaaaggcagagggcaaggcaaggcagagagggatctcctggggcacagacaactgacaaaagaaacacttggattgttgtataagaggagtgagctttgtaaataccacgttagctggcctgctgtggaacagaatgcctgtgaatgacagtagtcaggtagtggatgaacactgatctgagagcctgtaaaagaaactctttggaatgataatgtcatctagacctttgatacgcaaagtgtgattcctggacagatgtattggctttacctggcagcttgttggaaatgtaaaacctcaggcctcaccccagacctactgaattatttatattaattaaaattaaataatttttatttcaacaaaatccctgggtaatttgtatgtacattaaattttgagatgcatgatcttttaaggttcattctaatccttaaaattctgttttaataatgtgtacaatgaagtgctgcatggcaaactacacagaaactaaaggcatgttccaaaaaggaaaagttccatgtggctaggggaataaaagcttcatcagggaaccaggagttgggctggttcttaaaacctggagaaagaagatggttacatcaagagataaatagagtgaagcagaactagtggtgcggaccagctcgccagcaacagaagggtttgtagtcggcctggcagtggacagggaggttggctagaactattaccttaggtccgtgataatatccctgaatccaacttttcagaaagaaataggtaacatatttttcaccaggaagcttcacccagacactgaacagaatggtctcagtgcactaatggaggctcagttaaagggttgtggtagcacaaggaagagacattctgacttggaaatttggagaaggcttcacaaatgaaggggcatttgaaatgagctttgaaggtgcaagagtattccaagttgagaagacaacctgagtggtgttgggtgaacagtcattctacctggctgtagtgtagtatagtgtagtgtagtgtaggaaacatcagaggagtggagtgggatatgagcctggagagagctggcggccatggatcattgaaagccttgaatgtctgatggggaggttgactttattttgtaggcaatggaaagccaccagtggttttagttgagcagcaatgaaattaagcctgtgctttgcaaagattaatctagcagcaacagattggaagcaacaccaccattcctggtatcagtccaggtaaaatatattacagctctttactggagcaataacagtaatattagaaggagaaataaaaaagaaaaatattgcacaggcagaatggggaggtcccagtgatggagctgatcttggttcattgaggcaggggtggcattaatcatgtaaaacacaggaggaggaactgggttaggagtaatggtagagttcagtttaggtaattgcaaatacacactattccctgactagctcccaagactttttcttccctctcttcttagaacttcattagaagaggtgatgttatttcttagatgagagtatcttacttaccattgactaatacatgttctctgatgaactttgctattcaacatacatgcaaaggggttataaaaacaagtcaactctagtgctgatgagggtgatcatcatcactgatcatggtgtcagttgattatagtgtcaatttataacttaatttatgtaaaatagagcaatgcaaaagacatagcaatcttcacttcaaatgaagagtcttgaatgccacttttctaaagagaaggctcatggaggcacctcctcactattgaaaaatccattatacctgtgataaaactgattgtgttcagttgtattagatttgtatgcaaataaaaagttgggtaattagctatacattgtcctaaacgtataaaataagaaaaatacatagatgtatggtttcctaggacatctaccagtttagaatgcgaggctaatgtgggagctgccacagcatcctgattaaggctatggaaagaagttgcagactgatgatgtcttagaagtaatgacattttttaaagataatatttctttggtgagataaacagattatattttacagtaaacacattttatatttcagttaataagacattgtatattaaataatcgcatttaatgctttacttttttcctgtgttaaaattaatcactcatggccttggccatatgactttgccattcctcccactgtttatctgacttgtttatattttattgagcttgctcatatgacttacaatagcctgtgacagaagtgacaggagaccccatcctgaccaagaccttaagaggcatcctagtttcctctcactttcacgagcctctgcggggttcatcatgagaacatatccctagaaaccactggacaaggagaacaagaggtatatggaataggtctgatccacccttaccacctgaagtagagctgcccagctggcttgcagactcacaaacatgaaaatcaatgtttactgcagcaattcatgaaactttgaggctgttataaaaagtaaaggacctaatacaaatggaaagaaacatggttagtaagcaaagctagttatgagcagctgtcatgttctaacagttggaatttgaatcagagcaactattggtatttgaatcagagaggggccagaccagtttgggtgaaactcagttcatcttttaaactgacaataaagggaatatattttcatagtaattttatcattatgtggcaaactttgttctgtgagctattaaaatattcatcttggccaggtgcagtggcttacgcctgtaatctcaacactttgggaggccaaggcaggaggattgcttgagggcaggagttcgagaccagcctggacaacataggaaaaccctgtctctacagaaaaaaaaatagctagacatggtggtgcacacctgtagtcctagctacttaggtgcacacctgtagccttgcttgagcttgggaggtcgaggctgcagtgagccatgatcatgccactgcattccagcctgggcaacagagcaagactagctccaaaaaaaaaatcatctttattttaatattcaaatttacattttgagtatggaatgtaagcatcaagaattaatctttaaatccagatgaaactttcccaaggtctcttgtcatgcatcttggactgaataacaggcatccctgccttcacatcttcatgggaaggcaacaaaacctgaggaatacaacctaggatctcaaaagcttttttaggaataatgtcatatataataaataatagcaagaatgttacagcatctatagctctttaaactacctcccaagggaaagacaatgagggcttagttcctgtgtcttttaaactttaactttacgtgtatttttttggacatgtgctgtccagtatggtagctacaagccacatgtgaggtgaacacacagctagtcctaattaagatgtgctgtaaatgtaatagacacaaaatattttgaaaatttagtatgagaaaaatattaacaatttttatattgattccttgatagtattttggatttagttgctttctgaaaactctcctgtgttacccagtttgagtgtaccataccatccatctcttgcagggaccttgactgatacaacattaaaatgaagtgtaattttaaaaaattttatttacatatttcttattaagaattggatgaattgaaacttctttattttctttctctttcttgtcacacagaaagcctgattaagtagcattattcttttgtctacagaagtaaccacttctggccaggcatggtggctcactcctgtaatcccagcactttgggagcccgaggcaataggatcacctgagattgggagttggagaccagcctggccaacatggtgaaaccctgtctttactaaaaatacaaaaattagccgggtgtggtggtgggcacctgcaatcccagctactcgggaggctgaggcaggagaattgcttgaacccaggaggcggaggttgcagtgagccgagatagcaccactgcactccagcctgggcaatggagtgagactctctctcaaaaaaaaaaaaaaaaaaaaaaaaaagtaatgacttctgctgatcttttttctcccctataggttcatagaaaaaaaactcccaccttataaaggaatctttaaaaggttcctcataaaggaacagggttagcagaaccaagttttgagtcctgggtgaaaatccaggggagaatggtaatcagtgataaccaatggccaatccaatattaaaattagttaacagtgaccaatcttatttcacctaccccacccagagtggcccaaagcagattgctggatctgcctctaaaccaaccttcctgccaaaataattggggttaggttgtgtctgctgattgtctccataatttgagattttaacaagttgagtttggctcccaaataccttaaaggattttttttttggcatctctggggagggggagattggacgtaggcaaccaaacaggaatggaataagaaaagatttgtgttctctgaaggagacttgtgaagtctaattccaacttgctgagggaaagtgtttagaaaagaaaaagcaataggcttcaaccagaagacatgagttggagtatctgctctgccatgtagtagtttgtgtgatcctcatttgtaaaatggaaatactatttacacccttatgggttgttgtgagggtcagaatagattgtgtgcatgacagtgctttgtatacgcagacagaaggaaaaaagcggctgttattggctcaacttatttgacctttattttcatcatcatcggccactatttgatgtcaatctactatgctgtgagcaaacattaaaattaggaagccaggggtatgggaaccactgattagcatcatatgccagatgtgcttccatccaaagcacatgaacagaatgatattaaattacaagcctatcaggaacagaccagctttctgcctccctttctatgaataccaagtcccatgaaccttgtattcatgtggagttttaagtgcatgcttggaagttatgaggagacagcctggtatgttcgggaaagaaaataaaggttaggtacatggtaggctttggctcagccatttgggcaaatgacttaacctctctgaacctcagtttctgtttctatgaagtgggaattgtaatacctaccttcttcagattgttgtgaggattaaatgagaagatgaatgtaatacccttgagcacacagcgtggtacaccacaaatgctcaaccaacagcagcgatgacagtataggcaactaccacaagaaagaatttgaacatgtcccaattcgaattttgattcctaatcaagatctagtgaatttaacctaagtagcagaaaagaagattaagagttcctttccacagctttattaagtttttatattcacctggatgttgtcaaaagtgacttgatcattcaagagataggggacatttggcttccggtttgtgtgagagcttttctttccccatcagctcaacagtcagtccccagatctagagatggagagcttgggacaaggtcagaatgaaacatcaccagtcaatcctgctcaacaggtaactcttgcagcaatccttaaggaaaggggtgcagggtctcttcatgtttccatggtaaggtctatagctgctgcttcatggaataagcaaacaaagcccatgttgtgtgacgggtggcaacactttcagacttggatcctgcacattctgatgtgtaaattccacgatagggcaaaagcatgccactccacactaatgctgccctctcactaaattaaaccttggaaaaataagatgtggcttggctttaaaactcagtgaactatctttatggtacagttggtttccatagctgtaaacacaaaagatctatggtttctgcctacccaggatagtcttgtctctagacaatgtattgatgatgcaaatgttctggaactaaatagtggtgatggtggcacaacactgtgaatgtactaaatgtcactgatttgtacgtatttaatatgaattaaatgttaaaatggtgaattatatttatgtatattttaccataa

SEQ ID NO: 3758 - DNA, 4242 bp, Homo sapiens
aatatatccggaagcaactgtcatggctgctgtcagtgagggcccgtaatggagatcgagtcaagggttgcccagggacacttaagagccttcggcttcaaggaggcctctcaaaggacaaaggatgagactgcctggcggcagagtgccccccacaatcgtaggaactgtgtcgccgcgcttcccgttaacttgccgctaagtttttctagaaaagtcgcccttcttgccaggggtgtcctatagactttgtcatggagtgaaacagaaacaaataatggcctgtccagaagacagccaaatacatccttcaaacagacttcactgcaggagacagagtggattcatcctgtattctccatgtagacttccatcttcatgagtactccaagaagatggttcagttgactattgcaaaggatgaaagcatgggtccctgagaatttcattacttgcaacctgaatggaaaaatcacttgaaagcatcatgtgtgaacgctttggatacaaaagagatcaatagagttggcctggaacaagagatgcccttgaatgcaagttgtaacaactgagagaaattgcccagacactgcaacgggagttgccaacaaagtaacagagtcagagaagagctgagtcttgggaatgaaaaagtgatgaggggatgacttccacagtgggtatccggtcatttgggctgctgctctgccctcatcaaagtgatttccactctaagcctttgctaatttcacaacaggaaagcatgcaagaaattcgagaacaaaacaaatctacacgcagagcccagcatcttcaagcaaacaccctgaggtacagacccgaggctagatgagtccggactgcagatgaggcagctgcctcttaaactgcaaggggactgaaaaagtcatttgcctctaaaaaaaccaactctgaatacaaattgataatgaatattcatgagcccctccagcttgctctagagccacccttgactgcaaccctggactctgcttcctaaaaagtttcccaaagctctttctctgcctcctctcagaaggaagagggtgggaaagttcattcagggctttttgcctccagctttcaagtacttgctttttggtctgggcttttatttttccttctattttttttttcttaaggattcagatcaaatcaattttggtcttaccctttgtatcttccataagtagcagcttttgttttcctcctctttcctcgtctttcccccccccagcctctgcttgctgtggtccgtctccgtgagagaggtcctcaaggaaacagagatataacagacccttgggctcgtgggaggggctaaattagccggccccgtttcggaaggaacctcaaaccctgtctttttcattgactagaaaggacagattgactgaggagtccagcagctcattttcctaaagttactcgaagccttttccaggttgtaattttttgcatccttgaagcaatgtatattcaaatctctctctctttctcccttcttccctctctcccttactccctccctcttcatctctctctccctctcttcgttatagaaatccctttttctcccttgaaaaagtcatctcagctgcaagcaaaaaaagctattccttactgcaattatgaagctagataataagaaagttgttaccttgaaacccgctcgaaaaactgaaagtcaagaacagttcttccctccccataaagcctctggtcccatgaccagcaatcctttctcaaggctcattagagcaaagagcaacaggtgacccaagcgatgagtttcctgcaggagacgctgcgttattggttggaaggctgggtggaaccacagaggagctgctcaatgggaaccgctgcctggctatgaattgatgaaagtcatccaccatttcccaactttgacttcctacctttgaagtctaatgagcatgaattaccacatccagaccgtcaagattaccccaatgtagatgagagcctgaccaaattatttttaaactgtgtaacaaaattattttgaaatcaaaacaagggctaatcctttgaaaggaaggtaagtcctcaagtcccaaggcgacttggcagcttctccctccacaaggctgttgcaaaccttagcatttcaggtctgaaagatacctcagacattgagtctaaaagaggttagagatgtggagaggttaagccacctgctcatgctcacatacatggtctctcttatttgctaccatgttccccagcacctaatacagtttctctcacagcatgggctctcaataaatatttgatgaatggttgaaaaaaatgaatgaattgcagcaaagcagaaatgtagatctgttttcctgtttcctagttcttgatttttctacattgcttgtctggcatgtaaatttgtatctaaagccagttataccatataaatcattaaatttgtgagcccgaaggactgttttgactctatgtagaaactatattctccagcgagctttcagtcatactttaataaggacaaaggataaccttttagtttaggcatctctgttactttgcacggtgccacatggtatatactcaatacattttttatactttaataaatttggagctgtttaacaatactttatttctgaaatgctttatagttataggattttgcatgtatgataacaactaattacactgaatgaaagactcaatggatgtcttctcccgagtcagtttagactacatctctaataatgaatattggtctgatattcatcctgttatgataaaactggtttttggtgatatgatgggattttttgtaaaaaccaacaattggtttatgactgcctttgtactattgttttggagagaaatttgaaaagagcatgtccacaaaatagtgtgcgaattacagaatggaaaccaaaacatcaaagctagaaagagaaaagaatgatcaaagggaagatccagagtggctgaggggtaggcaggagaaacagacaaacaagtacctgagcttgtcaatgagagacacactttggtgggtgctgtggcaacggttctctactttattacattaggatattaggttctttttttttttttttttttgagacaagagttttactcttgtctcccaggctggagtgcaatggagccatctcagcttactgcaccctctgcctcccgggttcaagtgattctcctgcctctgcctccaagtagctgggattacaggcgcccgccaccttgcccagctaatttgtgtatttttagtagagatggggtttcaccatgttggtcaggctggtctcgaactcctgacctcaggtgatccgcccgcctcagcctcccaaagtgctgggattacaggcgtgagccaccatgcctggcctattttactacgttcttacattcttttttttgagacagagcctcactctgtcatccaggctggagtgcagtggcgtgatcttggctcactgcaacctctgcctcccaggttcaagtgattcttgtgcctcagcctcccgcgtaactgggattatagatgcgcaccactaagcctggctaatttttgtatttttagtagagattgggtttcaccatgttgtccaggctggtctcaaactcctggcctcaagtgatccgcttgccttggcctcccaaagtgctaggattacaggtgtgagccacagtgcctagccacagttctctattttaaacaaaattaaaattcaaggtcacttcagtcatgttgtatcagacgttgtcgacaaaaggttactttgacaattgtctcattctctttacatttcatcagggagagaaagagttagtaaaaagtaaattgttctagtacccaacttctggtttaaccaggagaggtaaaatctcattatagtaactagcacttcataaatatttgaagttcatccaaactgaatatggagtaatagaaacatagttttaacccctaattcatattacatgagccttttgacaacatttaatgctttttatggtaatatgctctgtgctacaatttaatcacgttgtccaggttcgcaccctcctcagcatcatgaaaatactatggttaagtatatattatcaccaattcatacaagaataattataaaagagatgggagtttgtgtgtatctttctaaaggcctcagaatttatcttaaaaaataaatcgtctttctcaac

SEQ ID NO: 3759 - DNA, 523 bp, Homo sapiens
ctaccatgaaagacttctgaatccaggaagagaaactgactgggcaacatgttattcagagatgggacctcagtatgttgccatggctgaccttgaactcctgcactcaagggattttcctaccctggcctcccaaagtattggtattacaggcatgagccattgtgcccaccgtctctggttcttaaccttctgcctccctcttccagttttaaagaatgcttgtaattacatgggctctcctagatactccaggataatcttgttttaaggtcagctgatgagcaacattaattttatctgcactcttaattcccccttcctatgtaattgtgctgtgtaacataggacatgagcaattggtggcggtgggggttattactttggccaccacagtaactattttatgccaggtactcagctaagcactggtgaattaagcatgaataacacacactccttaatctccatccattcatgggaggagcacttcacctgccatgctcctgagaatctcgggagt

SEQ ID NO: 3760 - DNA, 4241 bp, Homo sapiens
atatatccggaagcaactgtcatggctgctgtcagtgagggcccgtaatggagatcgagtcaagggttgcccagggacacttaagagccttcggcttcaaggaggcctctcaaaggacaaaggatgagactgcctggcggcagagtgccccccacaatcgtaggaactgtgtcgccgcgcttcccgttaacttgccgctaagtttttctagaaaagtcgcccttcttgccaggggtgtcctatagactttgtcatggagtgaaacagaaacaaataatggcctgtccagaagacagccaaatacatccttcaaacagacttcactgcaggagacagagtggattcatcctgtattctccatgtagacttccatcttcatgagtactccaagaagatggttcagttgactattgcaaaggatgaaagcatgggtccctgagaatttcattacttgcaacctgaatggaaaaatcacttgaaagcatcatgtgtgaacgctttggatacaaaagagatcaatagagttggcctggaacaagagatgcccttgaatgcaagttgtaacaactgagagaaattgcccagacactgcaacgggagttgccaacaaagtaacagagtcagagaagagctgagtcttgggaatgaaaaagtgatgaggggatgacttccacagtgggtatccggtcatttgggctgctgctctgccctcatcaaagtgatttccactctaagcctttgctaatttcacaacaggaaagcatgcaagaaattcgagaacaaaacaaatctacacgcagagcccagcatcttcaagcaaacaccctgaggtacagacccgaggctagatgagtccggactgcagatgaggcagctgcctcttaaactgcaaggggactgaaaaagtcatttgcctctaaaaaaaccaactctgaatacaaattgataatgaatattcatgagcccctccagcttgctctagagccacccttgactgcaaccctggactctgcttcctaaaaagtttcccaaagctctttctctgcctcctctcagaaggaagagggtgggaaagttcattcagggctttttgcctccagctttcaagtacttgctttttggtctgggcttttatttttccttctattttttttttcttaaggattcagatcaaatcaattttggtcttaccctttgtatcttccataagtagcagcttttgttttcctcctctttcctcgtctttcccccccccagcctctgcttgctgtggtccgtctccgtgagagaggtcctcaaggaaacagagatataacagacccttgggctcgtgggaggggctaaattagccggccccgtttcggaaggaacctcaaaccctgtctttttcattgactagaaaggacagattgactgaggagtccagcagctcattttcctaaagttactcgaagccttttccaggttgtaattttttgcatccttgaagcaatgtatattcaaatctctctctctttctcccttcttccctctctcccttactccctccctcttcatctctctctccctctcttcgttatagaaatccctttttctcccttgaaaaagtcatctcagctgcaagcaaaaaaagctattccttactgcaattatgaagctagataataagaaagttgttaccttgaaacccgctcgaaaaactgaaagtcaagaacagttcttccctccccataaagcctctggtcccatgaccagcaatcctttctcaaggctcattagagcaaagagcaacaggtgacccaagcgatgagtttcctgcaggagacgctgcgttattggttggaaggctgggtggaaccacagaggagctgctcaatgggaaccgctgcctggctatgaattgatgaaagtcatccaccatttcccaactttgacttcctacctttgaagtctaatgagcatgaattaccacatccagaccgtcaagattaccccaatgtagatgagagcctgaccaaattatttttaaactgtgtaacaaaattattttgaaatcaaaacaagggctaatcctttgaaaggaaggtaagtcctcaagtcccaaggcgacttggcagcttctccctccacaaggctgttgcaaaccttagcatttcaggtctgaaagatacctcagacattgagtctaaaagaggttagagatgtggagaggttaagccacctgctcatgctcacatacatggtctctcttatttgctaccatgttccccagcacctaatacagtttctctcacagcatgggctctcaataaatatttgatgaatggttgaaaaaaatgaatgaattgcagcaaagcagaaatgtagatctgttttcctgtttcctagttcttgatttttctacattgcttgtctggcatgtaaatttgtatctaaagccagttataccatataaatcattaaatttgtgagcccgaaggactgttttgactctatgtagaaactatattctccagcgagctttcagtcatactttaataaggacaaaggataaccttttagtttaggcatctctgttactttgcacggtgccacatggtatatactcaatacattttttatactttaataaatttggagctgtttaacaatactttatttctgaaatgctttatagttataggattttgcatgtatgataacaactaattacactgaatgaaagactcaatggatgtcttctcccgagtcagtttagactacatctctaataatgaatattggtctgatattcatcctgttatgataaaactggtttttggtgatatgatgggattttttgtaaaaaccaacaattggtttatgactgcctttgtactattgttttggagagaaatttgaaaagagcatgtccacaaaatagtgtgcgaattacagaatggaaaccaaaacatcaaagctagaaagagaaaagaatgatcaaagggaagatccagagtggctgaggggtaggcaggagaaacagacaaacaagtacctgagcttgtcaatgagagacacactttggtgggtgctgtggcaacggttctctactttattacattaggatattaggttctttttttttttttttttttgagacaagagttttactcttgtctcccaggctggagtgcaatggagccatctcagcttactgcaccctctgcctcccgggttcaagtgattctcctgcctctgcctccaagtagctgggattacaggcgcccgccaccttgcccagctaatttgtgtatttttagtagagatggggtttcaccatgttggtcaggctggtctcgaactcctgacctcaggtgatccgcccgcctcagcctcccaaagtgctgggattacaggcgtgagccaccatgcctggcctattttactacgttcttacattcttttttttgagacagagcctcactctgtcatccaggctggagtgcagtggcgtgatcttggctcactgcaacctctgcctcccaggttcaagtgattcttgtgcctcagcctcccgcgtaactgggattatagatgcgcaccactaagcctggctaatttttgtatttttagtagagattgggtttcaccatgttgtccaggctggtctcaaactcctggcctcaagtgatccgcttgccttggcctcccaaagtgctaggattacaggtgtgagccacagtgcctagccacagttctctattttaaacaaaattaaaattcaaggtcacttcagtcatgttgtatcagacgttgtcgacaaaaggttactttgacaattgtctcattctctttacatttcatcagggagagaaagagttagtaaaaagtaaattgttctagtacccaacttctggtttaaccaggagaggtaaaatctcattatagtaactagcacttcataaatatttgaagttcatccaaactgaatatggagtaatagaaacatagttttaacccctaattcatattacatgagccttttgacaacatttaatgctttttatggtaatatgctctgtgctacaatttaatcacgttgtccaggttcgcaccctcctcagcatcatgaaaatactatggttaagtatatattatcaccaattcatacaagaataattataaaagagatgggagtttgtgtgtatctttctaaaggcctcagaatttatcttaaaaaataaatcgtctttctcaac

SEQ ID NO: 3761 - DNA, 2173 bp, Homo sapiens
ctgcctctctccaccccaccccaatttcctagaaagccttgcactattcagctcccttagtgctttttgtcccttcccgaacaatatgcagtagctttaagccattcaagctccattatgcagtatatctgagaagggaaaggaaacaacccatttaaatttgaataaaaccgtgcctatgcgaacagtagcaatttagaatctcttttctgcttttaaaataatttatatttaaaaattgcactttagctttttgatccctttgtatttctcttattctctttctaacctcttctctgtcctcaaacttgcctttgctctcctttacaataccccccacccctcctccaaggctctgagcggcatcatttaaaatactttacagatatttgcaccaggtacatttatgtgcgtccattggtagcacagctgagacctgtgtctcacatcagcctaggtgaagcctactacaagaatgccaaggagaagagccagtacactatatggtttatactctttatccctttattcatagcatgttttttaaaaatgttatattatgcaacagatgtgaggcagcagctaagctatacttaagaattttctctcaccttccaaaccaaagtgtcctgaataagccaggagacttattcttttgtgcaccctggtgcacatctgactgttgtcctagccatagactctctgaggccactgaaagaacagtggccctatcgatttcattcctaggtctcaaaaatacaatgttgccttgtaacataattagggacagcacctctatttcacaattataatctaaggtaggataagacgacacagcagcaataaacttacaagtaaaattcaataccaaaacaaacacaaagaaatttaaaaaacaaaaaacctagctcatcatgttgtgaaaatgaaaaagtgaatgtccattcaaaatattttactatttcttgtggagtttttcagtgatgtaatgcttgtagccaaattgcttaaagagtgtttatatatttttttccttataaattgtctattttttaaaaaagctatttaaccacagctgaagtggggggtaaggccaaattgccaacacttgttaaaagattaatactcttaagtggcactctgatacctttccaacttgtcatcagaaaggaatcaataattaccaactgttgtatttagaccaacttacaatatctagctcattagaagccaggatctagaaagctccttctaagccatttaagatattcttacattgagcttcatattatagaactttataggattggatattttacaatagaataatttagcctcaggactgagaatgtggaagctgaataaattagctttaaatacatcattaaaatcttatgcacaataagctcattagattctagttttctcctttagaataccaatgccacagacactacaggagataatgaaaggtatcagttgtgttgagtggagggagtttaagagaaaggacccttcccaaccagcagccagtagaaaatacaacctactcacctttttcccttctaagttctgctaaatcacatctgcctcatagagaaaggaatgttgcctttgagaactgtcttggagaacagataagcttgaaatgttctctctagagaggacatagggtttgggatcctctgaaaaggcccagaaaaatagctcagttcaaatacaatgttctaggacaattggaatataaatattgtccaaaaatataattaaaagaaaaaagtttagcactgtgtaaagtaagtgttaactgaggaagtcccaaaaaggtgctgtcactttaagttctggacttggggttctttgtatttgtaaacagcaaagcatttgtgtttgtttgtctatttgtaaagcaaccaccttccttattggaaggagaaaaaaaggggtacatacatgtaaatacttgctgcagcatttaatatgtttaattttgtgttaagctttttgttgcatcgtgaacacatttattgttaccaatggacaatgagttcattaagactgttcaactaggtcagatttttacatctctttctagcaagaagagacaagattttgtgcatttgtacaaatgttaatatcactgcaattccaatataataaagcactcaaatgc

SEQ ID NO: 3762 - DNA, 1049 bp, Homo sapiens
cttttccccttcattaccaatgctttagaagacttaaatcttctgcataggcatttctggatttgcctacccacctaccaaccttccctcccctgaaaactttcagatgcttcttcattgttttagtcatttaccactttaatgaaattatctggcaactttattgtggtgggtggggatcaatgacggtgtaatgaggcaattagcaaattctgatagttccatctactccatgtgaaagtctcttgatgttttatatggtactcttattaataatcccagagagcaggggttggcaaactatggcccatgggctaaaatggtttttacattttaaaagggttgaaaactttaaaactggaaggatacatgacagagactggatggcctacaatgcctaacatattatctagccctttacagaaaacaactgaccaatccttatgagaccagacttgcaaaaattacagtaacagagtgaaaaaccttcttgaagtgttaggaggaacttgagtcataatttgatgttgaatcagagagaacaactgtttgggcttatttgcctcagagtatttgcccagcctctggtaactatcattctattctctacctccatgagagcaactttcttagctcccacatgtgaatgagaacatgcaatatttgtctttctgtgcctggcttatttcagttaacatcgtgacctccagttccatccatgttgctgcaaatggtaagatttcattcttttttcatgactgaataatattccctcatgtttatagaccacattttctttatccattcatctgttgatggatacttaggttgagtctatatcgtggttattgtgaacagtgctgcaacaaacttgggaatgcagatgtctctttgacatactgatttcctttcaaattttgggcatatacgtagtagtgggattgctggatcatatagtagatctatttttagttttttgaggaatctccatactgttttctatactggcactaatttacattcccaccaaagggtgtgagcattcccct

SEQ ID NO: 3763 - DNA, 446 bp, Homo sapiens
gactttccaaatccaggagcaacgccagtggcaacgtagtgactcaggcgggcaccaaggcaacggcaccattggtctctggatctgacctctccctgacagacaaccatctctttttatattatgccgctttcaatccaacgttctcacactggaagaagagagtttctaatcagatgcaacggcccaaattcttgatctgcagcttctctgaagtttggaaaagaaaccttcctttctggagtttgcagagttcagcaatatgatagggaacaggtgctgatgggcccaagagtgacaagcatacacaactacttattatctgtagaagttttgctttgttgatctgagccttctatgaaagtttaaatatgtaacgcattcatgaatttccagtgttcagtaaatagcagctatgtgtgtgcaaaataaaagaatgatttcag

SEQ ID NO: 3764 - DNA, 3988 bp, Homo sapiens
tataacagtgccactctcaggaattactaagtgacattttaaattgatattttaaactctttccaactacatagttatggtttatttcattctcatcctgttgggatgagaacttgtttgtgcctttcataacttgtttaaagcagagttttaaaattagtttataggatctgaggtggctattagttacagtggcaagattatttagaaagcaagattttgatgagaattaaaaacaatagaaaatgtagagtgcttaaacaaaaatgttatattttgaaagagtagatacttaatttataaataacagtctgaaggttggtgctattttgggataattgttttgctaatggataattctaacaatgcagaatacctagtcaagactgtcatcaaaaacattcacaaatgtttcattctatttttagtgactctgtttaaagagtttctgaaaggaaagaaattttttatttttattatctttagcagtactgagtgtcatagcagaatattttacagactttctatgagattatttttatggtacaaagtatttacatttccctcatgtttatcattatgccaattttacatggcagtcatgccactgactctgctatttagctaagtaatttcttttttcggagactgtctcactctgtctcccaggctggactgcagtggtgcgattctcctgcctcagcctcccgagtagcggggattacaggcacgcgctgccacgccccgccagttttcatatttttagtagagacagggttttgccgtgttggccaggctggtcttgaactcctgacctcaggtgatccacccaccttggcatcccaaagtgctgggattacgagcgtgagtcacagcacccggctaagtaatttctatttattgtgccaaaacatgtcaaaatcatgacctctttgaatggtatatttgagaggatgttcatttcattggttaaccatggactactctgtccacgtagtgaaaacatgcaccagtttttacctattatcatggtagtatcatctgccaaaatttcaaggcattcattttattctttgaacaactcttcaccatggtgtggacatgaattttcatatgtgttacttgactagaagtataaatggtttactatagatatccaaaaaccttgagatttgctcataggaaatgaatattgtgatgaatcctgggctctagagtcagacttgcttgggtttaaattcttgctctaacacttactgtttttgtaaccttgagcaattttaatctctctgtgtctcaatttcctcatcttttaattagggatgataatactacctacctcacaggatttttatgaggattaaataaatgtaaggtttttagaacattgatagggagcaataaatagaagattgtattattattctgttaccttggagtgtaagtactgcatttaagtgaatgaaaaatttgctttgaccagatactgaaggaaataagtaatagctagtatttatccaatgccaactgtatgctaggtactgtgcttagataatctgtgtataatagtgttaatcctcaaaatttgggtgttatacccctattatagataaggaaactgaggctcagagacaaagtaactttgtcactgtcacaaagctagtaagtaacagaggtaggatttatattcaaaaccctgtgtgttcattggaaccgtatcaggcttggggctattcatgtagcattatttccatttttatgtatatgatatatgacgtctgatgcattggccagtaatagtcaaattaacccagccaaattgtcacagtgattcttaaactgtggttctcacacttgcccaggatgttgttaaatgcagatctgaagaccccaatctcagaaattcaaatttaagcatggggcccaagagtatgcattcttaccagataccttgggcagtgactgtcaaaagtctggtcccaacaaacagcattaacgtcacctgggaacttgttggaaatgcagcctctctcggggcctcatctcagatcagatctactaaatcagatactctaggggcaggggcaggggcaggggctagcagttgtgtttaagcaaactctgcaggtgtctttcttatcctagtttgagaaccaatacccaacaacctacgtgattttggtgcaagtagtgtttgaaacacactgaagattactgcccaattactaagacatttttcaaaaagcatgttttaaatcagtgtagtccaggatcacactatattaaatataaagataacttaaaggatcattggatcattcattttggccaaatttttagcttctccaaagtgactaacatcagggcctacaataaaatctgtaattctccaagtttagtaattttatattgaggcaggaagggctcattaagtactaataagtacataatttattaaaaacatacataagtgtcatcaaaaaggtccacaattgttagtaaaaaaaattaaattgaagtagtaaatgctgttttataacatacatttttctgctaattcattctgttttgtgtgacctaataaagcaaaagaaaaataaaaaagcaattctccaagtacttcatagagcacataaaaccagatttcatgatgatgatgtattcactatcttttagattaagatctttgttatttggtaaatgatttcagtatggttttaaaacataaggcttttgatgtcttatgttctctaataatggtatgcttgtattttctagtgggaagttcatagataaagcagatttttgtcccagtttgctttcaaatataaatttcagagggctttttcttactgtaatgaggtatgaaaataaatcattgatcagctcttaatattttttgaatacagaattggatttgagcagtaaatttgctaactggttattttcacaattttcttgaatattaatttttcacttctttgagactgtcaaactatagttactaccaggttgatgcactgtacttgaaagaatcccttgattaaattacatctagcattttatttgccatttcaattttcagttcattagactataattctttgacagtttctgcctggtgtttattgcccttctttgtttgctttattactaacttccattttctagttactcttaaatgctgccttcacaaggttaatttggctgttaatagtgattagaatttttatcacttaattgataattttaagcctactaactagggttccctatgaaattgaaagtaaaagtctaagaataatgcctgctggctctcgagatacttgccctacttaaaaatctataatttaaaattaattctatgtctacaattattaaaggaagtaaagttatttgggttcttccactcacccttttctcaaaaacaacaacaaaaaacaaaactcattttatttttctactttatagtaggcctgacagaaacatagtgaagcaatctgggaggcaacctgtggtagattttatgctaaatgttaatgtaacctctgttgattttttaaaaatgtgtttatatataagatttgaaataaaaactttaatacaggctagaataaggaattttacaaattctctttagagcaaccaacattaaagttttagagttgaattttgctctatttcaactcccttacctctctagttttcagtttatattaagttttaataactttgcggggccctgcaaattaataatctacatgaagtatattattagagggaaactaatcttactgctaagcagtgtgttgtactacatagtgaatgttcgtgttttggaatttaaaaattatttaaggtaatggtgttacgaatggtttaaaaatgtctggtgacttgcttatttttaagtgatcaccattaagtcagaaaaatgtatttttaaatgtttcttgaagtgccttttgaacatttttaaacagcggat

SEQ ID NO: 3765 - DNA, 17865 bp, Homo sapiens
gtctccccgcttgggcacggggctgtgcgcgacgcagtggacgggtgcggggctcagcgagggactcccgggtccatagagatctggggagggtggggggagcaaggacgagtgcctgccgggacccccctggctcctcgctcccaaggagtcgaggggaacgtctctaccgcgctgcaaagccagcaggtaactttggggaggtgcgggccaggccagcgagcagcactcggcccaggcgccgcggggcggacggattggaagccggatggaggcgtggccgggtgggggccgcggcggcggggaggcgcgttcccggcgcgcagagctctattgttatataaaagtgccgaagcctgcccctcccgagcggaaaaccacctgtgtgcggccggcgcggcgcgagagggatgcagccggaaggcgcgggccctaatccggccttccctccctaaaccccggcggaaaagaggccgcgctttgtcccaccgctgcctgagaggcggaagcgggggcagccgtccggcggggtgcggctttggggagtgtcccttgctgcgctttgcgcctaccgtgaacaccgcgagggcgcctaaggtcgcggggtctcccttcgcccgacgccccgcacccacgggcatgcctgctaacacccccgctgcaatttgcatttttagtcacccgcctcttccctggtttgggaaatgtaggctaaaaaaaggcggctgcgaggcctaggttgccaattttggagctctgcttcaggcaggccgcccctggaggagcgtgttcgacaaaggtggggattgccgagctcctctccgcaccatttttgggcagtccttggaacaaaactcgtatatttcactgggtatcttctagtttcagccgggggaggcctgcgctggagttgactccccctgtcctccacgatctgtcacagaagttcccaccccgagacgtttcagtcattgggacctggggacagggagggaagaggcaggatgcccttcagcggaactgagaagagcaaacctgttggaggttcagcacaggacctccaacagaagagaaagggagggaagttgggtttctactttgcctgttttaatacgcagctacttgagtatgactatagattcgggaggatacatcgaaactgtagttttacccatgcttctgaactttatcgccaagggaatgccagtgtttcctggcgcattgattaaagtggcgttctgactgctcagtactagaaatgctgcgaaaagggcttctggagtgggacggccctcgtttgcattatgtcccccgcttcttcctaggtaagcgcccttagttaaatcatttagccgttctaagttgcagtcttccacgtcggcataacgaagataaaactatctgcttcatagggtccctgtgacgacaaaatgggtacggtgaaacgtcctaaagtggtggtggggtgctattagccgttggaattaatttttcattctgaattgaggacctgtaaaaaggcctcggcttggggacacggtttgggcatcccacagatgccccttgaggctcgcttgacagcccgcctggactcgctcatctgcagcaaagccctctgagatactaccctaaccgatttaatccgttccaattcagctgtcaagtaaagggggtgttatcgtagaccaggatcaaaaatcctttagcacagttatcagaatggacccagctacatttctgatttctccctactggtcacctttggaacacgctgttctccagccacagcaaactgatacaacaatgcatattgggcacttaactgcatgatgggtaccgtcttgtttctgtgtttacttgcataatttcggacagtcttcagaaaaaacatgtaaattatcccatttacaaagattaaagaatttgcccaagggcacacagtagcaacagagtgtcaagacgtgaggccaaaccctttacagactcttaaggatgcccacatgcacggattacatagagtgttatggacactatattcacctccacgtggtattccctgcccacatgtgaagaatttcaaggtcagcattttgaattttgacctccaggctttctccagcctcacgttttctgttgcatcctccatgtcaaagatcaaaagcgaggctgctttccctgctccttttacacaccagtggttttctttgcacgcaacccttcatcagtcaaacattcactaaatgttgcatattttatctctcttagaatatgccctagatcctaatcttcacaagtgtcattggttatctagtgcgtcagcacagcacataagcctaggttcaaacctctgtcactcagtagtagtctgggcctcacttcattcattcattgatgcatttattctagattccaggaaagcagtagagaataaacagacaacaataacctgcctcactgaagtttacattctaatgaggacagtccaattaacaaaacaaataattatatattagaaagtgaaagcgctatagagaaaaagcaagaaaaggaattcggaagtgtgtaacattgggaatatatattcctccctcaaaggactgtgaggattagacacaactgagatgacacacgagaagtgtagggcacaaagtcggtattcagaagatgatttttaaaatatcaccacttcattcctgcataaggaatgctgttggtggtgatattgccattcctgtgaggcactgaggaaaagctctcttaggagataagggctgtagtagttggaagaattacaggcttccttaattccagaggcctcagtgcccttcagaggatatcattcatatgaagaggtctgtatttaaaaattggagatagcagatcatctgtgatccattctcatgagtgcagagaagcactttcatagattcttgtttcttcctctgtgtgtgtgtgtgtgtgtgtgtgtgtatgtatgtgtgcaccgagcacctgtgcttgtgcttgaattcctcctggtgtttccccctggaaagttccttaaaaattgttagttaaaaaaaaaaaatttttaaagcagtgtattttggttataaaattttctctaggccatttgagaaacattccacttttgcaggaattttcctgagtttgagggcacttgagatttataagatgcaaatgggctagcatgacctttaatcttcttggaataatctctgtgaatacaatgacatttattaacacatcatgtgaaaacagttaaacagattttcagcaaataaggagagttttggaagttctgacttaaaatgtaaatgcatttaggggtcccaggtaggccctcaaagtgacagtggctttcagtgcagctaaaacttcaaaactgaatttaactgtatttgaaggatacacctgaaatagtatggcttaatgtaaaatgtatatgggttgcacaaaactgtccctaaggtcttctgatgagtgcttttaaaagataccaagaagttgtaccacaacagtagcaaccgagaaacacaagaagcctaaggaactgacagtaggtaacatgacttacaggcagtgataggctgtgagaaagccaaagggaatttcaaatagcccccaattaaaattccatgagggcagcccctgggaattgcagatccaggtttgcaatcaaactgcttctcacgtggaagctccgtgcagcttgccccatgatgaggagctgcaagggcttattgagcacgggttaatgatttctccaaacaatgcgggggaaggggaaaggcaggctaggttagacctcaaggcagaggtagctggacagcaacaccagaatcacacccacaagcatatctagggggagattggagcttccccatgaacgagatggcacattcacgcattgccaggatgataccacctgaagaaaaacatgaactattgtgaaattcagaccttagccaatttggctaagcttttaaaaattacggtcttcgtcagctttcttgcatttctgtttcccgtcatctgatgaaagacaaattaatttacattcaggctcctgtagagactttatctagaatttttttaaaagctagacggtctctagcaaagaaattcattaaaagatagcaatgttaattttttatttcagatgttttaattccatgccttccactgggaaaatattcattgattcttcttccttatcctttatttttacaaagcaggaaatgtaaaaagcatatataaatgtatatataagaaactcatgacgttggcatttctgcagtacatttctgagtaagcgcatttaccttcttttggaaaggagttgacggtaccttgtttcccgttgtactattttgaaagccccagcgatgatccttagtgggaaagtatagcttacattgccagccaggtaagtgagagactatatgtattcagctctccaaaaccttctcatgtcgtgtcatgaagcaccacatgtgtggtgtcgggcattatccatgttgcatcttcatgtggaatatttgccgtgagcctccctgtgtgggctgtttcctctggtgacttttctctccatcttgtgttgctttatttacgcaggtgtgagtagtacatatagctgttgtgtaagagaactcattattttcctaagtgggtactatttcctgccaccctatttttgcttcagaaatcagtggaagtaactgtgtgtgtccacaatacaggaatgctttagctcagtttttcaaactttaagaacttgcagatcccccaagaatatattaatagaaccctagggagccccaaactccagtctaaacaacactgcttaaggctgttggtgggttcattataaaagttatatctggacatatcatgaaataacaacatagtggctacaacttattctacaccaaccattgtacgggttaaatctaaccattgtgataaccttgcaaaacaggtataccattatcacaactttaaggtggggaagcctgagctctaatgtcaggtaatttatgctggaatccaaacttgcatctcagtcccttcaaagctccttagtacatacacactgctgccaacctgatgagtggccctgaatgaattcaacctggtataccatgatagcttctacataatttgttacactttatcttgctagtcaagactaggacttgtggaatcagcccaacctggattctaatcctggcttacctactttctggccctatgactcagggaaaccatttcatctccccatgtctcagtttccttatctgtaaaatgggaatactctatcacagagctattgcaatcaatgatttatatttgtaaagtgggtagaaacagtcctagaacaataactcattgattgctacctgtttttattgttacacacacacacacacatatacacacaattcttttttttttctttgagacagtctcactctgtcaccagggtggagtgcagtggcacgatctcggctcactacaacttccgcctaccaggttgaagcaattcttgtgcctcaacctctcaagtagctgcaattacagacgtgcactactatgcccagctaatttttgtatttttagtagagacagggttttgccacattgcccaggatggtcttgaactcctggcctcaagtgatccaccagccttccaaagtgctgggattacagatgtaagctaccgcacccaaccacaactcttaataaatgtttattgactttgctgaaaagggatcatataacaaaaaaacactatagtgttaatttagttctcaggaagagaaaaacaatccatacacattttttgaaaaaagtttcaaagaacagaatcaactgctttacggcccctcttagttgctgatataagcaacccagaaattgaggtttcttaatgggctgagatacctggatagtttggggacagtgaaaacacactgcgtaccaggggttccccatcactctaggactcacctgctgaagtagcaggcactttccctgctccatcaatgctggctcatagctgatcctatggactgcatattgtgcaagaggagaattggaaatctactagcctgagccacatagctgtcgtctctcagtaatctgggttcaaggcagctaatggaaacacacatttatattatgagtcctgcatataagaagtcccattctctgggaatctcctttctccttccgacttcatgcccagcaggagcttttcagaatacaaggagggggaagaggggagggtcagagctgagcatgagagccactcttctgtgactggaaggaaacttccattcatggacagatgagaaagcctgtgctagaagccaccttgtagaaacatacccaggtttgagtaaacagacacctgcttagcacagtttccatactaatttttgcacatatatgattccaagattatttttattaaacatccgataagtatatatcctttggtataaatccatcaggttttgctggacctaccagaagttttagattccttacccaaacctccaaagtgtaaacctggccgggcgtgagccactgcacctggcctaaaaacaaattatttatgttcttgaaattggtgcacttacaatatgtggtagaggaggtgtggcaggacacatggaccttgcatgaccaaggtacaagacagcagacagctcaactgtctgtgtcatggtgcggcttccagcactgagcctaggatcctgcccccatgagatgacacgacctgcaggttcacctttagaacattgctgacttcagtgtggccctttcatgcaatgtgctgttaattagagtacttatggcagagagaaggactttttcccagtgtgtataactgtacctactgctaaagcatgatttttaatctagttaaatttgctgtgaaatttacatttatagtgagagtgagatgaagtgtggtgtggaatgtaacctaaatctggagcctctaactactaacccctgattttgatcaaaagaatctgacaagtactctatagacaaactggcttaaaaggaaagctttttaaaaaaatataggtgcccaagtcccataaccagtaattctgatttaattgatgtaaggtggatcttggcattgatattttccaaaagctgcccagagaattctgatatgtggcctggactaacaactggtttagaagcattcacaacaatcatcccctaacagtcccttgcctaggcagaggtttccagtgagcccaagagcttcccacccagaccagtaggtctagaaatgaaatgtttagaaacacctggaggtacttgctctcagtccatatcctggcctacccgacagggactctgattcggaagatctagggatgggctcaggcaactatattgtagtccagcagccagcagtggcttatacaggtggaccaaactttgagaagcttccagtgacatcccagatagtcagattcctcactcatccactctgttcagcaattgtagaaatgttcttgaagtaactggaaagatgagtcaaatagtattctttagacacaagcatcagaacttcgtaacaggaaaatgctgtgtcaggcataactaatctgcttgcccttgtaaatgcaactcttgaactggtatgcactctgatgagttatttactggtgaaacctgtcacaaagcgttgggagattacaaagaacagaagaaggtatcttggtggcagcatcgtgtgtttattgaacacccgttgtgtgtctaaaactgaaatgactgctggggcttatgaaaatgagtgagattcaggccctgctgtcacaaaaaaatataagtctaactggggaggttagacatgtgcccaggtagctagaatgtaatgtaataaatgtggtcattgcagtagaaaggaagtgctatgggaacaagaggaggaaatggttcatctaccttagggtgggaggtggaaggtagaggtggggtgctgggaagtgtcccaggggaggcagcatctgagttagattccccagggagcagatttctcactgtccccatccagtgggataggagaagaaccacacacactctgggcaagacagaaagatgacatgagctaaggtttggagggatggacatgtgtgaccagtgcagtgcaggtgaatggtatggaaggcaaagattggcagagaatacaggaaaggtagtgtagtgccagatggaaatgggctttggatgtcatggtaagaagttttgaatttttctttaggtgaagtcatcatagatatttatacaggggtgtgacatgatttcaggatataattctgtaacaaagggggcgagtagactggaagggagagagaaactgggggcaggaaaaccaattaggaagcgattgcaattgtccagaaaaaggatgcagtaccaccacgatcatcctcttcctaaaataatgtattcatcaacctgcttagttttattcctcctatttctgcagctagaaaaatcacttagccctcttgtgactcagaatttctccctattaatagaagatgacagaatacttatctcacctcacacagggagatactgagagatgcttgcaattgtagccacgaaagagggggaaatgttattccaaatgccagtggcagtaattactctggagtagtgaggggagggacactgcctttcctcactaacagtccattataaaaatttcaaacctatagaaaagttgaaagttgagtaagagcatcagaaatactctttggagggaagcttctgcagaaattccaagtactcaccacccaggaagtggcatttccaatctaagggcccattgccttcaggatgagaatgccattgcagcctatttggttacaaacagtgttctataatatgagattttgtaaagaaaggcccattttcccattgttttccattacaaacaaaagtgtaaggaatgatattcttattattcctattgctgaaatggggctggggagggccatatttgaaggagttataccatcatctacatgctttcaagctgtgttttgccctttggggtttggagtctgcccttgtagcaagaggcacgtagtcataccttttccatctgctgctgggccccttcccatactaggtctccatttcagcaccctggaccacatcagaattctttcttgtttttggaaaagcatcattgatatctaccgcagggtgtgtgacagacataaactgctttaagttttgccaaaatgactgtgtcttctacctttgaaaaaaaatctgtgctctctatatttgctgagttggtataagatattccaagggataaaaagataaataatgaagagacactgccctcaagaagctaacagataggactgtgacctaatgaagaagttaggagggtagcattcagtgcttttttagaacagtatcaactttcaagattcaaaaggatggtcgtgttcaatgactgatggagtccttccaactggaatggggtgatttgaacttacaatgaggaaacccaaagtacttcattttatatatgaaaatcaaatggttattgagtgatataataaggagacctatcaggaatacgtaaggagaagataatttatgctcctttctaaagtacatttacgtaagtaatgaatgattagctctttcaaatggaaatgttttctctagtacagtaaattattctgattcatttgttcactcttaacatgcatttcttggaaaacttactggcaaaatttgtcacaaagcaattaggagactacaaagtacagaagaatagcctttaaatccttacacaaattagttcttattttaaggacagtttaaatctcacaacatcacagcctgcttttgcatgcactctttcatttacttgttagattcctttactgcaaagagctcaaggaaaacaactagaaacaaaccatggctatgctgacaagaaagtgtcagttataaagggaaatgaatgaagatttattcatttattaataaagtaatgtgggcagccatttgataattctaatttctgatttagtctttaaagttgacttatttgcatacatttttaaaagtctgtgctgttgccaagtgacttggaactacacagcatagtttacttacaaattagatgaaagcctcttttaaaatgtctgcacatattgtactttttttctcttaaaaataagccattgttgatttatttttggacaggtgatatttgtgaatggaacaaaatataaaaggaaggatatggcatacagtaagtcagtctctcctggccacccagttcctctccctggcaccaaccacttttgactagcattttgtgtatcttctcagggggagtctatgcatgtacaaggatatgcatttattattggtgttattggtatgcaattgtagcagactcgtttttaatgactacatagtattctattgcatggacatagcataatttatttagtcagccatcctatcgatagatattgaggttgttcgtaatctttttgctattgcaagcaatgactgcaatgattatgttttatacactcatccaccttgtggtgaatatatctgtagggtaaattcttaaatatggaattgtttggtcagagtatatgagtttataattttgataattattgcccaaatgcccccttcagagatcgcactaatttgcattcccaccagtaatgtatttccccatactttagctgacacaatgtgttctcaaacctttgccactctgagagatgaatattggtatctcatggtaactttaatttgcctttctcttaagagtcaatttgagcgtgtttttgtatgtttaaaggctgtttgaatttttttctgtgaactgtctattcatatcctttactcattttttgagtagattgttgatcctattttatttttataccttattttgcaaccataatgttaagttcattttagcctctgaactcaaataccatttgtcaatcattagtccaaataaaaaaaaagtggagccacttaataatcctaacgcacagtttgaaacataattcattgatgcctgacttttccttctcaactagttttaatctcaaattttaatgggaactgtcctcactccttaggcccagtcagggtcaaagagtcctgggttttatttgttttatttgaaccccaggagagttgcttgtctgaagctctgttttagcaatagattatttatacaaactctctgataaattttaactcattaaatagcagcgttaatatactcatctagcaccacattccctgccttctgcatgagcagaggagagagagtgatactattaaatattcaaaagcctttatccttatcccaacccctccataggaagatgctatcttgcctgggctaggtgtagtggctcacacctgtaatcccagtgctttgggaggccaaggtgggaggatcacttgacacccagagttcaagaccagcctgggcaacatagtgagaccccatctctacaaaaataaaactaaaaaaattagccaggtgttgcaggcacctgtattcctagctactcaagaggctgaagtgggaggatcacttgagcccaggagtttgaggttacagtgagctattatcaggtcactgcactctagcctgggagacagagcgagacccttttttttttgagacagggtctcactctgtcacccaggctggagggcagtggcgaaatcttggatcactgcaacctctgcctcctagtttcaagtgattctcctacctcaacctcccgagtagcacgcctggctaatatatatatatttttttaatggagacagtgtttcaccatagtggccaggctggtctcgaaaacctgacctcaattgatccacctgcctcggcctaccaaagtgctgggattacaggcatgagccaccatacccagccaaccctgtctcttaaagaagaagaagaagggagaggaggaggaggaggaggatgagaaggaggaggaggaggaggaggaggagaaggagaagaagagaaggaagaggcagagggggaggaggaggaggactagaaggaggaggaggaattatcttattatcttgcccattaaataaaaaagcgtaaaagtcccttgcttctttctttttcagaatggggatagtttaaaagtgtctgtttgcaatccccaaatatcatattgcttttggcagctgatattctttagcagctgattaagtgatacatattttacacaaaacagaatatcctgaatcaaagggattttgaatatttatttgaactggctttatctcaggtatatatctggaattcactgaaaataaaatgggtggtaaggactcaaagatgacagaggatagcaacaacaataacaagatggagatcaggaagtaggtatgcaaatacctgtaggttggatgtatataggaaaagctaccatatcaaactgggcagaagcaaccaatccagaaaaataacttctagcatccaatcatattgtggtgagattaaactcacaagaaagttaaatgaggtttagagaacatattctcaacccatacatacttcattggagcaactcttgttaatcttaaggggaattatggaactccattcttccttcttatttagaagaaaatagattcaaggccaaatttgtaggccaaattgaagatataacgagattttttttttaactcatcgtctttgccaaattctctagaacataaaacctgaggcaaagattacttgctaagtctatgttgggtggtgcaatttcagggctataaaagggaatgagaaaaaggtgaggcaggaaaggaaggaatgcaaatactagacggtgtgttaaggagctggacataacttcacaaagaacaaagcctgttgctgggtcctgcatgtcaccttgaaacagtccatcaggtggggagggcagtgggaggagcaatggggggagaaagaggaatttatcttcttgacctctagtcccttgattcaaaatttaactctgatttaagggagccgttgggtaagccagattccacatcccactaaactgcctggaagaggtgggaggagagcagccattaaggtatgaggtacagagtcccatcaggtgagacccatgtctgtagccactgaggttcctgttgcaacaggtgagatgtgatcttcccaaagccccagcttcttccgcaggaggctgagacagcaggcccacggatgtccattcaggaagaggctaaggcttgggggtcaggtgaagaatcttgagagacacaaaaattgttctagtatagtcatgacttaaaattataaagaataattttcaagtcttttagcaaatccatgaattggtgtttttgtggagatatgaatgactttcagtaaaagagtcaccgaatcataataggtatggaggtggaaattctattattaagatttatgattactgaaatattttcatgattactcagatccatttctggactgaccttatgcttaaccagatgatgtttattattaaagctgatttttaacgagtgttcattaataaaaaatgctcttaaccacaaggctttgtttccaagtgatgtataataatatgtgctaaaacacgaatctcaatttccagatgcatattttaccaaaacacctattgcactaaggaaaatatgacaaattcttttttttgtttgtttttttcctttttccctttgctttttattgctcaggaaactatgattgattgagtttatgaacacatgaacaggcaagcacgtacacttaaaagatgaaacaaagaaaaaagttgatccatgtcattccatgagaaaggctgcccgcagcactccagctcaaacacagtgtcccctcaagctctctatccccctccccactccctcaccttccctctgattcagggaaatcagattgggaggttagtgcatcattgacagagaatgccctccttccacgctctgtaagtctcccccagaagcggggaaggcagttcccttcagtagcgcacttagggttgattagtgttggttccacaagttaaggcacttcaggctgctttagtggcagcgtggttcctcccctccttttttaaggcatgtgtcctctaagagtagtaaagctttggaaactgtgcagactgttaaagttgacagcttaatacaggatcattgaagtcagcaggcaaaaggatcctcggagacacctccctcagaccagaagcttccagaaggcctgggcagctctgtgtttcggctgggcatggcacactggagccccccgaggccagagggtggtgcgttcaggtagcaaagacaggtgggctccgtcccgccttcacctgcagctgccctggctgctggtggagaaaatatgacaaattctaatttttctgcacattaatgtgctgtggtataggtctaagggagggggcgcagatggtggtgatggaagtggaaacaaaaaaatcaatgaaagagactcttgataaaacaagcgtcatatatctaaaaataaaataataacaaatggttatcctagcgtatacatccagatgacatttggaaatttgcatagaagtaacagaagggctaaatgaagccttctggaaaagtcatagtctttcaaactttatgtactcttggattctagaaactcacttcagttatttaagtgaaatgaccagaattagtgtcatctccatacattgagcaggaagttaactttgaggaactatacatgagcacttgtccctgaggttgtagtatctttatgtcctttccacgccctcgccacaaaaagccccagcaagaacaatcaatgttttcctgcttaacccgtatttttatctgaatgtacattctccctcctccctcttccctctaggcatttgctaggcccttaggaggtcaggcaacttgcactgtggcacatgaagaatattcacatacttcatatcctgcaggagaaaggagacagcacaagaaattctgttgtcactaattgaaagtagtttatcactttatctttagaaggtctaatgccaaaacttcaaggagataataaatagtccagtctgggtttgagcctggagtttggatgtctaagatgactccgagcggatgtggatttacgtgttagtacctgaaagtgggcacagcccccaccttggaatgaatgtacacttccaaaggactcgttcccacagggtggtggaaggaacaacagagacagctatgtgcccacatgctcagccatctgccattccaaccacatgtctctccccccgtttcctgcaaatgattcatctattctttttctccttcttcaaagataactctgtaagcacttaaggaggggaaagtcattaagaaaagtggaatctggagttattaggatgagatagagcagattaaacagtctggaatttcacaaagcaaacagcacagggtgcggaccctgggcccgtctctctcctgctggtgcatcatttcacaggttatcatccttcatgaacaggtcaacaaaaatggccacaggtaaacatgagcatatgagttgctaaagagaaagaaagacagagaacagcagaagtcaggaggattctggattttccaactggagcctctgtgcatcttatccagcatcacagacagtgtctgtcgctaagtgatgccaaaggttttacaccaatgaatgggatctttgtgacgttttcccaataacagaccaaaaagctgccactaaaatcatgcttttaaaggagatcctgaacaatagccagtgaaggtgattatggccatgtccccatgtccatgaggaggtgcttggtgggtatttgttgaattgcatcaaactggagttggatgggactcagttcaaatcctgactctgcttccagcttctggtacattaggcaagttgctaaacctctgggcttaggggataaagacactacctcacagggtggagtgaggagtagaagataatatacgtgaagtacttcatgtggtctttggaaagaggtagatagataggcaaatatcaggtgattacaaatactccttataatttcacttcagtttgtaccgcatctcacaccctgaagctagcagggtaaagagctctcaggagaatgaagaggcctctggcccattctagtatggtctctcccatcaggaggggaaaggcaaatattgcatgggacctggcaataagattgaatgagacataagcaaagtctgatcgcatccttatccccaccccttaacagccactatatcccttgaggcaagtgaagggccccagaagtgagggatcttattgctaagtagatcagacagagttcttaaagattctaatatgttgcctgtattgtctcatctgtaaaatgggtgttaaaatagcactcatatcttgggttatgaagatgaaagaagataatctatgtaaaggactgagcacagggcctgggacagttagtgatagatacatgttagctactgttgctattttgtattccatgttcaatctatgatattgattaacctgtttattgattgctggattttcatttagtaaattaattttcaataaatgattttcacttaagcatttgttcacgcagtcacttcattcatttatttatcataaaacatttatcaaggtcctattctatactgacactatgctgggctcaagagatgctgaggctttttgggcaagaaggttgaagactaggcagggagagagacctgaactaaagcaggagaaggcaaggtgtagtatacacatcatggagacatgtataaagcattcctggaacccagaggaaccaggaagtgctgctcataaaagatgctttttgaactagatcttgaagagtgagtagcccgaggagtttgggcttgcgaattctagataacaagaacagcttgccaaaagggataaagttgtgaaacaaacaaacaaacaaaaaacagggtttggagccaggaggactttggtgtgagtggtgtttggccattctgcctggtgccttcctttgaatttaggttcgaccccctgtgggggccacagagagtcacctgcagctcagtcttaccccaggtgctgggcccaagtctgctcttagaggaaatgtaagtagcttatatcactcagtatcgggtcagctaggctctgggttctgttctgagctcctgctctatttctagctgtgaagtttccacttgattcctgtcacaggctctaccttgtattccagttcaaataactgggctttggcctttgttctttcttctacattctgcctctaagtttctctaagactggaattttgcctttccttatcagtccttcctagaacttcagtccctcccagaacttcagtcccctccttggccctggggcctcactccaggctgcttgatccacttatggttattgcttgctgggttcaccttcttctcctttctgcaggtggaacacagactgatgacaaccacgtgctgagatcccctgttactgcctagacacaaattgctatctaggtcctgtttcactgcctggcagaactgccttgctacttctggtttggctcgccattgcctgaattcctaaactccattctgaatattactagtgaaaaatgcacggcagggcgcagtggctcatgcctgtaaccccagccctttgggaggctgaggcaggtgactcacctgaggtcaggagttcgagaccagcctggc

SEQ ID NO: 3766 - DNA, 14119 bp, Homo sapiens
agagtgcccctcagtcatccgtaccaaaaggaacagttaaagctgtttctcactttgacattttgtacatcgagcagaatatcaggaaaccaaaaccgagacctggcagcccaacttgagacacaaaactcctggtatcctgtgcaacgaagtgtggaatataaagtggagaagtaaaaattagagcaaggcttatggccagaaatgaatgaaattcataatgaaggtattctgaggaaatatgatcttactctcaaagtctcaacaataccctgggtgataacaactggctctcaaggaacaagatagctcccaagcaactccagtgcccaggaaagatggtgaagagatctttgcagacaatctatcagttactggggcagaaaaatcattgtgactagtcatcttcatacgatagcttaaaccaacagactgagaatttatagtgtagcgaagggcagtctaatgcagtagttacttggatccactcttgctgttttgtgaccctgggcaatccagttaacctcccccatatattagctttctaatgtataaaatggagatgacaatggtatctacctcattgaatggtgcaaattaagcaaattcatgaatgtaagatgcttagaggacatccgacacatgagtgcaggacaaatgttggcttttattcaattctaggtccacaaacaaaactttacaaaataaagaggtttttgttgtttttcttttctctctctctctctctcttttttttttttttttcatcatctcaagaaatcaaaggcatgcacctggaaaaagaaaacacacttttgaagtcttctaatcactagggctctgtattttgttgcagtcctatagtgtgggtatttaaagaataaggccaggcaactctgtctctagtctttgttcattcatttgatgcgtccttgagcaccttactaagcaccagtcaatgttgtggacaatggggatatagcatgatgaagccagaaaggatactgccaaaaaggcatacattaaactcataattacacccaaatttaccaaatacaggatccttctttgctaccacaaaattcttaatggctttaagtctcaactttctcatctgtaaactaagggcaataacagctgctccttctgtatgttgctgtgagaggaaataaaatcgtctttataacaaaactttgtgagagctgaaaaagtgtttgaataaatgcattcatgatattaacacttccatttggctgctgagataggttcacttagaagtattcataaatctatcaaggtagggaatgaatcatgaatcacgtcacagagcttaggtggaaacttattccgtgactacgattcctcttaggtgtactgaacataagctctcctaaaaacaaagcctgtacataaaaattaaatttagtataagcaatttgaaaactgaagaaaagaaatgttcacccttttctgagatatttattttatcctcagagaaagaatgaaataaaatgcaatgtcttttgccactctcctcataaattctgtctgtctaaattcctagacacaacaatgacagaattcatgtaaatatacctaacctgagaggtcagatttggggacctcatggagtggtgcatgggagtctgcccagctgctgaccacactcagtgagtgtatgaaaccaaatatccatccatgaccggtcaacatggaaaccctcattgaagaaataactactttgctaaaggagcaggttatttcaagtatttcattgatttcagctctcaagtattcaacaatttttaattttaaaacaaatttaaatttaaaaataatttaataaattaatattttgaaagagaatgctcccagcttgcatatgaaatttcagttttccttatttcagagggcacacctttccttagtagaaatgtagtgttaaccacagcttataaagtacatgttttagatttgtttcaaagctagtattttaataaaatatataatataaaataactaatataacactgaaataaattacatccatcttcctacaaagtagtttatagcttaatgtgaaatatctctctccccaattcccactttaaatattgaaattgcttgcacatgctcagtgcttcacattcttacctcttagtagttagtacttagctgttgtttattataaaaaaacaaaatcaccaaatagctgtcttgatttttttttgcatttcaaagtcagctaattaatttccaataaataaaacagtgaaagcctagtaatagagcacagattttcctacttttaagtaaatttcttgcttttcattgcactgaaatattattttatccaactgctttgtccaccctggcaatcagtataactagagtgatattatttccctgtttgattttatacaatggtaggccattggatcaagtgttctgtgacctgtttatcgttgcttattcctggatagaattcagtagagaaaattcagaaactataatgatggacttacatcaaactattgcactcaaactatttaggaaactgtctgaagtctgagagtgtagttcattatttgtgcttgtctcacaagggcacaatattctatgtcattttttatatcatagaaaaggttaggtttgaaaacttagcattacaaatgtcacatttacttccagtaggaaatgtgcaacaatatgtgacaaaactgaataaaatgttgaaacatgttttccttttgttttactttactcatttttgtaatacaacactggttactggaaaatgccttacagctttattcaaaacacatgttcaaagatttgaatgaaaaaacttcgactctctctggaacatctaaccgatacatcatttgtgtgccttaaattttttcttactgtcaggaacacttttatgtctttaagatttatttaaactaggttattatataatgaagcttgtcagatcataggaacaaagtcaaacaagatgtgctatatcaaagtataacatttaacatatagatttaagtatacatatcaagtacaacgcaatcaagcaaagtttaatctgaaaatgcaaatgcttcagattattaaagccacatctgtcctttgaagcacaatttagattgtttatcaaaaagctatgtgtaattattctctcccaccctagactttgtaacaacagatttcttaagaacatttcaatttcacttcagagttgggattttaaatacttaaccaccaaaggacacgagaacacaaacggaaaattaaaaatctttacaatgtattctattataattgctgttttgttggtgaatcagggtaatatttcaaaaagcattactccgagttttaggaagaaattcccaatgcttttagaaatcaattccacatagttctagcatcaaaaatgtgtccttaaacatattattacaatttttcatataaagctttatattacatttcactctctgccttggccaacaggaaacatcaaaggcaacattttaggtagtaaagagaaattccaaaacactagggacagagctttgaattttaagtacttgaagttcccaggccttaaatttatataaaaaataagtaagtctgttgtattctcttatgtacgttcattgacctataaaattctcttaaatacacccattggtctatccattgaaaagatacatatactgtcctaggtaatattattaagtctgaacacttgagaaggaactgaatcactgcactattatcctagagcagacctaatttctgtgcaaaagtatgatctttcattttatccataagaactgaatatgacagaaatgctgggctctcatttacaaaatccacttaaatatgagggctcattttagcttataacagctcacatctattataatctcagaaagcagcaataacttgtaaaattaattggagtctctgttatctataggaaaatttaaaattaaatatgtattttaaaaaacaataaaagagaggcttattgaacttgaaagtagagattcactgcttgtcaatctagatcatgaaggattcctgtacaaatgcaggtagtaacaaggtcacggtagctcaaactctgcttgtgcattcaaattcaatccagaaacctccaactgctaaaaccataaacgttctatatattatcgcctcaatattttacatttaatgtatcaattataatccggcttcagtaatcaacatgggagagaaggaaagtggtggctaaaaaaacttcagcttaacttaaaacaattttttcaaatggattaactcattcctctctgatgccataggcgaagcaaacaaaaaactggatgatagcactaattatatattttttaaagaaactggtatcaacagtttgactgaaaggttaaaggggaaacataattctataatatcataaactctgtcatagcatattcagaaaaggaaattgttgacaaatgtaattgaggcaagtgctttatttcctttccctaaatgtagagagagcttgattgtatttctgaaactttaatgcaaactctacagtaaagtgaagaagggcttggaatgaaacacagtatagtttctccatgagaaacaattagtatgccgaagagcttatgtcgaaggaaacttctgaaatcacaaagcccattaagacacaaactggctgtggatctagaaatactagggatttcagggtaaggagggagcaggataaaagagaaggggggcggggcaaagagctcaattaacacacagccatttgagtagggactgctcttttcatgtccctcccattttacaaatgcccagaggcatttctgcagtggaacacctttgcaaattctaaaaataaagcaataaactttaactcctcaactttcataatattttgacagattctcccaactttaatttcctttttgtaatggtagtgtgatttgcattatgttacattgcttcattttgccattaaaaaaaaaaagttaatctcaagagaactgctctggaaattatgcgctactttaatagacatcccctcagaatggaataaaaataattttctctttgtaatcttatcctgtaatggttggtacgatctcaccataggcctgttttggaagcaaggtttgaattttcttaaagaaattttgaatgttattcttagaacagcttcttgtttctcacaaaaatcatttatgtaaagggaaggagcacactgatttatttaaaatttggggaaattgcgaaccaaaaaaaaaatgcattccaatttacaagttacttgattctgtcatatgaagtggcagtgtccttttcctttcctgcttaaaaaagcagctctggcctgtggaaggcaagtggcaaatgtaagctttatggcaaaacccactcaatgatttaaaaatgctccaggaacactgtgttggaaagaaatcagtggtactgaggtgtgaatggaggatgctctttaaaggaagcaatttgaccttttgttaaaaaaaaaaaaaaagtcagtatctctattttgccttttgtacccaaataaagctcatttattctgaacttttctgtgatttgaatttctacctattaggctttcctatattgcgatatgagtgtccaggagccaggacagagaataagacacattttttaaaaagggataggctagaaggatagcactggaaatgacattaacagacataaggggaataacatggaatgtgatagctagcaagctataaagtcactaagggggatgagactgacgttcaataggataagaaagcagtcctgaacataaaatttcttatcactactcttagctcactgtgtaaataaccccacacttctagtacacctcaaacttctctgctatctaaggaaggagtataatcatttctccccaggttgatcataacctgagcttcttcctatgactgcaagaaaatctccataaccttgggcacaacagagatgttacccaagagtagtcctgctgtacgacatcaattagaatgactgaggcagcctcctccacagcctttgttttctagatttttcgtgcctacagaaattccccatgaagattccactattccacacttcactgataaggaatgacaaactagagcactgcttttgtttctgagtttcaatttccgaaatacgaatagcatagtaatgtatgtaactgtaactcatcaagttctatatattttttaattcatatttttaaatagtgaattttcaattatcttcaaaggatcatatgccctacagtttatttctgacaaatcatctgttttattatttctgacatccttacctattctgcttaattaaatgatttatttacataaacgggatatttgcttaatctaatccaggattttaagagggagaaatgctttaggaataaaaataatttcccttgcatatatgaacaaacaaatagtacttctgtgtgaaggttgataaaaattaactcccagaataaagtggaagcaaaactgatgagagggacaggatggaaaaagtaggcagtttccagccttttgtgagtcacatattaactctgtggttaccgtgtctcaagaattttcaggttacagatactctccaatgaacaattaaaacccttgccaaagccaaatgtaaacgactttgaaaaaagttttatactcctcaatggcagacacacacacaaaaaacctgaagagtagaacagagtgactaattcaccagcacagcatttcgagaaacaagtgaactgcttgttatactgatgttttctccaatcctccacaaagcatatatgcacacaggaagcaattataagctacagaactcataatacattttgaaaaagggatatacatagtacattacttgtttgcctaaaagccatcagaatttaaggccaggcatggtggctcactcctgtaatccccacactttggggaactgaggacaagagatcatatgaggccaggagtttgagaccagtctgggcaacatagataaacccctgtctctacaaaactaatttaaaaatatccaggcatggtggtacacacctgtggtaccagctacttcgtaggctcaaccagaggattgcttgagcctgggaggttgaggctgcagtaagccattatcttgtcactgcattccagtctgggtgacagagtaagaccctgtctcaaaacaaaaacaaaaacaaaaacatacacacacacatgctgaaccaaacaaaactcccaattgacaagatgaaacagtgtgaagtggcctaagattcttattcacagttgcataacaggctccttgatctgcaatatgtttggcagcaatagcatgaacagatactgtgcaagttacaaattaactagaacatcattaactggtgctaagaagacagaacctggtgttatctttagtaaatgggtaaataaggaatttttttttgagctatggctttgccataatgccacaatgaatgagccacaatcatataattgcttcttctcaaagaatattcaatgggctacagtcaggtttttttgtttttgttttttttgagatggagtctggctctgtcacccaggctcgagtgcagtggcgtgatcccagctcactgcaacttccacctcccgggttcaagtgattctcctgcctcagcctcccaagtagctggaagctcccaagtagcttccaccagataccctaaatcaggcttccgccaccaaacctggctaatttttgtatttttagtagagacggggtttcaccatgttggccaggctggtcttgaactcctgaactcaggtgatctgcccactttagcctcccaaagtgctgggattacaagggtgagccaccgtgcccagcctggtttgtttttttaaaaccaaccactatgccatatcaatgctacccattgactacagtccagcttgtttgaaagtgtctggaaaagtaaatctctcaattaatttcataaaaggctattactgaaatcagcatgaatatttccatgtccagccttggatatgctttggtctttgacagcttgactatctctatgattgggcaacaaggacagggttttaaaggacaatgtctttttactctttgcttctctagccacaaggaatactaacttcaagaacttcctaagcacttctctttgatgcatttgccttttttattgttttagcagaattattagcctttctactctcagggtagaacattctatgaatcagaggacttcaatcatacttgctttatacttaatgtcctttctagtctttgactaagacattgaaataagaaataatgcaatgcacaatcaaaataattctatgcaagatctgatagctatcagaatttgaaaatatgaaatgctgtttgcttatccttgtattccatttatttaaaacatttggtgcatgtttttacatattaagaacataattatatatattagcatataatttcataaaagatcattgcctatcttaccttattgttgccttatttgtgaatgttatgtatataacaggaataacaagtacttgtgtatcattagaatcagacattagtttggtttaaaaaataagtccttttgtttcatctggtcaatacagttttattaaaggctaatcatttaaggtattttaatcttagccgcagaaatggaagaatctttctataaaatatacctgtagcagtatataatatttaagaacaacaaaaggtaaacaaatgtaaccaaatggataaagggggctgcaaaattaaagttagaaactaacatatcaatgattcatattctctatgccacaagacatgaaaaaaacattagtttttactactctgtattctggggacattcctttaagattgcatttaagatgattttagagacaataagcatttctttagatggagttgatatttagtttctaacttttcagagtttatttctaggcatagagtctttaactgtgggtagcacttatctgtacaacatagtgttctgcttctgtgattaacgcaaatatcacgtaaagatggagctgatgtgagccagggtctagagccctcaaaggcactaatgtatttgtttgcagagtgtgatgcaatttcatggggaatcaggtcaatccaacttttcagcacctatctacctcctcctcaggctgtagggtattgtattagtccattcttgtgctgctatacagaagcgcctgagattgggtaatttataaagatcagaggtttaattgactcaaagtttcacagggctggggaggcctcaagaaacttacaattgtggaagaaggggaagcgaacatatccttcttcacatgatgccaggaaggagaagtgacaagcaaagagggaaaagccgcttataaagccatcagatatcttgtgagaactcacttactatcatgagaacagcagcattggggtaaccgcccccatgattcaattacctcccactgggtccctcccaggacatgtgaagattatgggaagtataattcaaaatgagatttgggcagggatatagccataccatatcattctgccctgacccctcccaaatctcatgccctcacatttcaaaacacaatcatgacttcccaacagttccccaatgtcttatccagcattaacccaaaagtccaagtccaaagtctcatctgaaacaaggcaagtcccttctgcctacaagcctgtaaaatcaaaagcaagctagttacttcctagatacaatggaggtgtagccattgggtatatacacgtgttcaaaatggaagaaattggccaaaacaaaattacaggccccatgcaagtccgaaatccactagggcagccaaatatcaatgctctgaaatgatctcttttgactccatgtgtcacaagtaggtcatgctgatgcaagaggtgggctcccatggccttgggcagctccacccctgtggtttgcagggtacagctctgctcccagctgccttcatggtctggcactgagtgtctgcagtttttctaggcaactggtgcaagctgtcagtggatctaccattctggggtctagaggacgatggcctttttctcacagctccactaggcagcctcattggggaactctttgtgggggggctcctaccgcacatttcccttctgcattgccctagcagaggttctcaatgagggctcaaccactgcagaaaacatgtgcctgaacatccatgcatttccacacatcctctgtaatctaggccaatgttcccaaacctcaattcttgacttctgtgaaccttcaggcccaacaccacgtggaagccaccaagtcttggggcttgcaccctctgaagcaacagcctgagctctaagttggcccctttaagccacagctgaaacacaggtcagcaagtcttgagactgcacaaagcagcaaggccctgggtccagcccaggaaaccattttttcttcctaggcctctgggcctgtgatggaggggctgctgtgaaggcctctgacataccctggagacattttccccattgtctcagcaattaaaatttgcctccttgttacttatgcaaatttctgcaggaggcttgaatttcccctcagaaaattggttttccttttgtattgcattgtcaggctgcaaattttctgaacttttatgctctcttcccttttaaacataagtgccaattccaaaccatgtctttgtgactacataaaactgaatgcttttaacaacacccaagtcacctcttgaatgctttgctgcttagaaatttcttccaccagataccctaaatcatctctctcaaggtcaaagttccacagatctctagggctggggcaaatgccaccagtctctttgctaaaacacagcaagagtcacccttattccaattcccaacaagttcctcatctccatctgagatcagctaagcctggacttcattgtccatatcactatcagcatgttactcaaagccattcaacaagtctctaggaagttccaaagtttcccacatcttcctgtcttctgagccttccaaactgttccaacctctgcctgttacccagttccaaagtttcttccacatttttcagtgtctttacagcagtgccccactctactggtaccaatttactgtattagtccattctcatattgttataaagaactgcccaagactgggcaatttataaaggaaaggggattaattgactcatagttccacatggctgggaaggccttgggaaacttataatcctggtggaaggggaagaaaacatgttcttcttcccatgatggcgggaaggagaagtgccaagcaaagagggaaatgccccttataaaactatcagatctcatgagaattcactcactatcatgagaacagcagcatgagggtaaccactcctatgattcaattacctcccaccaggtccctcccatgagacttggggattatgggaactgcaatttaagatgagatttgagtgaggacacagccaaaccatatcaggcatgcactacacatcagtttccctgtcaaaaagcagttattattattttttctccatgttttttcatatattcagaagagtagggaagaagaaacaaaaagcaaagcatccttaattaaagcattcaagatgatagctgatctttcacttgtgttgaccaaatggcttatgcttatttcaatcactgccatctatcagtcttaattagcatctatccaataaaacacttcacttctgaaatatattaattactgttttatgtctttggttcctattatcctagctgtacaaccacaaccataaaaacatggcattttccagcacaaagggatagtatatgttatgtatgatttatgtaagtttcattaacatttagaggagtggtctggaataagctgctgttctctgactttatgccctaaggagttcttcagttttcggcactagaatcaagtctttcttagtgagacaatgatgaaaagctttctgctatgggaatttcaaaatcattcatgttataagtggcaaatccaaataaaaaaagaagactctaggtttagatgaaatactctgctctatacattttctaaccacagaaaccagggaacattcctttttgtagtatttgtgagtaatgcagggaatttagagtcatttatttccctgctagcatttaaatgaataattttagatcattttaataatctgataatgtgaagtgctgtaaatggcagagttttctgttatatttactgataattgttcacttggattgtcaagatcatagtgttagaacctcagaagttttgttatttaactttgtttaggactataaaaaaaattcactgagaccatgagaaaattctctgggatggatggatggatggatggataaaataaaagggtaaatggaaaactttctagagaaaaaaaattcacagcactttgcaagctctttctagcaatgatactattatagaactgggttatgcactttacttctctcatattgtagcttaaatttttttcttgttccactgtcagtgagatgagagaacagattactgttctgtaagagtagtgaaagtgtctgtatttaaaagtgggcagaagtgagtaatattatgttcaatggtgttgcaaactaaccagaattgaattacacttattaaaatattcagaaaaaaattatttctgttatttacacatggaatataaggcaaatttcggtttcaaatgtacaaaatgtaaagaagtaaaaacaaattggagagggcaggtgggaatattttaaaagctgtgcaagtggatttaaaactctacttaagagactagagataaatattctgtttgctcacaagttataaaagtagcaaaccatgatggtgcaggcttctcccatcagtaagaaaagagaaaaaaattatgggttcccagaatcaagaagacattaaaattaagtgtagaatgaactttctttcttcctgaacaaaaatatggaaagctaaggatgataatatttactgcaggacttttaagctctaagtgcataaaacagaggattaagtgaaaaaccaggttcataaaatgcattagtgttattttaaaagaatgccatagcaaaagtcattattttataaacttttcttgccataaaacacacatctagttatgtactggttataaagttataatgaaggtgaataacttctagggatgatggaaggtaattttactatatatttttgaatcacagttatatatatatatatatatatatatatatatatatatatttgttatcaggaacaaaattatactcagacatgcttctttcacattttccttccttgtaaaacctggatcacttgctactgcaattagttgatgccaatttgaaattcttcttggaaactatcataactgtgtaagcacctttaatttactgcacagaaaaacggaagccatttaagtttcacgaaaattgaaaagaaagcagttcagtctcagtaaatgtatggtaatatgctgaatacaatttttttaaagaaatgttaatctgagattccattatttcatttaatagtacagaaagcttattaagctaagaataattatactaaatagtaaaccacagacataaactttagcagtgctatctcgtttagcagtgctatctcgacgattacaatttaataccaggaatgtatcatgtaatgaatgcatattgaagatagtccatgtaaggcttcatactatcaattacaaaacaaaagtagtctcccatttcactcctatgtgggaggagttctacatccatcacattttccacatttaccatctgtgataagttctagctcaataaacttgaagttcaataaacttgaagcacagaaagtaagcaacaaagaacaaaagaaaacagcaaactaaattgtaaattatcaaatatacaacatgctttaccaaaaagaggtgttcagaaaatatactttctttttt

SEQ ID NO: 3767 - DNA, 3606 bp, Homo sapiens
agagtccctctccttccgggaagcccgcggccgccccggcctccacgcaagcacccgagcgttactttcgtttccgcggcaaacgtctggaggcccgggtgagggaagaagcggcggcggagggttggggattactccgacgccgcggcagccttgcccgggcgtgctgggggagggcgcgcgaaccccgaccaggggggtcaccgggactgagcccggcggcctccggaatgttccccgcgcggtgccagtccgctcaccgcgcccttctccgtggccgcgccgtccagccaagtcctgccgcgctccgtcggccccgcccggatggccgcgctctggcgccccagctgtgggtcccctggagtcgccgcgctccggcagctggcccgccgtccgcgtcgagcgcgcccggctggagggcgtggactgttcgcgctgcctcctccccctgccccggcccttgccggggaggaggaccgcgagagcgccgccccgccgctcgtgggacctcgcgcccggggtctgagtcccggagctctcttgcgggctagaggatcgcggactttgttttcaagcgagtggggcggcctacgtaaaagaggaaaccgaaacctccgcgcgcacgagagggagaagggtctggagggaagcactgggtggattacagcgggggcgctatccggaggattcagagctctgcgggttagcataggcaagttagcattcctctaccttcatctgtaaagtggggctgttgaggaggaaatgtgattattttgcagccctttaaaatggtaattgtgaagtctcgagcaaagttggaactgcatgctattcatgtatattaaaaatcaaataataaaattatatgcacatcaggccgggcgcggttgttcacgcctgtaatcccagcactttgggaagccaaggcgggcggatcacttgaggtcagcagttcgagaccagcctggccaacatggtgaaaccccatctctactaaaaaatacaaaaatcaactgggcgtggtggcgggcaccagcaatcccagctactcgggaggctgaggcaggagaatcccttgaacctgggaggtggagattgtagtgagccgagatcgcgccactgcactccagcctgggtgacaagagcaagattccgtctcaaaaggaaaaaaaaaaaaagcacaacaggattacatactgtgaaaagatatgtatgtcaagagaactagccacgttcacaacacgagccacagactgggagaaaatatttgcaaaagacatatctgataaagcactgtgacccaaaatataccaaaaaaaaccctcttaaaatgcaacaatatgaaaatgtacaacttgattaaaggcgggcaaaagctctgaacatacacctcaccatatgtatatgcatatgaaaagatgctcaacatcatgtcattaaagaattgcaatttaaaaaaacaaatactattacacatttattagaatggctaaaattcagaacactgacaacaacaaatgttgatgaggatctggagcacaaggaactcccatacattcctagtgggaatgcctaatgttagagtctggaagacattttggcaatttcttaaccaagctcttcttaccataagatgaagcaactccacaccttggtatttacccaaacgagttgaaagcttatgcccatacaaacacctgtacaagaatgtctatagcagctttattcataattgccaaaacttgagggcatccaagatatcacttaatgggtggacagataagctgtggtacatctatacaatggaatattaagtgctaaaaagaaatgagctctgaagccacaaaaaaaaaaaaaaaaaaaaaaatcctggagcaatcctaaatgtataaatctaagtgaaagaagccaatctgagaagactacataatgcatgattccaactatgtgacattctggaaaaggaaaaactacggagatagtaaaaaagatcagcggctgccagggatttgcagggaaggagggatggataggtgaggcacaagggatttttagggcagtggagtctgacgttacagggttgggtacatctctatacatttgtcaaatgtatcttgaatatacacaaagagcaaaacctaacaaactccggactttggctgataatgtatatgttttatccatattggttcatttttgtaaccatgaatctatgttggtttatcaggtgtgacaaatattccacagtaatgcaggatgttgatggtaggggaggctgtacagtccaggatgtttgtggaaggggatattttctttctgcttagttttgctgtaaaccaaaacagctctaaaacaaagtctattcattattttttaaaagatgtacacatatcaaaaaagacgaaaggcagagctattcactcagcaaagctttctatctactgtatgccaagcaggtactagatacaagagcatctggtgatagatacaagaaatacaaaaaggaattcattccttcagtaaatatttactgagcacctgttctaggcactgaagactcggttgtgaattaaacacaaaaaatctctatgttctggccgtgtgtagtggctcacacctgtaatcctagcactttgggaggccaagtcgggcggattgcctgagctcaggggttccggaccagcctggcaaacatgatgaaacctcgtctctactaaaaatacaaaaattagctgggcgtggtggtgcatgcctgtagacccagctactcaggaggctgaggcgggagaattgcttgaacccagaaggcggaggttgcagtgagccaagattgctccagcctgggtgacagagccagactccgtctcaaaaaacaataaaaaataaaaaactccacgttccattcgtggagcttgcattctaatggggaagacaaaaagttattgcccatcactgtcctctagacatcatgtgaccttgggaggttggaaatgcgttgtttttgcttcattttgtgttcagtgttttaactcagaaacatctatttgggagctttactcattactcccagcaaaagccatgagtgtagactgtgcatgagatgaaggaactggtccttgcagaacaccagaatggaaaaggcaagaaacagcccaaggtgaggaaagaaaaccagcgagaacaaagagctggtactatctctgaagcccgtggaggccaaagtgtgaatatgagggggtaggtctcttggccacaggcctgaaaccaaatgaacccccacccccaggctgcagttcccagtgcacttggaaatgagaccctgactcctccaggtgagcctgggagacctccctgactcctttccatctccccctcctcccccacacccatctccaaggcctgccctctacgcccacatttcttcccactttggatcctgtgcctggtctaatgcccaggccccctcccgagcctctggtctccctagagccactccccactgtcgggacacctcatctgtgctccccaaaacgccacgcaaagcactggagagccttggacaatgaacacaacccgcacccccagccacccccgccacagccg

SEQ ID NO: 3768 - DNA, 7891 bp, Homo sapiens
aatgttgctctccctggagctgggctgcaggaagtctgggcccccggctcgcactcccggaccccgcaccaacctccagggtcgctctccaatcttaaccaggtttgctccctgagcgtacccaggtgctacagcatcagcttcccttgccgcttcctgcggctgaagggatggtccgaccaaagcctcctgccctggggcagccgatgccactgcatgctttttcctgcgcttgggcttcacggtgccacggatattggccggcttgctgcgcttggagcgtagggtaatgtacaccacattgggctgcagagtggacccattgccctgggactctggaggggccagggtaccatccaggggtatctcagggaaggatggctcggcggtgtcgcggctgcgatgtggccccttctcagccgcctgtccatgctggagagaggccctccccacctggctcaccaggaagcccaagtagatggcacacgcagtgcccagcagaaggtttctccgggtccttggacgccggctgctccagagcttacgcacccgcgggacgcacagggagcagatgaaccagtttatgagctgccccggcttgtctggacagctgccgcgtccgcttcgggatataagtggtctccagtgggcagaggtggaaggaaagggttggtgatgaagctgggaatgtttctgacacaacaaaccttttaaattatcagtctccccaaggagaaatgcggcttgtttctgggaatgaatggatacagagttaactgagtcacaatttcaaaccatttaagttcctctacaagagtcaagaaaaaaagtaatcatttcctttcataaatatcaccactaaatgtttttaaaaataaaatttaaaagcatgcaaacgagatagatgtatagatttgatagtcacttgaaagtagtgaaaacaagccacaaaaatccaagagtgttttataacttgtacctagagtcatttaagttgactctgaagcaaaagcgttaaaatgtgacaaacctgggcttttcctttttgaaattcagaaagaacttaagacaagtaatagataattttttaatactctatacctataccatttttattttttaaagtcctgaattaactaagtacaagcagcaagtattaacaataaaatttagaaacatattctcttagtctaaaggtacaaattgtacttcatattaataatatgttccattagcttacattgttagtataatacaaagccataaatgtccatatatcttggaagcagttgcatttattctgtttctctctctctctctctttctctctctctcacacacatacacacacacaacacaacacaactctgactgctttttatttcttttctttccaccgaagtcagctgaaagaaaataaaagcatctctagttctgttttttcactattaaaaagaaaaagaagaaactcgtaagcaaccttacttacacagctggccccatgcttggctccaggaagaatgtaatccttgactctaatgcaaagaacttttaaaggctgaggcatgtaagtagaacatatttcatggtcaagagtgttccacatttcaaacatttcagttcagctttaaaagctcccttgaaaactactgattgcaaagcaaaacttggaaactgactgctgcatggttttaagagatacaaagcttttaaaaacaatagttaacaaaataaactttaattttaaattcggaaaaaagaaatgccgtagagaatcagttttcattcaaataaatttccacttatttttaacccctgggagccctctagtgtcctgttcgcaaacagactcagaaatgtcagtctcatgaagttcaaaagatcgagaatgtttgctatcttggtggagcagccgcagccaagcaagtaacttgtaaaatgaggaatgccatcacccctcgagtgtccatcccacataacttggggttagagcacaagcgttcccaggaactactcaccttaccatcttggccgtttcatttgtcttccaccagttctggaaagagaaggcctagaagttcagaaaaaaaggtgtgtcacttgctgtgactgtgtggcagcttgcccatctcctgagagcccttgggaaagtgaaggacaatatataaggactccaatcacttaaaagctaagtattaagtttttccttgccactgctgacccaggtttgttgcatagattgcagacctggagatggataccttgttcttggttcagtgctgcacagactcctccactgggggaccctatcccttgctcctcatagtcctgatttctaggacccataaccctattataattaaaatcccagcattagcataggttcctggctacaacctttgtcctacttattgtatggaatttgctaatacctttgctatccattccaacaccaggcctggacagcaccaagctgccctgcctgcagctgaaaaacttttaacttaatagtctttgaagttttgtcatagaagtgttaaatagtactctatactgtatctgtcttttgaactgtatgtaaaagaagttacattgaatatattttatagaaatatgtgcactttttatctggcactttattgctcacccctaaggacatcattcctgttgacctaaactagtacatctatttgcagtaggaaaagtgcttttggagaaaatcacctgtctcctcagaactggtcttacaagtctgtgaagtaacactatgtgccagcctaatcactcatatatgacctcaagagaacaccaaataagcatatttccagcaggaaatgaccagtgctttggttaagaatgcacattatactgcagttctttggggaatgaagccacccttgactgaggtattatgccaactctcaccctgtgaatccactgactggggaacattgtttaagaaaatcacatggctgtgccaacaagcaaggagacacggcacagaagacagaggcagaagcagctttattgaaaaacagagcatgagtagaacgacttcaaatcccatatggcaccacagtgagaagtaacttcctctgagcttcttagagaatccaacaatgtcctgcttccttggggagctgcagccatgggcacatgggaatagggcttccaccaagagtcccgtcagtcacagcaacaggaggtcttcctcagacaactttgatgatagtggttgttagccagagcaagctagaaccagaaagaaaaactatgaagatgccacagtgggagtctgagcaccttgaggcctcctgttggaaactggcaaacctaactgtgggacacttggatgctgagttctggtaaacatgctgtcggaggcacggtaatttagtcattaacatttaaaaacgatctaattctatatacatactctgttgaagacttcttccaaccaccttgtattataaatttaaaatatgaaatacaaactctttatgtgtcttgactcagattacctaggaagggacagtgacctattcatcaatgtttagaattagagtaagttatagaatatagtctgagaaaattacttggaccaagaaagcaatgtccctgacattcatcaatctagaaccagagctgcagattaagctaggtgcaaatttatcagaaaacaatatttttcccaaatacatattgcagccataaaatgccctaaaaacccagttcttagagggactattgcttacttactgagaaattgtattctctgaaatcatagactatgagatgcattgctgtttaaaattattgcaataagaatgaaacatctcactcttatctggaggagttaagtcattgtgatcagtgaagccttgatttaagctcctgtgcaaagcttcagagaatgggtctcaggacacaacatttgacatctattttgacttcatttccaagaaaataggactgctatggtttgaatgtttgtctccctcaaaccaaggtgtcggaggtggggcctaatgggagacgtttgggttatcagggagggtccctcatgaatagattaatgctctccctgggggtagggaacagttagtgagttcttgctttattcattctcaagagagctggttgttaaatagagcctggcgcctccctcctccctccttgctttctctctcaccgtatgatcttagcacattacacctcccctcaccttctgccatgagtggaagcagcctgagcctctcaccaggagcagatgctggtgccatgcttcttgtacagcccacagagcagtgagccaaataaacctcttttccttagagattgcgcagcctcagatgttcctctagagcaacacaaaatggactaagacaagaaccataggtccatttcacagtacagagctgaggttgaccccttttatacacaaccatactttcttagagcccatagaatatcatttcatttacatcacacctaaattccactctttagcaaaatcttatgttaaccctatattttcctttgtttgatgagataccccacaattgctctgttgtgcagtccccacactgcaatgagtcagtaaactcaattggtttgtttacaggttgtccctggtggttttaggctgattgggctaagacaaaccacatcttattttttaaatgtctcctttaagcaaatgttattatctgtattttactctattccataagcagaagtgacaaagtagtctaattttaccaaaagatgcttatagcataaaactttctatgctgtaaacatagaaagtacttgaaatcaaaaagaaaaaattactgtccttaaaatgaaaaaaaatatacacacagagttggggttttttcactttactaaagctcaggctgtgcttattacaatagaacagtgatcaaaactacagctttttttcctcctttataatatgaccaaacaagggttagtggcaatgagcactgcatcacttaaaagatactgaaaaacttgaaatactgatgaacctctaacaaacaccttcttcccaatcctcactcttgacctatgaccttgtttccttttcactgagaaacagagaaaaaattagatgagaatgtgtacaagctctcaccacaagatcttcctacctcctctaactgcacctatatactattactatcaaagatccctctgtgtccctaacaaaggctatttcctctccttttgcactaaattccatatactcatgcctatggggagacattgttccagtaattatctcctttcctctgcttgggtcagcctctaggatggacccccatgatccccacctcctggtatccgcgccatgatgcaatctgcttacagcctaaatcaggatgaaccatatgactcatagaacactgcagaaggcatgatgtgtgacttcagatgtgaagtcatagaggacaaggacacagccaccttcttggatttctcactctgtggaagggcagtgacattccatgagacaagcagtcctgtggtgaggcccatgtcaagaaggcctgagatctcccaccatcagctacagccaatttgtcagtcacgtgagtaaaccacctgggacgtgaatcctctcgacttaaccacctcttcaggtggccagagccctagcccaggtctgactgcaacctgatgagaaaccctgagtaggaagacctgcttgagctgctcccaaattattgatccacagacactatgagagataatacgtacttagtgttcttttaacccactacattttggttggctgtatttattaccctgtaacagatgactaatacatctcctgtgatcaaaacacttcagaggttccccatttctctcagagaaatatccaaagtccataaggcctgtgaggcccctcacattcttcccacccccattacctctctaactccattttctaccactctccttctttccactctctccccactcccactccctcctccaggccttcactgaaatgtctccctctcagtgaggacttcctttcctaaactgcagtacccccaacctacacacacacacacacacacacacacacacacacacagagtctctagtcttcctagctccttaatttttttttccttagcacatatcactatttcatataccatatttgtcatctattttctggtttccctttctcagatgtaagctaagttggtgcaggggtttttgtctgttcccaatgtctagaagagtgtctgatttacagtagacactccatgaaatttgtcaaatgaatacaccagtgttaagagtataagagtgtaatagtacctttaaaaatgcctcaaagataaatcttttgatttatctttatttttagatctctacccccactttagccacttctgaaatttactactagaaaaaccttttctttcgtgaagaactgtctcacaaaaatagcagttaaataggaagctatcctaacccactgtttgccttttcccttgtgaaactcagaccaaaattgaaagtcatctattgtaactatgtgttcttggcatctaaactctgttttgtttcatcttgactttcttaatttcctaggttttttcctttgttcctattattttattgtttttattctatattgcttcaaagactttatgaaattaagtaaattataaatacaaatataagtaagtatactagtcttttcttaagctcacaacaaattattacaggtatctttgattcagtttattataattacagaattgtaaacttttcaaggaataaatctttaaaatcaacaaaggtaatatttttattatttattgggatattcttttttttcttttttttttctttttttttgagacagagtatcgctttgtcacccaggttggagtgcagtggctcaatctcagctcacctcccagtttcaagcgattctcctgcctcagcctcccaagcagctgggattacaggcgccgccaccacgcttggctaattttttgtatttttagtagacacgcggtttcaccgtgttggtcaggctggtcttgaactcctgacctcaagtgatctacccacctcggcttcccaaactgctgggattacaggcataagccactgtgcccaacctggggtattcttattgtaaaacattttacacgaaaaatatactttgaatcaggagagaaacatttcaacacagcatcattatttctcagtaaaatggcacatttttcctaatttcagattattcttggaaaattttgtttgcttctatgatataataaaattctgcttgaaaattacgtgttaaattgattccttctccatttccaaaaaacagaggaagggttattttaaacaataaagtggttgattatgttatccaatgaatcagcaggttttttactgccttcaccagtcatcatttctcattatacacagagatcctcaaaatgagcagcagatacactcagtctgtaggatcatttagcaactcggggaaggagggtaagtagcctagatttttttaaagttcccacacccaaacatctcaaaagatcataaaaagataaacaagtgttcagagattaaatatggaaaatattggtattggttttgattctatagacaaaaataaaataccacttggcagtagatttctcactttttaagtattcttgtatttggtgaatgggtaaaaagatagtcaaatgagttaaatatacatttaaataaatgggcaaatatgtattatcaattatcagttatcaaccccatcaattatttcatcatatctaaatacatataatatatattcctcggcctgtaaagtaaaccaaccccgtcaataatctca

SEQ ID NO: 3769 - DNA, 545 bp, Homo sapiens
cctgattgtagctcaagctgcagcctctaaacctgctaaaaatcaggaagaaacccctcctctggagggcagatggactgaagtggctacagccagtgtgggtacggaaagcctcccgctgaactgtgatcatgtgacacctgcagaccctgggaagggctgatctgaatcctggcagcaaactcaacctcttcttttgcttggggggcttgtgtttaatacaggtcattgcgatggaagaagtctcagagtctctctcacatcaagaggacagatggggacagggatcctggagcttttcttctcctgtgttctggttgcatacttgaatcccaggaaacagtgtgacacggtgccaatttactgccaaacatgcccggtttgtcaacagagccagacaaggaggagaggagagattcatgccccaaacacaggccagctgaggagggcttcgtcctccttcctttggcccagatgagggagcgccttcccagaagtcacatgaggaaaaaccgtgctcagcttcttgaacggagaatgtccac

SEQ ID NO: 3770 - DNA, 726 bp, Homo sapiens
ccgccctccgaggctgcatccgcggaagcccggctccccgagcgctccggcccggcccggcgccccggacctgagtgcgtccccatgaaggcgcccgggctggcccaggcggccgtggcagaggagaccccggactgggcgcccgagctctgccccagctccgaggcgcggtcgccggagccgcctgccaaccgccttcaagacttcgacacgctggtcaccgtgggaaagcaactagaagccatttgtgtcaaggtaacgtctggagaaacaaaaggtcaggaatggccaacgtccctactggccacagtccagccccaatctgcaagacagagccagccgccccgggggaattcccgcctggtgggactccacgtcaccagcccccagctgctcagggtacagcccctcgtgagaaccgagccacagtcatgtttcctacatcagcctcctgctcaggggtttgtacagagaccactgccagccctctaggtggtccctgcaaagagagtcccagcccccaaggctccaaatggacagggcaccatgttgaccccttcgtcggcctccagtttgccgactgtaacatgtttcatccagttcaggacgtttatttatttccaacttgcatacaaaacatactgagaaactaaaaccatcgttaaaagtgaagacacgttgagacaggtatctcgacctgccaagtataaagctaaagctgagttc

SEQ ID NO: 3771 - DNA, 1802 bp, Homo sapiens
gcgcgtgcgcgcggggcacccgccgccgaccaggcaagccaggcagcaggcgacccaagaccgtccgcggaggagacaagcaagctgtcatgttataagcagccctttgaggggtccatgtgatgtcaaggaatgaagtctctagccaacatttaatgaggaactgaggcccaccaacaaccttgagtgagcttggaagtagctccttcagcatcagttgggtgtcgagatgactactgacagcttgactgcaacttcatgagagtcttctggaccagaaccactcaagtcagggtttccccatgttggtcagcctggtctcaaactcctgacttcaggtgatccacctgcctcagcctcccaaagcgctgggattacagtttcagttatctacggccaactgggtaaaccaaatagatgctctttacaaatattttttaacttcttaaaatatctcattgaggattccgttccaagatggccaaataggaacagctctggtctgcagctcccagtgtgatcgacgcagaagacggatgatttctgcatttccaactgaggtaccagttgaatgaagagaagcacacctcctccccagaacagtactgcagctatgatataacgcctgggcagggttcgcaatagcagccaggctgtaatgtaagctggaatttcaatcaaggcagagaggaaacagttcagatggagtcttgctctgctgcccaggctggagtacagtagtgcgatcaaggctcactggaacctccacctcctgggttcaagtgattctcctgcctcagcctcccaagtagctgggattacagctgcccggacacgaaggagccgaggagcacgcctacgaagaacagggaggtggtgaggggcaccttccagttgtcctcacacaccagattccactgccaaggaagacagcatgaagcgtgagcccaaccctgaggcagacctcaaccccagcccagctctgagggaatattagcacggctggcgggcagactctcctcccctgggccaggatattgcctttgtacaaagggcataggccttgcagccctgggtttgactggcctgtgccgggactggggagagtaacctggggcaggtcactgccctccctgaaactcaggatcctctttggaaagggagggtgatgctcctactccgctcgcattacatagcaagaagccagccaaggccatggctgtgactggtgacccctcagctgtgaggcagtccaaagtaaaggtggcactgcatcttcagaagccagcctagtgcggaggggaggtgtttgaaaagcccaaagggcagggcagagggcatggccacttggtccaggcgtaaaatttcttttcccttgttgaaaagtgcaagtggttccaggagctctgtgactttattttctgagcaggcccctctgagaaatcatgtggtccctggtccactcacgcctaggccaagcttgtggcctgattcggggccccatcgttctggggcctacttactcctctccagggctccctagctcccctcctacatccctacaccctccttcccatccagtctttccagaagtgtggtccctcccattccctagggtctgtgggatgctgctgccctaacaagtccctgccagtgcatctacaaaatgagtttcagccagagtttcagtttgacttaagtcaattaagcaacatctcaagggaggtgacaaaaatttcaaagtgtgtttagtgacctttcatttattaaaaacaaataaataaacaaacagatgccaatga

SEQ ID NO: 3772 - DNA, 9612 bp, Homo sapiens
agggttgtctggatgggcaggaagagcagcgggggagaaagggctggaggcagggttgggcctccccagggtgtggggtgcagggaggggctgcacaggctgttcccctgaaggagggaggagggagggagcacagaggtgctgggagcaaatggagagggaagtggcagcggcccgagtgccaggcggtcccggtttggggttgatctttgtggaacagctccctggcccgtgtgtaagtggtcgggggaggcacggaggtctggagctacaagcggtggcaggaaggcaggtcccagtcttgggggtctggagcttatcttcttcctgtgaactgagtgtgggcagcacctatgggcggtgccctggacctgtggtctggtggagtccaggcctcccagggacagcagggcagccagggctagaggagcctgagggtccaggtcagggtggccctggggccactgcctccacctttgaccagctctgctgtggggatctgggcatgagaccccttcacccaggaggggagccgcgtgagtgagaccctaagtccataccccatggggggctctgaccctcctgcatagggcctggacaggggtgggtggggtgtgcggggggcggtggggagcccagactctcccagacacagcctgctctgctccagaatgtgggcttgggcactgcaggctggctgggtctgggctgcctggtgtgcctgtggtggctgcattcccacagccgggactgaggcctagtgaggaccagggaggagcctgaagggagctccatggaggacctgcctcggatgacacccctatcttaagaaggtcatggagacacacggacatcgggaacggacggaggaaggatgtgcagttgcagccttttcagcagacgccctgagaacgggaggtcaagagttggagcagacggtcagttctgacagggcctcagacctaaggcaggagcaccccctatgccagacctcctgggtcacaggatatgcacggacattgggaagggatggaggatggacggaggaaggacgtgcagttgcagctctttctgcagatgccctgagagaggagcaagaaggtcctcgccagatgctcctggacttgctttggactttcccttgctcttggacttgctctggcacctgtgctcttggacttcacagcctctagaacttttggtctttgtatttacaccagtcatctcacaatgcgtgttgagctttgcacccttttaccaaatgaggtcaccccatgaatgctgtcatgttatcacagatatgcgcacagaagctgtaatgttattaaacaaagcaatgtatccagatcactcagaatctatgcctgtcacggggagcaggagaagagggtgaatgaagagccacagcatggcaggggagccactgcaaggatgctgaaactcgtgtgaacagagttgctgtaggcaggctgctatggaaccttttggggaagcactgcctcttagggatggcagtgaaaatgggagaagagggtggcattgcctccagatggaagatgtagtgctttgccttgctccttggtgcttggagagggaaagggatgctgctgtaaagttcctggctggactttggcttgataaagcacgggcacctttgggagtatgagggtgggtgggtgtgcacatcttccatgaggagctgttagtattggggcagacgtttcaagtatggcagacaaaggatgttctgcgtggggaaatgtggtgacacccatttcacaaggacagctcacatagattgagtgctcaggaaggaccagcaccatacccagtgcctgatgtgtatcatctcaattagtccttgcctcagatgcaaaaggaaaccatcgccatcatcatcaccaccatcatcatcttcctcctgtgcagatggaaaggctgaggcatagagaggtgacggagtctgcccaggactgcaagcctgctggtggcagagccaggttccaatggaatgaaggctgtcatcctcagatggcagggtaggcaggtggctagagctcacttgggagaaggggaaaggacactgactttggctagggatggagcagagcttgggctggctttccatgcacgggcagggggcgtggctcatggctacgctccagccccgggtgtggacattgaatcttccaggtctaccctaggctatgggtctggacagcactgtgatggaaagaagacactctatgtcctgcattctgtgaccaatgatgtgactgtgggaatggcgctggcatctggctgccactctgggacgggtggccagctgccatcaggccccacccaggatgggaccaccatgcgacttcttccctcgctcctcctggtcatgtccagagccccaggaggaccagcaaagcctctcgagccgatggcagctcacgttctaccttgtcagctactcctctcctgggcaacattggctgcttgctgtggctctccccggggtatgtgactgcctctgtgctgggcacctggcctgggctttccttctgggcctgggcagctgggctcagcttggacccaggcagcagccacagaggggcccatggaggtgacagagttgcttctatgatggtgaacgggcagctgtgacacggaggaggcgaccactcctcagtttccaagtgctgcggtcagggccggggccagcaaagtccctcccatattcaaagagtgggtttgggtttgtcccaggaggacatagtcaggagcccatgctggcacatgcctcctccaaagttcagcctggatccccagcctctgccaacggccccgctccttagctaacccagcttgctcctgggttccacggcggagtcagatgtttctgggcagtttcacctttgtgccttaaatgcatgttgaggactttaaggaattgtggagaaatagggctgtggcaaaggcaagtgacaactgggaacaatgatcctgcagaggctgctgaggcctgggccccaggggcgtgggttcatccttctgcctgggctttggtgggaggggcagactctgtggtctgagacacaaaaaaacccaaaacatacgtgtgtacagacacacagcagagccacacacacacttgtgcccatgcacacactcacaggaggcccgtggactccgcacagggaagaaactcctccggtcgacagtggacggcgctgcagcagggactcacccccaagccctgcctgcctcccattgcccacctggccctggcttgatgggcttatctcatgctgtggccggggacctcttgcttcctgcaaccccttgctggactggggcctgggcctctcctgggctgtgcctagggtttgtaacccagggcctgtgccggcgtgcacagagcatctctccctgggaggctcagggctgcctcctcgagctctgtgggcctgcactggccggtgagcttgtggtgtgggttttcaggctgtatccttctacctcctgagcccaggggtcccaggcgccctgcagctgtctcctcggccatcctgtggggccccgaggccttgccctcacttcagtgcctgggtgctcaggctttgcccaggtgccaggagaaggtgtgagcatgagcctattggacacacctggcgacgtataccaggtgtcccacccctgccaccatggggcctcccgatacggcaaccaccacggacctgtggggaccaatgaggaaagagagaggcaggtctgggccaggctcacagggactccggcatagcagaccctgccccagcaggcccccttgtccttcctgggtcctggtccttcatgaggaactagcccatccctggtggggctcccaccccgcttctcagtgggctctatgcttgcctcgtcggagtcacccctcaggcagtcctgggatcctctcctttagacccactgtgccttcccggcctcccgggcttctgctgggggcagaagaaatgcctccccaggtctgtctctggaggctctgagggagatgggcttgggggctgtaggaggaggcagggattccagggtgtcaggaaggcaggggtgccaggtcccacctagtgaagtaataaaccgtgggtggtgatagtgacccagtgccctcactgcccagccccgcctgtcctcagccagcactgcagggatcccaggcccagactctggaggccttcactgatcccagccaccccagaaaagctgcagcctgcaggcaccagccgggccatatgcccagtgccagctagggcccaccgcccatcctgcacacggggccgctgggcaggtgcccctcacacccccaggatgtcagtgctcacctcgagcaaagcgccccagctcggccttgggaggtggtcgtgtccagggggatgatggagagctgtccaaccaagagagcgggagggagggaaggagggagggagagagatagagagagagagagagagagagagagaggaagtgtgggccctaaggctgccttagtggaggtgcgcgtggcctgcacctcaccaagcctagccactctcgcggctctgagtggctcacaggcttgtgagggccccgtcgctgcctgctgggtccccaccagggctccctctaggaatgcgccatggctgctatgacaatttgcacagcccagtggcttaaacaccatttataccacaggtccagatgaatcctgcagggccaaggtctgggggtgctggaggccatgctccctccaggcttgcggggagaacttccctgcctcctccagtctctccatccctgagctctcggctcctcctccgtcttcagggccagggcgtagcgtctgctctctcggcctctgcctccgcttcccacctcacctggcttctgtctatgtcagtctccctctgccaacctcctagaaggacacttgtgattacattagggctcacccctttaatccaggggagcctctccacttcatgattttcagctaacttgcttctgcaaagaccccctttccctataagggcacacattcactggtcccggggctaaggaccttgctccaagtccctccacccatgatgctgtgccttccagaaacctgtcctctgcagctcggtcttgaccccaagcctgctggtgacctgaacttcacagggttatccccttggactgtgtgcagcacgatgcaatttctgggcctgaatgtcatgctccctggggcaggaccttgagcctgcagcacacactaggccacctgcagtctcacaggccatgccctgggtagacagggaggtgctcaaccccagctcgggtcctctagtctgcctggctaccatgcttctcactctcctgcatctgcagaccctgcgttgccatgtgaggcaggggtggggtggggctgagggcgtggctttggtccctggctgtccggatgaagtaccagagtgacgccacagcccatcccggtgacatgctcacccccaacccccgtgtccgggaccccggtcttgtgtggtccctgatgtggagtcctcagtccttaagatacatccagaaagtcctggccatgaattggaggtgcagagtcctgcagagcctctgggctgggctggtgcccccaggagatggagggcctggtggatgccctcctccctcagagctggggcagctgcctcccaggggtgggactctgggctcagagagaggcccttgagctgcagctcagggggatgcgaggcttcgtggactgtgtcctggtccatgtggtgcacgtgtctccacctccaaggagaggctcctcagtgtgcacctcccccacatccgtcctctctgccggccccgggcgtctgagcagtcattccatgccagcacctctgcagcctgctgggcctcaggttctctgtgagggacctccccggccttcggcggaggtggagtaagctccgtcaaggcaggtggcttcgtcccttcctgtgagtgacaccagtgatgaaatggacccctccacacaggcatcctcagggcacagggccctgggggcaccttcctcctttcgtatttgttgagaaaaaaagtggcattgcgctcacaccaggatgctggagcagagctgacatgctcgggaaagggcagaggtcactgggggtgggaaggtcatccagtccagactcagcacctcgtgggctggtaaactgaggctcaaagtgctggtgccaggcctgaggcctcgcggtgacccctctctctggttcccagcacctgcctgagacctgccccaggcacccataacctggaattccctgtttccttgtccagggcctgaggaaatggctccccaggtctgtctctggatgctctgaggcagatgggcttgggggctctaggaagaggcagggactccagggtgtcaggaaggcaggggtgccgggtcccacccagtggagtaacaaactgtgggtggcgtttgggcctccccgccttccccactgggtgtgctggtgctggcgctgctgggtcagggctgcccgtgaccccagacaccactgtccatcctgtgaggctcccgtctgggcatgtcctgggtggattcctcctttctgttaagtagctacatgaggcaggggctcctggatccaaagcaaatgacaggaattccagagccaggtgcatccactcagggcagccagtgttggtggagctgcctctagcacatggaggagagtgaaagtcagcctgcccctctcacgagaaaagaacctggggatacctctcagcctccagcgttgcaagtgcaaggccagtggagttaatctgcaacgtgcacgagggcgtgtgtcagtggctgtgtgcaggagtgtgagtgagcaagagcaagagcgcatggctcctgctgtacctcaaggtgtgggctcctggtggctgctcagtgttcccaggggtgagaggcctcatgtatcctaggctgcctgagatttctgtgtgctgatcgcatcctcagtttcttgtccaccgcttcactggcaagagtcccaggctccaaggacaccctccctgcacatgattgggtgttaatggtggcctgggttgtgtcttcccctggggatgagggttgggtgtccatggtgccctgggctgtgtcctcccctagggatgagggtcgggcctccacgatgccctgggctgtgtgctcttatgggaatgagggttgggtgtccaagatgccctgggctgtgtccttccctggggatgagggttggatgtccaagatgccctgggctgtgtactcccctaggaatgagggctgggtgtccaagataccctgggctgtgtcctcccctggggatgagggttgggtgtccatggtgccctgggctgtgtcctcccctggggatgacggttgggtgtccatggtgccctgggctgtgtttccttggggatgagggttgggtgctatggcatcctgggcaggtgcttcctttctgcacaagggttgggtgaccatgatgtcctggcaatggcttccctgggttgcctcttttctgccatgtgggaagagcaggggaggtttagttggtctcagcacatcattctctcaggataagtagaagagtgtctgagctgtgaggccagtgctccagctttggaattgtcttccccaccctcacctccatcccatcaaagcccgacatgtcgtgtggcagcagcgaggtgggtgttggctgttctcttgggctgggggttagtcgtggacggggaaaggagagatgctggtcaaagggcatgaagtttctgctgatgggaggagtcagttcttttgatctgttgcacagcatggtgactatagttaacaataatgactatttcaaaattgctaaaagatgagattttaaatgttctcaccacaaaatgataagtgtgtgaggtgatggatatgccacttaccttgttttaatcatcccacaatatagacaggcattgtcactttgcattgtaccccaggaatcttcacatttgcttttttgtcaattaaaaatagagacacaaaaggagagaggggagagcaatagactcttcacggaaccgtgggcttctgcctccgggtaaaataaactgcaaaaaggattcccaggaaaccgttccctctttcagcccttggttacaggaagccggatttgggaaatctgcctggatgacattcacatgaacgggcacatacaggaaaacacggtaatgtaattagaatagtcagagaaaagtagccagaaatgacattcacatgaacgggcacatacaggagaaaacacggtaacgtaattagaatagtcagagaaaagtagccagaaatgacattcacatgaacgggcacatataggagaaaccatggtaacgtaattagaatagtcagagaaaagtagccagaaatgacattcacatgaacgggcacatacaggaaaacacggtaatgtaattagaatagtcagagaaaagtagccagaaatgacattcacatgaacgggcacatacaggagaaaacacggtaacgtaattagaatagtcagagaaaagtagccagaaatgacattcacatgaacgggcacatacaggagaaaacacggtaacgtaattagaatagtcagagaaaagtagccagaagaatttgcaacgtgcccttgtaacaccaaatttgatcagttttttaaaaaatgatcgttatgtaggtgattgagaagtaaatgtattcttttttaaggtaaaaatttggacccttatcatgcatacccccctctgtgctcttcaaatcaacatcattattaatatctgtacatttttgctcatctgagccagcacaggctgaggctgtcagaatggacaccttttggttgttgggtttctgtcagtttctggggtgaagctgcgtgattgagaacgtagctcttggctgccatctcggggattattaaggactgtgaactctatccacaagccatggcaatatctgtcccaccgaatgctccctctaacacactcttactcccgtgatgtgtgttaagggctccgacgatgctgaaaacagcacaggatgtgaaaaggcaggaacagttctgaagtcaaaggctgatgtcctgtttctctttccctctgtgaccgactcccttcccagtggtaacaagtacccacagcttggtttgaatttctgcacgctgttgtctgtgcactcgctcacacttacgcacacagcaggcatgtgggcgatgctgggtattttgtgtatgagtgggatgcacatacacacatctacatccatatcatgcccatgcatctgtaacttgcttttcccgtgtaagaacacttcttagagtttgttcaatgcatgtgtctgtgtgaatgattgaaggcatttctaacccattttaaagatggctacttaggaccatatggatgttgtactgatgtcatttgaccacgtccattgtttccatcttttgggctgttcttgtgtattttactttccatgtaacactgtgacattgagaattggtacctacaacagtctatttgctttacattaaatttgtaggctaa

SEQ ID NO: 3773 - DNA, 1355 bp, Homo sapiens
cggcacataggcggatgcggctccctatatacaactcggtcaccatggggatgggccggggccttttcctgttggtccagacccccaatctgcccagagaagccatgacaggagactggtgattggtgcaagcgacgtgggatgaggtaatctctcccccacccctttttctctagcatccgtagactgtttgcatcctttagacaaagagaccgtgcagaagcagtcggccgagcatccattatggggcggggttggggaggggcggaaggagaagaaaggggactggggttagaagactttctgttgcttaaacctcaaactgcagttaaaattatctatgtgaggttttttccccctacccttaataacaatttatgtttagattaaatatttaaaggaaaatgactgccagcccctccctcgtagtatattaaactcgactacattttgttagggttcaacatctctaattgctttaaacgtaaagtgggagggaaaatcggcatgatgctcgaaatggcctgggtatatgtgatttttttaatttaaaaaaagatttagccatacggtcattccaaatggtttctcaggttcaactaacttattttcagagcttcttctgcaggcacacgcacacccgaatagctaaacaaaactggaagatggaaagaataaccatattaaataaagaagcgaacaaatagttctaacatggcaataatcaagagcaagtgaacgtagagtagttataatggtttactagaggtattcttttatgagaagtctatgtaacacattttgtatggtacattgtcctttggaatgaatcatctttcctgatagaaaattgggaaaatacaaggagaaataattgagctcagaagttagtactacatgtgtgcagttacatatctgaattggacttttgtctggaaagtaacaagcaaaataatagtaataaccaatacaccaaattaaaaagaagaagagaataatataatgtaaaaagaattttgcaatgtcgcctccatccacagacaactgtgaaacatcagctcaataaacgcatttcctttttatgtagttcttatgtcaatttggtaaatatcctcctgcgagtgggcttctaactgtgggaattttagccggcctcacacccttgctgttcagctagagactctggtggttgctcagttgtcccttgggacaaaaaggctttgctttcacccctaggaaataaattggagtaaaattatcttgatatttaggaagcctccattctcagcaacgatccggagtaagtcactggacttcgtaccactggatgttggtgatgaaatttcagaggtaaa

SEQ ID NO: 3774 - DNA, 503 bp, Homo sapiens
aggaggggccgtcaggcggggatacagcctggaaggtgcgtgtggggctgggtctcggagtgggagacgtggagtgcaggtaatgcatgtccatggtacacaaattcacaaggtttgtaaatgagaaaagacgtgaggttccttttgttctttacctgtggcctccctgccctacacggggactctagggtggaatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccaccggaggtagctgcagacgcctgagagcgaggccgaggcccctcagggtttggagaccctgacacacccaccttctcacctgggctctgcgtat

SEQ ID NO: 3775 - DNA, 4290 bp, Homo sapiens
cctgtaatcccagcactttgggaggccaaggcagacagatcacctgaggtcaggagttcgagaccagcctgaccagcacagagaaaccccatctctactaaaaatacaaaattagctgggcatggtggcacatgcctgtaatcccaactactcgggaggctgaggcagaggtcttctgcacacacattgagccatctgctcttcctggtgccttctctacagcagcctgagccatgtctctaatctatgaatctcatcatgttactcccccatttcctctgggagtctctgaagtgggtaatatcctctgcttataatatgcttccccttaaacctctactctcttcctagctagctttgactcctctgtcacttgtccgctttggcatcacctcctcatagaagacttctatgactcccgagattctcaggagcatggcaggtgaagtgctcctcccatgaatggatggagattagggagtgtgtgttattcatgcttaattcaccagtgcttagctgagtacctggcataaaatagttactgtggtggccaaagtaataacccccaccgccaccaattgctcatgtcctatgttacacagcacaattacataggaagggggaattaagagtgcagataaaattaatgttgctcatcagctgaccttaaacaagattatcctggagtatctaggagagcccatgtaattacaagcattctttaaaactggaagagggaggcagaaggttaagaaccagagacggtgggcacaatggctcatgcctgtaataccaatactttgggaggccagggtaggaaaatcccttgagtgcaggagttcaaggtcagccatggcaacatactgaggtcccatctctacaacaaaataaaaacaaaattcactgagtgtcacgatgcttacctgtagtcccagctactgggaaggctgacatggtaggattgcttgagcctgggagtttgaggctataatgagccatgataggaccactgaactccatcctgagtgacagggcaaggtcctgtttctgaagaaaaaaaggacattggaatcagggccctctccatcctgaggtgcctacaaggcatctctctctgcaaacgagtaaacatcaccctccaactccttacagagtggagcaacaggaaaactccttcacctcatttctgtgctgcttgggaggcctggacagcccaataaccagctcctcgctgatgaagcaatcaggaaatggctcgagttgagctaaggagaatttggatccttcctttggttctcagtaggcagggtaggggccaggcatggtggctcatacctgtaatccttgcactgtggggggccaaggtgagaggattgcttgaggccaggagctcaagaccagcctggacaacatagcaagacctgggtggcggctgcaagctccgagactgcttcaggaggagggctagctgccagagaaagcaaccacattttttttttaaaatggagtttggctcttgtagcccaggctggagtgcaatggcacaatctcagctcactacaacctccacctcccgggttcaagcaattctcctgctacttgagaggctgaagcaggagaatcacttgagccctggatgttgaggcttcaataagctatgattgcaccactgcacaccagcttggacaacagagcgaggccctgtgagggtggtcttgtgggactgagcccctaacctgtgggttctgtgctaactctaggtagtgtcagaatggaattgtgggatacgcggttggtatccagagagttggagaactggtgtagaaactctgcacacacatttggtcagaagtctgtgagtagagagaaacatgttgcaggaagtcagggaccccaaacggagggactggctgaagccacagcagaagaacataaattgtgaagatttcatggacatttattagttccccaaattaatacttctataatttcttaggcctgtcattactgcaatctctgaacataaattgtgaagatttcatggacacttatcacttccccaatcaatacccttgtgattttctatgcctgtctttaatctcttaatccggtcatcttcgtaagctgaggatgaatgtccccgcaggaccctgtgataattgcgttaactgcacaagttgtttaaacaatatgaaacctgggcaccttgaaaaaagaacaggataacagcaatttcagggaacaagggagataaccttaaactctggctgcctgtgggccgggttgaacagagccatatttctcttctttcaaaagcaaataggagaagtattgctgaattctttttctcagcaaagaacatccctgagaaagagaatgcatccctaaggggaggcctctgaaatggccgctttggggacggctgtcttttacagtcatagataagggatgaaataagccctgggttcgcgtggcgctcccaggcttatcaggacaaggaaattcccgcctaataaatgttggtcagatgggttgtctgctctcaaaccctttctcctgataagatgttatcaatgacaatgcgcgcccgaaacttcattagcaattttaatttcgccccagtcctgtggtcctgtgatcttgccctgcctccatttgccttgtgatattttattaccttgtgaagcatgtgatctctgtgacccacaccccattcgtacactccctcaccttttgaaaatcactaataaaaacttgttggttttgcggcttggggggcatcacggaacctgccgacgtgtgatgtctcccctggacatccagctttaaaatttctctcttttgtactctttccctttatgaggagggtggcctgtcccgggcagaccagcctctttgggctgtgtggccccagctccctgagcccagagggaggtgagggtgagaaggcctggaccaggcaggacgcagcccccagggcccctgctgggaagaggtcagaacctcccaaggacccagaaggccagaacacactagagggtcccggcatcctgatgagtccactgtccccgcgatggttttcagggatggagaaggctccctgtcctccgctggaaccctgcagccgggctgacgagaccccagcgagacctgcagaacattacagcagaatgaaggagagccagaggaagaggcagatgtgctggcctgtaaacagtctgatttccaatgtaaaccagattcaggcccacgacatcaggtaaacatctgcatcagagcccccggccccccaccgcccgggaggccccggggtccacacggccgactctgggacccgtcacagtgaccgccgagacatttcgtaattaggcaaaattgatccttgcattccttccctaaatcccaaatctctgcaattttacttcttctcaaaaatgaaaacatttggcaattagctgatccaagtgaaaaaggtagagaatgtgctctcaactggaaaatgccaattaaggaagcagctctgacttcccacccgccctggctaagctgggagcttatcttccccgagaagaatctgctgggataagggggcttgggaaacaccgagggcagggctgcctcctcagcttcctctgagagcagattagccgtggccttgtgccagcagggcctgggtgccacacagggtggcaggggtggcagagccgggcccggctctggtactgggatttggggtggcgggacccagtggggcacccgcttgtgggcggcactgagggcggtgacgtaggcagcgggtgccggtgtctgcccctccatctggccgggctccccaccctgctcctgcagccctggacctcagggcccatttgcggtgcaaggcggctcttggccattttgcccgcagggccctaccttgggtcttgggagcttctgtcccttgccctctcttgtccaggtcagcatctcccactgtgggaatcctatgtggccccatcgtctggacagtgtgggtcaggtcactgtggctgttttgtgatgcgtgtgtgggctcatccctcagtgctcagaagctgcagacactatggaaccgcttttcaggccccgtggccgtcacccccgctctagagacttgattgcagggaccatgcccggccggcctaactgcacccctcactccaggtgggtggggggacccaggcctgctggcccctgtggtggtgcagcccagaaggtgtgaatcagtttacactgttcagtgcctgaataaaagtcacaggacaaagagga

SEQ ID NO: 3776 - DNA, 2299 bp, Homo sapiens
ccaatagtttgactttattaaatcaatagaacgggatctcagtggttaagccgtcttaacagggccaggtctcttgaggtagtttttgggccatcagttaattacatcgactttccaggaaacagactatggagaatgagaggaatcagactgcctgtcacacacctctcatggaaccccctagtgacacctataaggacgttacagatctagttccagactttacagatctagttctattttctcaagttacagatggggaaactgaggccccagcagggggaggggatgtatctaagtcactagtgagttggcggcagtcaggtctcttgattcttttccccatactctcagcccaacttctcagtggagaggggctggcaggcctgctctctggatagaatgtagcaaaaggcccgtggtcaaactgatacggggtggggaaggttggtgggctctcagccatcagccattctcatcttacacgtgaaaaactcagctgagagaagggaagtgacttcccccctcagggtaacacccaggactggagcttggatctcctgcttctcagcctcctagaagcttccacaatggaatacaaaaggaaaggtatatggcggcatggccagtctggagaaagggatcaagttaatgactttaaatacaaataatctgaacaaatgactagataaaaattgatttccctaacatgatctcaccctccatgagctgtgctgtttctggagagagcagtccaggaaaggggtgtaggaaaatgcagtgttagaacgaacaccaaggctgcaaatgggggcaggggtgggctgggggcatttagacagtctgcactggggtcagtaaatccatgactccatctttggtgaggaaggccacctcaccagtgttctgacaccaaacctcaaaatgtgcagggtcctccagggccctcttgccagcgattatcacaaaggggtagccaaacttgttggcatctttcagtctgtttccgatggtcagatgggtcctgtcgtccaggagcacctccccgtgaagctgaggcactgcctctgtgatgtggtcgtacagctgccctatgagctcggaggccgcctgctccttactgcccttcttaggggggatgaggcaggcttggtaaggggccagtaggctgggccagcggacacagtcttctgtagagaggacttcaatggcagcagccaagatccgtgtcacacccaagccatagcaccccatttcagccagggttggtttgccacagacattggtaaactgggcattgaaaatggatgagtacttggtacccaggtaaaatgtgtgccccacctcaatgcctttggttttagtcaatgggccctggcaagcagggcagttcatttgtgacaagtctagtgtctccatgttggctgagaagctgcagcggggacagatggcaagccggtcctctccaatatccactgggagctggaactcatgagacactgtgcccccgatggtgcccacatcggcctggaccttgacaaatggcagccctagcttgttgaacaggctgcagtaggcatcacacaccaggctgtaggtctgctgggcagcctctggggaggagtcaaaggtgtacatatccttcatgtaaaactctcggccacggagaagaccaaagcggggcctgggctcatcccgaaacttccttgtcacttggtacagcaggaagggaagctgcttgtaggacagtttcttctgggaggcaattaaggccgtaatggcttcctcgtgagttggtcctaagcagtattccttgccatgcctgtctctaagtcttagcagctctttgcccatcaagtcccaccggttggtggcttgccagagctctgccgggctgaggctgggcatgttgactttctggcccccgatggcctgcatctcctggtctatcactcgcacgagcttctccatggcacggacggtatatggcaggaggtggtaacagccggggcttgctgggtagatcaggcccacctgcagcatcagccgctggctcttacaggtcaggtcatcagatttgtcctgcagggagagcacccggtcttcccgaaggttctgtggctggaacacacgagacagcagcaggcgccgccctcttcttggggcacagtggtgaaacctgcaaggaacatacccagagagctggcggctgcaggtggccagggcgggcaatgctctgcatcttgtcagcagcccttccatgacaccctggcaccgggaagcccacgcctcccgcaag

SEQ ID NO: 3777 - DNA, 3198 bp, Homo sapiens
agggctgcaggcactcctgggagcaggaggagggtggcctgtcctgggcagaccagcctctctgggctgtgtggccccagctccctgagcccagagggaggtgagggtgagaaggcctggaccaggcaggacgcagcccccagggcccctgctgggaagaggtcagaacctcccaaggacccagaaggccagaacacactagagggtcccggcatcctgatgagtccactgtccccgcgatggttttcagggatggagaaggctccctgtcctccgctggaaccctgcagccgggctgacgagaccccagcgagacctgcagaacattacagcagaatgaaggagagccagaggaagaggcagatgtgctggcctgtaaacagtctgatttccaatgtaaaccagattcaggcccacgacatcaggtaaacatctgcatcagagcccccggccccccaccgcccgggaggccccggggtccacacggccgactctgggacccgtcacagtgaccgccgagacatttcgtaattaggcaaaattgatccttgcattccttccctaaatcccaaatctctgcaattttacttcttctcaaaaatgaaaacatttggcaattagctgatccaagtgaaaaaggtagagaatgtgctctcaactggaaaatgccaattaaggaagcagctctgacttcccacccgccctggctaagctgggagcttatcttccccgagaagaatctgctgggataagggggcttgggaaacaccgagggcagggctgcctcctcacctcctcagcttcctctgagagcagattagccgtggccttgtgccagcagggcctgggtgccacaccgggtggcagcgggtggcagagccgggccccgctccggcactgggatttggggtggcgggacccagtggggcacccgcttgtgggcagcactgagggcggtgacgtaggcagcgggtgccggtgtctgcccctccatctggccgggctccccaccctgctcctgcagccctggacctcagggcccatttgcggtgcaaggcggctcttgaggagacgaaactcatctgcctctgtccctctgggcacgcctcgtgccaggtgcatctgtggacaggggccatgctcctgggcttccaaagttggagaaagctgccaggctcaggtgggtacatcacagcagctgctgccctctgaacacagtgacaaaagaacactctgggcctggagccctggtctgggggcaagagttctaaccttttttcaccgtgaagcctgctgagaataagagctgtggactgttttcccagaaaggcatgtacatgctctccacacaaaacctttcatcgtggcccagctactccagaggctgaggcaggagaatcacttgaacctgggaggcgcaggttgtagtgtggtgagatcacgccactgcactccagcctgggcgacaggagcgaaactctgtctcaaaaaacaaaacaaaacaaaaccttgcatcctttcagggggctcacacctccctaagggcccagtaattaaaccctttgggcctgagggtgagaaactttgtctcagttcttccccaagtgatcagcccaggggtaaggaaggagaagccagaaagcaggacccatgagaagggccccctcctggagtttgaggcccactccctcctgccccttcctctcctctgtccaggactcctccctgctctgccccactcctggggccataaccatggggagctgtggttttctacaggcccctgggcacaaagtgggcaggctcacctggaggcgatcagagtaacatggcaggaagtgagggggaaagccgccctggaactgcgcctctctgccccctgacgtcactggcgtgcactcctccctcccctcaggcagtggcatgagttccatgtgagcgctgtcctgctccctctgctgcctcttttttttcttggggctgccataacactttcccttccccagccctgccaacctggtgggacattgggcttccctctcacagggtcctggggacaggcccatcctttatcatacccacagagagaccgtttttttcttcagaacctggggagcagccaggttccatgagaccttgggtgatccacccgcctcggcctcccaaagtgctgggattacaggcatgagccactgcgcccagcctgggcctgcttctttctctttttctttttttttcattagcagcttaaaattggtgccttattcagacacaagcaaaaggacattagcccagctttggaaataggtgagagcccatatatgagctgggggagttaatgagatcttttttaggtgcttttgataaagtagcctgcactacaggattcactgtgacttttttccttaacctatgcatttctctctgctagcttgaatgagttaatgttgttattgtggtaatagattagtaatcacagagtgggcttattataaaacagagttcagccccttttgccctcttgctttcttgcactctcttttccttctgccttctgtagtgggatgatgcagcaagaagacccttaccagatgcaggcccctcaaccttggacttcctaacatccagaactgttaagaaataaaatttattcctttcctttccttttcttcctcctttcccttctcttcccttttcttcccttcccctccctccctctctctctccctccctccctccttccctcccttcctccttccctctttctctctttcccttccttcctttccttccctccttccctttttccctccttccctcctcccttccttttttctttccttccttttttcctttttataaattatgcagtctgtggtattcttttatagaagcatgaaatggacaaagactccattttcaagagcaagcacttttgtagtttctgagcgaactatgactgcaaaggaagttctataggtagcctcagatccactacctaggaagcatgctaccaagcagacctaggatctaggatttgatcaagtgctgggcaacatgatacctctgcaatttagcacttccctatatacctccagttggctcagcccattagggctaaaactacccctcatatcctagtgtctcttgtaggcagaagccttgcctaaaccctaagctgcttggctcacattctgt

SEQ ID NO: 3778 - DNA, 1527 bp, Homo sapiens
gcaccggaacgccgcagccggcgctcggtccatccggcccgtgggctgtggggccccgggcggcggcggctacgtagctgccgccggccttggccgcggccgggcgggcggatatgtggcttaaatggcgcaggcgtcggggcctagaggctgaagggctggtcgtcctaaaaactcgtggacgtcgcgcacggttacccggacgcaggcccgcccctctggggaaccgcgagctcctcgcagctgggtggggaccgtcctcgcagtggcggcctccaccctgccttctcgcttagccaaggcttctggaaggctcgcaaagtgtctgttgttggaagaagccgggccctgactggcgcgacggattctcccagccgctcagcagagcgtctgtagaatatgctttttgtctaatgatgttagataaaaagcaaatttggagcagttttcttattcgagttcaaaatggttcataaagcagcgaagacaactcaaaacatcagtaacacatttggcccaggaactgctaacaaacatacagtgcagtggtggcttaagaagttttgcaaggaagagagccttgaagatgaggaacgtgatatgggccatgggaagttgacaacgaccaattgagagcaatcattgaactacatgaaaaattacagaagaactcagcgttgactattctacggtcattagggtcgttcagcattcgaagcaaattggaaaggtgaaaaagcttgataagtgggtgcctcatgagctgagcggaaatcaaaactatcgttttgaagtgtagtcttcttttatgctacgcaacaacaaaccatttctcaatcggattgtgacatgtaatgaaaagtgaattttatacaacaaccagctcagtggttggaccaagaggcagctccaaagcagttcccaaagccaaacttgcaccaaaaaaaaggtcatggtcactgttcggtggtctgctgcccatctgatccactacagttttctgaatcctggtgaaaccattacatctgagaagtatgctcagcaaattggtaagatgcaccgaaaactgcaatacctgctgcctgcattggtcaacagaaagggcccaattcttctccacgacaacacctgactgcgtgtcgcacaaccagtgcttcaaaagttgaaggaattgggctacaaagttttgcctcatccaccatattcacctgacctttcgccaactgactaccacttctgctagcatcttgacaactttttgcagggaaaacacttcagcatggtgcagaaaatgctttccaagagttcgtcaaatcctgaagcacggatttttatgctacaggaataaacaaacatttctcattggcaaaaatgtgttgattgtaatggttcctgttttgattaatagaatatgttttagcgtagttacaatgatttaaaattcgcagtctggaaatttaatttttgcatcaacctaatatttctatggtaaatccttgcaaacatggaaacaatgcatttggccca

SEQ ID NO: 3779 - DNA, 3078 bp, Homo sapiens
tccttcagcaggatgtacacagagatataactttctacagcatccactgcagctctgggctccatttccctttgaaatgggatgggagaaaggggcaggtaacagactggagtgaggagactgaggagaaactgtagagaataatacttaggagtacacgtgctggattctctcattaaggaaatattcatgagtcaactatccagaatcatagttattattcaagcggtgtgggtttaaaaggagatttgatgccatggcaaacctcactgacttagactgttcttcaagttaaagagcaggatgatgtctgaagtggctgaaacacatatggcttcagtgtgtcaagaagacctgaaagatcccacatggaagtgaaattcattactggcaagcacggtggcaggagaccccagagggctgagccgcaaagaatttgcagagccttatggctaactccatggcctagtttgatcttgaagttactgtcttggataatcctctcaaatctgttcctgcacttaagagccactcatcacatgacggagctccctctcaggttcctttacatcgccctgtcagaaatgactttcagggaacagacatcacatcaaatcatccaacagatgtccctttcaaataagttggagcagaaccaactatatggagaagtcataaacaaagaaacagacaacccagtgatttccagcggattgacattactctttgcacagaaacctcagtctcctgggtggaagaacatgagttcaacaaagcgtgtgtgcactatattggctgactcttgccgtgctcaggctcatgctgctgacaggggagagaggggacattttggagtccaaatcttgcatcatttcattgaagtgttcaatgtcatggctgtaagaagtaacccattttaataactggcatcaaaggatttaggagagagaaacccagtatccagacccatttccgtcagtgacactctcctcgtattgggaggattggccagaatcgtctgattcctgtttctgatttccttcctcactggcatcagagtatttcactataggaaaactaatatctaactgagctccaagtgctaaataacagcatctcatgttcattccgggtcaccaagaggttcagggtgaccaagtcacaaactataaatttgaacatttgatgatttttgcaggagactgggtgaacaaaggaaaacccgagagatacataaaggtggaaactaggatttctcatttgaattatttaacatgcctcactctaatggttataaatgtaaaggaaatgcaggttcttcaagaaggtgaaacgaagttactgaatttaagtttttttttttttaaacctactttagaataggaaacatgcttactaatatttacaaggcactacaaggcaccagccaaaaagcctgatttattggcaggatattcttgttgttgttgtttctattgtccatataggcaggcaattaatactttttagaaaattaagttgccaactcaacactgcctacttttgaatttttattctagcaacagccgataatttattggaaattccttatgtgctgggcactacgctagacattgggagtacgaaaattaatatggtaaagatcctggctttaaagagtctttaacattatttcagcagttttattacaggtgtatatgttggaattgacagaacacttagctcaaagcaagggttcaagcatgactttgcagagtagatttcagctgagcttaaaggatgtgagaataagtatacacattttttaaattacccagaatgtagtgcctacagaagtgcttgagcctcagttgcttctaagagtccaacttcagaacttgtatcttctagattgagctcattgcttaatttctagccaacatagcccatctctctcagctgaatactaagctcatcaacttctcctttgatctaggtcttgattagaatgttgaacatgacaaggctgaaggcagaaaccatagaaacttctatccagagttacactcgtctcttaatagctgcctactgttgcaatcagaataaactcacttcttgcccaattatgacagttcattcaccttctactcaagggagactttaagaattgttgaagttgaacttctcaggttcttatacttagtgacactgttcatgcaatggctcagtatttcttgatttctcagaaccagcaaaagtcacaaactgaatcctcaaattggaattcgtaagtgactaacttgtagcataactttattatactaggaaagatggggcaagggacagaaaaaatatctgtaacatcttatatgttcaaatataagcgctttatgtatatttagtcattcaaactccaaatacacattaagaagtagtcatcaatattccactctctaattctacaatttctacctttttagattccacatataagtgagatcatatggtatttgtcgctctgtgcctgacttatcttacttaacataatgtccttaggttcatccctgtttgaaaatggcagaattgcctgtttttttttttaaggctaaatagtatcctattttgtatattcagcacattttaaaaaatctgttcatcagctgacggacacttaggttgattccttatcttggctcttgtgaataatgctgcaatgaacacaggagctcaaacatccctttgaaatactgatttaaatatctttgggtataaacccggaattggctgtggggagttagacagggaaaatgtccacattgctctacggatacaaagtttcagttaggaggaataattctggtgttctattgcacagcacagtgtctatagttaatagtaatgtattatatatttcaaaatagctaaacaaagagaattttaatgttcttaccgcaacgaaataattgtttcagaaaataaatatgctaattagcctgatttgctcattccacagtgtatatacatgtatcaaaaagtcacattgtaccccataaatatacaaaattatttgtcaattacaataaaacttttttttaaaaa

SEQ ID NO: 3780 - DNA, 5476 bp, Homo sapiens
tttattttttatggagaaggggtctcactatgttcccccaagctggtcttgaactcctggacttaagcaatcctcccacctcagcttcccaaagagttgggattaaaggcgtgagcccccatgtccggccaacaagacttcctcgtgactataatgtgagcataatattaatagctctgagagagagaagtgaaccagaagaccaacctcagtgtcaggaagtctgggcgtctgtcttctgcatggctgaagacatggggctttgggcaagtcatctgttctctttgaactttggcttcctcacttctgaaataggagggtcagagaagatgtttctttttgctgaaaagttttacagttctctgatctataccccttggtcacacacaaccaaaaagtagaaaacatgagtgcaatacttttccaccagtactcccagtttatacattatcttctcaaaccaataaggaacttctacaaggccctgttagtgatgtgttacaggtgccagcattagggaaactttcagactgttatatctattcgttccttcatccatgtatactattcattctgtatgcagagtaatttatatatgtacaattacatggcagtgaaagataatcagaaaaatgaagttttttttttttttttgagatagttttgagacagagtcttgctctgtttcccaggctggagtgcagtggtgtgatcttggctcactgcaacctccgcctcccgggttcaagggattctcgtgcctcatcctcccgagtagctgggactacagacatgcgccaccatacccagctaatttttgtatttttagtagagatggggttttgccatgttggccaggccattctcgaactcctggcctcaagcgatcctcctgccggcttcccaaagtaccgggattccaggcatgagccaccatgcccagtcagaaggtttttttttaaaaaacacactcctgaactaacaattacaaagagctagtgacaatttcccaaataattatgcataacaggagcccatatattgttctcaaatcataaaccataactgattttgaggaaaagacattctgtcccactgatattcttttcatgagtaagatctggatctgtctggaggcacagaattaatttttgcatgaggaatcccaaccctaccatcattccatggctgaggaattggttattactcctatgggaaattgggaatgttgttggtaccccagccttctcttaagacaaaatttaacaaatgcatacatgctaagatgcttatactcataaggctttgtgggtctcctttctaaggggaatttgaatactaacaagaacaaaggctaaataccaaaagggggctttctaatggtagaatttgggatatcaggtagccacatagagcagggctactttgggggctggagactgcagaaacccttcagtttatacgtgtgagtaaacctaatcacacttgatgtattgctagtgaagtcccagccccctgagcctttgcagaaacccaaagaatgctaaaaagggcaggttttagttcctgccaattatttcatttactacaaatgccccgagttccgaatttacttccctccccaccagaaatatgtcattttggaggcttgtgaaaattaagcattaagaaaatcccgcctccatcctaatacactgcatccacaagtcccaaacaaaatcacttccttggcctacacacataactacctgtttctgtttaggtctgtgactcagaaagtgcctggaagaagtcatgagagggagtcgatcccatcttacctgccataggaagaatagggcctgctcagtagagttcagtgtgtgtgttgaaggtggtggttcttagtccttccctgaattcactaattcgcattgcactcactcttcctgatcaatgagttattgctgagaaatcattgtagtaagtaatacaggtatccccagtaaagccatccctctcctccatacctccgctgtcccttgggttttggctccaggatccttgccccatgtcccaaagaatccctaccttgggcctccctcctcctcttttgtcaattgcacttgaccttttcaggaaaaagaaatcaattgataccttagtcctaatgtttgacccttttctatctcagaatagagaagtccctgtatttgttctttttttactcaagtttaatatagaccacctaggcacagaagctccgtgctatattctgttgcctgtaattgtccttccatctaattgggaaaaggttactctattgaaccatctgctgattcccttaccttttcactcttttgtcagtattcctttaccagtaaattcttggttatctaggtcctgaagtttcattcatgttttttttaaaagctttaatttttcttaggaaaactgtttctctcatcttaaagcagactatgatcttttctactttgttatacaatctgaacataatgaacactctaaagtcaggcatggattttatcataaaagcagatcgtattaagatttttttaaaaaagaaccaggattgaggaatctgtagctaataatttaataattcaccagcatgttttgggctcccacttcatgctggccactgggctaggcactgagggtgcagaagcaaacaaatcagcctcctggccctcagatttgcattccagtgagtccattcataaaacctaactcaaagccagcaacacccccaaaagggctgttggaagctttgtagctcatctgtacagctgtcttgattcctgtacgggatcttactttcttgggaaaatatgttctaaatcctgtttccttgggccattaaaaatccatgctgtccctaatcaatatatagttatgtgtgaccttcttagaattaaaaaaatgccgctggacagcctttgaagggaaaggcagagaaatctgttttgatggcttgaaaataagtgaaaaggtttttagggaaagctaacaagctttcaaagatttcagatctgccagcattcattcattaaggcatgggattaggccaaaagagcctcctaccaagggagagacaggaaccatgtaaggagatctgtgagaccgcagtggaagagtattgaaatagaagccagacctgtagacgtatttgttaatatgtgtgccaagccaaagtacaggaggaggcttggaggcatggagttgtggtggaagcaggttctgaaaagcagaactctgaagctggctcattctcacgaagtcatctggcccagcctcccgcctccaagcacatcctgcctgcagagggtctggctagctgccttttcagctctcgagggatagagattctacaacctccctctgtcatcagttccagagccactcccctttgcactagaagttcttgctttcaaagaatgagggtgtgagggagggaggggtcaagaaacagagtgacaggggaaacaggcagaacaagtcagggcaaaggaccccagcatgaagagttgtggaggtggaggtggggaagcagcctcacatctcacacttccttccttctcttaaatgtgagcagctgactccaagccttgtggaaactctagaaggtagaaccagccatctggggaagctggccttacagatgccccgtctggcatagtggaggttcctgtgctctgagaacgcagtgtgaatctagacatccactgcagcctgggaagagctgtgttttcttcaaaagtctttaactttcacagtcacccctctaaagaaatgttctctgattgaaggcatgcttctattcctactttattgtgtttcatgcattctgccagagtaattacttttcataccaattcttggatgcagagaaatctctggtagtctaaggggatttcgatccaagtaaagctactatctcctattccatccagacttttccgtctgcctccattctctcagtcacatacctagaagcaagccagaaagcctgtccaaccaaaatcactctccaaagcccaagcactttattgttctccctgtctgttatcgagccaaggtgtatttggcctcattttatgccattagttgtctggctttcatggctctgcaccacattacagtcagagcaggaaggccagcagtggagatagaattatggcagaaacccagagtagaggcctctgctggtgagggagcctgcagcactctccacgctggtgggtcctagcatgcccaacagacccccatcccttcccatcagccttgggccttgagtctcattccaactcatcccctcccctttcccttctttccagtcccaggtgacacttgatgcctctgactcctttgaagagggcatcaagaagtgaaagaacaaagtccttttctgttcgggatctgggcccatcctgggagaggtttttggcagaaatggctgcagtggaaccctctgactgccagggtgaaatagtgctccagcaggctgcggtagactcactgccagagtgggtcaggactggcccagaggacagggtcgtctcttgagagtcctcccagctccagggcctgattttaaagcagtaacacgaggatataggttatatacaggctcctggaaggcaggtgccgcagctcctgtgacaccccatatgcctgagcaagcttctccagcacaagagatgatgcaagtatgaatgggtacggggggagcttaaaacctgccaacactgagacttgatgccaggggccgtgcacccgctctgccacctgctaggtctgtgcaatggtcagagcagaggtgtgtgatgagttcagctcccaagcacatccacacttaggaagtgttctgtgtgtttttaaataatccttaccatgtaaagattgtattacatttgtatacaaaatttttttgcattttacttttgtaatatttggggttttatagatttttattttatggccaagtatacttttgtaaggaaatgttgaagtcttgagtatttttattcttttaaaaaactatagttagtgtcaactgtgagcactgataaatattattcatgtgtggttttccttctttttaatccagactttttaagaaactgttttggcatagagctttacttaaaatgctgcttcattttacacattgtgaatactgaagattctaaaaaataaagatgcatttaaaatctctgtgctgttccattgtagaaatggtaatgtgcattgctttgccaaagtggtaattaaatgtttaatggtttagaactcctagttcacaacagggcttctcgtcatcacttgcagcgtgtgagcttccaaataagccgccatttctttggaaaacgcacgcacttaggcatggcgatctcctgttccgttaggaaatacggttatgttgacattatggttactgtgcttgtggttttgcaataaacatgtattgaaagca

SEQ ID NO: 3781 - DNA, 2445 bp, Homo sapiens
ggcagcttccttaaagccgcagccgcggcgggagcttggggtgccgggcggtggctacatcaggcggcctccgcacgctgcccccacccccatcgctcggccgccccaaacttgcttacgtccaccctgctctccttctgaccgaccccaggatatctggagagatgtgaaaagtgtgctgacgcggaagaagtcggtttttccgcgagcaaagtgtcgtcccctcacgctctccacctgcagctccaggtgagctgcagcccagaccctggcgccgcccaacagcgtccgcgcgcggggaggactctgggtgggcttcacccgaccctcgaggttcctctcccagcccctttccactgtctccagagttacctctcagcagagcagcagcagccttcgctgccagcgagcaagacgatcacgttcactcgatttgaatttagttgttttaaccgtgctggaaaaaccctttaaacacagctttcctcccatcccttagacccctaacaccaaaaaaaaaaaaaaaaaaaaaaaaaaaaaaaagagagagagagaaagataaatgaaagaagtggcagggtcaagagctgctcctctacttccttataattttgtcactgtacttactactttagtattggatttttccactagttcaatttgaaagcaagcttaccatcgaggatattcacgttataatgggtggagggggtgggtcacataagtgggagaaacagacaggaggggggaaggaaccaaactgttttctaaggatcggttgtctgcatgaagaaatttcggtttccctccaaccgccccctcctcgattctcctcccgcccacccaaatgctgcagttactaagcaaaaggatggggttcctaactttgatttctaaggacttttaggcttctcatgtaaggccccgttttaggctccccgctggcccggagtcagcatcagtgacgtatacacctaaatctggtcccccggccctcggcgacccgcagcccggcggcggcagctgtgcggcctcccgcctcaccctcgcttcgcgcccgccaaagcccgaggcgggggaccgggggacaccctgtgcccaaaggcccctcctctccttaacagttagttaagctccgggattccggacccctaacccagggctgagacttgaactctcagccgctccagtcaggaactccctggagataggggcgacagcggcagcgccgcgagctggtcctgaccccagactctaatgcccctcggtccccagcttggagctgcccccggcgtccccgcagccaggagtccccgccgagcgtcccaactttcccgcggggcccaccgtcacgcgcactctcccggcccagcgaactgggcatcgatctcacgtcggcagagcgcgggcggcgggcgggagcaaggggagtcccggacctagagcctgggcacgcgaggcggcggcggctccgcaagcgttgccgaattattcattattaaaggaatggacgtgtctcttttactaagtttttatctcctttgaggagggccggtcttgccctggatctcagcttcttgcaaaatctaggttagaaccgtgcaggggcagccgccgcgatcactcgcccgccacccagcacccttgccccagggccgccagcgggcaactcgtctcctgcccgcatcccacctccgctcgccaacccgcgccctctgccctgggcgcgcaacctgccttgcccggggccgcccctgcgctctccggaccccctctcgccgctgtcagcgcaaagtgactgtcgctgcactcaccttttctaggacatggtggggaggctggggcgggggaaggggaacggctagactcccgccgccgctgctgccgccgccaccagcaagtccaatattggctgatcggcggtgaggatggagaggatgataatcccggcagtggcagtcgccctgctgacggtgggtagagcaatagtgctgttaccctacaagaggcggcgaggcagcggcgccaaatcgcgcagagggggacgcgggcacccgcccgcccccagcggcggcggccgggcctctggcgggcccctctcccggggctgcgcgtccgctcggcgttgacagcggcgtccctgggagccgggaagtccggcaggaggatcccgcgcccgccgctccgcagcgccactctccgcgccccctccccgggccctgggtggccggtgacagctccggcggccgagcgcgtgtgtgagggggcggtcgcagggggagcctgcgcccccctccccgggtcacgccctcacgagcgggaggaggcggcaccgcgtccggccacccgcgggtgggaaacgggcaggggcgccggcagccgccctcccactacggccactgacaacctggaggccaaaggaaaactgagcccaaatgcacgcac

SEQ ID NO: 3782 - DNA, 3238 bp, Homo sapiens
acccccacccttgcgccggccgggccggtcagggggaacccgctcgcttcgcccggccgcgggcggggaggggaggggagcggcccggcccactatgcaaagcgccgggcgccgccgccgccaccccgtggcaaaggtaaaagggtcgggttcagccgccgccgcggcgcctccatgtccgcgcgccaggcccgccccctccgccgccggcccgagcccgcccgaccctctttcaattttacctcaggatttggcgccaaagcggcctcgaagcgggtcccgtgtctgcggcgggcggcccccggcgcggagggcagggcgcggggagcccgggctcccggtgtcggcggatggcgggagcccgggggccgcgggctcgcggggcagcgggcgagagacgagacgccgagccaaggcttctggaaggctcgcaaagtgtctgttgttggaagaagccgggccctgactggcgcgacggattctcccagccgctcagcagagcgtctgtaggtcggaagtgggggttgtattggaatatgctttttgtctaatgatgttagataaaaagcaaatttggagcagttttcttattcgagttcaaaatggttcataaagcagcgaagacaactcaaaacatcagtaacacatttggcccaggaactgctaacaaacatacagtgcagtggtggcttaagaagttttgcaaggaagagagccttgaagatgaggaacgtgatatgggccatgggaagttgacaacgaccaattgagagcaatcattgaactacatgaaaaattacagaagaactcagcgttgactattctacggtcattagggtcgttcagcattcgaagcaaattggaaaggtgaaaaagcttgataagtgggtgcctcatgagctgagcggaaatcaaaactatcgttttgaagtgtagtcttcttttatgctacgcaacaacaaaccatttctcaatcggattgtgacatgtaatgaaaagtgaattttatacaacaaccagctcagtggttggaccaagaggcagctccaaagcagttcccaaagccaaacttgcaccaaaaaaaaggtcatggtcactgttcggtggtctgctgcccatctgatccactacagttttctgaatcctggtgaaaccattacatctgagaagtatgctcagcaaattggtaagatgcaccgaaaactgcaatacctgctgcctgcattggtcaacagaaagggcccaattcttctccacgacaacacctgactgcgtgtcgcacaaccagtgcttcaaaagttgaaggaattgggctacaaagttttgcctcatccaccatattcacctgacctttcgccaactgactaccacttctgctagcatcttgacaactttttgcagggaaaacacttcagcatggtgcagaaaatgctttccaagagttcgtcaaatcctgaagcacggatttttatgctacaggaataaacaaacatttctcattggcaaaaatgtgttgattgtaatggttcctgttttgattaatagaatatgttttagcgtagttacaatgatttaaaattcgcagtctggaaatttaatttttgcatcaacctaatatttctatggtaaatccttgcaaacatggaaacaatgcatttggcccagtgctttgtggttgtgtactctttttctttgtttttttaatagatggcattggccgggcatggtggctcatgcctgtaatcccagcattttgggaaggtgaggtgggtggatcacctgaggtcaggagttcaagaccagcctgactaacatggtaaaaccccatctctactaaaaatacaaaaaaattagctaggcggggtggcgggcatctaattccagctacttcatgaggctgcgacaggagaatcatttgaactcgggaggcagaggttgcagtgagccgagatcacaccattgcactccagcctgggcgatgagcgaaactgtctcaaaaaaaaaaaaagttggggtctcgctgtgttgaccaggctggtctcgaactcctggcctcaagtgatcctcccatcttggcctcccaaagtgttaggattacaggcgtgagccaccacaccctgcctggttgtgtactcttttaaatactaagtttttaatgttaaatgctgcttttagatacactgtaaaaatacacctatcaatgagtttttttattaaaaacattgcaattgtactagactttaaatactaagcaataattcaggcttcaatgttggtttatagttttctcatttctttcatttaatacctctgtaaaatgaagcagttacttccattttcctgaggtgagataagtgccctgcacaatgttataggcccagtaagtgagactggagctctgatctaatccctttgacattaaagtttgtgcagtaaaccagctatgtcagtttgccacatttgtaatagtgttcaataaattttcacttaaaggtttaatattaaagtagtagcaagaattcataaccttaattggctttaacagcttttctttccctgaaaacagatgcatatgtacacatgcacacagattgcttacaatatcagcacgtaaaaggcctttgcacattgaagtcggcactgctttggtgccttttttgttttttggctcggtgttttgactgcaagtctttttggatagaattttatagttagaaagtagctaacacttgggttttataggcacaaaaaacaagtcttatactagctgtactttattttttgagttcttattaatgaggaacatccacttttgcattgacagtgatttcaagattgctttatcagcctttaaaggattcttgactagtcgtgcacatcagaactgccaggtccccagtggttctgaagcagtaagctttgggtgggctctggcatcagcactttcactaagcttcacagataattctgatgcatactccaggcctgaaccactgatcaatttgaaacatgcataacaaagcaaaaaaagttttgtttcaccttttgaaatacagttaactcttttaccatgccagagatcattcagagagacaggtcgttgctccggagtgatacagatctggcagtacccagcccttgtgtgtgtgcgttagctcagcacctgcccacactgcgagcccccgtaggatgtgccttgtccttccctgtttcagcacttaacacactacctgcccct

SEQ ID NO: 3783 - DNA, 3890 bp, Homo sapiens
agtcctgcggcacatctccaatggctcccactgccaagggcatgccccagccgtgcatcaaagacctccccctggaatcatacgcagatctcctgccctcctccaactctgccctggcacacgccgccccccacctggtgggccccctcattcctcggaggcatcctctgctcacctccgcctccccggccattggaccgtgcgggcagaacccgtggactggacccacggcctcagccgaaacgcgtcccgggcgcggaaaccctcggccgccgtggaaccttcccgggaagctctccccgcgcgggtgaaatgcgtccgaagacagggaaccgcttcccggagccgctgggaaggaggacggtacggaggcccgggagacccacggcgcctgtccgcgagcgataagtctgaggaagatggagccactcgccggtggggcacggcgcgtggaaggcgcggcaaaggtccctgcccttcacctcgcgcaggggatcgcgaggaagtcaccccggcccacgcagagctgcctgaggcgccgggacagccttcccgccgaggactgcggactgccgggcaacgccggaactcccggaactcccgtggcccgcgcctcccctcgctcggcgcccctcacgccacgacctccattcccggctctcctcgcggcgcggctgggtcgttgccaaggcgataagggagggcgccgctagctcctgaagcgggacgtgaactacatttcccataaggagcctcgacgtggggccgttcagacttggccaatggcggcccaggaacgggaacgttcgggcgggccctgcgtggggcggggcttccggcgtcggctttcggcgctggctttggggcggtttgcggcagtgggatcattgggcggtgggcggtgtggaggagtctccgctggtccgcagaaacgaacgaaggcgcgagaatcgggaagttctgcctcagtgacctgtacgcgtcctagccgcagtgaatgttgctgaaccccggtgacctcacagtggaggggcggccccatggggccatcggaccgcgccgcgcgggggcgttcgccagggcctccgcagaagcccgcctgtgcccgcaaccgccccgaaattctctccctggcaccgtgtccgctttacggagcccggagcaaggctcagaaaaatgtcccagccaaaaacatggtacatgcctgtcatcaggcaagtcttcaaagagcggctgggaccaggggccgagggacctcgtttagaggcggcttagggggaaggtcagcagttgtgtttcagttgtgttgggttttcggcgccccacaatgcgggcgacgtatgggccacaggtgtggatgccagggacaggtcgccctgcacatggctgaggcacggtaggcttgtagtctaccccatatcaggccatggtgatctcaggtatgggggcctgggagaggagagtgagtacatggctgagtacgtcagagcacggggtcagggacacatcaggggaggacgctggcaggagaataaccgggctcctgggtgtcctccgctgaattcagacgcgttcatgttagagcaggtgggcctgcgtcctcccggacgaacggagttcttaggcaaggtccagaggagcttctacctgaagtggtgctggagaactttgcactcagtgctgggtgagaccactggcaccataactctccccagcctcaactctggtttttttcctctgttctttccatgttccccttggaagtcgctgttggtcgtggcactgaggcccagatcatgccacctcctctaacaagtggctgagtggacaccccacacattctacccaagggccgtgagtggccaagatcggggctcagaagtctctgaatcttcacagctggtcacgttcagctcggtcacttcctgtaagattccaggcactgcatgcactgacatgggtgcgtgtgggcccactgggtcctgcctgggagccttccctgaatgttcattttttgcaggtctgtgtttgtcttggagtaaggattattctcgcttgctggggtcatggtgttttggcctctcctggcctggactctcaaaaactcatcatccttcataggtctgaaggcttctacattcccaccagcaggtggaccatatgaactcaaaactagttgtggcagagggaccctgaagagatctacccctggtgaatgcccccaggagtgggctgttctcacacctggtgcccagcctgtgccctcgcaggtcttggtgcctccactcagctcaattccagttttctggccatgccccgctgtgtccctttctctctccttagtgcctagctgtgcaatgtttgcctctccttaacatgtcctcagctgaccccatatcctcagtccttgcaaccctgttcctcagtgacacctgtgtattctctccagtggagacacaggtgggacacccccaagctcatggtacatgcctgtcatcagtacccctggactgtcatggtgggtcagtctgccctaggctggactgaccaacctgttcattcccccacaggattgccctttacagttcatgagttcccccaactggagtgcagacaagagcactgattgatggaccaggtagacttgaaaccaggaatagcacaaaagttatcaaagaggctcagccatggagattgcaagctggggatggaagtatccctggaattgagctgttctcacacctggtacctgagttatacccctggtgtctgggtaccaaggtcactagccttgccacttttctatgttcctgatcccctactaaacagtccaccttttcgcctacttcccctgactcctgtaccctgtcccctctttctgcctagtttgaagacactggtcatcccataacatgtcctgggctaatacatatcctcaaatcgttcttgaaaatctgttcctcttccctcctccccctccccctccccccccccccgctctttccacggtctccctctgatgccgagccgaagctggacggtactgctgccatctcggctcactgcaacctccctgcctgattctcttgcctcagcctgccgagtgcctgcgattgcaggcgcgtgccgccacgcctgactggttttcgtattttttttggtggagacggggtttcgctgtgttggccgggctggtctccagctcctaaccacgagtgatccgccagcctcggcctcccgaggtgccgggattgcagacggagtctcgttcattcagtgctcaatggtgtccaggctggagtgcagtggcgtgatctcggctcgctacaacctccacctcccagcaacccgccttggcctcccaaagtgccgagattgcagcctctgcccggcggccaccccgtctgggaagtgaggagcgtctccgcctggccgcccatcatctgggatgtgaggagcccctctgcctggctgcccagtctggaaagtgaggagcgtctctgcccggccgccatcccatctaggaagtgaggagcgcctcttcccggccgccatcacatctgggaagtgaggagcgtctctgcccggccgcccatcgtctgagatgtggggagcatctctgccctgccgccccgtccgggatgtgaggagcgtctctgcccggccgccccgtctgagaagtgaggagaccctctgcctggcaactgccccgtctgagaagtgaggagcccctccgcccggcagccgccccgtctgagaagtgaggagcccctccgcccagcagccaccccgtctgggaagtgaggagcatctccgcccggcagccgccccgtctgagaagtgaggagcctctccgcccagcagccacctcgtccgggagggaggtgggg

SEQ ID NO: 3784 - DNA, 3531 bp, Homo sapiens
gccaaagcggcctcgaagcgggtcccgtgtctgcggcgggcggcccccggcgcggagggcagggcgcggggagcccgggctcccggtgtcggcggatggcgggagcccgggggccgcgggctcgcggggcagcgggcgagagacgagacgccgagaatatgctttttgtctaatgatgttagataaaaagcaaatttggagcagttttcttattcgagttcaaaatggttcataaagcagcgaagacaactcaaaacatcagtaacacatttggcccaggaactgctaacaaacatacagtgcagtggtggcttaagaagttttgcaaggaagagagccttgaagatgaggaacgtgatatgggccatgggaagttgacaacgaccaattgagagcaatcattgaactacatgaaaaattacagaagaactcagcgttgactattctacggtcattagggtcgttcagcattcgaagcaaattggaaaggtgaaaaagcttgataagtgggtgcctcatgagctgagcggaaatcaaaactatcgttttgaagtgtagtcttcttttatgctacgcaacaacaaaccatttctcaatcggattgtgacatgtaatgaaaagtgaattttatacaacaaccagctcagtggttggaccaagaggcagctccaaagcagttcccaaagccaaacttgcaccaaaaaaaaggtcatggtcactgttcggtggtctgctgcccatctgatccactacagttttctgaatcctggtgaaaccattacatctgagaagtatgctcagcaaattggtaagatgcaccgaaaactgcaatacctgctgcctgcattggtcaacagaaagggcccaattcttctccacgacaacacctgactgcgtgtcgcacaaccagtgcttcaaaagttgaaggaattgggctacaaagttttgcctcatccaccatattcacctgacctttcgccaactgactaccacttctgctagcatcttgacaactttttgcagggaaaacacttcagcatggtgcagaaaatgctttccaagagttcgtcaaatcctgaagcacggatttttatgctacaggaataaacaaacatttctcattggcaaaaatgtgttgattgtaatggttcctgttttgattaatagaatatgttttagcgtagttacaatgatttaaaattcgcagtctggaaatttaatttttgcatcaacctaatatttctatggtaaatccttgcaaacatggaaacaatgcatttggcccagtgctttgtggttgtgtactctttttctttgtttttttaatagatggcattggccgggcatggtggctcatgcctgtaatcccagcattttgggaaggtgaggtgggtggatcacctgaggtcaggagttcaagaccagcctgactaacatggtaaaaccccatctctactaaaaatacaaaaaaattagctaggcggggtggcgggcatctaattccagctacttcatgaggctgcgacaggagaatcatttgaactcgggaggcagaggttgcagtgagccgagatcacaccattgcactccagcctgggcgatgagcgaaactgtctcaaaaaaaaaaaaagttggggtctcgctgtgttgaccaggctggtctcgaactcctggcctcaagtgatcctcccatcttggcctcccaaagtgttaggattacaggcgtgagccaccacaccctgcctggttgtgtactcttttaaatactaagtttttaatgttaaatgctgcttttagatacactgtaaaaatacacctatcaatgagtttttttattaaaaacattgcaattgtactagactttaaatactaagcaataattcaggcttcaatgttggtttatagttttctcatttctttcatttaatacctctgtaaaatgaagcagttacttccattttcctgaggtgagataagtgccctgcacaatgttataggcccagtaagtgagactggagctctgatctaatccctttgacattaaagtttgtgcagtaaaccagctatgtcagtttgccacatttgtaatagtgttcaataaattttcacttaaaggtttaatattaaagtagtagcaagaattcataaccttaattggctttaacagcttttctttccctgaaaacagatgcatatgtacacatgcacacagattgcttacaatatcagcacgtaaaaggcctttgcacattgaagtcggcactgctttggtgccttttttgttttttggctcggtgttttgactgcaagtctttttggatagaattttatagttagaaagtagctaacacttgggttttataggcacaaaaaacaagtcttatactagctgtactttattttttgagttcttattaatgaggaacatccacttttgcattgacagtgatttcaagattgctttatcagcctttaaaggattcttgactagtcgtgcacatcagaactgccaggtccccagtggttctgaagcagtaagctttgggtgggctctggcatcagcactttcactaagcttcacagataattctgatgcatactccaggcctgaaccactgatcaatttgaaacatgcataacaaagcaaaaaaagttttgtttcaccttttgaaatacagttaactcttttaccatgccagagatcattcagagagacaggtcgttgctccggagtgatacagatctggcagtacccagcccttgtgtgtgtgcgttagctcagcacctgcccacactgcgagcccccgtaggatgtgccttgtccttccctgtttcagcacttaacacactacctggtacagagtatgtagtgggcatctgttgaatgaatgcttttcccagtagcagtgtattcatacaatattaatataattgtcccctggcttacagataaaaatgaaagcatcaagtgcccagtgagtgagacccaggtgttcttcctccacccctagtggtcccctgggcaggtctttttttttttgtaacactcaccagtctgttctgtagtcaatcattgattgacttgtctgtgaacttggaggaactgtttcatagtttcattagcacagagtaaacatgtttgccatgcaaggttattttgcatctgcatttaagtgataatgttgaatcaatgaaaagtgttgattaagcagtagttgtagatatgctaagtttttcaaattactaatatcaagtggagattgtttttacttttaagggtattgcttttgtgatagcataaataatggttttccttttttgtaatgtaaattaattgctggcaacttttgtattcccatagactggggaagcttaattgcctttacaagtacttatgtacaactttgtatcaaattttctgtaatagtttatgctttagtactatatatgtactaataattttatctgacttctgtttatatcatttgtacaattacatggttgtaaaataaacttttaaacctcacgtaa

SEQ ID NO: 3785 - DNA, 1514 bp, Homo sapiens
gcagccggcgctcggtccatccggcccgtgggctgtggggccccgggcggcggcggctacgtagctgccgccggccttggccgcggccgggcgggcggatatgtggcttaaatggcgcaggcgtcggggcctagaggctgaagggctggtcgtcctaaaaactcgtggacgtcgcgcacggttacccggacgcaggcccgcccctctggggaaccgcgagctcctcgcagctgggtggggaccgtcctcgcagtggcggcctccaccctgccttctcgcttagccaaggcttctggaaggctcgcaaagtgtctgttgttggaagaagccgggccctgactggcgcgacggattctcccagccgctcagcagagcgtctgtagaatatgctttttgtctaatgatgttagataaaaagcaaatttggagcagttttcttattcgagttcaaaatggttcataaagcagcgaagacaactcaaaacatcagtaacacatttggcccaggaactgctaacaaacatacagtgcagtggtggcttaagaagttttgcaaggaagagagccttgaagatgaggaacgtgatatgggccatgggaagttgacaacgaccaattgagagcaatcattgaactacatgaaaaattacagaagaactcagcgttgactattctacggtcattagggtcgttcagcattcgaagcaaattggaaaggtgaaaaagcttgataagtgggtgcctcatgagctgagcggaaatcaaaactatcgttttgaagtgtagtcttcttttatgctacgcaacaacaaaccatttctcaatcggattgtgacatgtaatgaaaagtgaattttatacaacaaccagctcagtggttggaccaagaggcagctccaaagcagttcccaaagccaaacttgcaccaaaaaaaaggtcatggtcactgttcggtggtctgctgcccatctgatccactacagttttctgaatcctggtgaaaccattacatctgagaagtatgctcagcaaattggtaagatgcaccgaaaactgcaatacctgctgcctgcattggtcaacagaaagggcccaattcttctccacgacaacacctgactgcgtgtcgcacaaccagtgcttcaaaagttgaaggaattgggctacaaagttttgcctcatccaccatattcacctgacctttcgccaactgactaccacttctgctagcatcttgacaactttttgcagggaaaacacttcagcatggtgcagaaaatgctttccaagagttcgtcaaatcctgaagcacggatttttatgctacaggaataaacaaacatttctcattggcaaaaatgtgttgattgtaatggttcctgttttgattaatagaatatgttttagcgtagttacaatgatttaaaattcgcagtctggaaatttaatttttgcatcaacctaatatttctatggtaaatccttgcaaacatggaaacaatgcatttggccca

SEQ ID NO: 3786 - DNA, 526 bp, Homo sapiens
tcttagaactggggttcttagaagtggtgatgcaagaagtttctaggaaaggccggacaccaggttttgagcaaaattttggactgtgaagcaaggcattgggtaagtaaataaaattatatgctttaaaatgttgggacaaactgtttcttttgaatttgccaatacatgtgtctctgtgaactttgccactgttcattatatgagacaaggataaccagttccctctacatcactcctagtcctcatccttcacctctgtattagactgtcttaccacttgcatggtcaatcattgttactctttctttgtacaaactaatttagccagctaatgttcaccaacaatatgctagctcctcgaggtacaaaagtcaagcaactctaaagcctaacagtagagagagaccaatggtgactgagatgatgaaataagatacctatgagaatagctatgagttttgagagcctcctatgaacgaggaatgtatttctaacttttataaccacataggtattactactt

SEQ ID NO: 3787 - DNA, 1552 bp, Homo sapiens
gtactttttatgtctgtatggtaaaagacacgagacatagtcacactcccaaaaaattacaatcagttgaagaggtttgactaacttgagattttaacttaaggaccaggcagtatgcacttgattacagaccatacattctaagtactcagagggaaacctaccctttttttgtctgatttcagactattttttcagctagatttctttagcctctacgaaaatatattgcatgagcatatcattaaggaagatgagggagaatcatgccccaaactttctagaagaaaggggaatgtttttaacaaagaaacatgaaagaacatgacatgaagctaaatcatactcctgtttgtccttcatttataaaacctcaactgtttctatgtacatagaagataaaaacaaacaataggctgggcgcagtggctcacgcctgtaatcccagcactttgggaggccaaggcgggcagatcacgaggtcaagacatcgagaccatcctggccaacatggtgaaacccagtctctactaaaaatacgaaaataaactgggcatggtggtgcacgcctgtagtcccagctactcaggcggctgaggcagggaattgcttgaacctgggaggcagaggttgtggtgagccaagatcacgccactgcactccaggctgttgacagagcgagactccgtctccaaaaaaaaggttctttgggtggattagttgatagtaacagttcgtcctatgtggttgtagttgtgcacacaaaattgtgtttgcactagctaggactaaaggcgtgtgccaccacgcccagctaatttttgtatttttagtagagatggggtttcaccatgttggccaggatggtctcaatctctttacctcatgatccgtccgccttggcctcccaaagtgctgcgattacaggcgtgagctaccacgcccggcccttaattttaattgttaaaatttgataaagaaggtgggtagtagacatatcaaatgatcattatattattttctgtgtgtttgaaatatttcacagtattttaagatgaacctaaaataaaacattaaagaaactccattaaactaatgagcctataaaaatatatatcccactgggcatctgtaatgaaaacatgctaatactcagcaagcttactgatttttttttttaagccgttaaatttcaggcatcagatttcagtcttctctttccaagcacatagtacaagcaggctctttcatcccacactctttttttttttccgagacggagtctcactttgttgcccaggctggctcgatctcagctcactgcaacctctacctcctgggttcaagcaattctcctgcctctgcctcccgagtactacaggcatgctgagaatacaggcatgtgacactgtgcccggctaatttttgtgttttcggtagagatggggtttcaccatgttggccaggctggtttcaaactcctgacctcaggtgacctgcccacctcagcctcccgaagtgctgggattataggcataagccactgcgccca

SEQ ID NO: 3788 - DNA, 632 bp, Homo sapiens
aactgggtggcttctggaaaacagcttcccaaaaagtatcatgtgggaaagactacttgaaaggactgaaagccatatctagtttggaaggggttcccataagtaaacatcaagtaagatgcagcatgtcatatttttatccatttcacactcaagatgaagttcccaaggatcccttctgtagctgcttcaccgtatatacccttcctcattcagcccatcccaaaacaaattctgacaatgacacatgagctgcatgtagctgaccagcctaccagatcttttatgcagttcgacatacaaggtgacaccaaggtaagacaaatgaagttccagtttgggtgcctccatctccctcccctggatcctgatccagtgactgccaaaaccagaaagaactggggtagggtgcttgatcatggggaacgctgttgtggttcgtccggcagatgggaaaagggaaaggtttcacttcttcacaatttgaatgacatcctcatcctccaacgtatggtctttacccactttctgaggattgtgtttcacagagagaccccagaccagagcactgcatggaagggaaaaagaacagtcagtgtaaataataacctagcttctgccctatttgcctg

SEQ ID NO: 3789 - DNA, 1125 bp, Homo sapiens
ggaacacttacccagcagtagcacgttcttccccgcagggagcttggagcgcgagcgggtggagacctcgctgaggatgcaggacctaacgggaagcaaggcgtacggtgaggccggaggccggagccgcagcgcgggagggacggacccggcctcggcgcgccggggatggggctgccgggaacgcagtggccgggcccggcgccgagctccagcgggcacgggatcccgaggcgtccgcgcaaggccgggggagccagcgggggctgagggagaggtggagtcgttaccaaaggttctgcccgtcctcgtcgtcgcctgccgcggcgccaccgttgcccgacgctatctcgttgcccaaggggccgccagtgtaagtcgaggataatcccggcggagaagaaccgaaggagccgactcgccccacggccgccatcttggtcgggaatcacaccactcccggcaagactaaatgtgcgaggcggctgaggcggtggcggtggaggcggcgggaacccggatatggggcgttcagcgcacgggagcggggcggggcctgcgggggcggggccccgggccgggccaggactgatggagcgagcgagaacggactgcgcgtgcgtggctgcctggccggcgctgaggggctgagcgtacgcgggcggcggggtgggccgctatgctgcaactgaagcccagtgatctgacagtatggaagtgctttccttccgctcatccgcggccctgggctgcggcaggggggttgggtgtgtcaggtgaaaagtgctccctcccacccttcagacaggtccccaaaccctgcggcctgcgcggaattcctgcattgtcattgccggcccacccactgttcaggctgagagcggtcccccgcccaaaccggcgcttcgccggcgccaagatagaaatgggtcgcccggctggtaaagaggctgccctgcaaccctgggctggagtattgctgtggtcctggatttctggactttatttgcgttctcaagtggcgaagtgttcctcaacctggacccacatcagaagcaggttctccgagcccctaagcagcggcgtgacaaaggatttttatcaagtggaccctcacagaacatc

SEQ ID NO: 3790 - DNA, 1048 bp, Homo sapiens
gtgagcgaggagttcttgctgaaggccttgccgcactcgccgcacacgtagggcttctcgccggtgtggttcctctggtgcagggtgagcgaggagctcttgttgaaggccttgccgcactccttgcaggcgtacggcttctccccggtgtgcgtgcgctggtgctcggtcaggtgcatgttctggctgaaggctcgcccgcactcggggcacacgtacggcttctccccggtgtgcgtgcgctggtgcacgatgaggtgcatgttctggctgaaggccttgccgcagtccccgcacgcgtagggcttctcccccgtgtggatccgctcgtgctgggtgagagaggaagtcttccggaaggccttgccacacacgtcgcacacatacggcttctcgcccgtgtgcgtgcgctggtgcacagtgaggttcatgcgctggctgaaggccttgccgcagtccccgcaggcatagggcttctcgcccgtgtgcacccgctggtggatggtgagggacgagcgctcgatgaagtgcttcccacaggtgtcacactcaaacggcttttctcccgtgtggatcctttggtgctttatcagggacgagcttcggctaaaggccttgccacactcgctgcagtcgtaggttttcttctcctcgcagggcatggggggcttactgaggtctgaagtgctggagaagttcttgccacgccttacgggtggacaggcccccttttctgtggggtcgtccagccgtggtgggaccaggacacagccttggttggcaaatgccttcagttcatgacatgcgggtactgagccccctaagagtttgttcccctggggaattcccaatggctcccactctgcacctgcatctccccgcggcctctctggccagctgcctggttcccacactccttctgagccaggacccctggcaccattcctcgtgggtccccccgtggcctccccaacaacggagagcttgtcttccgaaatgtcattctttggatccaactctttcatttcaggtctagtctcccagtctg

SEQ ID NO: 3791 - DNA, 556 bp, Homo sapiens
aactggaagagcggcggtctgcagccctcccctcatacccttgcccccgcgacccggccccttctcaagccctctgcacggtacctgtccccaggactctctgttctctttcccgctgcagcatgggcggtactaccgggtctcagatggcagcgcgggggcgacgaccccggggctggggatgaggggaaacctggcctagcgggcatgcagcgccttgtcatgtcggcgccgctggcgacggcggcatgagccgtggctggagaagttgggtgcgtggttgccgtcttgctgctgggactccgggaggctgtcggagcagaggtgggcggcacccccttctctcttcatggcggttctctcttcggaagtgactccggcgtgagcgggaaggaacctggggaccagtaaggggcgggtcttacttcatgaatcacgtcttgattggctggcacggtggtcatttcggtggtggcgcaataggaagccgcagcctctctggagaaggcggggcttggggacgggggaggaagaaacctccccctcccaccccgtc

SEQ ID NO: 3792 - DNA, 385 bp, Homo sapiens
gaatctcccctcaccaccaacccccactcacactctgctcgccggcctcgcacttacatcgacatgcaccggcgctgagggtcacgaatcggagtcattctcctactgggggacgcgtggcccttccgcaaccatggcttgtgatggtttaacgcggacaggccattcctccccgtcccgcgcgcggtctcctcccctcctgtgcgcccgctctttaaccaaagctgcgtgtcagtgagccgtgccggtcacatggtgtcactgctggcggccgcaccttgctgcctccctcttgcagctctctgacgatgcagcgaccgcggctggcggagattgagcaacggggaaaggtggacatccaaaggtgatacagctggaaaaagga

SEQ ID NO: 3793 - DNA, 2147 bp, Homo sapiens
cttatcgccaccgcacttagctgtcgaactaagaaatcggttgtgtgggaaaaaggaccagaataggtggaaagatagtccagaaatttacctgtgccacacacaagatggcgagacgtagggttcgtccctgtgctgccaaaagggggcgcccgacacggaaggcgggactccggagacacgagcgcacattggccgagagtggcgggcgaacacaaagttgacgctttgcgtccttccattggcagtttcttccgtctgtctctcggttgcagccgagctgggaatggggaaaacccggagtgtgggatcgtggagggcggacgatgccaagtccagcagagcttgcgctcggggctagaagagagactgagtctcccttctcagtttcattaggtaatgggcgacatggctccgtctccacagcggggctttgctgagcttagcacgcagtctcccggcggggaggaggcgcgcagtgccgggcgccactccgtctccagtacgcgttaggcccgcgttcccaggtgcccgtctggccgctggactgttggcctttccggagcgagttttactttaggaagaagcccgggatcccggtagtttagcctgaagaaacgtggggcagatgctgggcagggcggggataccgcgccaacacccgctgcccagcggtcgccctcctatgcagcggcgaagggacgcccgctgtgtctccgccctgcccccaggcgccccagtggctggaggtggcattctccactggacgggcgcgcctcaatccgggggacttccacagtgctgttcccgaggactacgcgtctcaactctttgtcgggttccctccctcccactgccagtctgtcttcaccgccgcgcagacctggggccgcccttcacagaggaagggctccttgacctcagccaccgtgaccccctcctttgtgtcacattctcagagagttggagggattatgcgtcatcgtaaacagggggacagagcgccttccacctgcggcgcatccattaagttccagttaccctcgagaggattgttttttccacgaaacccagatgcaatgagagcctggcttgtaccatctctaagcatcgaggcttccccctcgtctgggtggtggccttcgggcagtggctccggaaaggccatcaaggcttccccgtcgtctggatggtggccttcgggcagtggactgtgtccatagctgaaaaccagacttgacagttctggattcaggctgttgtgggagcgggaaggtcaaacacccagaaggaactgatgaatgtgaatttccctctaagaactgctttgcctggccgggcgcggtggctcacgcttgtaattccagcactttgggaggctgaggtgggtggatgccgaggtgagtggatcacgaggtcaggagttcgagaccagcctgaccaacatagtgaaacccccgtctctactaaaaatacaaaaattagccgggcctggtggcgtgcgcctgtaatcccagctactcgggaggctgagacaggagaatcgcttgaatccgggaggcagaggttgcaggagctgagatcacgccattgcactccagcctgggcaacagagtgagactccatctcaaaaaaaaaaacaaaaaaagaactgttttctgacgttattcccatgcaggtgcctttgctagaagtgggtgaggaaggctcatgcccatctggttccagaaccaccacttaaatttcccaaacactcactgaatgcccgctgtgtacatggcagtgagcctttgactcatgcttcattttcatgtacaaggtgggtaggacagttatggagttgaaccatatgaaactgatgtctatgtaggtgaaaacgaactgaaaatcaacacatttacaggttcaacttctgatataaccctccttttaacaaatcaaaaaagcaaacctagagattatagcaagggacttggagttacccactggatcaatgatggagccgaggctaagtcctaaaacagaggaatctgcatttttagatgagccctggggcagaagttgcccccatggacctccctctcatcccaggagtgtggtatctgacagctcatagtgggggagttatttaggctatgaagaaccgt

SEQ ID NO: 3794 - DNA, 3644 bp, Homo sapiens
ccgctctcccctactctaccagcccacccctccaaggtccgtctgcgtgagaaaaggggctcggaagaccgttgaagccctgcgcccacgagaggggagcccagccgccccaataggggacgaggagtgggtgctacggagaagtttggattgattccggaaaaagagggacagagataaaacagcaagagtagcaaggggaaaagggaggcaaaagagcagaactcactcaggcatggacgttgggggcggcggtggctgtcgagtgcgggcctgaaaccaagaacggctccccgggcgggcgcgccggcgtcggacttccgaggcggcggcttctgcctctcctgccgccgccgccgccgccggagctgcggctgccgcggaagttaattgcaacttgacttcaagttgtcctctttccccatacgaagtgggcgtttaaaggggagagcgaggcgaggagcgagcgagcgagcgcgcggggccaagggaaggaagagaaggagggggagggaggagatgttaacgggcgggggggggagaagggggagggggcggcggcgggggcgggagggggaaggggccggcgggagctgctctcgtctcgtcggtcgcggcgcctgcagtctggaggcgcaccggagcggccggggcgtcccccgcgggagcccgcagccacccgggacgcgcatccagacgtggcgcttcggaccgggcacgctgcgcccgggggctcggcggaccccgcgtagccgccgcttcggagcttgtgcggcgcgggctggccagcggggcggccagggcccggcccgcctccccagcgcccgcccggcttctccccctggcggtgggagcctcggcggccgctggcgacactaggcgcactgaagcccgagccgagccgagcccgagccgccgccgccgccgccgctgctgcgcaccgctcccgggctccctcccagcgcgccggccggggtgtggggggcggcgggccggaggggcgagggcgggccagggggcgcacacgggggttggcgcggaagacaggaccctcagcctcgagggagcccctaggtgaccaggcaaaatggcagttccttccagctggtcctcagatgggcacatctattagtaagtttcatttctgtatttggatctttattcatccttattatgaattccccaatactgaggtttctaggaacctacctgccattggctgaagggttgcttctgaattctttcccagaggcagtgacaaaaatcaaacatccgatgtgttctttacctttcagtaagctcagcctccctgcttgtgtcacatctctaaacatacgtacatgcgtgattgaaactgtctattgaaagcaatattacattaacattatcaatactgaattagagaaaatatctatcaatgtcaccaattccacctgtctcttgatgtatgactttttacctgacaggctaaataacaatagaaagttctttttaaaaaatagaagagttgctatgcagggacttttttggaattaagtgccccagagaacctagaaatgtgctttaaaactttttgtttcacctggcagatccaaaaaaaatttggaagcttttggttgaattccctcattacttgaagttgttttatgaaaattgaatatatatatctgttaggttaccaagacttatggttagctatcttaatggctagtgatataagaccttgtaacaaaccctaccaatggaactgacaggattttaccagggaggatattgcagtacctgtaagaggaagggatacaaattggcacttcatacatttgtgagaacaattgcctttaatgtgtctatttggttttcataatattgcaggcctctgctcttgtaagaagttagctgcagaacccacatgtgaatccttgtaggactctggagaagatcaaatgggagcttagatgtggaagctctttggaaaccaagaaacactctgaaaatgaaaagggtggaagagtaaactgttcctgtttctccatcttgacaggaagcagaagttctccttagctgatttttcttcttgccttatactgggttctttaacaccagaacaaaaataaataaataaaagaatcttccagaaattcatgaagagacttcaggtcaggaaagcctgaactttctcatccaacacccgttcaagtcggaggatgctgattaattcatgatggaaaggtatcaatttcacagcccagacctctacattcttgaaatgctcttctcatgggagacattaaataagctttgaattaactgagacctctgtggattctataactcaaagacccaggctgacggctggtggaatagctaccatctcaaacatggcgtgatgctgcatcagagagaaaaataagctcttgcattgacaatgaaatgtctaccctgtagtgacttgtgcttacttccactcacaagtgattgcccagagctacttacctggctccaatctaccactgggtgtgtacttgcaatctaccatgtacctagaagatgagagaaacaaattattaatgatgaccacaccccaatactaacaacaattgcagaagaatcaatgacttaaacaaaaatgtggccattgaaggaatagaaaatatagtgagtttagtgtaaatttaaaagtgatttataagtaacatacaaaatccagaaactataagaaaacagattcacaaatataaatatataaagctttaaaaaagtttaatgtaacaaaaatggcataaaaggagtcaaaagtttttaaaaaatatgttaatgcagtagattaggtgctaattttcttaatatactaataactcaataagagaaattttgtatctagaagaaaatgaacatggaaataggcaattcacagataatggcattcatctggcgaataaaaaaatgtgtgacattcagaataaaataaaaatgaaatactggttttcagccatcacttgagcaaaactgcaaagatacaatgagactcaggcattcccatatactgtggatgggagggcaaagaccttcaacctctaattttatttctatttttaaacatgtatgttaaaattttaaatgctaatgtcctcttgacccaataatcttatgtctaagatttgaatctggagataaacttgaacaaatgcatctagatttatgtataagtattaatatagtttagatgtgtgttcccacccaaatctcatattgaaatgtaatccccagtgttggaggtgggtcctggtgtgaggtgattggattatgggggtgaatttctcaggaatggtttaacatcatcccctacggccctgtccttgcatagtgaggtgagttcttctgagatctggtcatttaaagtgtgcagcacctccccgcctcactctctcttgctcctgcttttgctatgtgatgtgtgagctactgctgtgccttacaccatgatttgaagctccctgaggcctccccagaaggagatgctgccatgcttcctgtacagcctgcagaattgtgaggcaattaaacctcgtttctttataaattacccagtctcacgtatttctttatggcaatgcaataatagactaatactaatatgttcagtg

SEQ ID NO: 3795 - DNA, 6358 bp, Homo sapiens
cggctccctcagtctggcgtcatctaggtcgctgctcagggaaatgcggaggccagtaggcttacgtgtttaccgcgtagggcaaagccttgccaaattcccggccagcggagcggcgagggtggggactcacgggaagttaaacagcctcgtcggcgtcctcgaggctccaaaaccaggctctaggcggggacgactgcagccgttatggaggccaccgcggctacggccgcggctgaggcctccccaggtggagcggtggcctggaggggaatcttgatcctgggccagccacctgtcaagaggaggcggagcgtcatgcctctggaagactggatgaatattctccaggagcctgacgaaggcgaagaagtctttgcagaggaaattgaatgctgtctgatgctacaattcatatggatcctttcctggattgaagcctgacttttaaaaaaggtttcaataaattgcttatacctatgaagagatgcaaaagaaccttcaaaataaagcaaaggacttgaagaaagagaaggaagacatgaagaagaggatgtcatttaggtgaaggtgatggatacagaatctgagtctgaggggagcctggttgacagagagacaaaaaaagaaattttttttttctgactaaaaaaaaaaaggaaattttgttaacaaaatcaagaatttaaaaaaaatgctgtgagagctgatctatgcatctggtttgtgagccagtattctgtgatggctgcagtttttagagatcctagtagctctacacatctgtcttctgctttcctagaacctgggcaccccatggatgactcactgctggttttgtgtgtgtgtgtgtgtgatttaaaattacattcagtcaactctatagccctatgggctttttgaataaccaaatgctcaacagttctgtaatctttcaggttgctgtgatcagtccccaaggagtctacactctcaaagagactgggaaaggcctgtgagacaatgggattcttttttctagaggtgtaactctgcctgtgtttgcatgccacctccagaaccactaaaatataatttctcagtgggtgactgagtaagactggcagcaattgcaaaagcagattcatgccatgtgtcactcttcacagtcaggaacttatttacctcttggaactttccaaaggaacgatgatggtggcggtaatgtcacattagtatggagcccttaaattcagcagtgttcaacctgagggaagacagagtaggtcaattctcttggcagcagctgagggaaggagagagcagggagcagggctcagataaggtttgtttggcagggtccaagcacttcatggaatggagacctttggctgtcagagatctgaggaagatttgtcagggcctgctacactctgagggcttgcagtttggatggttgggaacacttcttccttgcactgatggtgctcctatttctatgacacgtgtactagttcagacacaatttattgtgttcaccaattctatgcacagcaatcagactgagattgaaatccagtataatattaaaggtgatctgggccaggcgcagtggctcatacttgtaatcccagcactttgggacgctgagttagggggatcacttgaggccaggagtttgggaccagcctgggccagaaaatgagaccccatctgtaaaaaaaaattttttttaggttagccaggcatggtggtgcatgcttgtagtcctagctacttgggacactaaagtgggaggattgcatgagcccaggagttcgaggctgtagtgagctaagattgtgcctctgcactccagcctgggtgacagagcaagactctgtctctaaaacacacacacaaacaacatctgacaaggcatttcagcctggagtcagtcaaaaaatcttagaggtctgtaaaggagatgactatgctgttagggctgtggtagaaacctttaataacaagtgaaaagagcttgtatttgccaaaatgaacacaggatatgattctttttttgcttttgctttggagttgtatcagctctgtgcggtcacatgggtatctacaaatcaaagcacccatcaaccagatgcatctctgagagttaacagcagaaggtggcataataaaagaagttctcggtagtgaaaaaggttggaaaccaccagctaaaccaatcctcttgtaccaataggagattcaagttgagaggtgggaaagggcctatctcagagtaggtgcttgaatacttcttactagaatgaaagaaggaacttaagatcacacagccatgttactgcaggacggggaatggaacctaggtcttcttatttttggttcagtgttaactcccattctctaagcagactgggcctgttattcaaactgccttcccataggtgcttccctgcttctctcctcacccagagaaggacttacaaacagcttatcttcagaggttttgtgcctgatagttatggaatgtgctggtttgagcagggaggatgtaaggggagggaatgctaaaagcctgtctacttagagtcaggtttcctgggtaagtccctggaaccccatccccttcccctttcttgagaccccaggacttgctccagtaactgccaccctgtgcctttgcttcagggccatgctggataaggagctggctgcctctgtgaacatcctactcaaggcatcttcactgctgtacatccttttgaaatcccagagatcttcagtctccctgtggattaaggagatgtgcagtatttaaagtggcttcaggaaggcatggaagaggactgagtggggaaagctttttgtgcatgctgctggctacctccagcggctgcctccagcctccatcagctgcactctggggaagaggaggctgccttctacctcccagcatctctggatttcatgttcctgtcagcacagaggagctaaatggcctgtagaggctgaaggtctgaggctcctaaagctggaagaaaaggctgggccagtcaggccaagcaagaacacagtgtaacttgtctctgagtgcttcatggttaagggggctaagcaggcacaagggcatgaggatggttatatgtacagactgaggggaagaagcagtgaagatgagacttgccatcttcttgagtcagtaggcctgcctcaggtgcctaggatgtaattgctctgctgcttctcatggggaggagtggccctcatgaccttgtttacctggaagagtgtgggatgaatgcctcctcctatggggactcgcaagtgctttagcaaaaggataaattgctaattgtggcatttcgtggatcagcaggattatttctccttgctaaagaggattttgttggtcctgaattctgaggaggtgggactaggaatgggctccatgagcctgtgtatgactcagggaatattaggactttggcacagcctcatgggttgggagtaagtcttggctcttccctagcctgaatgacagacatcagatcattctggtgctttgtccatgaagatgtagattctgagcccacccaactaatcttttcacttgagcacagaaacagccccgggaatcggacagacccgtgtctttcaggtttgcttcacagagccccaggggttgacaataggtgccttggagactgcctgcatggggatttttaaaaagctttctttgttaaaggtttgtaaaccactcctctgagcctgttttcattttatagattattcagggaactgaactgcacagagatccagaaagtgggtagtgcaggctgtagtgctgataactactgtactacttggatctttgtgctcccaaataccaaatggaagaggatctctgagagtcctttgcaaagatcttgtagggactttaggctggggccttcggaaaattccagaggattccaatggagattttgagggactgactcagaagaacaaagagaatgataatggtgatgtccctgctttttacaacagatcatgttctgatatatatgcaaatctgtgtaaagtaaaccctacctaaaatgtactggggacccaagatggactgcctgtattgcttccaggataaagtccaatttctagctctggtttttataaccttgcttcagctcaccttttccgtcatcatcccctccatctcctctcccacgctgggaaatggatggctgcactatactgtgtgatgttattgctatgttcatgccatcccctctgcctggaatgcccttctgcatgaatgcctgtgaaatgttgttgctcctttgtatggcctggcttccgtggttggcaggaatctcttctttcgtggtattcctgtcatctttgtgcatcacagtcagctttgtattcctagcttgtaagctacttgaggataggggcatgtctgaatctatttaatctcttgcacctgtttggcaaattgatgttttaagtatttaaataactaaagctctctctacagtacatactcacttttgatttatgaattggcaaaattcaacttttttccttgaatattcttaaagtgagatgaattccaaaggagagtgttctgtgtgtggccttcattgagtggttttctgttaccagaaagctcttggtggccttcctcttccctggtgtcaaggttgactgttataggaaatgggaggggagagggccgtttctgccacgcattgtcctaggttcttaacattatttaatccttataatgcaatgttatcctcattttacagatgaaacctgagaccaaagaacatgtaacacataaagtacattgcagagttaggatgtgaacccaactctgattctaaacctaatgctctcactctttcattcagaggttcagtcagttctttgtaggctgtagatccagagaagctgccgtagccaacaatgaagttgttagtttttaaaacatctatgtggtaagttggtctggcacttaaaaatgtattgtttcccaggcacggtggttcacacctgtaatcccagcattttgggaggccgaggcaggcggatcattaggtcaaaagattgagaccatcctgaccaacatggtgaaaccccgtctctactaaaagtacaaaaattagctgggtgtggtggcgcatgcctctagtcccagctacctgggaggctgaggcaggagaattgcttgaacccaggaggcagaggttgcagtgagccaagatcatgctactgcactacagcctggcaacaaagcgagactctgtctaaaatatatatatatatatatattgtttactactcaccacagatctgcaggagttcactgatctctaggatctgccttaactccaacttacatgttttggtcactattacaaactgtcatcccagaatgatgctgcagaggctagggctaggacacagaccagtgtttccatgtgggaattccctcccagtatttcttaggaaatgtatgttttttgaatccataatccctagaaaaatcagttgaggaaatgagaagtattgtaattattctgtgaatagtaacacttaccattatggagacatcactagtttgaaagaatccaacttcatcaaatattaacgtaccgagttgaaggctacaagaactgagacaggagcatagcagagagaaacggtcaccatctcattagccctatttttggttgttgtgatgccattacatctgtatatctggccatatcagctgctaatggtgagttcttgcaaacaaaatgatttgataaacaacctaccatactttatacaaatcttatggtgttccgagaaataaactttggaagcaaaataagttaacagtctggacacgattgattctatattctgtttaccttgctctaggctattcaaatgttatatttatttgaacactatccaatatatgttccctggcatcttcctgtcttttaaatattctctgtacgctacagttctttgtaagtaaaaataagcttaatatgtctacttagcaaacaaagtttttccagatacctataataatgaggaaaacagtataaagaatgaagtatttgaagaataacttataatttgggggatttctgagaattctacttctttgtccctaatttccgaaggtaaatgtttgttgtgaatttggaaacactagactacagaaaagcaggcactctctagcctgggaggcccactgatcttaggagggtccatatagctgcttattgcagaccttgcactagaacccaggtcttttgacacctggtgccacttttcattccattccattaattatagcccagagaataaccac

SEQ ID NO: 3796 - DNA, 5179 bp, Homo sapiens
agcaaatgttttatttaataagttataagatacaatttacagtcggcgtttgattccagtttggcttccgtgtcccagcttacaacacccgtggtcctttcacatcaggctccgggctgttccactttctgtagggtgggcttttacccccaacactcgccccagatactacacctgccacaagagtggccacttcctcaggactaagcagcaaaacctaaaggtctgcctgcccagaccacactacacatttgggctcaggcaacgtccctgacactttaacctcattccaaagccagctcaggtctgcaggaaggcaggcaaaattccctacacctcatttctggatttctgcaccacacagctctcactgtttctgccaatggtgaaaagaccaccaataagctgctgcccttctctcccccaaccattcccaactttcaggccaaagacccgcaggagtttcattctgtcctgtctgtacagatcattattttccagaaaaagtgacccatgaagttggctggggcgggtgtggagtgttatgtcatgggacggaccttgggatgagggcgttaatccatgggcccctctgagatcactttaaacattttggtaagactgcccaggctgatgaagggctggagcgtgtgttaaaaacaagggctagtgttggttaaaagggatctttggcaagtgggaaactgctcgccactgcagaatttcttcagaccaaggaagggactgaaacggacttggaaaactaaagcaaaaccatgactgccgggatggtctcgtgtggtgattctgcaagaaataatcaccagagcgaggggacaggtacttgagagacatgtgggcctggctgccactctgccctctgagtttctgtagggtgcccggctgccactctgccctctgagaagtgtaagaaggccacagagcatgggggtgttggcgatgaggagcggtaaagcagtgctagtgatctaatagccaaatacattaacacggacactggaagagattaagcggattttaagtcatctcctttgccaaatgacaaccaaactaggtgtcccctttttctctgcccatcttcccctagccttgtttcataaatgctgaagagtgaaccagcagctcaggctagccagttttgtttttttgaaatgtcagtctcattgtgttcctggtctgtctgctgcagtggctggtctgttccaccaagagttctggtttgcacctagtgtactcaggatcttctcagccccctgaacaagcttgcatttcttaagattctccaatatgtccctcaagagtccagtctaggacttatttctgaaggcattttacaacagcaatattttagggatggggtttcagccccacaaacaggctggagggctttgtataaaatgaattacaaacaagcaacaaaagcaaccacaagaactctctccaggatttgagaaaactgttttaaggcactgtgacatgaaaagggctgccagggatgtgttcctccccccacttcacagccagcacataatcgcccctctccttgacgacgtatgtgacgttgtattgctggttgcctacatgcttcatggagacctcctcgcagggggtggtgggcccatggaccccgatcagcagcatgttggagcctaggaggcaaaaggtggttactccacccggatgcatcaggacaggcacaggaagaagaggaaatatgagagccaaaggaaaggaagcagaggcacagtgaagtcagataattcatctggagtcacacagctggggaccagcagaactgggatttaaacataaagtctgtccaacttggagctaaagcacttacctgagagaagatggaaggaaaaaaatccacaagcagaagtctctcaccactgcctctagctataacctgtatctgacaccacaaaacatctctgggcgtggcggtcttcccccaccccctcaaatatgtccagctcagttcctgtgagtttaatgcatgttaaacgcagcactgcttgttcttcaaggcagttaaggaaggaggcccttctggtataccccgagcacactggggttcctggaccatttcattaggaaaattgctcagcggctccaaagaatctggagctccctggtctatctcccagcctctcaagccgcctccagcagggtcccgccccaaattctccacattcccctactccaaaatctacagaatggaccatttaaagcttgagccaagagatacagcaaactcacccattaaaaacagagggaggtttgctttgttcagaaggtcaggatactgggcgctctggcggccaagcacagataccttttcattccatgcacactgcagctgtgtaatctcagaatggatatttagggaaaggcttgggagcaggagggctggaaaaacaaggcgccttccctgtgacaagagcaatatttacacagggtttgaagcaggcggttctgtacctctcccctcctggctaggagcttccctgcaagagcaactccttctctcagcagcgtccagcacttgcagagcacagcctgaaacccaagctcccaaaaaggtgtgcgaacagccaaaaggaaatgggagagggcccaggcacagcggcatgagccagcaggagggtgagatgcttcctggccagtgtgggagaccccagcagctgctgtgaggcctggcctgaagcctgccacgcgctccaagtgccgagaggaccccacctgggccctcaaaggtgagtaccttgtcagggcccaagtgccagcactgctgcctggaaagtactcctgagtggctgggaggacaggggtcctggtttaggacatccccaaagtgggctggggatgcagtcactgcctctgggtgagccagccacttagagagggggccaagctcgggggttcagcgcataggctctgaggtcacggatgtagactgattcctggttctgcctcctcccagctgactgctttttgggggagtgttgtttggggagtgactcaacctctgcatctcactttccacatctgtaaaatggacatcacttacggtaaaatgataccatgcctttcacaaaaggcaagccgcaggcccagagttcagcgtggagccgggctggatttgcctggggagtctggcagcactcacaccacccctgtgggtggctttgctgaggccactgctttggccagagtcccgggcagcctgccagcccaccagtcactcctgcacccggagagggccccttggccacacaggtcacttgctcctagggctggatgccaggcaaccatgcagccactcacccctcacccctgggaggcaagtctgctccatcccactctccttatgcggggtgggggtacacacacaagagactcaagaaaccaggacatactgctttcccaagagggtccaaagtaacaccaaatgcaaacatgccccagtgagtccacactgcgcacttcccctgcaaagactaaggactgactctccaccctggcagcctccataacagtgacgcactcactgcgcaccacccgatgccacctgttcaaataactgcgattcacagcaggaattctcactacagccaggaaaaggaggggaagatctgttctgacatggaaagatctttaagatgtcaaagcaaaaacacaagctataccacacagtggatacagtaagattctttctgtaagacaaaagcaaaactctgtgtctgcttgtctaatgaaccaattagctaaccaacccagcaaccaagaatgaagacagacaatgagatgacagacagggtgaaggtcctcccttcccagagccgtttgcttccagacccaggtgggggaggaggagagaagatggagtgagtctcactttatttacttcttcactgcctgtatctttcataatcaaacatgtcccatctgtggcaaagaataaaagtaaattgtaacgggtctaaaaagcttcagaattctttgaacatttcagtcttttctcctcctccattaagatctgagagtaaaaagaggaggagataggctgggacaggtcttattgctgcttcagtgcatttctgggagcctggtaccatgaaagaacagacgggtaggagcccacttggacgcatcatgaattctgtgcaggcaaagaaaccctcaaaattaatgacactgtgctgtgttccctgactatcagcatcctgttctgaaagtcaagaaacttggcagaggaaggaatctgaatcacaactaacagtaatgaggtgtgataacacggccatcgagctctcactctggatttatcgtgggtcaaaccgcaactcccaaaacagctttggacagcaagcgcctccgaagtgtgcatgaccccagtttccacggggagtacgtgtaaaaagctttcatggggcttgaggatttccatctggcttggtccctggagctggttcagttaaggcttcaagaagcagaagagtgggttacctgtggtgcccccttcgagtcccgtgccataggcggacaccagggcagggttccccgcttgtccaggctccccaacgcgcactttgaaggggcttccaaccacgtggctcccattgaacttgacatcgatggtgtggacaccattctcatgagggatgaagcgaacagcatacttatctaggagaatgagcaaaggcacagggtgaaatcaagcaaatggacacccctgagttcagtgaggataaaggatggaggccaagctgagatggcccatttaaaatcaacagttctacagggagcctggcactcagcatcctggatttcagaaccagacagaccccctgggtatccctcatcagccccaagggaaacgcatccacattgcaaatcctataaacacaggacaagactctgacccctgcctcagaagaacacttcctttctttagaaaacctcacttcttcagtgtgaaattctgtgaatgctgttactaatcctgtcacgagatgaatctcatttcaccaaaattaaattatgtttttccactaaaatgatgatacaagttgaagacacagcactctgaaattggaagacctcaccacttaaggctccgcagcggcttactcagctgaactccaggttacta

SEQ ID NO: 3797 - DNA, 19232 bp, Homo sapiens
acacatgcgagtttttgctggcttgagaacaagcaaggaaaaagacaaatcccacctaccctagcctaaaatacacagtgagtctcagaaccccgcggaagctgtggctcatttctaaaggtgctggcaatatcgaggaagacttgtatccacaaaattccaaatggaaaagagagaaaagagaacaacaaacagatgtgtgaaaaaaagacacgaagtacaaaacggatgtattaatggcaaatagagtaaacttgaagcctgaaattgcagcactcatttggtgaccaggagtgggcaaacagaaggacaaaggcctacaaggtaaggtaaatggagcagatggaaagaactgcagttcttgccagtattattgagtcactacagcaacagtaaattgtccctctaaactttgtgtcatgtgagaaaaataaaacgataattaatacaaaaagtagattctacattatgaacccagaaaccaaaaagctctgctctggatctgactctgttacttactacctgagtgacattgatcatgtcatagagttctattccctcctctgttactcaagagaacacttgacttctttagcctagagttatcctatgaaataatgcatgttatatatcttcatacatggtaagagagtacatcaatggaagatgttgcttatttaacatgccaggtggttgatacataggacacgcagtgactccacagttaaatataacagtgcccaggagtctgctttccgttcaaagaagaatttgcagacacttactttgactggcttaatttcagacttcttgggaattctgttctgaagttaggaacttccaaggtagaggacgtttgtgtttgtgtattccaaaatgtatttgcccatgttgggtcagtcagattgagttggcatgttcttggtgaggtatacagtggaagtgggccagtttcctgcttcacctaggctaggctttcctttttcctagaaaaatgaaaggctcaggaaagcagccatgctaactactataccaccatcaccaccaggaaggctcaggacactcattcccaactctggaggatgctgtggggttcatgagcaggaagagatctcctgataaagaggttaaagacctatcatatctccaaagaaagaggttaaatgattttctgtgagcttcgtaaatgtggaagtcaggatttaatgtattgacattgatttgcttaactctgtggggaaggatgtagtcatcttggcattctattttgccgtggcttagaggatgattctttcaatgaaatagactccacctcctcctagaagtatgtacaccactgtacatgcaatccacctttgcctgctggaagaacatatcctcagtcttttaagattcagctcagtgtctcttctttcctgaaatctttactgacctcaccatcatgtattctgaagtatatacagcatattgttgtacattcaccccgtctcctctttgcatttggccattagactgtgagtgccaaaggacaggggctctgtattatttgcttttgtatcatcagcatccattatagtgtctgtcctatagaaaacaaaccttaacataagactgttgaagaactaaattcattgctaagtgattgaaaaatgtgattgaaaaatgggtaactggttgtatctctcaactagtgaccattagcctggcagctttccctgttgcataaggcttaagaatctcaagtaccccactgccctgtgggtaaaaactgtcaactaaaaggagacagaaaacagagtgtgacaaaatattaatatcattccaatttaactgagcagattatctaaggtttccagttatccaaggcagaggaccattatattaggacagatcatttacagtggatatcagactcagatttttagtatgaaagagaggggcaagtattgtactcttttaaaagattacaaatattcaatccttggcaatttaatatttgtcttcctttgtctaagaatacgaggggaatctttgatgaaagacttgttgaggcatatggcaagttttgaaagaatttgaaggtgaataagtaatgaaatatctattccctcttttaacattaaaaacaattgtatttaaccaataaggaaaaaaattcaggtaaaaaaattccatgcatatttttcttttttaatttaatttctactaatattatgactcagaggctgaatccaggataaaggtaatctatcatcagggctctctttcagggcagaaagagaacatataaagactagaaatgaaaaaaagagattaaacaaggcttccacttcatctctggattctatcacttagcatagtgttttcaaagttcattcatttgtatcatgcatcagtacttcattcctctttgtggctgaatataaaatctcgttgtacagatgtaccttgtattgtttgtccattcatctgttaatgaatatctgagtagcttctgcctattgactgctatgactagtgctgttaaaaacatccatgtacaagtttttgtgtggacatatatttttatttctttgggtatatacctaggagtggaaatgttgagttatatggaaactctatgtttaatcatttgagaaactgtcagattattttccaaagcagctgcaccattttatactcacatcagcagtgtaggagggttcaatttctccacatactcaccaacactttgttatctttttgatacttgctatcctagtgcctttgaagtggcatctgattgtggttttgatttgcatttctttaatgactaataatgttaagtagcttttttttatggctcattggccatgtgtacgtctttcttagtgaagtggctattaagatccttagctgatttttaatcaggttatttgtcttttatgattgagtcatgtctttatatagtcttgatacaagacccttatcagatatgtgatttacaaatacttttttccactctgtggattattttttcactttcctgatgctggtctttgaagaacaaaagtttttatttttatttttcttgtagccattgcaattttggtgaaatccaatttatctattatttatttcttttgctcatgcttatccaataattataatccaacagattattatccaataatctgttgccaaagctaaggaaggtcatgaatatttactcctatgttttcttctaagagttttgtgattttagctcttacaattaggtctctaatccatttggggttagtttttgtgtatgatatgagataggaatccaacttcattcttctgcacatgaatatctagttgtcccaatgccattagttgaagactattcgtttctgcatttaataaacttgctatccttgttgaaaatcaattgaacacagatgtatgggcttatttctagatgttgaatttatttctggatgtttatttctggaatggaattctgaatggacgtctattcctttgatctgcaggtctatccttatgccagtatcatttgttttgattaccgtggctttgtagtaaattttgaaatcaggaactatgagtccttcaacttggttctgtttcaatatttgttggctatctggggttatttgaaatttaatatgagttttagaaccaggttgtcaacttctaaatagtatcagcgaggattttgatagaaattatgttgaatctgtagatgattttagggaataatcttaacaatgttaagtcttctgatctatgaacatggggtcttttcccattatttagatcttctttaatttcttaatatattgtattttttagaatataagtttcgtacttcttttattaaatttattcccaggtattttattctttttgatgtagttatgaatggaattattttctttgtttcatgtttagattgttcactgcaagtgtaaagaaataaaaactgatttttgtgtattggttttgtattctgcaactttaataaattcatttattagtactaacagttttaggtggatttcttagaattttctatacataaaatcatgccatctgcaaatagtcctaacgctacttcttcctatccaatcttgatctcttttatttctttttttgtgctaatcggcctatgtagtgcaattttgaatacaagtggtgaaacagacatccttattttgttcctgaacttagggagaaagcatccagtttttcaccagtaagtataaaattagctgtgaggttttcttatatgtcattattattttgaggacatttccttttattcctggtttgtttagattttttgtcttcttttttaaatcataaaaatgtgttgaattttgtcaaatgctgttttagcatctattgggatgaacatgtggggttttttttgatatggtagaatatattaattgattttaagatgttaaaccaaacttgcatttctgggatatatcccacttggtcatgttgtataattatctttatatatttctgggttcagtttgccaatgtcttattgagggtttttctgtccatattcataaacatattggtctatagttttcttgtgattttgttgtccgttttgtatcaaggtaaaacaggcttcatgaaatacattgggaagtcttctctctcagtatatttattgtaatagtttgtaaataatttctattgattcttttttaaatgattgataaattcatctgtgaagcaatatggaccttggctctttcttaatgggtaggttttgaatactaaattaatattttaatttgttataggtttattcacgttgtttatttcttcttgagtcagtttaggttctttgtatctttctaggaatctgtccatttcatataaattaactaatttgtttgcatataattgtttacagtatttgttttaattctttttatttctgtaaggtctgtaataatgtcccctctttcatttctcagtcttgcaatttgagtcctctctttttgtcttagtcagtctagctaagcatttatcaatgtacgctttagtcatgatatctcctccattataattataaaatgcctttctttatctctagtaacattttctggtttagtctatttggtctaagtttttaaaaccactccagctttcctacagttgttgtttgcaagatatgtcatttccatcattttacttgtagcctatttgtgtctttgaatctaaagtatatcttcttttttaaattattatactttaagtatatcttcttttctaaacttacacatggataatgttttctttattaaaaaaactccaatctgacactctgtgccttctgattgaattaattcacagacgtttaatgtttttatttatatatttgaatttacatcttacattttacttttgttttctatatgtctgttgtcttttttgagtctcaattcctctctatggatttcttttgctttaagtgaacattttctaatgttgcatattaatttctttaataattttttcactatatttttgacttaatttgtagtggttactctagaatatactatatacatcttaactgatcaaaattagccttagatttaaactagcctaattccagtgatatatagctttatttcattttcctcttttttgtggtggtgttctatgtattacatctattaacattataaacctcaaaatacatttctataattattattctaccatatgtagtcattttcttagcccattacagctttactctccctaccgcctttgtgctattatcagcaaatatattacgcatatattacaaatagcacattatatataaaaaatatatgaaagtttttacaatttctctttaaatccatcaggagaagaaaggaaaaatattcatttatagtgtcttttatacttgcataatgacttttgctgattctctttgtttgtttgtgtgactccacatggcaatctggtgtcaattgcttttaggctgaagaatttcttacagtattacttaccaggtgagtttgctagaaacacatttcctcaccttctgtttatctgttaaagtctttattttgccttatttttaaaaagtagcacactgtttttctcttatgactttgaagagttaccatcatctttcacttttagcatttttacatcatgtgtctgtgagtctgtttgtgtttaccctacttgaagttcgttgtaattattgtcaataaatgtaagaagtttcagccactatatctttaaatatgttttttttcctttctctcttttattctgataatcccattatatgtatattgatgcacttaatggtattccatatttctctgagtatctattcatttttcctcattcttttttctgtctgttcttcagcttgcctaacttctatcagtctatttttaagttcactaattctttcttcctccagttcaaatctaagattaattctaataaatgttttatttcagttattatagttttctgctccagaattttcatttggctctttttaatgatttgtttagtatttcttttgacctcaggagcattccttcaagttgtcagattgcccggttttctcctgcaaactagttggcctacaaactaggctgtatctttatcagatcctaaaactcttcctaatattttttcactgtaaccttccctgttcttgagattgtcctttggcttcagcttcttcatgtttcgttgaaaataaagtcagatcctttgggaagaatttagagtcatcattttgtgtcctgtttctcctaccaggcaaaatctctgggttaaggccctagagctaagagttgggacattgacaagattctctttgagtgacattcttgtttcagcaactgagaacttgatgcagggagggagatctgcgcagcctgaggtcacttagtttagctctccagttgtagaacaattatcacttcaagttctggggcaggggctataaggatctcagtattctcaacaggtggactgtatattccatgagtggggattgagcagagaaagggaactgctattcttgaccgtatttacccaggtcttagcctcagcaataggcacttggaggtaggatgagaaacactgaagtaccgctcctcctaagaataaatccctctaggtggagagtgggaatggtagaatccctgtattcttggctccagaagtctggaatggggaggctctaccctgctgagctgggtagggggagagatgggactttctgtgttcaagtatcacggactcgcctttcttactgaatttttagaaatttctttgaattgatgtttcttcatttgctgtctgcctttagcacaattttcaagaggactttaaaaacatattttttatcagtttcattggagtcagtggagctccagatattgtcatgccagaagttggtctttagcctgaatttcttttataacccatagcaggttttacatatggtgtgatctcaaggcataaaaaatgtattagatcttaatgcttaggatattccttggtatgctttagctaatcaattaaattttgctgagttatatttaaataaagcataaacatgtccttatttttacgttttgaagtcttcagagtggttgcatttttgctgtttaattttttcaccaaatcttattttcatttacaaattagaatacagagtcagagaagtaaaatgatttacctatgaatatatggtaagccagtgaatttttcaaaagacagcatactcattttttcccatagctgttaacttttcctttttccccatttatctttaagataagtcatgagttagagaaatctgtttcataaacagcagaaatattagtacttgctgtaagtatcaaggcctgaaatttgatcttccccagtccaaaaattataaggaagagatgttttataaggctgtcaacacatctggtgcacaggtgaaagctgtagatccctaaaactggaagcaagaagcttttcattaaagagtttgctaagctaagcatatcttttctctgttcactaacgtatttctacaaattttacttgtctatattgttccaaaaaagcttggataatctaactaaaggaagttacaaccaggaatcccgctcaatccagagaaaatgatgaaagtattagctgacaaggccaatctaagtaaggatttattttggccaaaacttaccatttgtctactttacaagtgaagtgaaaggatgaatcaaactggaggccactattttcagcaaaacaatcaatgcagaaacaagaattcaaatgccgcgtattctcacttataagtgagagcttaaaatgtgtacacatgaacatagaatggggaatgatagacattggagatttgggagggcgggagggtgggaaggggtgggagatgagaaattacttgatgggtacaatgtgcattattcgggtgattaatgcactaaaagcccaggcttcactactatgtgatttattcatgtaagaaaactgcacatgtactccttaaatttgtacaaattaaaaaaaaaaaaaaaaaggaaaaaggaagcaaacaaacaaaaaacaaaacaactaaaaaaggcacacgtggtcagaccccagagctgttttcgggatcacctggggaaataatgcggcaattatcacatcagcctccacttttacaatggacaactaattttaagaattatcctatttccaggatatagtacacatctctgccagtttaagcttccatagacatgcttttatcaagcaccttcagcgtccagattatagggttacattgtcttctcaatttttgctgtaattcttatttttggaaatttccacgttgttgttggtagtattccattacatgggatatgccatagtttgtttaaccattcacctgttgaagaacatctgagttgttttcactgtctagctatcacacataaaactactgtggacatctgtgtaaggtttttatgtaaacataaacttttcatttctctaggataaatgtccaggattatagctgctgggtcatatggtggcagcatgtttaatattttaagaaacttcctgtcttctagagtgcctatataattttacattccaagcagcaacatatgattgatccagttttcctataaccttgtaatcatttggttacaagctattctggttagtatatctctcattgtggttttaatgtgcattcctccagtggctaatacttgatcaactttttatgtgcttatttgccatatgctctttgatcaaatgtcaattttttcgcccatattttaattagatttttcaaactgttgattttgagttttcagatattagtcctttgaaaggtatattacttgtaaatattttctcctgtctatagattacctttttatttatttaagagactttcacagaggattagttttaaatttttataaaaattcaccaattttatcatttatggattatttttggtgcttaattaagaaaaacctttgcctcgctctaaaccctgaagattgttcgtatttttttctaaaacttttatattgttatgttttacatttaagtttatggtctattttgagttaatttttgcagaagttgtgagacttaaggtgaattagcttcaaaatattaattggaagcgttcatcttcttctattttatggcagacattgtatagaatcggtgtgaatttttctttaaacattttgttgaattttccagtgaaaccatctgtgcctggagatggtttgggggaggaattttaaaactacatattcaactttattagtagttagagagttattcaagtgatctgttttgtatcagataaattgtggtaatttgtgtttttcaaggaattgattctctttcttggtggtatttttaagtcctatctctttgctgataatatatccagttattccatcagtttttgagacgagtgttgaagtctctaactgtagttcttgatttgtctatttcttgtttcaattctaagatacacatttaggattgcaatattttcttggttgattgacccttgtcattctctgtctctgctgctttgctttgctttgaagcctactgcatctgcaataattatagccacacttgctttttttgagtaatgcttgcatgatgtgtattttcccctcatttcttttaactttcctatattgttgcatttgaagtgagtttcttgtagacaggatcatgtcttttaatcacctctgccaatctctggcttttaattgatgtatttagaacatttacgccattaatgcaagtattaatatgctagagttgagtttctctttttttgttgttttccatttgttttctttgtttttcatttactgttttttctgctttcctttacatttatgaaactttctaaaaattcaatttttatttatctttaatgttttgaatatatctctttgtattgttgtcttcatgattattttaggtgttactatatattatgtatagataacttataacagtctaccagtgtcatcattttgtttgtttgagtgaaatttggaagctctacctttctttatatctttttacactcccacatttatattacaattatcttaagtatttttttctacatagatttaaaataataccaggtagttttataatttttacttcaattataaaacataatttagaaaacagaagaggagaataaaattgtattgaatttacttgtagttttgtttaccatgttcttccctctttcctgatatttgaacattccttttttttaaaaaaaaaaacaaaactatttcctttctgtttaaagaacatcatttagctgttcttttaggagacgtctaccagcaagcattgcctctgtttttttttgtttgtttgtttgttttagtctacacatatattaatttcctgttcatttctgaaagatattttcactaggtatagaatcctggcttaagagattattttctatatcactttaaaaattatctgccacttctttctgtcttccatagtttctggtgagaaatccactgtcattcaagttgttttttccttagaaagaaaagtattatttctttctcacaactgttgagatttttttcttttcctttagttttcagaagtttcactatgtagctttttttgtgtatgtgtgagagattatcctgtttgggattcattcagcttcttgaactgtagatttacatcttttgtcaaatttgggcagttttcagccattatttcttctatttctaatttctcagcatcatcctttttctcctctccttctgagtcgtcaatgacccaaagtcagattatagttccacatatccataagggtatactgttttccagcctgttttctctttgttgtgtaaatttggtaatttttatatttttcttctaattaccttctaatttactaattttccctttgcctcctccattctgctgttaagctcatccattaagcttcttacattataatatttttcaactctaaacttttcatttttcttctttatatcttttatatttttgctgagactttgcatggtttcatttgtttcaagcatgtttgtaattgctcattgaaatgttttcataatggttgcattagatatttggtcgattatcctaatatatttgtcttctcatagcttgcatcttggattgtcttttcttcacttattcagagatcttcctagttcttgatatgataagtaatttttgacagaaatatgtacagtttgagctttatattataacactgaatctcacataaatctctgtattaacttgattcctctgacacgatgctggtggggatggggaattgctggctaattattaccaagtgggagttaatgacaaggttctctactagacctccattgacaccagaggaatgggtcttcattatcgctgattgtaggtaagagagttggctctccactaggcctccactgatactccctagtgggagaagttatagtgactcattgtactaaatgcttcccctatggtatccatgacaccaagagggagaagtaacaccattaccattggacaatggtgaaagttctgcctctctctatgcctccacaatcaccctagtgaggagaagtagggatggctcatactacttgatgggtgtggaaatccaggctctccaagtggtctctctccattgaccctcactggggcatgagatggttgtaggtggtgactatgaaggtcccaactccttactcagtcttctctggcagcaccttggcagatgttatgggaccctcatgacagactggggacgatggaagtctaagtgttctacttggcctttgttggcatttgttgaggtgctagtcagctgaagtaagaagttattgtctaaaatttctctgtctttccattcaactcctttatttgtcctttggccaaagacagcagacttgtgtttgggctttttctttttttttcttcttatctctggctttaagtctgggatatatgatataaagaggatgaaagggaactcattatcatgtcatttatgggttttaagacccccttactagcccgctttcttctctctacttctcagagttttatgttcatttttgtatagtgtcttgggtttttagttgtacttagtgtgagaaatagggaaacgtatgtctattccatctttttggaaggagaagtttcaaccaactatgtcttcagaagtacttactcatttttctaccacaaagtacacgtaaaactagttgtgtttgccctatggctgggggaatcaaatgcctcatccctttagttagcattagatttgataagtattcccaggaagaagacaaatgagaaaatataaacaaaacaaacaaacaaacaaaatggattgcaactttaaaggatgatatataaatttgagcataataggagctattcagaagtttaagttaaaaattattggccaggcacggtggctcacacctgtaatcccagaactttgggaggcctaggtgggtggaacatgaggtcaggagttcgagaccagcctgaccaacatggtgaaactctgtctctactaaaaaaattaaaaaaaccaaaaaaataaaaaattagctgggcgtggtggtgcacgcctgtaatcccagctactcaggaggctgaggcagaagaattgcttgaacctgggaggcagaggttgcagttagccgagattgtgccatcgcactccagcctgggcaacagagcaagactctgtctcaaaaaaaaaatatttacaagctttttagctttttagcattatgttgtactatgtttcgattttcaatccagggattaaaaaaaattgagaagtctggcactgtggcatgcacctgtagtcccagttactcaggaggctgaggtaggaggatcacttgaacctaggtactggagaccagacttggcaatatagtgaggccttgtctcaaaaaaataaataaaaataaattaaaaatatgagaattcctggacatagctgtggattttgtgtcaagtcagaaagattgtgaaagcatcaatattataaccaaccctatcatacttaaaatttaatagaccttgggatttggtaatcatttccactggaatgattttagtcattaccttaaaatttattattaactattatatttattatttttattaattaccttaaaattttattaattacctcaaactaattagagtttcaataaaatgttttaatcctcacatttttggatgctaacattcaaggctgaattccacagaaagttaagaattgtcagtttacttcaattaactccttagataacattttttgttaaatgtggcaaaatctatgtcattatttaaaaatacagttaatctacaaattacaggtccacaagctttcttatggctttcttctaaaaatataggcctgtgctttcaattttaatatctgactcgaagatcaactaggtgtcaggtacaaaactcaacatctattctagcttcttttctatttctttctctgcccttatttcattaattttcatgatcacaactacgatgaataagctttgaagttttaaatctttgtttctctttacaacactcttccttctgtactctacatttctcactgtatttgaccttttctccaggaactactgcagtgacctcaagtaaaacaaatcctaatctaaacttcctaactctctcccaatcaaaccatttctcattgtctcattgattcattcattataaatggtggtgccactctttcagtctctcaaactggaaagttcagtgacattcattccttctctacccaccaagtatttaagtcaccacaaattccgtaagctcattacaaatatctcttgaatccagtagaatttttttttctcacaacactgttcccatgatgtccattgtctctttcttggaaagagtttctgctctgatttttccaatgtattccaaatgaatccgatataggcttattttcccattcatctcaatatattttcctattcattccaaatgaatcctatataagttcacttttcacttgagttacatttctaatgtatgaattcataatgacatcatcatcaacaatagtaaatctccacatttattgttcggctaaaaacatttcgatcaaggttaaatttcctctgcgttgatattccatccagttatgtgtctttatagtagaatgatttataatcctttgggtatataccagtaattggattgctggagtcaaatggcatttctggttctagatccttgaggaaccaccacaccatcttccacaacggctgaactaatttacacttccaccaacggtgtaaaagtgttccaatttctccacatcctctccagcatctgttgtttcctgactttttaatgactgccattctgactggtgtgagatgctatctcatcatggttttgacttatatttgtgtaatgaccagtgatgatgagctttttttcatatgtttgttggccacaaaaatgtcttcttttgagaattgtctgttcatattctttgcccactttttgatggggttgtttgtttttttcttataaatttgtttaaattccttgtagattctggatattagtcctttgtcagatggatagattgcaaacattttctcccattctgtaggttgcctgttcactctgatgatagcaaagatttggaaccaacctaaatgcccaacaatgatagactggacaaagaaaatgtggcacataaacacaatggaatactatgcagccataaaaaaggattagttcatgcccttggcagggacatggatgaagctggaaaccatcgttctcagcaaactaacacaggaacagaaaaccaaacacaacatgttgtcactcataagtgggagttgaacaatgagaacacatggatacagggagtggaacatcacacactggggcctgttggggggtagggggtaagggaagggatttcattaggagaaatacctaatgtagatgaggggttgatgggtgcagcaaatcaccatggcacatgtatacctatataacaaacctgcaggttctgcatatgtatctcagaacttaaagtataataaaaaaataaaagaaaagctctacatgacagcttaaggggattagaatttaccagagccaatggggagccagaaggttttttcaaacaagtaagtgagaaatttgaggtaggagggggctttctgttgttattgatactaatttgtgatttagtaaatattttggttaatttactgttaaccatcattgtctctcttttctctaacagaaaaatagaccgctagccttgtaagacggtagttttcattgatgtgtgaaagatttttttcctaagttcagctaggttttattagtcaagatagctgtcatttttttcccttaacaatgtctctttatgtaaatttattctccattttgattgctactattctatttcaggcccttatcacctcacatccaaatagctgcagaaagagagagaagaagaaaggaagtaaaaaatgaaggaagggaggagtaggactatgttcagacaccctccctaggtcaattaaatcagaattttggagaaatggtcaaggcattcaaaatttttctttgtgccaccagggttgagagccattgcctttttggtcccttttaattagattaattttacctctaaaccttaacaccaaaactcaattaacctttttaagacataattttcagtgcatgttttactgctaaatttcctcagccagagaccgtagataatataccattttttaaatttcacgagagagatagctctattgacaaagctgtatgaatttaatatagttccaaggctggtactttcctgacttggctcattctcttacaaatctaagcatgttgtagagagtaggcttctcctgcctctgttgtctacagtgaatatttatggagataaacttccaaacttttctttgattcttcttctgactttcgattttccctcatgtcaacctatgtgcttttctatctggcctttctccttcagactgactgaatgacatttaatcacatctttctcttttctgcgaggtctccacagattgatggctacataaccatagccctaattttgcagggctacacaaacaccctcatctatatcctgctcttatagacaacccaaaagcaagggtacttgaaaacagtcattaaagattgcaggcatggagctagggacaaggcacaaaatggcaaatgaagcatcatttcatttatatattaacatgagtgggtctaaaatgtagcttctttgtaatatgtgagattgtgatctcatcttccatgactgcgtgccttgattctaacaacatatatcatcttccaatacctgcactcatttttaagaaaacaagttttattttatcccagtggcgtactagctagtaaactctgaagtcattttcttctactctatgattaagcaccgaagtgtctggatgaagtggaacccttcaactttgctggcattcttagatggaagctttacacatttaaaacactgagcttctcagtccactgattggtgctgcttggatcaccagtccttggcgagatccagtcctatttcctaacactgggcattatgttttttctgcatcctatccttctatttagattgggcatcctttaaactgggatcttgctatgttccttgttacttgttattcttcaactctctgttgtggaggagctgacaattgtgccttttattattattttaattctgtaataagcccaatgatataaatacattctccaattctgtggtttgctttttcactctgttgatgatgtcactgatttttccctagttctttgaatagctagcatttgtaaatcttgtgggtctcattttagacataaagttctcagaagaaccttcttagattactttgtttaggactgtgtcaatgaagcattttaagcaaaggcacaatatgatgagatttacattttgagaggatcattcatgcttttgtcttaatgaaagatacaggagaaaggttagcattttattgaacaattctgaagatatcttggttgattatggcttaagatcatggcagcagaggtaaaaagaagtccatggatcctagatatatttaataaagaaatttgagagttgatgcattaaatgtaagagattgagagagggtggttctatgcttgccccatggatttctagtttcagtaagcatctggatagataatacaatacaatgcaatacaatacaatcgcttgtatgactaggactgagtacacagtaggatctcagctcactgcaacctccacctcctgggttcaagcgattctcctggctcagcctctggaggatctgggattacaaggcatgcaccaccatgcccagctaattttttgtatttttagtagagacagggttttaccacgttggccaggctggtctcgaactcctgacttcgtgatccacccaccttggtctcccaaagtgctgggattacaggcataagccacgaagcccagtcaacaattaaataatcaagtcattattgtgaatttggatctaaatgacctggcagaaaccatggagatgatcttggatttaaagaggaaaaactcaaagcaatgtattctgatcaagaaatggcaggaaatggcagctacctgatatggaacaatcaacaactgaaggtttattttgaatgagaggtgttgtccaactgcgagacggagtgattgaagctgagaataaatggaaacacaatcaatagtcactccagtgaggtaggaaagaaagccattccgaagtggcagagaagctgctttttcctcctgcatgctgcctgctagtgtggatcttggcataacagacactacttggcaaaagatccatccttccttttcctatactttgctcagcggcctggaagattgacctcaaaagcaaaatcacctggatttccttgccatttggctttcaaatgtgctcagccaatgacaggctggaaagaaattgacagctgggaaaagaggaagatttgtgtacaagatcccttccactcccatctcattacctgccatggtcctagcagtggctgttcttattatggccacaactactcttggacaggccaacatccacaactccatccttcaactaggcttcattaacactgtccctcacccttatctctttctgggtaggggtgataaaggtttcctgacatcagagttcctgagtgcctcatatattcttgttggtccctgaaccttgccccaacatcaataaaaagttccttcattaaataattttcagttgaatctttcgtgctgggatctgtccaattcgactttagcatacttttcgtgccaagaaagtgatagtttcttgccaggatttggctcaaagggctcacagtgggtgaggggatgagattacttattaagtgataaaatggagatcacagtggttaacctgcctaagatcacatggttggtcaactcatggtcgattcattaaaatattaaaacatagaatcagtcaggc

SEQ ID NO: 3798 - DNA, 2641 bp, Homo sapiens
agctacaacatattttcccactttaaataatatttaacatatgacaaaccccagacaaggcttttaatatgtataaagaactgcagtgttaggtggtttatttgcaaactgttttcagtgttgtccatttttatggcacctttaacaatattcttgtttccaaagtacaaaaaaaataggttaaataatctagccataactgaatgtcaagcaataaaacaaatgacttttgtgcatagacttaaaaaatacaaattttagacatctgcatgtaaatgcaatctcttgtttactgctttcttcaacttgagcaatcgattccttatttactattaacttaagaacttgtaacggcctgtaaacattttctctcttactcttctttcaaatttacctgtccctgcttttgagtcataatatttaatgttgttctgcacatctctatacagttaactttttggctttcattctgtatagataagaaaatgttatattataaacagcctactcagtgcaaatatttatctgtttatcaaatccacaatatgctgtataataccggttttactatataatctattttagacatagctgtttagaactagagtgtgctatttttgtgtttttctgatgtgtggtgctagacaagttacttttgtgaacaacaaaaattatcccttttattcctagacaataccacctttgggtcttgttaatttcactgagtataactatatatttgtatatatatacatatatatatatatctacctatgcccaactggcagctgtatcagagtgctggatttgggacatgcttttctctttaaatacataatatcattatataaattattctagagtgtatttaattaggataaaattacttccttagtatggatatttgacatctatagggtgaatttgtttataaatatggctatatggaaacttattagcatttactttatgtttgctacttggctttacagcatatctcctaagctgaaaaataatttgccaggccttcaagatcctaaagaaacttgtttaatggagtaatatacttttttttcttattaaggaattgtattactggcacctaacacagttgtattcttagctcctattatagataatgggcatttacataaaatatcctagatggcttgatggcagaataaacctttcccctcctacctgagtcatgagaaggatggagacgtcctctgccataacatgggccataaagcaaattcgacatgggatgttctgtttcagtatgacctcaaccagttccatgaactgagtgaaggaccttcattttcaaagttatttaataagtagcttaattaagcctttctacccattctcccaagatctactggcattattgaaaagcaaagtttatcaaatatctaactaaggatgtagttaaccttattaaatattgattagaattgttctgtaatattactgaatttgtaagatctttagcaaagatttttgagcaatttataaatgtagagcaaatgtttctgtttactgcactttttgtaactgaaggtgataaattctcaagccatgattattggcttccatgcactgcaatatttatccacaattctagacattttccatttttgtggaagagttgctgttaccttaattataaatgcaattgtgtggttaatgagagctaatgctagtagttaaccttttaaagtggattggctacagttgagggagaaatctcttttaatataaatcacatcattccttaactgcctctcttggaaagagattgaaaccttttttttaaagcacgatttagcatcctaagcttcctgagggtagagattgtatctttttgcgtctgcacaatggctagcacatgtcagcatttgacaattgttaaatgataacaagtgtgccccaattaaaacgtttttcctgggttgttttgttaaatttacaaagtaagccaagccttacggttaacattctcctctacaaccaagtattaaagccacatttaaaaagaccacatgaaatgctgattctaattgtgtgtaggtcttgaggattaagcacacaaatttcacaaacttctgtttgagtaaacaaactcagccttctgtaaatatacatgcaagtttggaaacagtaatactgtacctataaatatatgctgtctgttttgtgtacagtatgtaaaaactccttttctgccacactaaaaatgcaagccatttatgggaatcctaaaactagtattgaactaaaactttgctaatgatctttattagaggatcgtccaacttttcacttaccttgggttttcttttcaattcactcttacactagtctgcttatttccagctgtttattttattgagtcctgaatttaaaaaaaaaatattttgattcattttgtaaatacaagctgtacaaaaaagagagatttaatgttgtcttttaaatactccaattttcattctaatatgaatgttgttatattgtacttagaaactgtacctttaatattacattacctttattaaaagtgcattgaacacatcaattttagatgtgctttatgtactgttatcctataataaaacttcagcttctaatggaa

SEQ ID NO: 3799 - DNA, 9852 bp, Homo sapiens
agtccttccgggagctccggagctccggggcttccaccacatctgccggctcaggacgggtcgtgctcatcccttaactttttaactttttgttgtttctatttatattttattgtgctatgtcttgaaatgttgttgtagctattacttttgattggatattacttagtattcctactttaaataagagtagtttgcacaccacacagctatagtgttataatattctgttttgttttgtatcctattagcagtgaggatttttttttacctttaggtgatcatttattactcattaatgtccttttcttcctgattgaagtactccctttagcattcctttaggacaggatttgtccccagtgccttatttagttcacttggtgaggtcatgttttcctggatggtgttgatgctagtagatgttcttcagtgtctggacattaaaatcttgggcatgcagcaccatatgagaagtttaaaaaataaaatttaaagagagaaaaggtgagtatttattgtagtcttcactgtctgggattatttgtagctatctttcttgggaaggcttttcacatatttgaaaagagttgggtgttgtgatctaagccatatctgctttatggagcaccttatacccaataatgctgtaattcttccagactcagagaagtaccaccttgacagccttcaacaagatccaggagaattttctggattactagccacagactctttccctacccttattttctctcaaagatacagagtctttctctctgttctaagccacctaaagctgggagaagaaagacacaagcacctctggccaccaccactatgactgccctggatcagacctgaagctagcacagcacaggtcttgctcaagtcctgctgcatgcaatttctgacgactccctatgttcactcaaggcctttggtctctacaattagcaggtggcaaagccagacaggcctgtgttctttcctttagggcagtgagatccctcagtccctggctgggtccagaagtgctattcagaagtcagggctttggccactttttaatagggttttttgtttttctcttgtaaatttaagttcctcatattgaatattagatctttgtcagatacatagtttgtaaatattttttcctcattctataggttgttcactctattgataatttcttttgctgagcagaagcttttaagtttaattagatcccacttgtcaatagttgtatttgttgtttttggtgtctttatcatgaaatctttgcctctttctatgtccaggatggtattgtctaggttgtcttccagagcttttatagttttgggttttacatttaagtatttaatccaccttgagttgatttttgtatatggtataaggaagaagtccaacttcaatcttctgcatatggctagccagttatcccagcaccatttattgaatagggaatcttttccccattgattgtttttgccagctttgtgaaagattacctagttgtaggtatgtggtcttacttctaacctctctattctgttccactggtgtatgtgtctgtttttgtactagtaccatgctgttttggttactatggtgctgtaggttagtttgaagtcgggtaatgtgatgcctcaagctttgttctttttgcttaggattgccttggctacttaggttctttcttggttctatatgaatttttaaatagcttttttctacttctgtgaagcatgtcattggtagtttaataggaatagctttggacagtacaaccatttaaatgatattaattctttctctccattaagatggaatgatttttcatttatttgtgtcttctctgacttctttgagcagtgttttgtaattttcattgtagagatttttcacctccctggttagctgtatttgtatgtactttattctttttgtggaaattgtgaataaaattgcctctctgatttggctcttagtttggctcttcttggtgtataggaatgctagcaaatttcgtacattgattttgtgtcctgaaactttgtggaagttgtttatcagcttaaggagttttgggtcacaactatagggtttagatacagaattatgttgtctgcaaacagaggtagttggacttctctttctatttaaatacgctttatttctttctcttgtctgattgctccagaaaggacttctaatactatgttgaataggagtggtgagagagggcatgcttgtcttgtgcgggtttcaaggaggatgcttcaagattttgcccatttagtataatgttggctgtgagtttgtcataggtggcctttattattttgaggtatgttcctttgatacctcatttattgagaatttttaacttgaagctttgttgaattttactgaaagtcttttctgcatctgttgagacaatcacgtggttattatctttagttttatttatgttatgaatcacattttattgatttgcccatgatggaccacccttctattccagggaagaagcttatttcactatggtgaattagccttttgatgtgttgctagattcagtttgcaagtattttgttgtggatcattgaatggatgttcatcaaggatactggcctgaagttttctttttttgttttgtcactgccaggctttggtatcaggatgattctggcctcatagaacaagatggggaagagtccctcctcctctatttcttgaaatagtttcagtaggactggtactggctcttctttgtacatctgttaaaatttgttaatctatcaggtcctgggctttttgggggttggtaggctatttattacggattcaatttttggagctcataattggtctgctcagagactgaatttcttcctggttcagtcttgagagagtatatgtgtccaggaatttattaatctcttctagggtttctagtttgtgtgtatagaggtgctcgtagtagttactggttgttatttttttttctctggggtcagtggtaacattcccttcatcatttctaattttctttatttgaatcttctctcatcttctttattaatctagctagtgccctatcttagtaattttttcaaaaaaccttgattaagtgatcttttgaacagtttttcatgtctcaatttctttcaattcagctctgattttagttatttcttgtcttctataagctttgtggttgagttctccttgcttctctaattctttcagttgtgatgttaggttgttaatttgagatatttctaattttttgatatgggcattacttcttatgccctactctaaattttgttcttctagaaaactcagaactatgctttctaaaccaattcaaactttctcagtgaatcaacctggactccctgaggccaagttagcaattttccattacacttggttctctttctctgtaagaatatctaatgcaacaattcaagtgtttctttccctcctggtaatgcggggaactccttttggctgagaccaagacttaaaaccttgttctttcaacattaatgaagatctatttagaaagcctccatttttgcagaaaagatatataaacaccaatgaaaatcaatatgaaattatatgacatacaattatattgtggaaagactgaataaataagtgaactaagctctaagaaaaaaagatgatgatataaaatgatatagaagtaaaaacctgggctggtatagcataattaatgtatcagtaaagtatgtacattgtagaagtggcaggaagacagcatagagagtgagacctgaccaaaagctttaaggaaagttctatacccttaaacgagattaaagtggactcaggaaaacatgggccacatgaggggaaggacacatgttccagatgagccaaagctcagagcatctctaccttctccaggaggaaaggggaggcaaagcagcaggcagaagacagcacggccaggtcagcacagggcacccaggccaagccaggtgggctccatcatacaggtagtgaggagtcactgccaggtgggctttattcattagtttgttttgtttcttttagtaacgaagacacatgatcaaagttgacctttgtaagtgttgctgcagctgaacaaaaagatggataagaccagtgttttaaaaattatgttgtatagagcactagcctcagtgagatattagtagaacacacaggcacacacacacacacacacactcacactaagcccagattattctggcaaatgctgggttaagcaaactaaaagaaacatctttagtgctggacttctcagaacctggaatgtcgctatatgactcataaaacagcaaggttaagacagaacatgtcattttttcccagaaatgctgaaacactttccttcccttggcttcagtgtcaccttctttctcctggttctccatcaacctctttggctgatccttcttgatttccttcttgacaatctgctgctgctcagccattctcttttcattccccatggatttctcaagtgcgtttctattcctgcattttaaactttccttgtttttcctgacacctctccttgtctgactcacccctgttctaaggcaggtgttccatctgtgtgcgcttttggcaccctgggatgctcccagcatgttccctgccacactccatcaggttttctccgcagactctgtgagggcagcagccttgtctccaccattccttcaatgctcagcacataacacagaagctgactccataacatttagttggccaactgagactaaatatatgttcctctagatcttaaaaagttacagaaacatagcacaatagacaaaatattctctttagtcaggagttctctatatatgtacaacagtttgaagtcattattaaagcaaagtgaaagagaaactgtcacagaattccccaagataaattattttgctttagtcttcatcatgtgagataatcaagaccatgtgttattgtaaatatttctagcttacaacacaacgacctgatttttattgtgtgaaataaccgcaatataaatcagttaattaaaaattgcataaataatcctttcaaataaaattctgcctaaattttacattactcatatgttcaaatgataatgagctcataggcttttccaatacctcagtcaaaacactgtactgattccagctgtgggaatagtatctgaaagttattttacagatggggaacaggtacttacctgacattggcctttacactactgtgcccttttaggtcaggaaaaagctgttcccttaaaatcctaaaatctcttctgtcaggtctgaagggtgggtgggaaacacagttttacaaattttagccacagatgttttattccttgcttaaagcagtgactagataaaggccactagaagagtctccaatgtttctttagaagcgtgtgcctgagaacatcttccagaaacactcccttgtctctgcccaaaatcaccttaggtaggaaaatcaaaactcagcaggctgagggatccaaggggatcactgagctctgagtcttatgagagaagagagagaggtctaagactttttgtgtataaatttatgggttccaagtgtaattttgctgtaagcatggatggcatagtggtgaagtcagggcttttaggtatccatcaccagaataatgcacattgtacccattaagtaatttctcactgttcaccccttccatcccctcaccctgctgagtctccattatcattccactctctacgtcaatatctacacatcttttagcacccgcttatgagtgatacaatatgatgtttactctgtgtctggcttgcttcacttacaacaatggcctccagttccatccatgtgtctgcaaaagttataattctattgttttttatgcctgaatggtatttcattgtgtatattttctacattttctttctccaatcatttgttgatgggtatttagtttcattttatgtctgtgctactgtgaatagtgttgcaacaaatacacaagtacagttatctttctgatacattgatttcttttcctttgcataaatactcagtggtgggattgctgaatcagacagagccaatagatgatcagtaatggtggccaatcatcagctagaaagaaagtgcttagcagggcttgaaaacaccaaaactctgagaccactgaccttcaaaaacttcaacagccctgagtgaaaagtccaaacacatttatctaccattcgaagacgctttattgtctgtcctctgcacatctcagtagtctctttttaccacactgtctatatactgcatgagccatttatatgaaactatctgacactccaaggcatcttgtactatatattcaactatgtatccctagtacctagcacagtcctggcatatagtttgctactaaacttttacagaatgaaggaattatcttgtatccaggttccaagttttaaggtgattcttcagtaaaaaaaagtattacagttcacaaataatctacttccctttttacaaatgggatcaattttaatcttatctcctaataacattactttcatttactctgatctaaatatactgtcctaagagagcaataagaaagagagttgaagctggagtttgaagaattgtacatggtcctgtgataccctaccttgttttaacctgagtgactctctcctagcggagagagagccggacagactccattttagtttcttcacgtgcagccccctttaccttccacccttaattgcataactagtgtaaactgactcaaagcaggtccaggaatgcacttagtgataagatattgaggcaagctgcaccagctgctcctgggtacgcactcggtgaatgtcacgcaaaacccctgcatttctctctttgtgatagtttaagcccctgcacctggaactgtttatttgttttgtaactgctattgtaaccaattaatattttaactatttgccagctctgcttctgtaaaacttgtttcagctaaactcccccctcccctatttagaccacggtataaaaacaaaaccagccccttcctcggggccaagagaattttgagcattacatgcctctcggttaccggctaataaaggactccttaatttgtctcaaagtgtggcattcctctataactcgcttggttacaacagtccacactgtggcctgaggtgcattgcccacctgagcttcatctgttatgtatgtcagggaatataagcagggtgagagtggcctcatcagaggaccccagatctctggcttacccatctggcaagtgcacctctgtgagcaaagacttcagagccaggtgacaagaatggcccaagcagtccaccaggaaaacctgggcccagtgtacgtcaatgcagagcatcaagcatggtgtaacaggtgcacagttgcctactcctgttcagagatgactgcatcccacataccgtaaaatgaggaaatgcatagaagcagatgtaactgaagaagacagcagaagcaacaaggagggacaaccaggacctaggagggcaccatgccagagacgcctggaccccatgctaggctcagtgcctgttatactcttgggagccagcactttccctctccatcacatggcatacttgccattatttgttgtgtaaaatattgtccttagttttcacctttcctaggagacacaggcagagcctgtgacactacagcttctggcacacagtaggtaggtgcatcacaaacatctgctgagttcacacactcttgccttctcaaaacttcttgtcaagtcttcagtgaaaaggaattgctgattgagcaagaattaaacttctagagactcctggatccactgaagtttgagacaaggtgagatttgtttactgtcatattcctagctcataacatattgtagtcacttaaaaaagtttgttgaataagtgagtaaattgattcatacgtcatacttagctatatattttctgagtagaattgataaagttaatagtttaagtctagtataattttgctttactcattcaatgaacctgacaattcaaataggtgccaggcacactgctgctgaagaaaaagaggtataagatataatttctgtctacaagaaagccacagtctaaaaagtagaaacatatgaacaaatcgtaacaataaataggctaaattcaaaatcagaggagtttgtttctattttaaacagctctagtcaggaagtgttagagagttctaaacaggaaatattccaacacatcatctaagcatgaagcaggagacacccataattgagtttgctgccaccaaccccaacagcaagaattccagtcctgctgctgcaaagtaagtgtcactctgattttattgctgctgtgtaacccagttttagactctctggttctcacttaatgttctaaaaaagtattaaagagaaaattttattctggtgatgagcccatccactgcagccatctcaacatcataccaattataagcctatcatttaaaaagaaagctgttagtttaacttatttatccaaatatcagtattacataaacatatttgtcatcagactttggacttatgggttaaatagcatataaatatgattagagccttaaagtttacacttctctggttcgctcaaatttttttcaaaatagcatatgcctttctaaacaatggttagtatatttttcaaaatgaacattaaaatgtatattttccaaaaacaaaatacagctcccattggtaaatgatgctattgagacacaacagacaacttctcttgggaaccatttaatcagtgctcacttttgcactctttccagaaatgtcaatggttttgaaatatagaagtatattatacaaataaacttatacttattcagtattgtgcaatatttagtatttcttctagccatctcttgctgaatagtaagccattccaaaacttacggaattatttattgtttaatattgtttattgttattatttgtttagtaattttaataacgttatttctcatggttttgtgggttgatgggcactacaaaagttctcttttggagtctttcttgcagttgcggttggttggctgctgctgaagtcacctgaaagctcaattaggctaaagagtctaaacgggtcacttacatggctggcagtgcatattggctgctgagtgtgatgcctatctgacctctccatgttacctggagtgctcacaacgtggtagtttgtcccaagacacacaggcaaatactacaaagcttcttagggcctagccttggaggtcctagaatacgacttctgctgcatcctattggaaaagcaagtcattgtgaccagcacagattcaagaaatgggagattcgactctacctgtcaatgtaaacagcagcatgtgcatgcagggaggaaagaaattgagggcatcatcttgaagactatcatatcacaccattattccaactagtgaacattatgttttagatgggtagtactagctactcatctgtcccccagaaacccaagctaagcatggacatattgaagagaatgtcaacaccattaaaaaaactctagaaaaatcacatgtgatgactgaggttaattcagtctgtcaactacatcaatataattgccttcttgtaaccctaagtatggtgaagcagaattgaattctacaaaagtctttcatctgttttcctatggaataattaacaaacccaataaatgtataaatagc

SEQ ID NO: 3800 - DNA, 1245 bp, Homo sapiens
gggggtggtgggcccatggaccccgatcagcagcatgttggagccagctttgctgcagtccaccaggaaggaactcttctggcccacaaaggcctttgagagccctgcccccttagaggtcaccttgctggcgtccgaggatgccttgggaatggcgctatagcaggtctctgtagacgacctggtcactgactccaccaggatggatgaggtctcgttggctgagccagggctaactagacgctggcctgtcaccttggccttgaagggactgcccacgatgtggttgggcccaccgtatttgacgctgatcaggtagttaccaggagccatgggggtgtacatgactttgtacccttcaggtgtttcctggcaatccattttaaccttggatgggccttcgatggtgacggataatgtccctggacctgctcgggtggtgttaataaagaattccgactggatacctgtggtgcccccttcgagtcccgtgccataggcggacaccagggcagggttccccgcttgtccaggctccccaacgcgcactttgaaggggcttccaaccacgtggctcccattgaacttgacatcgatggtgtggacaccattctcatgagggatgaagcgaacagcatacttatctaggagaatgagcaaaggcacagggtgaaatcaagcaaatggacacccctgagttcagtgaggataaaggatggaggccaagctgagatggcccatttaaaatcaacagttctacagggagcctggcactcagcatcctggatttcagaaccagacagaccccctgggtatccctcatcagccccaagggaaacgcatccacattgcaaatcctataaacacaggacaagactctgacccctgcctcagaagaacacttcctttctttagaaaacctcacttcttcagtgtgaaattctgtgaatgctgttactaatcctgtcacgagatgaatctcatttcaccaaaattaaattatgtttttccactaaaatgatgatacaagttgaagacacagcactctgaaattggaagacctcaccacttaaggctccgcagcggcttactcagctgaactccaggttactactctttactttgttcacccattggggagttcagtttgtttttaaacattgggagatggccattctaactactgttcaatgtctctgttttgggaaggcataacaagaaataaaaaggaatatatatgaaggg

SEQ ID NO: 3801 - DNA, 2830 bp, Homo sapiens
ctcaatcccttggtctctctgattccttatatatcccgatacatttctgggggctcatcaggattggagatgacagatttactgtcccctttgcctgcgatactaggtccccggggccaggagagacccggcatccaaggtgtgccacagctgagcttcacccggatatatagaccagctctccccacgtcccagcaccctgcctggcagcgcaatggaaccgaggatggggctgcaggacgataccagcacttcaggaactgtgacagaatcttgctccgctgccaaggctggagtgcactggttcaatctcggctcactgcaaactctgcctcccaagttcaagtgattctcctgtgtcagtttctttaggaatacagcactccatattgttaccataataatgaaacggattcccatggctacagcgatgaagcagcagaaaaaaaatggagatgctgtcaaagaaaaaagacacagatcagagaaagaagcataaaaggtgtttaagaaataagtaacatagcagggcgcggtggctcatgcctgtaatccctcacgcctacaatccctcacgcctgtaatctcagcagtttgggaggccgaggtggacagattgcttgcggtaaggagtttgagaccagcgtagccaacatggcgaaaccccatctctacgaaaaattagccaggcatggtggtgagtgcctgtagtcccagctacttcggaggtggaggccgaagaattgcttgagcctggaaggctgagatctcagtgagccgagactgccactgcacgggtgacagagcgagcctctgtctcaaagaaagaaagagtatgtacctggatatgtatttttaaaataatgtaaagatttaaaaatagttcgaagaacctaattgtatggcttttgaagcaactagaagtatgttctttacagatggtgggagtaatgttatattaagtttgtgtaagctataacacttaagtgtttataagcatgtttataagctggtgtttacaagcatgtttttatttccgaacaaaattcaaaagaagtttgtctttgtaaaaattcagatgtgcacagttcttgttcctctctgaagatattggaaatgtattgctaatactggtaatatataacaatttttttatgaatagatgacttatttaatagttacgtatctaaatctgaatattttctatataatttgtctatggaaacaaatatttatacaattgttcacatattgctcttttctttgtaatgttattccttctaggtataaaatatagacgttctcaagaagattagtgtttgcaatagaaagctgggccatttggccacacctgcaaatgattattggttttgcgggagactgcaatccataaaaaattactggcagagtttgagaatttgtataagaaaacaaattttatgagatgcaaaatcaatactattatactaatttaaattttgtaatagcaaagctaattcttgttacttttcagtctttcaattcactaagataatgagtgttacgcactgaacacatacaaatgtattgctgtgactgaatgaagaggacaaattaacaaagcaattccgaggccctggaaattgatcaaaggctaataatcatttgtgaactatttattcttggaaaaactgctagagattcaaggaagagtgcagcaaatttgtagtaagtttacctagtgctgctcccgtgccttctgcccacccaccacacccagcacagtgagtaacagttgcagtttttacagctgggggaaaatcaacagtgttttttgccacaaggacagacttgattagcggtcagaggttggggcatagtgtaacagaccactgcttttcaactgaaagtgctgaattttgcaggaaatgaatgagaaaaccccattttttgttgttttttattttttttagtctgaggtgtagtctcctctggggcaagaacagtgccagccataaatataacaaaatcctaaacatgagagtgcaatagacctcatgacattagccctctacatattctttaaatttttttttaaattgacacattgtaattgtacatatttatggggtacaacttgatgttcaatacatatatatgttacattaaataatcaaatcagggtatttagtgtatctgtctacctcatgtatttatcatttctttgtggtgagaacgttcaaaagcctctgttctagctattttgtaatatgcaatatcttactgttaaccatcatcaccctactatgcaatagaacagaacttattcctcctacctaactataactttgtacccattgaccaagctctcaccctgtccccctctttttctctcctccagtctctgttgaccactgttctggtgtttttctggtgatcgctctgcttctataatatcagctcttttttgctttatttctacatgagtgagattatgtgatatttgtctttctgtatctgccttatttcacttaacatgatgctcagcaggttcatccatgttgtataaatgacaggattttattcttgattattgaaaaaaatatgcatatgtgtagaggagaccagggtgattccagtaaaaagtaaaagcccaaggagacttgagaactgattgcaaatttatgaacacttccttcaccacacacacacacacacacacacacacacaccgctagcacagagtggagcctctactaacttaaggttttcgaataaaccttttaaaataatatattggctgacaaccaagctatgcaattcacaagggcaatccctaggaaatggggct

SEQ ID NO: 3802 - DNA, 3896 bp, Homo sapiens
gaagaagaaactgaaggggagggagtggaccaggcacgaactggagcatcaagcttgtatatcaatatcaaagggaaagtggggcctggtccacggaggtccctccggagcagctgaagatttcaaaacaagataatggtgatgggggtgggatggcctgggggcacaaaaggaataggtgaaactggatgtaaagtgtgcgagtctgtatttttaacaagcacccaggtgatttggggataaagcctaagtagaagatcttgcttatatgagaatattgggctagaagaaaacgctgtagttttccagtgaaaacctcagctgcccttgacatgctaatttgtatctgaatttaaaaggagcttattatgaatgatgaagatgctcttcttatacctatccttcaggaatttacaagggttttaagagctcaatgccaggaaccagagatgaagaccaaatatgtatttcttagtgtatcatcatatcacaaagtgttctagggtcttagagaaagagggtagctctgtggcaccagtgcactccagcctggctgacagagtgagaccccatctctaaaacaatttaaaattaaaattaaaaaaaagaaaatgttgtttacaattcttagcatcccccaaatgagacttataccattcggtgggcacagatcgacagtaacaccaacatgacctctgggtcagctgttaaatcaaaagttctaaggtcactttaaataactgaatctaatccttatttatggaggaactgcctgagggcagtcagcccagactctcctgtttgttcatgtcaccagcagggtgacattgtcaaccccatggaatgactgagcaatagcgataggaataaggctgaggaagacatctggaggtattgacagggatttgcatgggaggtgcaggagctggggctatcccctgctgttttggataggcttcttggtaagattaagaggagtgatgatcaaactgtggtcacagccatctggcaagagattttctgttggtaattttttttttttcaagataggctctcactttgtcacccaggctggagtgcactgccaggaacacggctcactgcagcctcaacctcctgggctccagtgatgctcccacctcagtccccaagttgctgtctaagtagtatgatagtgacatctactgtaatagcttgtattattacaatctttgaggaagctgcagtttagataatttagcacaatcatcaggaagaatttaacagtccagcatggccaacatggtgaaacccagtctctactaaaaataagaatatggtatatgtggtaaatcatagtttgtactttcttaaaaatgtaatcattagagcagatatttttgaggtgacattgtgtacattgacacagatcctcttgtaaataggcatacggagatcttgaagttctgggttatgcaacattacgtttataaatttgacaccaggtgattctacactctgaagtacttctatgggtaaacatgcaacattttagaatgttcgtagcaaatggttctgtttacaagatgcttgccaaattttatgagaatgatttgtcccttttgaaggaatgggtgaattttggagacataggcaagtatatgtataaacctcaagttaaacatgttgaagatttaggacttacatcattatttctgaaattgttctgatttttaggtttgagaccactcagcataggattgtcatttaaatttagctcttctgtcacctttcctggctcatattggctcttgtttaaactgttaacaagccaggcttgtggctcacacctgtaatccctcctgcttgaggggccaaggcaagaggatcgcttgagcccagatgttcaaagctgcaatgcactgtgattgcaccactgcattccaacatgggcagtagagtgagactctctcttaaaaaaaaaaaaaaaatgcgcgcgcacacacacacacacacacacacacacacacacattttttttttaaggaaaaaaaaccattacaggaatttcttaatttgtcttccagtttcccctcctagctgttgagcatgtagtcatcagaatacttgtcctgagccctgtttcgactgtgttatgtccctgtctagagtgtggcttcagaggctgtgtatctgcaatctggcatcccactttcctagcctaagctcccctacttctcggcctgctgcttccatcagtctggacttctcaccattctctggatgcctactgcttttccacctcttatcatgactcataatatgccccatggcaacgatatgctttcttcccatgtaatcatccttgtaaaaccatttctgtccttcatcgccctactcatgagcctttgggctttcttgattgggtagctgctagtgatccctttttcctttctctctctctgtctgcaacctggcaatctcagctggcactgacctcagattgctttgtatttagtaatttatatatttttggatctttccaatgagattttaagcaatgtgtgaaggtagtgattttgtcttgtatgattttgaatcccacccagggcctagaggcagacatggaataaggaagagaacgctggactccaaagtcaggacaacatgtttctagtcacagctctgccgttaactggttgaccatcttcaggtatgggatttctgaacgtttcaaatttcaatcaatgagcactgtcaacacccacaggagagaataaaattacctgtgcaaaggtgtattgtggtgtgtgtaacttaagattacagttctgtttgagagttaaatgatgtcatagctcacttgctatgctgcttccaggattttgttatatgctgaggtgtaaccatttgtgttgtctgactttcgtatgatttaattgagccaaatttgggtcagaacacaaatttgaagatgacttttcagtatatgatgggtatttacatttgaacactagaattttaggtctctcaaataattaagaatagagccagttttgaataaagtctagcagaactatgcagctttagtcatttgttttgtctaagtctgtattttatgtgttgtcttcttaagatctataattttggcatttatgtcatttgtgacatagtctgaaaatagagacattgttggcctttaaaatctcagaaatgaatgacttaatttagtgtcctgaaagagcttttaaaagaggattttgtggcaatgtttctcttactacgtactcacaggtttgcaaatgggaaaaaagtttacatttcagtttaggggcatatctaagctatgctattccctttagaaaattagcctccaaaatcttttgtttcaaaatattatattatttcataaataatttcaagcaaatacagacatccacaatgtagaacatgagagaccccctccctcaatttccacctcccaagggaagtttatgtatttttctaggcccttttctatgtctttacatctctgtctcacacacacacacgtatacacacacacagtttatttttaataaaataggattataccacacacatcctgtcacttgcttttttgcttaagagtatatctaagagaatcctttgtgtcagtgaagctggagctacctcattcttttaactggctgcgtggcgttccattgagtgtctgtcatcatgtgtttagccgagtggatggatagtctgcttgtttttagtttttgctcttaacaaacactgctgcagtcagcatccttgcacagatttctttgtatacttgtattagtatttctgtaagatctgagaagtggaatttgtagggtcataggttatgtacacttaagtttttgacactcactgccaagtcatctgtc

SEQ ID NO: 3803 - DNA, 1116 bp, Homo sapiens
tcccaaccactacaccagccctcagcgcctcagtttcccgctccagcctgcgaatgggctccggggacgtccaaggcgaggcgccagagaagccacatcaactcagctccttactcgactcctgcatgggcgatacagtctcgccccaacctctctaagagcccccgcttccccgttctctatgttaaggccttggagccttccccaactactcggacctatttcctcaaggctgcaagccccatgccgcctcaccgcgggtcctcgaactcaacgaaggcgaagggcggtcccccgcggcgattcttgaggtcgatgtcgcggatagcgccgtatttgtagaacacgtcctcaatgtccttggttcggatgtctggaggtaagttacccacgtagatgcggcaatcgttgttccctgcggggccacgaatcacaccacctcccgacatggcggtgacgaaaagcgcggactcgagaacaggccttcccaccaagcctagcgcacggcagagcgagcccgcagcggcaccacgtctcccgcggcccctccaaaatggcgcctttatcagctcggcgcacggatatgggggggagacagaggaagagaagcggaaggaaacagcgattcgatcccaacacgcacgcgcgggagcgcaacgggtgctgcgagggctacgttcagcgcacgcgcacgcacgcgcgacgtcaccctccccacgaagggggtaaaaaagtcccccgcgttcccagcttggggtggtttgcgaacagagtgaccagccgtttggtaaaagttaaataacgaactttcgttaaaggagctagtcatccaggtcgggtcttgaaggatggtcgatttctccaggaatgaggatctttgaaagcaactcggcgccttcaaagcacttggtgaaacctagcctaaagcgttgtcccaccatgctctgcggcgataacggcctttggcgggaaagagtctcggaggcggggccaaagggggacggcccgggcggttgctccggaaacccgggtatcttcgtagggtgcgtctaatccagagctgagttgcgggtgattgaacggagagctggggcgttggtttgtcttcccgcccct

SEQ ID NO: 3804 - DNA, 691 bp, Homo sapiens
ttctttttttcttttaaatcttttctagctttccttctgacaaactttgctggagtcctactccttttctctccttcttgagaaaaatgcaaattttgctccatgttttggtatagcagggaagcttccatctttttttactgaagcataacatcagggcctacattccatctcaaacggcttgtcaaggtccttccacaaataagatgttcctccaaagatgatgtacagatgccaagttggatatagctagagaaatctcatggctaccccaatcaggagagaggttgctgtttctcagaagtcctcctccccacttccagggtcatcattgtctctcaacaactttgtggggatataaaaaccctcgcggaactggttttctgagaggtgtttgaagcaggaatatattatgcaggggatggagcagccattccctggctagatgaccacatcactgttgcacactgattgtttgctaaaggcacaatgctttcctgaccagaaatgaaaaatgcctgctgctcaattattgtcaatctaactggaatagagtcaggcctcgtcagatggtttcccaaacacccagatggtctcttagattctggatggtcagtgtggtagttctttccattacatccttgagatcctgctgttcacaccattcagcagggcaccctgaaccttgtcc

SEQ ID NO: 3805 - DNA, 3539 bp, Homo sapiens
aaatgttaaggaggcttatttaaatattcagggcttcaactaaagatctaaccactaagatcaaaagagttatttaaataaaagttgttgagacattttttcatctgtattaataatgtggcttttgaagttacccggtaataatgtgtccataatgcccacacctaatttttaatttccattttggctttaggtgtggctttattttaatagctgccaaaaagttggcaattgtttttacgtttagaacttcacagtttgcttttctgtaggtttaggtagcattggggatattcgtctaataaaaacttttaaaatttctgttctgaccctgaggcacttaaaaaaaactcttatgggccaaattttaaaagtagagtgtctctactactgcataaagaatttctataaaagatgaaacatggagctgattgaaagaatagacggcgcaatggtagaggacacatagttaccactgtcactggtaatctacagcttgatgcgaagtcattccgccttgtttgttgaaatgttaatcatttcattaagaaaggttaagtaattaactgatatttcattagggaatcaatgacagacctttttttagtgatgtatggtagatattttctaatagaaagtttgccccatttaattatttggaaagaagctagttgattgagccttgggaaggaggggtggggcatcttcagataacatctatgtccataagcaactttaaataattttggagaaaatggtctattagaatagaaaatcgttcagtccccagttttcttttatgggctccatcaggcatgttgttgcagacctgctgttgttttgcatgccttctctgggtttaagaagggttcagctgcttaaatgtgttcatcttattttctaaataatggcttttgttgcagtgtgatgcatgttgacagtaaacgcgcagccgtaactttggcacaaaaaaggaacaaagagtaaatcagtgagcacccatgtacctgtagcccggcttaagagagaagacgctgctggttcaggtaggagaggctcctggaatatcccatcctcatcttacctctgtccttctttcctagaggttactttaccactgttcgcagctgggtggttttcatcttgtgtagttcttcatatttttaatatgtatgcatgtacaggattcctcaaaatacaggattttgttttgcacgttcaaggtttgttctgatagcatcctactatatatgttttttagtaacttgcttttttaaaaaataaacaacagtaaaattcatccatgtggatacatgtagctatagcttattgatttttccatgtgaaccttttgaaatactggatattaattcaagacaagttctttaaatttgagcctaaaacccagtagcactctgtacattgaaaatttcagattcataagaaaccatcagtcctgactggaacttcataatttgttcatttgtctgtgttttgggggaaaaaactttaaaacctcaaccatttatcagggaatttgattaaaaaaaataatctatcaagtggctgatctcttacattaagggaaaaaacaggcaaagcattcatttgaaggagcctagccattttctctttcttatttaaagacttggcttggaacttagcagttacatatgcagggtagcgagttaaaaagccatgtttaattaacaggcgctttatacttctgtatccttgttatgatatagcaccttgttcttcagtgtagaaagtgatttctgcatattttaaaggactggcatctttatggtaagaaagccatataaataaagatatacttagatgaaaatcggaacatgtttttaaaatagtgtgtgtctactttcatctctgttatcaaacttgctgcataagccagagttgatgctctgtgattatgctaatgaccaaaagaatcgatgatgcgagactagatgaaatcagtggtataatcggggaaagttatcagtttttttgtcattaagtattagtgataaataatacactgttcatttcgagtggatagaacatatttaattctgatgtacagagtttcattttagtcaggctcattgctgagtaaaatgatcatcttttgtaatttaagaggaaagagaaaaggcatttttgtcagcctggctaactgacttgggccatctagaaatgtttaccttgaccagccagggaagattggaaaaacttaattttttttcctcctagacaacttgcttatttgtactgacattttattaagaatatcagatactcagtaaatagcataaatgactagagatgttaaacaaaatgagtataaaggtagatagtgtttccctgaagaatggggaaaatgataacaaaggggcaatgtttggataatgctctttttaaatgactagtctgcattaaccaggggctattaaagtcggtatcacccattagacagcagttttaattttttttaattgagtttttcatatcaaataagatcatacttagtaatggtttacttaaagagaagtaatacttgtaacttagaatcttttcctgggttactaaaaccttaagggaaaacactgattctaccttccttgtcaacaaagcgtttctaacacaattctctgtaacagacatttctctgtggatagagtttagcacttgttttactactgtatgacagtacctggtgacaagagagaaaataaaagaataattagcaatgttctgtaggacatgaaaagtgattgaagtctacgagagaaggaaatcagatcgatgttattttaaaaaaatgcatcacaaaaatgattctcttcaaagcaaagcctcctacccaggctggggccagctgtgctctgccatttccctgccacagccctgtccgtccacgttggctcttaccagcagtaccatctgctgctccagcagtggccttctctatggtaaggcaggccaattgggtcaaatcttgtgatatggcagatgtccactgagagctaagattgggccaggctcatttttatgtgtgtccaaagccaagatttcaacttggtgaaaggctgtggaatttatttccccaagtgttgcccaaactctgttcttttcttcaactgcctccttgggctgagatgattgcttaatgctcttaattatgctggatccctctgtattttcgaacacctgtgggtaattcagatcatgagtggtcacagaggctggctcgacaaacggcttccctttccgaatgggaaaatcccagggagctggaccatgcaccgtgtgtcagggagctgagtggaggctgaaagaggatggaacacttcccttgaacttgaactggcattgtgttgtgtccaagtatccttcacccttggattggggagagtcttacaatgaataactcagaaaaaagttttcaaaataatcctagattgtaagatatctacgaccattatccatagccatatctttaaaaaaaaaaaaagaaaagtagaaaacaagaa

SEQ ID NO: 3806 - DNA, 1551 bp, Homo sapiens
tgggaacgcgcccacgccgcagctgggactcgggagaggctagggggaccgcgtggccttgctgtggaagggacccgcgcgggcccgccgcgaagggggccctgcctggcgcgacctggggagagccggggccggccgggtggagggcgcacggggacacacggacacgcacagacacagacacgcgccccgggctgaggagggtggtgggaggaccgccggccgccccccgcgcggagccccagggaacccggactccagccgcaaagcggagaggcgccagcagcaatcagccacctcaggggcggcggagtccaagcccctctcagccggaccgtaccgcctaaaccctcctcgggtcctccttcctcacgtatgaggtctctgtaccgaggcggctggttccatcgcagccccgagccaacccgccaatcccgcaggacactaaccgctccggccgccgcaggttctcccgggactgccccctccagggggccgctgtcccgccccacgccgggggccgccacaggacgagttctctagctccagccgggcgaggcgccagggagctccgaacgtggcaggatccacttttacttttccagacaagggccgacggttgtgacctggcttctcgtgaagtgactcctggcgacagcagcggagaggactaccgaagcttgcagtcgcggtttgaaaactgcagccgcgtctggggcatcgccgttcgccagatccctccccctagagaggtcagttcgagaggtgtgaatatccggagaccggggagaaggaagccgcaaaattcgtcccagctgcctgcgactagttaccaaacttcagtgcctaccaaagacctattttctgactcttcttgagagtcttccttaggaccggaacgtaccctgtaagtggagaacccagtttgctacaacttggcagaggttcctcggagtgtcaacatcagttggggatttatggaacctagaccccactgctaacgtccgctgtcgcgaatggtgtcccttctgaggcactgactgaaggcagtgtagggagggtcccaataggctgaatagccgattttgcatttatagtgctaaggaaaaagatgaaagccctcagcaacctactcaagatctgttatcctttgaagacagtggaaattttcaaagttctgtgcaagacacaaatgttttacatagatatataatcctagtttatatgtataggatacacacatactcatacatatatgggattagttatgtaatctaggattgctttcagaggacatttacgataattgcagaaaacccttccgtgggaaaggatactgggagtggagtcgtcctcttgctttcaaaagacttaatgttcagttagcatataaaggacaggttttcttgttctatcccagtaagccaagcaaattcctgtgaagctagctgtttccctttcctactgcattttccccaagataaaggtatagaatgcatcacagcccttttatgaagtctgtttgttgttacttaggttaactcctcctcc

SEQ ID NO: 3807 - DNA, 2348 bp, Homo sapiens
cgcgggcctcgcgctcgcaggcctcgggtaccggccgcgccgtctgcccatcccgacggcggcccggcgtggggaagcaacggtggcagggacaggatggaagggccgcgctccgcatcctactgggaggggacgagttcaggctgcggcggctgcggtcgcgggacactgggcgctcccggcctggctccgggataaccgggcggggcctgggccattcactgcctcggtttcccccggttggcctcgcgcgtaggcgccggcgcccccatccccgcccagagctgtggggccgcagagacccagccggggcgaccccggagcctggcccggggtccctcgggcggccgagtcctcccgccgccaggggccgcccccgcccctttgcggcccacgaggctggcggcggcgtccgggcacgcggtctccaggcccggccgcgaggctgcggggaggagcctgcacgagggcccggcagccccggcagcccccccagccctcggcgcctctgcaaccctgcgacgggctggggaggccggtatgcgtggttcccggagcacccgtcccccgaggctccacgtactcaagcgtttctggggcggaattctgtgggcagcaacgggggccccctctccaacaagcgcacctcatttctcacgtgggagccgcggcccagagagctgaggtgacagagcttgggccgcagagctgctccctccctgcagccgcacagcaggccggaggcacagccggcgagagacggccactcgctttggagcggcggcgaggccggcgccttcccgggcaccagggactgcgtggcttggccggaaatcaggctagaagcagctccgggaagcacagcccttagcccagcgccttcccacactgtggcaggaatagcactggcggcccacgcgcttgtcagggaacagaacagctctcgcccgacgcctggcaggggagcagggaggctgcagcttccccagcgaccagctgtttcccaggctggcggactccacggaccggctccgcgtctcctctccagccttctgttctctctagaggaagatctgcgttttgtctgcactgtgggccgactctctagtggggagcgtcagaccctctaaagtggctgcctctcgggaaagcttccacacctgtcatcagattctccaaaggggctgtttgatgcaagaaacgggaagccccgggggtactaggagcagggcttgctgccattgggcatggtgaggccccggcaccctgcccaggacgggcctgtgggctgagctgcagatgggcattgaggatgccccaacagcaaggtgcagaaggcatccagaagcaaaggaaactgatgaccagcgtcaaaaacaaacaaaaaaagggaacttggctcggcggtggctcacgcctgtagtcccagcactttgggaggcagagacaggtggatcacgaggtcagaagtccaagaccagcctggccaacatggtgaaatcccgtctctactaaaaatacaaaaattatccaggcgtggtggtgtgtgcctgtaatcctagctactcgggaggctgaggcagaagaatcgcttgaacccgggaggtggagcctacagtgagtcaacatgaagccagtgcacgccagcctgggcgacagactctgtgtttgtgtgtgtgtgggggggggagggcggggcgaggcgaagggaacttgaggtttaaagcagggggaggagggccggaaatgctccccgccgcccccgacactcactcgccccaggccccatcctagcccagggtcagtgtcattcccttcaccttagcctctcactgcccaaagaggcttacttttcttctttaaactgctgttaaaatttgggaggaaacggaaagcaagggcacctgatggttcagtgcagcttcaggttagaggggcatttgaggtgcctgagctgggggagggccttccccctgagggactgggagaagggtaagccatgtgccctggaagcactgcagggagcctcagatttgcaccccctggctcacactcgctggcgccagccagcatggcagggatgggcggggctggttcttaggtttcctgctctttgggtgctagcacccagggtaaggagacacccatgtccggttgcaagacaaacccttctacctcctttcctgccaaaggccaccagcatcctctgcctcaatctcaatctttggaactttttagctccaaagtggtttgatgaccacaggctaaaattcatagtcttaaaattttagatagttaagagacagatctgttacaggttttcaaataaactggtctatctagtgtaa

SEQ ID NO: 3808 - DNA, 2676 bp, Homo sapiens
ttagagactagaaacacaattaagaggcacaaatccacacagaaaatatgcatattttgtctcctttccccccaaaacaagctgcatatacttgtgtaaacttgttgatttgtaaaacatgtctagtactgcagacaaatgtgtgggatgaaaggaaataaaagccatgaaaacagggccaggtgcagtggaataagttctcctagctcagaaggatctcaacctcttgcaagttacttttcacttttaagggcccttaaagaagcatttgcttagctctgtatccaggccatctctccctccccgaagagcaacagaccagcaactgacattaaggtcacatgggtgggtggggagtagaattgcgggggtgacagttccagccaatccagacaacgaatcattgtttggaggaaccagagcctcaaagggtgagtgcactgactagggctggctctccatctgttcacacacttgttgagtgcctactctatgccaaagcactgtgttttggtgccctggggaacacaaaattgggatagctcctgccctcagggcttaataaagtagctctcagtcaagggttagagcaagggttgacaaactacagcccaaaagggccacccgtttgtgtaaataaagttttattggaacaccagccacactcattcgtgttcatgtagtgtctgtggcagcttttacattacaacagcagggctgagcatttgcagcagaggctatatggcctgcaaagcctaaaatcttcactttctacccctttacaaaaaagtttgccaattcctgctagagaagagatgacatacaactaagaacttaaacgagtgatcagggaacacaaattatttacataataaaatttcagagagggggggctggctgaatttaaaaagcatgaattacgtgaggcttgattactgtgaagagataagtcaacttaaagttacttacatttaacatacaatttatatgcactggtttaaaacacgcacacacacacacaaaatgtaacacaagccaactactgatctggtacagatgacaaaagggtgatcagttccaacttcaaaaggaaaactggctatgatgagtccatattgaaaaagtcactgtcatttatgggtggtccaagggatttttttcaagggtaattttacctgcttcattgttcatttaagggtacacactgaactttggaactaacgcttgcatgggtttgtgcctccaaagcagtcaacactgaagtcttggctgggctcagtggctcctgcctgtaatcccagcgctttgggagactgaggcgggaggctcacttaagtccaggagttcgagaccagcctgggcaacacagtgagaccccatctctatttcaaaaattataaaataataaaaagaaaataatctctctgcataagcaacaacaacaaaccccactaaggtgttgaaggacccattttaatgaatagttaagaatggtttgtatgttatactctgcttttttatgttttgacttttaaacaaagaaaaataggctgcttttgcatttagggttgatcaaagcagtctgtcttttttttgttgttttggtagagacagggtctcgccatgtttacccaggctggtcttgaagtcctgagctcaagcaatcctcccaccttggccctcctcaaagtgctgagattacaggcgggagccaccgcacctagcatctttgctatttgaaacatcaaatgaaatcatactaatgtgagagctgaattccattgaaaggaaaagctcattaaataacaatcgccattgtctggccatggggagactactagaattaatgagtgtttatagttcttgccctctcatcctcaaacatcttagataaaatcccaagagactgctgctgaaagcgtcctgctgtaaattacaagaaaatcagcccagcttcaagcagaaaatgccaaggaccagggctggggagcagatttcacgtaagaacatccagacactaagaaaacaccaaggaatactgtataagagacattgcagtcacgttgtgggagctgccactgagatgcagagtgtgggtctgcttggagaaaaggctctcacattccaagccgctgtccttacgtgtaaaagctttgaggtgcaccctcttccacactagctgatgtaggagttagaggtagtaaacgtgtgcatacaaaactcaaacctgttttgaaaagcccaccgtagaaagcatgcttaaaagatggaattcggctgtatgccagaaaatcagtagcattatggaaggaaattgaactagaagtttaaaaaacagccaacatgcaggcccttccccacagtagaagggagcctgggtattgtgcaatctcacacccactgaaaaaatgccacgcatgcctctaaatgctctgagaaagaatgctttgcactaagccacggcaatacacgccccgtgacttaggaaagccagcgtgaagtgcttcatttctcatcccgatgcacaaaacacagggctccatgggcccgacatttcagtccagcctgaaaagactagtgagcacagccctaaaattgtccattcaaggcaaaaagcactttcttatatctcgtgacaaaaaaaaaaaaagaaataaaaatgaaaatagaaccaca

SEQ ID NO: 3809 - DNA, 5856 bp, Homo sapiens
ctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggac

SEQ ID NO: 3810 - DNA, 2863 bp, Homo sapiens
ttagacccgagttttataagaaatttattttttcacagatacagaacataaatccaagaaaaattattattatttttcacaattatgactaaatcatgttatttctagttatttacaagtactacaatgttctatgcatttcttcatcctagacattaataaaacacatccctttggtcttagatacttctctttggtctgtgttttctcctttctgaattttaatcttctgtgatgtgaggaaatttacgtgaacctttcacatatctatttttttccttgtgcacagttgataatttcctcccttagattccctgagaaaagaaacacaaaatattcttagtggattatctcaggaaaggcaaccagagggaagaggaatattggaccactgaaaatctcaaccaacgctaatattaggagcacacgtaccatgaggaagagaagggatggggaaaccaagatggcagagttagagcaacaaagttagtaacatgagagtttcccagcaatttgagtaagagagaattggagaggatgtgatattctgaattgatttcccaagcactaaaataagatttgagtatactaaactgaaacctctgtcaaatctctaaatggaacagagcagcatgtactatgcacagattgttaaaagaaagtttatgtaatactaaatgcggtggccattacataaaaggacatacctctacctagcaatgaccatactgcatgaagagggactaagatgaaggaaagaaacaaaaaggcaagtcaaagaaagacaggagtgtaaggtcctaaggaaggggcaaataatcaaaggtctcatctgatcaggagcaatgccaatccaatccagttctaggtcccaagtaaagaaacatagtctgagaaaagaggccagggatacagcttgggatgttcagagagtggaaatgacagaggtggattattttaaaactttcatctcaagacaaaaagggaaaaacatagtgcagattctctagtatgaactccaggaaaagagggaaatgcaaggagggaaaaatgcatccagggagtgggttaaaaagcagaactaatcacagggcaacaacccacaaaaagacagagagctgccaggtatttaatagatccaagcagaaagtagccaactacctgaccgcttccaagcttccacaccaccaaaccatctacctatttgctcaaaaggcaaatcctctaagaagtcatctgcagcccatagcattcgtctcagagcagaaagaattagaacatcctttacagggtccagctcccactcagaggaataattgctaaccaccgagatgtcagaaagagcaaatccaagttttctttggacttcctctagctgcaatacagaaattaaaaagacattgcaaaacagtgaaaaatattattttatgttagtataaattatgaaagcaatatcaagatgtaggaacttgcaataatttcccattggaaaaaaatggagatctggtctcacaaagtactcttgaagaacttcacatatcaagttctaatgtcactgataattgtaatttggaatacatgcagtggattctaaatgatttagaaacaaaatttttatgacacctatcctacagtccatatatttcctgtttcttttaaaaaacattctctggataagtagattttattagaccagtttaacgtttaattcttgtttagactattttacctctagaatcaaactgcctaggttcgaaatatttatctgtcactgctcagcactgtcaataaacgttggcagatgtttactctgttttctttgtttcctcacttgtaaaatgcagtaatgatagtacccatttcataggcttgttataaggactgattaagaaaatctatcacatacttagtgctcaacaaatacttgctatcattgcattctcccaactggtgttcccacctccaggttccttttgattccaatctattctgtacacagtgccagattaatttttctgaagatcataactttaattaactttgatcatatcattactctttcaaaaaattgctgtgattcctcataatgctcctaattaaataaaattacttcatgcaaatgttccttgcccattttatctctgcctacaaagatccagcccttcactaacctgaactccacatttcccaaacatgctgacttttcctccattaatatattgtcttatgctgaatttgttggccctttttgtctcttcattttgtgaaatatttcttctccttgaaagccgtttccctgtgccgttccattgatgaaatctccccgaacccctttaacactatactttccttctctaaacttttaaagcactttatttttcattgtttcattatatttatcacactcaatcgtacataatctcttgtcaactttttcttatcccacactcccatcccctcaccactatttataaaattgtaaaatttttagtgcgggggaatttttttcatgatctgtgtagctgataagagagtaacacactggctcaaccttaaagataatatcaataaacatttattgaattgaatctagttgaattaaattgtaataaatgaacttacccatgtcagtgtaaagatagacagttagccttctgtatccatgggttctgcatctgtgagttcaactaaggctcaaaaaaaattgaaaaaaaatgggccgggcgcggtggctcacacctgtaatcccagcactttgggaggccgaggcgagcggatcacgaggtcaggagatcgagaccatcctggctaacacagtgaaaccctgtctctactaaaactacaaaacaattagccgggcatg

SEQ ID NO: 3811 - DNA, 3685 bp, Homo sapiens
atagttggctgtatttctgggttctctattctgttccattggtctatgtgtctacttttataccagtaccacgggtacactaaaatctcagacttcaccactatacaattcatccatgtaaccaaaaaccacttttaccccaaaagttactgaaataagtatttttaaagattttaaaaaatagagaggaaagaggaggctatgaaattccataatggagttacagatgcttgacataatttagtggatattggatttagaagcttacatgaatgaggcaaacctgagatctgtgatatttgtaaatgaagataggagtgaacttactgcccttaggagtggagggagggaaggaagggagaaaatgagagatgccataaaatctattacttcaatggatttgaagtaatcctttgaagcaggcagtgagacttacttcataaatccatacctttttaatgtggattggagagaagttgttgcgctgtaatacctctgttgctactgtgagagtcattgccagccactattctcatgtcaagctgcccttgaggaggtttctcttgacccaatttagaaacaacccaaaacaaggtttgtaacttagaggaattctttgattctgtgacaaggggtctgtgaccctcttaaagggatcaagtacacaggagatagtacaagtagtactaaatagccagcttaaaaaattggataggtgagatgagacaggaacagtggacagaatggctctaggcatccccaaacaccacatctgggataaggaaatagtacaatggaaagtctatccttggacctactatttgtcattccccatggcatgatggaatatctaaaataaaaagagttgctttggagaaggattgcaaaatattatttcatagaagagatttagaagaggggaaactcccaattacataaggtgggcattatagcttctcaaaacattggttccctatatgggtcatgaagattgatcccagtatcagcctatggcttactaggccagtttaactgaaagatttaatgagcttggaaggatgctgccacctgcactctcactttggcgggtgtttatcaccagtgagtgcggtccctaaaggagcaaaaggacaataagcacccagtggacaacagtgtggcattttgagtgaagatagcaactgaaaaggtcatcggcttggctagattgggctgggcttgttttttaaaaataaaaaaaaagttttccttcatgataaaagtaacaggtgatcattgttaaaaaataaagtatgaattaaaaagtaaataatatgtataattttataagccagaaaactaatttgtaatattcaggtgtatgtcctttcattctttttaaaaattatgtatataacacagttttataacaaaattgacatcatattgtatatatcattttattatctaattttttcatttgaaaattcacaagcatatttccatgttattgttctttgaaaaatacaatattaagtgctccataatatcttatggatttaacaaagtttatttagatgatgtcatgttattggacattttgattattaccaagtttgcgtataaaatttaaatgtaatgaacatcattgtacattaacctttatgcacatctggaattatttctttagaataaggttccagaattaaaattatttagtttggatgatgagagcatttattagagcatctgacaggtgatgctgaattttcctcaatacagttgtgcaaattgcattcccaccagtagtgtataaatgtgaatatccctccatatattcatcaaaacatggcctttctaattttgtaaatctctgctaatttaataggtaaaaatatacctttgttgctttaaaatttttatttctaatttacacacagtaaaattcactctttttagtatatggttctatgggttttgacaaatgcacagtcatgtatcttctacactagtaccatacagagaagttctgtcactttaataatttctcttggtggctctttttgtattcaaccccttaccccatactcaatctctggaaaccatcaatttattcttcatccctatggttttgccttttccagaaggtcatataagtggaatcaagcaatatgtagcccttttggtctggcttctttcacttagtaaaacgcagtcaagattctcccatgttttgtggataattatttcattcctttttatcactgagtagtacttcattgtgtggatgtaccacagttttattatccattcactaactgatgaacttgtaagatgtttctagttttggtgaatatgaacaaatttgctataaactttcaggtataagttttgtgtgataaatgctcatttttatagggtaaatgctttggagtgggaatgagtgccagactgttttctaaagtttccctagcattttgcattccaattacaaatatgtgagagttccagtagctttgtatctttaccagtatttagtaattttgtattatacatatatatgtatgtaaatatatatatatattcatttaaattttaatcattgttagaatttgtaattccccaatgatatatggtattatcttttatttgtttataattgacacataattatttatgggatacattgtgatgtttcagtacatgtgtacattgtataatgatcaaatcaggatatcacctcaaaccttatgatgatcttacagttaaagatgatatattcttgcaaagtgtctgttcagatcttttgctcccctttttattggattattccttttcttactgtttttatatgttttttaatatattgatacaaatcctttgtcagatacattatttggaaatagattttcctagtctgtgacttgtcttttcattctttgaacactgacttttttagagcaaaaattttaattttgatacaattcactttatcaatttttttacttttgatgtgcaatgtaagaacacttgtctaacccaatgtcatgaagattatatattattttcatccaggaattttatagttttaagttttacatttatatctatgatactttttgaataaaggtttgtataaagtttagctatgggtcaaggttcagtttttaaaatatggctatctaattgttctagtaccatttgttgaaaagattgtttcttttttattgcattgcttttgcacttctgtcaaaaaatcaattgattatatttgtttgggtctaattctgggctgcctattctgttccattgttatccattcacaaataccacactttcctaatcataggaagtcttaaaattagatagtgtgtacaacttcgtccgtctcaaaaatcgtgttgattactactttgcttttccagaaattttagaattgttgctttctataaaaaattctgctagtatatctgttgagttagaactatagatgaatttgaagaaaatttacatcctcacaatattttgtctttaggccacaaacatgatatagctgtatatttattttggtcttgcttttttttccactttcagcatacagatcctggacatattttatatttataccaaatattttatatattttctactgttgtcaatggtagtggtttttaaattttcaaacattcattactagtatatagaa

SEQ ID NO: 3812 - DNA, 13106 bp, Homo sapiens
ggcaatctgttagggtttgtgtctgtcgtgtggaagctttgttcattcgtcttttgcaataaatcttgctactgctcagtctttgggtccacactgcttttatgagctgtagcagtcaccacgaaggtctgcagctgcactcctgaggctagcgagaccacgaacccaccgggaggagcgaacgactccagacgcgctgacttaagagctgtaacagcttaccgctaaggtctgcagcttcactcctgagccagagagaccaggaacccacctagaaggaacaaactccggacatgccgcctttaagagctgtaacactcaccgccagggtccgcagctgcattcttgaagtcagtgagaccaagaacccaccaattccagacacactgtcatcaaaaagtgggatatctttttaaacagagataacattgcagaatcttggagttggaaatagacctcagctggggtttagtcctgttttctcctcagagcagaagtcctgggatgccgttctggactgattgtcagttttttctcctgtccttgagctattctaatgccagacatctgtggctttacacagccaggctttcagttagagaacttggttagctcaggtcaacaaatgctgctctgagaacactgactcccatgtggggagactctgcacctggagctccgggagagccggctcaggcctcttcctgctatccagggaactgcagtggcgttggagggccttgctggggctggggctggggagaagggattccaaccctactgataattcgtttggaaacaccgggctgtggatttcagaagttcttgggcagcctgattaccactggcagtgagccggggacgaagccgaagctatgagtgacagacggaaagaactgggggctttggtgaaccagagaacacttagctcctccagccctgaagcaggcgtcaccgcagggcttatggtcctaagagccacttagtttccttattcattaaactagtttaatttgggttttctgcatcctggaggacaccaagtcggtgtgcggagggaccctgtagacacgtgtgcaaagaataagccgacgatcatggaatttctgatgacgccactgacacgtgggatggaggcctccttcccagggcacccctacactcatgacaatgaatcctggctcttattcacccctttggatttcacaagcaagtaagaaaagagaaggacagaattaaacatggggacagatgaagaagtaaagaagatgaaaatgaggaagataaaaaacaaactgaagacacaatgtgaaccctgggaattcaaggctgaatagtacgaagtcctttcctcacagagttcaggacccaggagtggaggccagataaggaccaaatgacagaaggtgagagaaccagatgcattaccacagacacctgttgggagaggacgcttgagactgttttgacaagaagcaaaaactcagagaactctgtgaagtctctaagaaaaggccaggagagcaccagcaaggggttggtggcagctttaaagatgcccctatgtgactgccaggaccctctttccgggatgccacacgaggctttgaagacaggtctaattctatcctgacagtatcaccctagtcattccaacatcccttttagttctaacgccttaagaaatccagcaaccccctttgcagtccccaagctgaggccttctaaaatgcccctgaggctggtggctgaggactcagggctcagcggaggatggggtctgggtgtccccctggacaagtttcccactagctgagatgcaggctgaagcacaagaaaaggggaagaacagaggagttctgagctggcctggggcataaagcacttggaggtataaaacaatgacttcttcttggtgctgcttgctgcgtccttcttgagtgtaatgagccctgagtattcctggtcacctttcctggtgctgtggtgagtgctcattcctccggcatggagggtgccagggacttgggctgcctgtgccatgctatcgattttcttccctaacccccacacttatgctgatcattctgttagtactccacacaaggctgtgaggtgttggttgttgctgttgtgttatttctttagaactctgaaaggacatgctcactccaatgtccccacgggtctgagctgaaggaccctgcagtgtcctgctccatcaaacatcactgagttcatctccttggaagaggaagctgccacttccaagtcagacctgaccgtcacagcctctgtaatcacctgtggtaggcagaaatctgacccccgccccccgcaaccccccgccaattgtacaagcccgaatccccagaacctgggactctgtcaccttacatgacaaaagagaccatgcaaatgtgaatagtcaagaatttaaaatagggacatgatcctgcgttatctggacaaaccgaaggtaatcacaaggttctcagaaatgaagaggagaggtaggagactccacataaacatgtcctccaaaatcagaacacttgtctcacctttgcaggctttgaaaagggggaacgcacctccagcctcacaacgcaggtgcctctggaagctggaaaaggcaagggaacgattctcccctgggtctccaggaggaatgaggctctgcaggcagctccatcttaacatgctgaaccttattttggacttccaaccttcacaactgcaagataatacatttttgttgttttaagccactaagtttgtggtcatttgtgacagcagcaacacaaaaccaatgcattgcttcatcttcaaatgctacatttctagtggcattttaaaaggtttataaagtgtacagatatatgatacagatataatgatataatttatcatgcaaataaggacccattcttgggagtgaaagaggtgtcattaataattacacagaaacaggcacagtggctcaacctgtaatcccagcacttcggaaggccaagacaggtggatcacttgatgccaggtgttccagaccagcctggccaacttggctaaaccccatctctacaaaaaatacaaaaagtagttggaagtggtggtgtgcacctataatcccaggtactcgggaggctgaggcatgagaatcacttgaacccggaaggtggaggttgcagtgagccgagactgcactccagactgggtgatggagtgagaccctgtctcaaaaaaaaaaacagaaaaacccacaaaattccatggaaacaataggcatgactgagagtatctggctccaactgtgaagtaccatcaccctatggaacatgacagacacgtctccagttctgttgtttctggcgcagctgtgcatgtttgcgttttgcttatgtggagcaccgtgggtgagaggagcagtcaggtaagaagcaggtgcaagtgaggttttttttcttcatttcccagccatctttcttcaatatgatggactagggtcatgtctgctcctaagatgagacttccccttcctctccacttgtttttcgtctgccaccctcattcctgaatacttttactcagatgctcaaggtgccagtatatatgtttggtgggaggaggaggatgtttcttcacaggtccaacactgcaatatcttatccctcatcatctttgagtgccatcatgctagaattccacattttctctttcctgttactcctatcaataatttaaacaggaaaataaagcatcaatagactcctcagaggataagatgggtgactaactttggactctggtggttttgtctctgaatttatcccaggccatagcaaaaaagtaagaaagttgatggaaatctaaacagaaagctgtgactattttctagggaatcagagctctttgagctctcattgaatatgtgctcacagaaaagaacagccacaagccatctatccagtaccaccccataaaagaaagaccacatgctgagaaacttttagcagggggagtataattactggaaaatacagaaatcaatttaaatgaacaataattgctagtatttattatgtttcaagcactgttctaagcaacttacctactttgtttcttttgctcttttcagtagctctatgacataggcacttatttctgtttcgcagatgaataaactcaagcaaggaggagctaagaatctttctaaaacttacacagctaataagagacagaatttcagttaggaccaggaagtctaggcacagggcccgcagactggaactcaaagagaccctaacagaacatatgggaaatatgagctaggatcaggctgtcaccaggtaaaggaaatgaaaatattttttatgaaaaatacaattgcttagacaaaaaacacaagggctaaatattaagttggtgtaaaggtaatggcgttttttttgccgttacttctaattgcaaaaactgccattacttttacaccaccctaatagcaaaatgactgtagtcacagtaggcagaagtgagctggaaaaatcaggagaggaggtctccaaataattccattagtgataaatggatggaaaaatttaaaaagaaagttaagaggaatggaagaaagaagttgaagtattgaaagtcctaatatgagtgactaagtagaaaaaaaaaccagatgatatattttgttaaataatgacagagagccttccagtattaaagaaagtcggaaggcctaggatggaaaagtgtagagtgccaagcagaagagatggggagacccgcatttggctatgttgcggtggctcgcgcctgtaatcccagcactttgggagaccgaggctggcggatcacgaggtcaagagatcgagaccatcctggccaacacagtgaaaccctgtctctactaaaaatacaggtgcgtgcctgtaatcccagctactcgggaggctgaggcaggagaatcgcttgaacccgggaggcggagtttgcagtgagctgagatcgctccactgcacttcagcttgggcaacagagtgagactccgtctcaaaaaagaatgtcagacacaaagaaaactgtgaggtgctccggggccctgcgaagcgaagactcccgcagcaaagggaggaggaacccaaagcgccaagggagcggcggccgcggagcccacgccggggcccgagatccgagcgcaccacgaggatggcagaaaggaattccctagtacaaaggaccacagaatgttgaccacaagattcctcttccaaaagatacttgagagatgccatcctatgaggagatacaaactgaggagcacacggggatacatggaaagcaaggttcagtaaataaacgggcgcgtttgattgtattctcagtaagcagtgactaaaaccaaaatcacatcaacaaaacaaagagaagcacaggaatccagaacccaaactccagtgacaaggccccgttggagtgcagagcccgacggcagcagaggcggaggcgtggctgacagaatatcagaatatgagaccatgagaagcaggtgaatattgtatcttgtttccaggaaagatggaaattaggaggaaaagttaaattataggtctttataaaataaagacaagtctaagaaaattaaaattaaatagctttttaaagcagtagaagaaaatatacctaattataaataacaagaaaagaaaaagaaataaaatgaagtttagtaaataaagcacaatatgaggtatcagaaatatcagtaactgcaaagaagctaaacttcccaaaggacagatctcagatttgcttgatgaagaaaatgaacaaatccagcagttagttgtcatgaaaagacacactgaaaacaatatgtactgactttttttttataaaggatttaagaaagatatgctaccaaatacaagccaataataaagttaagatggtgagtttgttaccaggcaacacaggatttagagcaaaatagtcctaaagaacacagaggggacactactgataatatgacacattcaacaaagtggataacggtgacaataggcacacatgttccccatcagtggaaaatgcactttgttgaagacacaggaagccgtcatgagcatcttctgtgttagagtatcaagaaaacctcagtaaattctaaatcacaaactagctctgaacaatattatctgaccacaatccaataaaaccataagcaaaagaattattttaaaatttcatataggaggaaagaaacaaatctatattaaatgtgttaaaaatgggaaatacttagaactgaataatagtgaaagcactacacgttaaactttgttggaaactgctaaagttgtacttcagaaagaaatttgtaactgtgacaatactaattaaaaataagaaaaataaaaaagcaaaagaactcagcatgcaaccctgaaagtgaggggaaaaaaagagtaaacacaaagaaatggaagggaacaaaatacgttttttaaaaaatcagcaaaattcaggaaaaaaccctgataaataataaaatctgcttctctgaaatgttagtaagaaaaacaatctctggcgaagaaaatttaaaaactattgaaaggaaacggaaaaataactgcagatttaactgattttaaaagaaaaaagagtattagaaacaatgacaatacattctaaaaccaattgatagggcaaatttctggggaaaaaaataaaataccaaagagggtcagaaaaagtcacagaaaaaataaacagatgaccattaaaaaattaatagaaagagaagacttctatgagcaaaaagggcccatgcttttttacaagtgaaaaaattaataggaagagaagacctctatgagcaaaaaaggcccatgcttttttacaagcagattctattaaaatctgaagaccagctatattgtccagaggacaaggtcaagagacctgagagagagactggccccaccacgagaagagtctaggatggtacttacacactctcccctggtcctatccctctccttactgcaccatgagaagagtctaggatgatattcacactccactggccctgtctctcaccttactacacaaagtcaccttcaaggtcaacaatccagctttgtcattaccaacaaataccattgcacctcgaattcagacgcgtgaatcttgcactctggctaccacctcccatctttccagctcccttcccctgtttccctgactctcaaccatcctttggttccacctcgagccacaatccatggatcacctcaagctttcgttgtcgctctgtccacggaagtcctctcttctcaccacccattgtgactgccacggccattcatcatgatgcccttgaacacacacagctcccttccccgctgttgcttcctgatcctcacccatggaaaccacagcttggctgtcgctctccatctaatccctgtgtgcatcaattcagcctgaatttcgctggagaaaagccgagcactatacgggtctcacgttaacttaacaaccatgaacctcaatggggctttggtgctgctggtatttacactactcgtccctgctccaattgtttcttccctcatctacatgagtatcttccacttgcccctctctcctgaagcccccaacaaatctcccctcctcactcacaggcttggagtcatccaatgagctcgttcacttaattcccttcattgcttctacccacatctaaacatcaggaatggaacgctgtgccttccccccactagcagaggggaactgtttgtaccaccatgtaaggcgagcctctccatatttgcaggcctcaagccctcttgcctactccacgatactgaactagcaattctttcttccctctgatgccatcagttttccctgttctgaatcacttccattatgacatctttacattataagatttcctatcttaaaaaaatcccaaactgcgatctgtctctgtcttgctactgcccccatataattctctgcttccctttaaaagcaaaactattcaaaaatgttgtctgtgttcactctttcttcgtcaaacccaatccaaaatagatgcttaccacacctctccaattcccttccccaactcactgatagtgttttcctcaagaattctggcttttaattatcattcttgtacttgaccttccaaatgtatttggcaaagcatatccctcttcactcattgatacagcttcttcttttgccttctgggactatgcgctccactggttttccttctgtctcattggttgctccttgtagactatcccccccttgtctccagcctcaccaagttggaatagacaagggcttaggatttgtccctcttttcttccctggctgcatgcttttcctatgggatttcacccagcattgtggttctaaacgccatctgtatgcaactgattgttgaattgctgtctctagcacaggtatctctcatgaagttcggactgtatatcctattgcctattccatatttccttgtggatctctaattaaacacccaaactcaacatatccaagacaactcctgaccttttcttctcactcccaaaagctggaccttgggcagccctcatctcagttgatgagaattccagttactaagtgccaggtacttggtgtttccttcactcctttctttgtctcatatcccatattgatttcaccagaaaatcttttggaacctactttcaaaatatacccataatctttttctcaccactcctactgctgctacttggtccaaccttagaccatcttggttcaaatagctgtgaaattgaaaagggcacccttattccttgtgggaagaggaatcagacacagtcaccctgcagagaattctgtggcatttattaaaggcaagcatgcatctattcagggaatcagagagacttatctggttcataagagatatgcacagcactgtttgtgggaggagagagttagaagaaacctaggtgtccatcgctaggtgaacatgtaggtaccatgtagtgaaaacacattgttgaattccataccacagtgagaaacacaatttagcaacatggagagatctcgaaaacagcactgagtgggaaaacaggatctgtaacacaaaagtgtgtggcttaagatcacatatatatggtatatctttcaaggatacatttgtatccaaggacatttaataaacacaattgagttgatgctttggtaagggaaggattgggtcattgatggacaatgaagggaaaaataatgaaatgaaataagagagtccttgacagaccagtaatagcactgtgctacatgactcatccaactctcttcactggtgagaaagaaagagagcatactaaagctaaaagaagtcttagcaattattttaacccaatctctgccttaaaacacacacattctattatatctagcaccaactctgcttcagtcattttatagaagaacatcagctatacatttaaggaaatccaatagtcaaaaaaccccttttatagaagaacagagcttttctaggaaatctgctgatggaagaggggtagatcaggttttctaaaatggcatcatggtggataagttattttaaagtgtctgttgctcaacacacacacacacacacacacacacaatcacacacaccagaactctttaaaagctggaaaaaaaatgtgaataaaataaaaccagagctgggtgaaggcaatcatagaagccagtgtgccaaaatttgcatacaaaagtcaaaactggcaacatagttttgggaattattgtggccacttaggggaatgagagattgggctctgaatctgcttgccaatttgcatagttgaattaaaacctcctacacaaaggcaggacaattggaggaactctagcttcagagaaatggtgggtgaaaaaaaaaatctgactgcctgcaagagaaccaaggaagaacatcttgagctctgtcctttttccaaatggaaaaaatatcgtctccctgagaatataggagcaaagcttggtcttgtgcacctggagtccaaatgtgcacccccacaccatgctcaaggagccccaggctgaggcattaaacatttccaggcaggcagcacccattatattttcaggtaaatctctggagaaaatcatcctgaatcttggttcctggggattctcacatattatatttggctaaatattagtgcctgcacatgtgcgcgcacacacacacacacacacacacaaccatgcaatgaaaaaagtcactgagtgagaataagtggaagccacaagtaatctatttccattctcaaagacttcagtcactgtaaagattaaataccaaataaaaatagccaagaaaattgaaagaatataagtgagagaacaaggaagatataactgataagttttcagaactgatgaaaataaaggaaaccaaagagacacaccaggagaaagtggaatggtatctttaaaaaaactagaaaaacaaatgcaatccaaattgctgtacatgatcaagtgatctcccaaggtcaagagtgggataataatatttttcagaaaagcaaaaactgaaagcacttacaacgagagtcgtacctagagaaactttggcaggatcaacctcagaaagaatgcaaagcatcccaagagaagacgtgataattgagggaactgagagcaagcgggaaagtctaaaccaacattggcttatagaacaccaatggaaatgtctaatttctggggctaaagttaaaaatatgaaattatatgtacaatgatagcagattagtcagatggaggatgataaaaaaaatcctaaggtctttgttctattcacgaaaagggtagatatgttaaattcactttagatttattattttaattggatatatacagggagagccaatacagtaagtaaatgcaagaaataagaaaaaagcatgatacaggaaacagaaaaatagaaagcacaaaaatgagatggtggaaataaacccaaatgcactagtcatcacaaggaatggattaggtaaaaagacaaagatttccagatgagaattaaaaaattaagttatatgctttttgcaagagatatgcctaaagcctaagaatataggaatagaatacttaggtaattaattgaaaaatgtatgccaggcagataacaactcaaagaaatctggcatagtactattaatatcagaggaaaagcctaaaaggcaaaaaccattattacagatgaagagggtcattatatttttatttaagtttaagttgcccatgaggttataaagatctaaatatttatggatgtaataaaatgccacaaaatataagaaaaattgacagaattacatggagatataggcaaattcattaatacccttgaatatattcatataacttagttagaaagtgataggccaggctgaaaatatttagtaccgatagaaatatttgaaccagacaattaacaagctggatttagtgggcatataatgaaaactgcttaacaatttgagagccattattttcattactacagagaaaatctacacaaatatcatgtgccctgtcacaaaagaagtctaaatgaatttcaaagattatattaaagcaggccacattctctgattagacagcaatcaagttgtaaatcagtaagagacagacaacattaaaaatgcacatattctgacattttatagctttctaattccaatgtcaaccatcaatttaaaaaattcaaaatgcaaacgaaaagaaggcacctcaacaacaataaaaattccacatcaaaatatgtgagggacagttcaagtaaggcctaaaaggaagtgtagaagattatgtgaggagagaaaattagtaaagcattaacaggttaatctttctatttcagaagttagaaaaagcataacagtggaagcctagaaagtagaaaaaaggagataataacaaacagagattcaacagggagggccaacgatgtcaaaactggttctttgaaaagattaaaaataaacctctgaccaagaaatgtagggaggagtcacaaatactcaatatttgacctgcagaggagatcataggtagatttcaaaggttgttaagaattttaaaattttaaacaaattcctagaagtataccaaaactagcttcaaaaaatctgagattagctgtatttaaattagaaagcctgaataatctcataagtattaaacaaactgaatgaatattttaaaatccttccacaaagagaacaccagactcatacagttttacaggtgaattctgccaaatctttaaggaaaaaacagttttaaagtgatacaaacttgtctcaaaaatagaaaaagagagagaaaactcccccggccattctttgagtcttgtataaccttgatattaaaatcaaacaaagtatagacaactgaaaatcatgagctgatctcattcaggaacagatagatgtaagatgcttagacctgtgataataataagaacaataacagtagcagtaactattggctaaaccaatttacgcgtggcttcttggttgcagcgagttggccttcatacctgtgcttcctggtccctggtcgtcacctttttccccgaacacctgtgaggtgtgttgaagagtgaagggagaagatctagccgacttaggagggctccctgtgagccgacttagggcctcccggtgaggtggagggatgtgaggaaggcagacaggcggggccggtccacagggattcagttggccacgggcataggctcggtgctgtgggtccctgcctttgtcttccgggctgtgagtctttgctcagcaccagccagcgcaggcttggtttgcaacgatcatgattcagggcagaaggtcttggtccctgtccttgagaagcttccagtctcctgagaaagatacacattcatccaaaaattaaacaaataaatgcaaatgtgcaacctgtgataagaaggaaggacatgaagttctgtggagctctgagagactgtaatggggatgcag

SEQ ID NO: 3813 - DNA, 1658 bp, Homo sapiens
cctctgtccctcacttcctctttctgttcataaacattcttccacgacgtgctgtgctggaatccctgagcctgctctggcctgggaggctgcctgattttacacaaagaactcttgaatccccttttatcattttctgaaccatttgagagcaagctgcaatcataagatccagcacctctaaacactccagaatatatttttagatataaccctgtaatggctgaaaagtgttccccccaaattcacatcctcctgaaacctcagaatgtgaccttattttgaaatagggtcattacagatgtaatgaaggatctccaattgaatccgtccaaggattaaggtgggccctgaatcccatagactggtgtcctcataagaaaaggtgaggacaaagagagacacagagacacacagatagctatgtgaagatggaagcagaggttggggatctgctgccacaaacaaaggcaccccaagtattgccagcaaccaccagaagcaaggagaaaggcatgggacgctttctccatcagagtctccggaaggaaccaagcttactgacaccttgattttggacttctagcccccagaacttcaagataatacatttctgttgtttaaagccatgtggtttgtggtaatttgttatgacagtgctagaaaacttatacaaaccctccaaggcagaaataaacatgggcacaacactgctacccaatccacagatcccattcaaattttgctggctcagcccatcatgtctcttttccctttcaggtccaggatccagtccaggagcatgcattacatttagttgtcacatgtccgaatagaaggaaggagattcccttcaatatggaataatttcttagtctttccctgtcttccacatccttccgttttttgtttttgtttttattttgagacagtctcactctgtcacccaggctggagtacagtggggtgatcatggctcactatagccttgacttctccaggctcaggtgatcctcctacctcagcctcctgagtatctgggactacaggcgtgtgccaccacactcggctaatttttgcttttttttgtagaacagagtttcaagttgctcaggctggtctcaaactcctgggctcaagtgatccacccaccttggcctcccaaagtgctgggattacaggcacgacccactgcaactggccccacatccttcagtttttaagagtgcaggccttttgttatgtaggatggccctagacctggttccatctaatatttcattttggtcagacctcgccatgatttcttgacaggaaaatgatggacaggatcctgggctctgcacattacagcatatgatgtggtcttgtctcatcactggtgatgttaatcttgattgcttggtcatgttggtgtcttccatatttctcctccattgagtcaccattttcacctttgcaattgataagcattttgtggggagattttctaaaattatgctaaaatcctgatccttaacaacttctacccatcagccttaatatttgtggatgatccctatctgaataaattataaccataatagtgtcatatggtggtttgctattttcatcattccttctacattaattacttggtattctactgtaagaaagaa

SEQ ID NO: 3814 - DNA, 9639 bp, Homo sapiens
gaatggcgtcggggttggagggttggaaggtcgggaagtgaaggactcgcaggcatatttaacaacgcaaagttgctaggagttggtaccagcgtttgggaggtagaggtggcgctcatgcatatttgagacaacatctggatggttggggagaacggtgatgccacactcaatcagaaactatgctactgctgaagaggtatattgagccctgcctggttaacctccagtgaggttattagagaattgggagaggctcaaatcagcatcctgcacctagttatcaaaccattgtgaagtcttgattcctggatggccagaaaacttgtcattggtcaagagcaacattaagatctgcctgttactcatactgatgcttcctgcccagcaagttcatcagagggcgaggatgaattacggttgccatgaatgtccttgtgaggcagttgggaagccttggctggattgtgaaggatatttgaaaagtattttagagtccaccagatcatccatgtgagtgaccatgcagcaaaagaaggagggtcctctcagtgattaaggtaacatagtgattaaggtaagtagggaaagagaggcttactttgccctgattcttgtcagggaggctcttagagatgccatttccagagcataagtgacaggccagcattttcaaagcttgcaacttattctataatatatccttcttaaaacaattcatgtagattatatgctcacccagtctgggatcactcctgcagaagatcagaagaactgaaatataggtgacataagctcctgcttttgtaaatgttttgttgaaacacagttgtgttcatccattattgtcgatggcagctttcatgctacagcagagttgagtagttgggagagaaaccaaatggaccatagagtttgaaatattactgtctggcccttcacagaaagtttgccaattcctggcataggttaaataaatgtactatatccacaaatcctcctctccccattttcctttcaatgggacttgcatttacagttgatcctagaatgtatggaatctcatagtaatcagcttgcttctgaatttcttcccactcaaattaagctcactcagaaagcacattcacaaattgggctacatatacagaaggagctatgttttatatgcctcactgtagtcaactcatttatcctatatgtatggttcccccattttttccttcttttcaggggtaacttttaaacttgagccattcatgagtatccaaaaagttacaacttatgttctctaattaagacttcatccttattttagtatacttcccctctctggcttttttgcatatttctgcagatgtcttgacctttctggggagtaagcccccttagaagattaattttctgtagttctctattgaggaaatacatgacatttagctttttaataatttgatgccattcattgagtacctactgtgtgctttatgtaccctgtctcgttgaatttttacaaaaaactgaaagagttagttttgtgttattactacctccatctcaaagatgagtcttggaaagcttaagtaactttaggtcacattgtaatcagtggcagaactgggacttaagaacataattcatgactgcattttcttttctttctttctctttctttctctctctctcttttttttttttttttaaagagatagcatctcactcactatgttgcccagactggtcttgaactcttgggctcaagcaattcttccacctccgcctcccaaagtgttaggattataggcatgagccctcatgcctgccccttgcattttctatttaagtgatcttgaagtttttttttttcttttttaaatctcggaatttggcctttagtaagcatagaatagcaaagtgtaatacctgagctgggggaaaaagtccttgaattctttaggaaagacttaattggtgggtacaaagtgaaatgctcactggaatcaggaatcagaaaccagttctgatcacctatccctacatatccttcttcactctgccctggcatatcatggttgatgtacatagcaatgatcatcccttctgtaatcccacttgacagtttagaagtggattgataatactcttctggcttaaaacccttcttctctgggcaggtgtggtggctcctacattatcccagcaccttgggaggccgagatgggaggattgtgtgagcccaggagtttgagaccagcctgggtaacatagcaagaccctgtctccacaaaaaaataaaaaattaactgggcacggtggtgctcacgcctgtaatcccagcacctggggaggccgaggcgggtggatcacgaggtcaagagatcgagaccatcctggccaacatggtgaaaccccgtctgtactaaaaatacaaaaattagccaggcgtgatagcaggcgcctgtagttccagctatgggaggctgaggcaggagaatcagatgaacctgggagacggaggttgcagtgagctgagatcacgccactgcactccagcctggtgacagagtgacactccgtctcaaaaaaaaaaagaaacgatcacatccagatgtcctgttactggaagggcaccatagtttatcctgcacctaacactaatacacctactctgggaattcttctacctacaactatttatttatctgatcccatctggtattaaagttctaaaagttaacagaattcttaaaggttcccaatgcctcccagaaaccccatcatctcaaaatcactagctattaaaagaagcaaaaaaaaaaaaaaaaaaaggtggctcctgacctagtctctttgagtatgaagacctatttactatgtaaagctgtcacctgccttgaaaagattaagacagcaagaaagttcttagaaagtgggtatgtggctggcctcagataaggataaattgctgagaagaaggagttgggttttttttgtgtttttttgtttcttgtttttgagacagggtcttgctctatctcccaggctggagtgcaatggtgcgatcacagctcactgcagcctcaacctcccagactcaaataatcctccctcctcagcctcccaagtagctaggactacaggatgcaccaccgtgcccattgtttctatatcagggtcttataatatggcagacacaatggcctcccacagagaaatgagccataaaaggaccctgtaaaagcaaggatggctcattgttttaagacagccaaatgtatggcacttggagaatttcaaagagtagaaggccttcttgattgcactcccctttaacagccttgcctcttatggggctatgtggatcgttgaaatggttcacaagtaaagtgaaaaatggttatgcgtagtgtgtcagccccaccctaagctcccagagcctccattctgagtacaaaggtcagttttcttctcgggacaggccaaggatgatggggttttaatttctctcctgatccatggcaaagcattcctaaactaggcactggaagtcttggtaactggaaagagacattcaccaagatgaggaaggccaaaaccaagtgccttatatagtccctagaaagcatttcattttatggaacaatctttggtctctctttttttttttttttttgtgagacagtgactcaggctggagtacagtgattaggtcactgctcattgcagcctcaacttcccgtgctcaggtgatcctctcacctcaacttcccgagtagttgggactgcaagcaagcgccaccatgcccagctaattttttgtatttttttgtagagacggggttttcccatgttgcccaggctggtctcaaacttctggactcaagcaatccacctgccttcgcctcccaaagtgctgggattacaggtgtaagctaccatgcccagctctggtctcctttcttaatcctgttgaataaggaagattttttttatctgaaccctcctcttactcttctttctgttctccttccatgatcactttgtccatcttcctctttgtcataggcatgtcctatttctaattccctttctcttttctttggtaggctagccttcgagactgcattaccctccccaacttaaaatcttttgataacccaggcagctgggttatccccaatttaaagtctttttgttgtagctgtatggcatttatctagagcatggggtacacacagtaggtttctctcctctcttttttaacatatttattatgtttatgcatgtaaagagtttgttgttggccaggcctgatggctcacgcctctaatcccagcactttgggaggctgaggcgggaggtcaggagttcgagagcagcctggccaacgtgatgaaaccctgtctctactaaaaatacaaaaattagtggaacagggtggctcatgcctgtaattgcagctactcaggaggctgaagtaggagaatcacttgagcctgggagctgagatcgtgccattacactccagtctgggtgacagagggaaactctgtttcaaaatcaacaacaacaaaaaaaagtttaaaaattggaaaccaccaaaaggtagtattaaaagggaaataaaaattactcataatcccagaacgcagtcatatgctatttttagtcttattttattcagccatttttctctttacacaaacttttttttttttttttgagatggagtctcactctgttgcctgagctggagtgcagtggtgcgatctcggctcactgcaacctccgcctcttgggttcaagcgattctcctgcctcagcctcctgagtagctgggactacaggcgaccgccattacactcagctaattttttgtatttttagtagagacggggtttcaccatgttcactgggctggtctcgaactcctgacctcatgattcgcccacctcggcctcccaaagtggtgggattacaagcatgagccactgtgccctccctacaggttttaaaatttattattatctaaatattcattttaaatgttaattttagtgtacttctttgattattttctttagagaaatttctgatttcagaaccaagtttattagcattcactgtatacattagcaccattaaaactagctagacccaagaagcagtattgaatgggtaccccttctttactttcctctgattcactctactctggtgctcacagctaagtaagtatgtacagcaatggcctgtcatttggtcgattatcttttgtgctctgaaatgtctttgttttttcatctgctctcaatacctctgtgctctgatcctttgtatataagggtaaccatatttgttctttcctgtgaaataataattcttttccttccattcagagtagctgcctgactcatacaatgaataaagtcacatagactcaaagagtggagatggaggtcggatgtggtggctcgtgcctgtaatcccaacactttgagaggctgaggtgggaggatcgcttgagcttgagcacaggagtttgagatcagtctgggcaacgtagtgagatctcatctctgccaaaaaataaaaattagctgggtgtggtggtgcatggctgtagtctcatgtagtcccagctacttgggaggctgaggtggggggtcacacatactttttgttgttactgcttcatcattggttctgatcactcagtgttctttcccttacaccagatcataatacagtattctgactaggcaacttagctcagtttattacgaatagccttaattaatttggtaaattactatgaatgaacatttcattcattctgctaggtctaggttttgccagctgttccattaagggacactatggcacgggttggcaaactttttctgtaaagggctaggtagtctctctattcaactctgctgttgtagcatgaaaacatccatagacaatatggatacaaatgagcatgattatgttctgataaaacctgatttacaaaaacaggtagtaggttggatttggcccaggggccatagcatgctgacccctgctctacagtatacatacacaaagactttcaaacaaagatgtatacaataaaacaaccattcagagttatttgattcacagtgtgtataatataataaaaataatacagctgtatttgagtcagcactgaaaagtctcttgtgatctgtgtcttacgtgcatgaattgcagaatattcatacgaataccatgaatattcttcacgggccatgttattaccatcccttagaggaatctcttccttgtcgtgggtctttctttgtatggcttagaagtgatgttgtctttatattgtgttatttgttcttaactttacattatcagctctggtgtgcttacctttttcaccaacgtgtcttctaccctacttacctcataagtgaatctaatacagaggttattttggatataatcattatcttaacaggcaagatagtgggctgtgctatttcaaaccctaaatttggctttcaggattatgaagtattaattcttccactgatatctcaaaaggtgatctggacaaaggaacaggtatctcaggtaagcaattgttgaatatgaaagtaaatattcttctttgatcgtttgttgtatttgttatgtttaatagctttcctaataatgaaccaactttgcatttctggaagaagattcgtacttttttgagacggagtcttctttttttttttttgagatgtagtctcgctctgtcgcccaggctggagtgtagtggtgcaatctcaggtcactgcagcctctgcctcctgggttcaagcaattctccagcctcagcctcccgagtggctgggattacaggtgtgcatcgccatgcccagctaattttttgtattttttttagtagagacggggtttcaccatgctggccaggctagtctcgaactcctgacctcgtgatctgcccacctcagcctcccaaagtgttgggattacaggcatgagccaccacgcccggccagattcatagttttcaagaattttgaattatatttgctaaatttgatatttcaaattttattttctattttatttattatttttttcctttatttatttattttttttgagacagggtctcactctgttgtccaggctggagtgtggtggtgctatcatggctcactgcagccttgacctcccaggctcaagggatcctcctacctctcagcctcctgagtagctgggaccataggtgtgcaccaccacacccagataatttttgtatttttcgtagagacggggtttctccatgttgcctaggctgttctcaaactcctgggctcaagctatttgcccaccttagccttccaaagtgttgggattacagggtgggctaccatgcccggcctttttctgtgttcaaaagtgagttgttttgcgggggatggcagtctttttcaattgttgatgttagggtcattaatgaaatcttttgttgcctattgttttaaactgaaccaatctcaaatatatcccatgccattaaatatactttaataacatcttttaaaaattggcacataatacaccactgcatgaatgtaaaaatttaacttgtatctgatatttggaaccttgttttaattactgctcttttaattgtgtgtaaatagtgctacagtgaataactctatagataaatttttgtacatatgtgtgttttatttcctgaggttggataaaatatatggtccttctattagtgtataagaatgcccgttttttttttttaactttttcaccagtacactatgttaaggtttcagaagaatttgccaattgtaaaggtaaaaaatggcctttgatattttaatttgtatttctttgattcctaacaagatagaacagataaaaatcttgggtcttatttttgagtttatttttcacacttagttttagtctatcatatgttgcagatatttcccccagtttggcctataaattattaatttgtatgtagctcaaatatctttttctttatggtttattctccacttgcattttataataggaagataaatatattttttatagttcataattcctttatactttttattatttttttaaatacaaatctttcccattgggaacctttttggtgtgtggtatgtaactgatttttctaaatgttcagcacattcagggtttggggggttgtagtaagggtacttgtggagctctcaacagcaggactttaaaaatcttttctccagtgctctgcttttaacatgacttaaatattctctcagcctgtttcagttttcctgccattggcttatgctatcttctatgaggggagttagcaaactttttctataaaaagcccagtggtaaatattttaggttttgtgggccatatggtttctgctcttgtagcatgaaagcagtcatagacaatacataaatgagtgagtatggctgtgttccaacaaaactagttacagaaaaaggtagtgggctggatttggtttattggcggtagtttgccaatacctgctttatgacactgtactcttacaacttctgctcacctagtttctgcttcgtcatagtgggctttctcatagttatgcctctgattttcccttgtaacttcttagaataccttcttcacctctcatctttgctactgattacctgtttccatatttcacaattttaagtttccgagagcacaggcgatagctaaattaagatgctttgcatgttaccactattatgtactttgcttggctgtctaccctgttgcttcaatataaccaattccaaatagctgcattccttttgagggtctcttccttgcaatccagagttcattgcaagaaatggggtgatttggatcattttaaggaagtttatggaattcaactctagtgtggtatcattaatgtaattaagctcttctctccttatgtgtatcatgttggtcctactacagtttggtttcctcatactctgtcttcctctaacctcctggttactgaatacttagattttttttctcattcataacttgagcttttgcaactactataggtgtgaccttccttctacattatctttctctctacagactatcgactttagctcttgctactctccatgttgccaagttgtcattaaactgagaatctgattccctgtgggttaagtttcctgagaccgcagggatagtagttgctatttggcaggtctaggacatttccccctactgattactatgtgcaaatgtatctctttccctatttatgatgcaaaattgctttagcctaacacaatccagctactataagtgtatccagaatcaagctctaaaactagaatgcaacccagtcatgtagcatccagaagtacctgaaccatctttggaacttgacagtttcacagttaactctgcaaccttactctccttatatcctgatgctattttatatgcctgttaggttgtatcagatctacattctgatctatagtttggagattataattttctaagcaaccctttgtgaggtcacagatactttttgtttgttactggttataggc

SEQ ID NO: 3815 - DNA, 5357 bp, Homo sapiens
tatatcaaatatatatgtatatttgatagagatgatagcaattatgtgtgtgtgtgtgtgtgtgtgtgtgtgtgtgttagccaagtgtggtttctcatgcctgtagtcccagctactttggaggctgaagtgtaagagttgcttgagcccatgagttagaggctgctgtgagctatgatcatgccactgcactccagcctgggcaacagagcaaaaccccatctctaaataaaaaaaaagaatcgtgagacatcatgtaatccaacctcttaatgttacagataagtaaactgaggcccaaagagatatagtaatagtcccagtgtcagtaaactgggtcttgaacttaaatgtttgtttcagttctcattgccttcatctcttaattgtcggcacttaaggccaaccaagcagcttagacagcgcagtccactcaacggtaactttatttgctatattgacaatctgctctgttctgtaatatagaacattggatcaatctttatctttttgctgacttaaggaggctgctattgttgcaatatccagagatttcaagttctagccattgcggggtctttgtggtgttttcaatttctcctctctccacccctgcccccatctgtggccatctaagttagcaatacaatttattttggccatttaaaatttttctgcctttgttttatttcttcccaaatatatttgaaaatgaatgatctatatagctgattttctgaccacatatataattgcaatttttatttgctcttcaaactattacaacatttttgtccttataaggttttttgggcagataatgcgaggtctgtggtgttaccttttatatactcctattaccttatgtttgtgaagcattttacattttacagagcactttgattcatctccctatttgttcatttatttaactgttcagttcactgaaatatttattgaacacctactggaaccaagtgactgtgctagtaacttgtgatatacagtagtgagagtccaggcatgtaaccgatcattataatacaataacatccctaaaccagactttacaagtagataggatcaacaatactctatcaattttcaactccaattttctattctacttaaaatgggaactagaaactgtttgcctgaagaatgtgtctgaaacataatatatcactgcatgtctgtgctgtagacctgttaattttatctgtgagaaaaaaagttactcaaaattctccctgacctaagaatactttctagttcactgcagtcttactgaccagatgcaacagttgaagtttgatttctcgacccaatatttctattgggttttgaattattaatatcactgttttgaggtattcagaaacaccagtgtatcaaaaaagcatttgcactttaggtgtgtgtggtggttatgtcatttattagaccatcccagacataagacaatcagggaaatcagaaaactccagcctcaaatgtgtctataatttcctgttctaccattgtcatatcataacatggtattacttcttaaggttttgattaagttgatctagcctcaacttaaattgtaatacatctgcctaattattgtctggaataacttttcaaccatccaatgcccactgctctcacaatgattattgtagagaagtaaaatggtaattattcaagtaaagtcacataatttctggagtcagtttttcataacaagtttatggaatacatcatcattggcttcttcataatatatttattatgagtgaccaaattttgcctggaggagcaaaatgctcaaaacttgttattataggttaatttccagctcactgttgacactgaaagattctgtgttactttaaacccaggataaaaggctggaaaaaaaattaaatgtaagtcataaactagtactcagcttttcctagtttctaaggcttattaacatttgcaaattactcaataaatgtctttcataatggaataacataaaagcttttgatttggcagatagtgatattttatttattttcattctggttgaaaaaaatctcagtggcttctcttcattccacgagaattttgatttttaacagcagtctctctttttctcagcattgcaaatatatatgtatatatacattcatgaccaaagtatcgcttactgaccatgcagctgtaaaccttctgtgcctatcaaacaaatacatagcatgaaactaattttagaagtttcatgggggaattttaggggaaagtataaacctaagagtgagtgaatggagatgattcatggaaaaaaaaataaaaatctaaatgtgctattaggcagagttattaacttcttttagttgttgtttgagatggggttttgctcttgttacccaggctggagtgcaatggcgtgatctcgtctcactgcaacctccgcctcccaggttcaagcgattctcctgcctcagccgcccaagtagctgggattacaggcatatgccactacagccggctaattttgtatttttagtagagacggggtttctccatgctggtcaggctggtccccagctcccgacctcaggtgatccgcccacctccgcctcccaaagtgctggaattacaggcctgagccaccgtgcctggccgagttattaacttcttaagagcaatgtgctaataaatactcattgatgaccagctcaaatttaggtcattcagacatccagacactggggcacatattctgcaagcaatgctgagacccctgacatagagaaagcaaaggatatgcctatgattagtctaaaatgcagccatcaccccccatacctcttctatggcattcatcctaacatcatggaggcctttgtcctagagaattatgtgacttgccctagagaattagtgaatgaccaaaaagagactttccatttatcttcctttgacttaaaaggcatgaaaataaggcaaaaaaatcaataaaataattttcctgaggaaaggttaagagatggcactttcctttccgggcccagagctggatttctctgagatttgaccatctcaggactcagacagactccagtgctattttctggacatttgtggtgaagcctcagccaccatgttcaaggtggtttgaatgaaaacatactcagattgtcacatttatagcagggaaataaaaactcaaattaggcatcctgcagcaggctactctgaaaataacattaggcaacatcagagcttcacttgcaaagaaatgttaaaatcattttagggaaatcagtgaagtctctttagaaacagacatcttgtgtatggcgtaacccagtcttggggccctcacggagaagagggggaagtcttttcattgattggtcaaaacaaatctctcatttgcctgatttgaagcatttcaacagtgcctggagagtacattattttcaggggaaaaaaaggagagagtcttttttatatgccagctgggatcatgggaacttcgaatgccaggaatttactactgtttctggtaattctgtgtgtagtcatttgaaatgttgaagtgtgaaaagagaagaaattgggcacttcttgcggcgggggagggggggggggcggtggctttccagattttatgccagttgcaccagcatgcagaatatttgtaatgcatttcaaagtggatataatggcaccctttgtcagaatcacaaagctcactgcggcactgctacaagaggacactgaggaaaatctggccctatgaacctagtcaaccccaagcaaaaagaatgactatgtgtgtgagtgcagcacatggccagttcgtttctcactgttttggaaagccctgtgtgccaaaccaaggacgtgtctttcagggaaaggttaattttccgaagtttattaaaatagaacttggaaaaccaagcattttgaatttattccagtcctctgggcatcattcctatttcttctgccatgtcaaggagaaattccaagcctgcattctgtcatgctaaaataaccagcccatacttctcggtgaccttctgttgaacgtacctgagcctgcaaatgtaaaaatgattgtatctgaatctgcactaatggtgtctgagagcaaaaagagtgtgacctctattggaaacctttgttcaaattcaataattcagagatgctacatacttctgcaagcttcctgattatgttcactgtaatattaatgacctaagtttgaatgtatttccttacagtccattaatttgacatccatcttttacctggggattattacaattgcaataagtcattaatgttttcttcacacagcttcttaaaccaagtttctctgcagctctttcggttctgcttacagtgtgtgggaaatctgatttttttcccctagtaatagtttgataagaaatttagtgtattgactgcctcagtgacacaatttatctttaaaggtgtggaagctggtggggaccaaatgttacctgtgtttttgctgttgattgctattttcagaagcaaaccatgtttttcacttacagtaggagtcaacaaatttgggattttagaagggggaggagggagctatttgtgtaagactgctgtcatatttgactacatattaaaaacagtaaatgagcattttgttttaatttcttaaataccttgtctttcaacatacgttttgtttcctttcttccattagtgttcaaaaggttctacccattgtggaagaaattctgtgtgcagaattcagaggcacaaggctgatggcaagatagaaagttattttgcttctaaacccaccccgatgtggaaactgatactagctagagggagctgtagaaaacaaagatttcaggattgcacagtgtgtgggcaatgggatggagactttttcccctattcccagccacagtgcccaagcgttcaagtctcctggatcagacagatgggattttagctgctgctttaaatcctagtgctggaataagtcaaggtacttcagttcagctcttgcctctgtcactaatcttgctttatgaactcctttgattttctgaataagttccagaaggttctctattattctgtccttcttccaaactggaaatggctgtatctaattctcaggatattttggatgtgtgcctcaggtaatttatgtggaatgtgtaaagcaagatgtctccaattctgaatattccttccccttttcccaatcctccactcttggactacctttataacaacaccgagtacgcacagacctgaacccatgcccaagaagcacacacaatgactggagctgtcgggaattcctg

SEQ ID NO: 3816 - DNA, 1916 bp, Homo sapiens
ctctgcttctatctctctccaattgccctccctggcctgcggccgcccggtcctccttcccagcccagtgcagccaggcacccgggttcggcttgctcaggtctctgtccgggactgggaagccacggagggccgggaaagtggcacactcctggagctcaagcttcctactctctcatcgctgaataactaccgggcaggactgggtggaacagacagcatatttaggtcattgatgggctgctgggtggatggagctggaaagtgatgggcactgctttctggggctgcccaggttccttccgagggctcgcttttcctgggcagagcgggaaagaggaggggcaggccggtcgcgaaacgcaaatagtcgagaatagcgatccggggagaagcaggtgtctgtggggcccaagagaagtaccatctcgttaaaaattcagattgaactatcttacaaatggctcccagaagatccactccctgtgggaacacagcagttgtggaagtgaagacaggactggacccagaataagggttcaaatatgtggggaaatctgacctctaaattcttataagtcagagagtgactgaacaacagcagtgagacatcgaagagttttaatatctgctgtaaaccttggcacagatcatttacttctctaagactgaatccaaaaagcacaatggaatactataataagctgagacagcatggtgaattccagacaagcctgagcattccctatagccagagaaggaggcccaacacctaacatagccttggatgcagaactgatagaacttggggaaagtgatgaagtagttgacctcacctgtgaatctctagcacctgtagtgattgacctaactcaccgtgactctgtagtgattattgaacaaaggaggaggccaagagcaaacacaaggccactccaagaccacactggcagttgtgtggtgaacaatgatgaggagggagtgaaaagggacagagatgtatgtataaccaacagtgcccaccataattccctgcaaaaaaattttttttgtcatatactacctggttatattcagtgtcaagtttgcatggatggatgctcagagattgaacttagtatacaacacatctactctatagaatgtggccacatctgtagtcagtgcttctgcacttcctttacacatactaacactgcccagtttgtttgaaaaaaatcagcctccatcagtatcactgcagttatatatgatgtatgccttattgctcaagacagatcctgtggctggatttttccatgtctttgtgcaggaactatgggttgttggcatccaatgctctgagcttaaaaatactgatttttaaaattgctatctgcagtatataagaaactctttgatttctcatatgctctgagactgctttttgtttcctttggttttatgcttcagctctggacttcagttgccagagtgtgccagatactggggtcgtccttaaagcaactttccctttcttatagtcatcaatttttagttggccacatgtggacattctggaccacataaataaagacaacaccctagagatggtgaagtaagttgtaaactaaaatcctaagccccctaattgactgaatggaacccctcttgaccaaagtgaccccagaaaaaccttaaaactgagttcctggccatgacgggatgggaggtcagacacgcttcattatatctccgtctcttttatggtttagacacaacaactgaccagcattaatgtcaaaataaagatcataaggctgacagaatagaccctttgtggcaataacaaattattcgtaagatctaaggtcatgccaggcaagtgttatgtcatgcactcctacacttaaagaataaactatgttctaactgcc

SEQ ID NO: 3817 - DNA, 3395 bp, Homo sapiens
tctgatgcagcttcccaaaggtaacagatgcaaatatgaaccaatacatatatatttctttccctctttttttttttttttgagatggagtcttgctctgtcacccaggctggagtgcagtggtgttgatctcagctcactgcaacctccgcctcccaagttcaagcgattctcctgcctcagcctcctgagtagctgggactacaggcgcgcaccaccatgcccagctaatttttgtatttttagtagaaacggggtttcaccatgttggccaggatggtctcgatctcttgacctcgtgatccagccacctctgcctcccacagtgctggggctatagccgtgaggcaccacacccagcctttccctctttttacacaaaggatgtatcaacataccatgaaaactgcttttgtcattccgtaatatattttacagttattccatactgactctcaaagagcttccactctttgagaataaatagctatatattatatcattgcatagatgtgccatatttaactaggcctctctattgggacatttagttttttcctaatattttgctgcacgaaaaataataccataagggctaagctaattattcattcatagatattgtggaagaatatagaatacaatttctataagtggacctgctgggttgtagcatatgcacatgtagaattttgatagaccctgggaaacttccacctccccacaaacgccatgtgaattttatactcccaccagcaatgtgaaggctatttctacagttccgaattctgcacacaggtgtcccaggagcaccacagttaatgtacaggggtgcatcaggatattttaaaattttgagcgaaacagcaacatttgtcagacactgcatgacagatattgctacaagctagaattacgtgctcaaggtagttcacattttcaatactggatctcaatgtattccttctttttgaggcagggtctcactctgtcacacaggctgctggagtgcagtagcatgatctcggctcactgaaacctctacctcccaggctcaagtgatcctcccacctcagcctcctgaatagctgggaccacagagatgcaccaccacacccagttaattttttgtattttggtagagatggggattcaccatgttgcccaggctggtctcgaactcttgagctcaagctatctgcccaccttggcctcccagtgttggaattacaggtgtcagccactgtgcctggttattattcctttttaaaaaattttttaaatcaccaaaatgtcatgaatatattccttttttttcgagatggactcttgctctgtcacccagactggagtgcagtggcgaaatctcagcttactgcaacctccacctcccgggttcaagcgattctcctgcctcagcctcttgagtagctgggactacagtcgcgtgccaccatgcctggctaattttttgtatttttagtagagacaaggtttcaccgtgttagccaggatggtctcgatctcctgacctcgcgatctgcctgccttggcctcccaaagtgctgggattacaggcgtgagccaccatgcccagccaaatatactccttttaatgacataaatctttgcaaagctaggttttgatggttcctgtggtaaagtaccacacaaaaattagtgaacaggaaatgaggagggcaagtgtccagtctaattcccaggtttaagtagttgtacacatcccattaataactgtacttaagaatgaaataaaaatatcttctttcaacttaagtgtattatttattcaaatggctaataagcttaatgaatactcattaaattgtttaaaattaactagttaataagtgaaacttttagggatttcttttggctcagaagcactgtgaaaaaattactcaaacactaaaggtgtcaattcaaactttctgatctttgctaatttgataggggaaaaatggcaacttagtgtagatttatctggcatttctcttatgtgaagttagttgtttcttatgattaagaagcatttgaattttactttttatacattatctatatctttgtccagttttttattgggttaatggctttcttcttgatttctgggagctttttatatattagggtaattggccatttctgactgtttcaggtatttcccccagtttgttgttttctttttactttaacatgggctttgccctatagatctttaaaaatttagctgaatttattgttttctagacttctgggttttgtcatacttagaaaggctttccctattacaggattataaatttaaaagccttccatggtttctctctctctttttttttttttttttgagacggagtctcagtccagtccaggctggagtgcagtggcgcaatctcagctcactgaaacctccacctcttgggttcaagcgattcttgtgtctcagcctgagtagccaggattacaggcacgtaccaccacgcctggctaatttttgtatttttagtagagagggggtttcgccatgttggccaggctggtctcgaactcctgacctcaagtgatctgcctgccttggcctcccaaagtgctggaattacaggcgtgagccactgtgccttcccatggtttcttatacttattttaacaatgttatttttgctttaaccatttcaaatatcaaatttctggtagatctgagatactttcaagtttataggacaactggcatctcaaacttgaagtatccaaaatggggctctcttgtcatctccaaccttggtcctcacctgcttttcctctattccaacagttactcaaaataaaaatttaagacttgtctttggcttctctttttcttcatcaatgccttcacactccttaccctgaacatccaatctagcagcaatttgtgttttttctgggaaggaggggagtccaaaatatatattgaattaatctatttcttgctttctctacagccaccaattaccctagttatgggcccatcatctcacctggactatcatgggtctccctctgttgcccaggctggagtgcagtggtgcaatctcggctcactgcaacctctgcctcccagattcaagcgattctcccacctcagccccttgaatagctgggattacaggtggtgtctggtgtttgtccagcaaaaaccataagttcttaagagaattgtggaagtgaagatgttaaagacagctcttgattcctctcttaatttctgtagtaagacttcatcttcagcaggcagctgaaaatacaaggtaaatttctacatgtaaattttagactactggatcctataaaatgtatgtggcctcataaaataactgtatgccaccgcctcg

SEQ ID NO: 3818 - DNA, 544 bp, Homo sapiens
atgtttattaggccggtcctgacacctgcctgcggggaaggaccaccgagaccagatcctgggtgccatggggtgcagggacagaccggtgcatggcagcggctgcgcctagccgcgctcgcagatgacctcaaccacactgggctccatgggcacagggtctgggcagcgcagggcagcagaggccaccacttcgtccagcagcaagtgcacgagttcttcgtcggccacaaaacgccacaggtagagctgcagaaagtggcagtccacttgcacctgctgcagcccgaagcgcccaaaggtgcgcagccgcacacactccagcagcgtcttcaggctgatcttgatgatgccggtcagcaccgacacctgcaggcagggacacagggatgcagcttggggactgcaggtgtggggctgctccagccaaccctccccgggatccctggaagtctgagtcacgttggaagtcggaccttgttgaactccacagggctgaacacatcaatacgttcagagaatagcttctggatattgctcaaga

SEQ ID NO: 3819 - DNA, 8347 bp, Homo sapiens
ggaagcacactgcggcgattctggagaggttgtccttttctggcatcagcgttgcggctcgaggcaaagctggtcctgtgcctgctgtccattgccgctaaggcctgctgctgccattcaggcgtgtctctctctctctctctctttcatgccgctctctccaccccatcttgggacggccagctctaagaattcctgctacgacactgaattcaaccaggaggtgatgccacactcaatcagaaactatgctactgctgaagaggtatattgagccctgcctggttaacctccagtgaggttattagagaattgggagaggctcaaatcagcatcctgcacctagttatcaaaccattgtgaagtcttgattcctggatggccagaaaacttgtcattggtcaagagcaacattaagatctgcctgttactcatactgatgcttcctgcccagcaagttcatcagagggcgaggatgaattacggttgccatgaatgtccttgtgaggcagttgggaagccttggctggattgtgaaggatatttgaaaagtattttagagtccaccagatcatccatgtgagtgaccatgcagcaaaagaaggagggtcctctcagtgattaaggattatgaagtattaattcttccactgatatctcaaaaggtgatctggacaaaggaacaggtatctcagagacagggttttaccatgttgcccaggctagatttgaactcctgggctcaagtgatcctctcgacccagcctcctgagtatctgtgactgcagaacagtggttggtaggatggcggagacatggacttcagagagttcttggtagaagactcaaagagccacctgtcatgagacatcccacttccttccccaggttacttccaagactgagcagccaggtttttggtagatgagaacaaatgtttcttcctgaagccctggggcttcaggtaggaagaaggactgctatacttgttctcacccttggcttctggctgctccagttaaacatggttcccattgatacagacattagagtgggaaaggacttcgttcatagaccgaagaccctcaaaggaaagtccttccattttgggaagggtgacattgatttcgtttagctgcttaagatatgtacttgctgttgtcttgtgagacatgacatctgaagctgaagaggagtccctctcattgttgtcattgtcccaccgggactgaaagtctcccagttgaggcagcattttagctttgatgtctacagggcaatcatggatcaggaaatttctgcaaattagacttggaaaacaaggtcttgatccttcttgtctttggacgaagactaatcatcacttttgactgaaggtgtagtgctggagactatgttggaggcagcacctgatgcactatccatattcttccccttgatcttgtcttaaagttttccaaatggattccgaggcttgtctttgatgaaaaggtcaaacatactggcagtcatgttgtttctcataagctggatgtcaacctcaatttctcctctttatccttctctcctggtttggatttcaaggtataccaccgcatcttcctgctcccctagtctgggtgcaggtcctgcaggtacacctcggcgaagcccaagtacagtagcagcagcacctcaaaggtggcctcctcctctgacactgaggtggcatacttctccttacccacctgaatcaccgagtacatgttgcttgtaccgtcaggctcttggttcttggcccctggccctatgcctgcaacactgtcacctgcacgtggattgggaaccacatagcccccggacctgctaaggccattaaggacaggatggtgatgcctcggctgactgacgtgagaagattgtcatgacccatggcctctactgctgtcctaccaacagaaacttcataatgttgtgcaggcgttaccactacctagttccagaacattgccatcacccccaaaataaatcttgcattcattaagcagtcacccctattttcccccatccctgtcaaccactgatttatgttctgtctctatggattcccctgttccggataattcacgtaaatggaataacacaatagatgccttttatcatgggtttctttcacttaggatgttttgtagggtaatccatatagcatgtatcaggacttcattttttttttttttttttttgagatggagtttcattcttcttgcccaggctggagtgcagtggtgcagtctcagctcacttcaacctctgccttctaggttcaagcgattctcctgtcttggcttcccaagtagccaggattacaggcgcctggcaccatgcccagctactttttttgtatttttagtagagacagggtttcaccatgttggccaggctggtctcaaactcctgacctcaggtgatccgcctgcctcagcctcccaacgtgctgggattacaggcgtgagccaccatggtcagccttcattcattttcatggagaaaaatatttcattgtatgagtataccacattttgtttatccatttatccattgattggttgtttctacttttttttagctattatgaataatattgctgtgaacatttgtgtacaaggttttagtggacacaagtttttatttttcttgggtatatatctaggagtggaattgctgggtcatattgtaattctgttcaactttttgaagaacttcccaactgttctccatggtggctgtgccattgtatattcctaccagcagtgtatgaagttacaaatttctccacatcctgagaacccctttattattttctgtttttctttttgattatagccatcctagtaggtgtaaagtggtatctcattgtgattttattttgcatttccctaaatgattaatgatattgagcatcttttcatgtgcttcttggccactagtatatcttctttgaagaaatgtctattcaagtctttggcagtttctaaatgagttattgtctttttgttgttaggttgtaagagttataatctggataacagatccttattagatatgtaatttgcacatattttctcccattttgtgggttgtcttttgtcttttttattttttattgcttgtgttttggtatcattattgataattcattgttaaattaaaggtcatgaagagttactcttactttttcttctataatttttagttttagctcttgtattcatgtctgtaatcaattgaagttaatttttaatatagtatgtgttaggagtccagcttcattgttttgcatgtatctatgcaattgacccaaagtgatttgttgaaaaatattattttctgatggtatggtcctgacacccttgtagaaattcaattgaagatatatgtatgagtttacttctgcagtctcaattctattctattggtctaaatgtttatctttatgccagtaccagcctgttttggttattttagttttgtaataaaatagacaaacatttggccgattaatcaagacaaaaagaaaagtatatagaaataatattatgaaagaaaagggggagcatattgaaaaacaccataaagattaaaaagattaagggacagtgttaacaatttatgccaatagggtttgaaagtttagagaaaatagacaaattcctagcaaaatataaattatcaaaacctactcaagaaaaaatagaaatcttatatagtcacaaggtattaaatattcaattcttcctagagacccaaatatatgctttctacccgtaactcactgtaaataaaaagaaagggataatatattgtgcaaactctagtcaaaaaaaagttggaatgacaatattaatataaacaaaagtggacttcaaaagaagcaatattatcagagagaaagagggcactgcttggtgaattgccccctgataaagacataacaataccggaagtaaaaattgacataactgcaaggggaaattgacaaatccacaattatatttgggatttaaatgctttactcttaataattaataaaagttagctaaaaaattaattttagctaaataaattagctaaaaagttaacaaggatagatctgaacaacactaggataaacttgtcctaatggacatttatagaccactataaccaaaagtggtagaattcacaatttttgcaagtacacatggaatattcaccaaaataaaccatatcctgatttataaaataaactaacaaactggcttctctcacttagcaatatgaatttaaatttcccccatatctcttcatggctttatacctcatttccttttattgctgaataatgtttcattttatggatgggccataaaatgtttatctatgcacctatagagggacatcttggttgcttccaagttttggccaatattaataaagctgttataaacattcatttgcaggtttttgtgttatcatgaatttccactcatttggttaaatacctaggaatataattgctagatagtatagcaattctgtttagttttgtaggaaactgcaaactgtcttccaaagtggctgtatcattttgcatttccactaacagtgactgggagttccttatgctaaacatcctctacagtatttggtgtggtcagtgttatagattttggctattctttcaggtgcatagtggcatcttattgttgttttaatttgcaattccctgatgatgtatgaggggacttcaaaaatttatggaaaaattgaactaaaaggtaaaagtaaaaaatataaacttcttaacataagctccatcgagttcaagatactttgtaagcaatgataccagccatttggttcatccctaaggaactgagggttctgagaatttaatcaggtcaatgaagtcttttttacgttatgaactgaagaaaaatgtgtgcaatttaaaggtttgttaagactttgaaacaaaaagaagtcagaaggagccaaatcaggactgtaaggtggatgaatgcctaatgatttcccatcaaagctctcacaaaattgcccttgtttgatgagaggaataagcagaagcattgtgatggggaaggactctctaatgaagctttcccaggtgtttttctgctaaagctttggctttctcaaaacactttcataataagcagatgttgttgttctttggccctccagaaaaccaactagaaaaattcctttaacattccaaaagactattgccatgagctttgttcttgaccagtccagttttgctttgactagaccgcttccacttcttggtagccattgctttgattgtgctttatctttaggatcatactggtaaagccatgttttgtctcctgttaaaattcttcaagaaattgctacaggatcttgatcctacttgttaaaatttccattgaaagctcagctcttgtctgcagctgatctgggcacaacagttttggtacccattgagtggaaagtttgctcaactttaatttttcagtcagaatagtgtaagctaagccaatttagatatctatggtgttgactattgtttgtgctgttaattcttgttcttcttcaattaaggcatggacataatttttttcaatttttttttcaaacgatgtggaaggcttgctgctatgtgcttcatcttcagcatcatctcatcccttcttaaaatgagttatctgtttgcaaactgctgatttcttttggagaatcatccccataaacttctcataaagcatcaatgattttaccattcttccacccaagcttcacactaaatttgatgtttggttttgcttcaattttagtagaatttatgttgctctgacaggtgctcttttcaaacttacgtcttacctttttagtgcctcaaactacatcctgttcaggcatgttataacaagttagtatgagcttattttggtataaaaaatttggactccataattttttcataatatgcatttttcattaccttttggaagacaactcatatcaccttgagcttcttttcatatgcctattttccatatgtatatcttctttggtgaggtgtccttttcagatgtttgtacatttaaaaatcagttattacccactcccaccacttctattcaacatagtactggaagtactatcaagagagagcaattagacaagaaaaagaaattaaagatatctaaattggaaaggaagaagtaaaatgatctctctttgcacatcatatgatcctatgtgtagaaaactccaaagactccaccaaaaaaacctattagatctaataaatgaattcagtaaagttgcaggatataaaattaatatacaaaaatccatggccattttattcacaaataacaacctagctgagaaatcaagaaaacaatcccatttatgataacataaaacacttaagaatacatttgaccaagaagatgaaagtgcatcagtatagcctgcacactgaaaaccacaaaacattgatgaaatacattgaagaggacacaaataaataaaacgatattccatgctcatagattggaagaattaatgttgttaaagtgtccatactacccaaagcaatatatagattcaatgcaatccctatcaaaatctcatcagcattcttcacagaaatagaaaaaaatcatacaatttctgtggatccacaaaagatcccaaataaccaaagcaattctgagaaaaaaaaatcctggaggcatcatacttcccaatttaaatttatattacaaaacgagagtaatcaaaacaatacagtattggcataagagatacacaggacagtgaaatagccagaaataaatccaaacatgtatggttaatgaatttttgacaagagcaccaaaaagacaaaatgagaaaagggtagtctcttcaataaataggtgctggaatttccacatgcaaaagaatgaaattagactcttacattacaccatacacaaaaatcaatccaaaatggataaaagatctgaatgtaagacctgaagccataaatctagaagaaaacataagggaaaagctccttgacactggctttggcaatgtttccttggatatcacaccaaaacctcaggctacaaaagcaacaataaataaatgaaattatatcaatctaaaaaacttctacacagaacgaaaacaatcaacaaaatgaaaaggcaatgtacagataaggagaaaatatttgcaaaccatatatcaggcaaggttttaatattcaggatttaggaagaactcatacaactcaatagcaagacaacatataacctgattaaaaaaaagtggggaaaggacttgaatagacatttcttcaaagatgacagaaaatgaccaacaggtatatgaaatggtgctcaatatcaccagtcatcaggaaaatgcaaatcaaaactactttgagataccacctcatacatgttaggatagctattatcaaaaagacaagagctaacaagtgttggtgagggtgtggagaagagggagcacttgtacactgttagtgggaatgtattatatattggtgcagccattatggaagacagtatggaggttcctaagtaaattaaaaatagaactaccatatgacccagcaatccctcttctgggtatatccccaaagggaatgagattatctctgcactcccaagtttattgcagcacaattcacaatagtcaagatacagacacaacctaggtgttcatcaatgggcaaatggataaagaaactgtgatatagagagatcaatagatagataattagaatattatttagcctttaaaaagaaggcagtcctgtcatttgccaaaacatggatagacctagaagacattatgctaaatgaaataagccagacacagaaagaaaaatattgcgtgatctcacttatatgtggaatcaagaaaaaaaaggttaaatatatagagatagagaataaaacagtaattactaaggtcaggataaggtggaggaaatgagatgtaggtcaaaggatgcaaagtagtaaatatgcaggatgaacaagtgaaaagatcaaagatcaaatgtacaacatgaggactatagttaatacatattgtatattgtgttcaggactttttgctaaatgagtagattatacctgctcttgccaatgggggaataatcagtaactatgtgagatgatgggtatgttcattgttccactatagttttactatatatatatatatgtttcatttaacattgtgttgtataccttaatatagacaataaaatttatttaaaacataaaaaaaa

SEQ ID NO: 3820 - DNA, 1917 bp, Homo sapiens
gaaaccaagttcatctttatttaaaggattgacaatcccattttaaacaattctttgatttacaaagagggaggtagactcgttagcctcccaaccttagcttaaatcgtgatgttgccaggttcctggtggttcagctgaatcctagacagtttcccttctcttcataaagctgagaagaaaaaaaaattatctccatctaggcccacgggaattttgtgcatagacagtttgaattggtctgaaaagtgtgactagctacctacctattcacaatgcctagaaaatgggctaccagatatggtagtggtcaaagccccgactttcctgtctgaggtactgggtttgctctaaggtagaccttggcaaggcccctaatggtccgtccagcagagtgatgctcgtgtccctcggctgtcaggtgagcgtgggtttgtgaatcagctttggataggatcatttctcttggatttaccactaggctctgtccctaacagggtctacctacctgacccccaagctggctcagtctcagcgctaaggtgtactatggaagggtccggacaaagactaatatttgagatctcttagtagcacaacgtgaaaatggtaggggattttgtcctccaacaccaaagacacttgcttttttaagaacaagaggatgtgtaattcactgaataaaatggttttcctccgtctaggggggattctagcatctgcccttccatttttgttgagagaagtattagctgatctctcaaatgcagatgttaagagagtaacaactgggttgatccacctgttgcttttacaccatagctccattttccaaaaatatatatgtatgtacatatatatatttcagatttacagggaatttttttgtgaacaagaaaaaaaaattgtctatagaagtcacaagtgtctttcttctcaggagacctcaatgatttccatgctgcccgaaaagctagactgactgcccactttccccagctcttcccgtgacctgttctctgacatgatgctctctccaaattccatttggcagcttctgcgtttaaactgcttttcaaaggggctctcttcatgccagctccgccgcgagtcagctctgtcacttggcttctgccgcctgcgcacagaatagacttggtctccgcaagtgggcagctggctgcagctgtaggcagagtaactggcactgcctccgtagatggctgaggcagagtagaagtgtgaggactctgtggcaaaataccagctgctggtcagggaaggggtagaggtctggggggccaagatatccgagtgccagcccttaaggcccaggccagcagacttcgtgaggtgctgctggctggtggaaaggccgaaaaggaagctggtgtggtaattgtcctccacgctcccacttcgatgcagtggagataaaagggacctctgggcggtgccactgctgctggttctgaccgaatgcaatcgcttgctctggctgtctgaaggcctggcggtctgcagcttcttggggatgctggcttcctccttatcaggactggtttcgggagtctgctccgatagttcctgaacaggggagaactggcatagcttgttggtcccatccagagtagtggaaggtttgtagtattccaaagcatcttctgatgaggagaagccatgtaaggatgctgccatgctggctgaatatgaaactgatttgatatccagagagaaggaacgcttgagcttattgctgtcttccagcctgtctgcgggatgcacgggcctttgtcctgctgcctctgaggtagcagagtcggcacagggtggactgaggggcgtctcgcttttctgtccaccctctgagacagcagggacaggttcatttggcttctccaggtgcagcagcttgag

SEQ ID NO: 3821 - DNA, 421 bp, Homo sapiens
gggagggagagcggcctgggtcctgggtgttgtgtgcggagctgtggcgtcgcgtgtgaggcgcgtgcagggtgagtgtgagtggacgcgtgagtgtgtgagtgtgcgcgcttggagcgtgttaggcgagtgcgtgcgcccacccctgcgcccctcctcccgcttacactttgatcttatttgatcggatcgtgaccccagccccgccgggccgacccgaaatgaaaagctctcctcctgcgaagccccctcggggcgctgtgcagcgaggccccttaggcggcggccacgctgtggtccccgaggtcccggagctggccctgcggggcccggcgctcagaagtgatgaattgatcagatagacgaggccgggcttgtccccggccactgattatcgaggcgattctgatctgggcacggc

SEQ ID NO: 3822 - DNA, 556 bp, Homo sapiens
aaagggacagggcttgctgtggctgggcgtcctggcccgtctcatctgaggctggtggggatgtcacaccacatcggcccagttttgggaggacctcagctggtagacagctccctgcccctccctcccctttgcaatggggacaggctcgcaggccagagcttgacctcagaagcaagagggagaagggcagacaggggtcggttgagccagggtagaaaccaaggggagccagggtagaaaccaaggggtcagggctgggctggaggacacggctgggggatctcatttcatggattttgacctgtcaatttgtatttgtgtgtgaatgtattttaaaaccaacaacaaaaggaaagaaaacagctacaaggaggccgaaggggcctttgggtgactcactctgccaggagcagtgtggatcaaggacacatttgtcagcgcatgccacacacacacacacatacacacatgcatgcacacatgcactcacactgtcacccgtcccagccatctgtgccacacacatgccatgcacactcacactcccagtccc

SEQ ID NO: 3823 - DNA, 4420 bp, Homo sapiens
ctacacagacccgcactgacctggaaaagcttcgggagcggcgacgggaaggcagcaggaggtggtgcggggacccgaggcgcctcgtacccggccgggctgacgcggccccgctacacacaaagcgcttcagctgcacagggcgctattttccgaaaatgccgcgtctggtcggcgcccaaaatccccaccgaaaagtcccccgtgctgcgcgcggagggacacatggtgtgcgagtgagtcaagctcccagcatccctcccggacccggccctcttcagctcatcgcccgaggattttccgcctctgccctcgtcggcagatcctgctcctacccactccctagctgtgttcccgcggggagagaggggaaagagggtctgattttttaacgaagggaaagaaaatatgccatttctagcgcttcagccacacaaagaaagcggcggaatgatccgctctcggcgaccgcaagtcccggctcgcccggcgcctgcgcggcagcgggggtgggagctgcggacggccatgtgcgcggcggagaggccgggtggccaccgaaccttcccgcctgttctgcggtgggtaggagtttggaaactaatgttcctgtgctaaccttcgtgtctctgtgacatgactgttgaaagacggagagtgcggaatctttggagttttaagcttgccaactgtgcggcctagcagaatcctgggagacggaaggacagccaagaggctaggatttacctttaagtgtccctagattcaactaggcagactgggacgggagacgctgtgaaggtaccagggaaggaacgagtgaggttccttttccactttttcataaactcaacagtcaggttcatgacgaagatatagatatttctgtagattttttccccaacattctaattatgcctcatgtttcgtagatcctagtaactgcttggattactgccacctcagaggtagagatctgtttttccgtggctggaatgccaaaaattttgttgtattttattaagaaagtagcaaaagtttggagatttgcaaagttaaaaaaaaaaaaagcattatgaacttaatctagatgtgatttgctaaggaacttaatatattgatatgtttttcacaggggcgtctgggcatggctttcccaacctagtaactgcaacttttagcatcctacatgtaggacttgggaatatgtgagacagcgccaagaatttaatccaggagaattgacaagcttaaatgaaatccatattgcccactgattttgtgcagcttcagataagtaatctttctccacttagccttttgtaacaattgatgtaataaaggtttgtagtctttgtgtaatttattaaagcattgtgcctaaaatagaaaaaaagcataggaaccataggctgtgttttcttttgatttaatattttcatttcttcagttaatagaaatttgccaaattctgatgtttttctgtagcattatttgaatgagcattgtttatttgagtgaacattcagctaattgttacagaatcgttgcccccattaatcttaggctgtagaatgtagacaagtaaataggcatcatcagtatgatgagagtgaagctacttaatactgtggaatcaaataaaggaggaaccccttactaaaccaagagggaggaataaaatggaatgggactagagaagcaattagctttaataagggtattatggaagactttctagatgagaagcagtaagtacagatgtttggaggcaaacactagagagattgttgggtaaagaagacaatgctggaggtctacttgtgaaggccttgaatgctatgtgcagaagtcagcttctgagaaccaggaagaagatattgaaagattttaagtagaagaatcataggattgaattcattttagacagatcactgttacacaaaaatttgaggcaaacagaagagtttggagtaaacagtaggctgtgagccagtaatgacttggactgagttggtagcaggtaggtgtgaagaaaataaagtggttattgggagatttggttaactgaaaatgactgagggagatagatgtcaggtgactcccaagtgagttggtggagcagctaggaggatagtaatgtcttcactgagattagaaacaaaataagagaatatatgttagggaaggaagaagtctttgttttgaccatgtaaaatttgaagtgcatgtgagccaaccagtcatatatgtgtagtgtgcaattagatattcattcaacactgttggaagagcacctactctgtgcctggtactgttctacacactgaaataggtaaagcagcagcaaaacaaatggttcctactcctgttttttagagggaaacagcatataaacaagttttaaaaataagaggagagagaatatcccataaattcgtgaagaaggctgggtgcagtggctcatgccagtaatcccagcagtttgggaggccgaggtgggtggatctcctgagttcaggagttaaagagcagcctggccaacatggcaaaaccccgtctctactgaaaaaaattagctgggcatggtggcacgctcctgtaattccagctactccggaggctgaggcaggagagtagcttgaacccaggacacggaggctgcagtgagccgagattgcgccactgcactccagcctgggcgactgaacgagactccgcctcaaaaaaaaagagtttgtgaggaaaattaaaagctgattggataaagtgttactctggggaaaagagagcaaacttttggtggttggttgatcagagatggcctcactgagaaggtattagaaaggacaagaacagtgtgagaccaaagggaatagctgggcaaaggccctaaggtgaaaaatttgttgtgtttagggaatagcaaggtcagtgtatccgaaatctagtgaccaaaagaaggaatgataggaggtgaagtcttcagcctcaataagaaggtgaagtgcactggaagccattgaaggatttaagaaatggagtatctggccgggcgcggtggctcacgcctgtaatcccagcactttgggaggccgaggtgggaggatcaagaggtcaggagatggagaccatcctggctaacatggtgaaaccccgtctctattcaaaataaaaaatttttttaaaaattagccaggcgtggtggcgggcgcctgtagtcccagctactcgggaggctgaggcaggataatggcgtgaacccaggaggcagggcttgcagtgagccgagatcgtgccactgcactccagcctgggcgacagagcgagactccgtctcaaaaaaaaaaaaaaaaaaaaaagaaatggagtatcatggactaggatagtagcagtagagatgagggaagtggatggatccaaaaagctgacctatcttgcttaccaattaaatgaggaaagggaggaatcaatagtgatgcctaggtttggggcatgttgtctaggtggaattaattttaattacacttttaacccctagcatatccaaatattatttcacatgtgatcaacataaaaaattactaaatattaaaaatattttacattatctttctcataactaagcatttgaaatctggtgtgtattttatacttatagcatatctcagtacttgatttcataaaatttccagctgaaaaaatagattcacgtacccaagtcgttccaagcatacttaaaagttttacggtaatcgaatcgtgtatatttttaaattttattttaaattaaagttaggattatgaattcagttcctaaattagcctcatttcacttctgcatttcaagtgggacaagttattaccatattggacaatgcagtctagtgaagtagaggatagtggaaagtcagacttaaaaagttgtttagaaccagctctggaaggccttggatgtcagattaaaggactgagattttacccttgagtcaggcagaataatggatggtttttgaactaaggagtgacacaaggttgtgcttatgactagaaggaggccactaggtggccagctggtgagtcaggacacccttcagttgctttgacttcagccctgtggattcaaagtctgatttttgtcagcgctctagagcagtctcaccaaaagtgtggtccacaaggcagtgccagtctgtaagccctttgttacacatccatgtcaaggcatttacagaaagtaagaatttagaaacttatagcagtttaacagactaattttatttctgtgggtctaataaaaatttgagggattgtactttgcatattctttatttccctttttttgtttgttttttgtgttcgagatgggagtctttttctgtcgccaggctggagtgcagtggtgcagtctcggctcact

SEQ ID NO: 3824 - DNA, 1526 bp, Homo sapiens
gggcaggagggcaggcctggcctcttcagagagggttctagatgctcctgcttgggttcgcaggacagatggcggctctgtgttcccgggatgacttcctcggcagcttctgtcgctaccacctcacagaacctgggctggccagcaggcacctgctgagtcctgtggggcggaggcaggtggccggccacacccgcggccccaggctcagcctgcgcttcctgggcagttaccggacgctggtctcgctgctgctggccttcttcgtggcctctctgttctgcgtcgggcccctcccatgcatgctgctgctcaccctgggctacgtcctctacgcctctgccatgatactgctgaccgagcgggggaagctgcaccagccctgaaggtggcagctgccttcagagcaggctggagggatttgccacacagccccacccttgggctgagaggacctgggaagcccctccaggagggaacacggtcatcctcaggcttctggagcggggttcctgcagccgcagaggcatctggaggaaacacaaccaagaaaggaaggcagttgggccccagcaaaggagtggctaccagggctcaacagccacgctctgtgacagcgcagagctcagcgccggcctttccctccctctgccaaggactcatggccaagccagctctcggggccttttttccagtgcccatttggctactctgctgcaccaagcttgggagccagcctgccaagagccgcctgggcctggcctccccactggctggccttgaggtaggcagagtgggttgtggcgcctcctctctctgtgtgggaccaggacggtggcttaagtctccactccaggaaagaatcaaagtttctagagttgtgagaaaaccagagagtggctctcctgattcttcactctggggtgcgttcttcatgttctcccagctgttccaagactgggccgtagaattccatgtttcaggagcctaagaccctcccagagcccaggtgcttcaccgcagaccgcaagccattgagcacatcacccaaagcagtggccaacatcgcggacccctgtgccttgtcacagatgggtgctggtcctcaggcgttggggacactgctgggtcgatggggtcggattctgccagtttctgctctgcagccaaagatggtcagaagcattgtcacttcagtaacatcaagtgctcaaagacatggcaaccgttcagtggtacttaagtattcaaaatatacaactacagattctctgacagaaaccagcacggggtcttcaccttcattcaccccacaggcgacatgcgagggagaacagcatctcagtggtgatttccaaaccaagcctttgttttcggtgtggggttttgggggtttgctttaatgtttttgaaattgtaaatgttgggctttgtattttgatgtaaactgagaataatggcattttagggcctgtgaccaaaaatgaagcttgtaacgaccatggatctgaataaacatgtccttg

SEQ ID NO: 3825 - DNA, 3597 bp, Homo sapiens
gaattcctacacggctgtgcctctcccaccccgtcctctttgctcggaagggagacctggtttgctctcctccatgacagcccagcccctgctgtgcacaggggtggggctcgggatccctccctgcaccctgatgtttattaactgtagatagtgaatttcaagttgacaggtaccttctcagggatttatatataaatatagttagaggaaaagttgaagtctattttactactttttagtgtttgagtaaattatgctttaactggacagaagaaatatttctcagacaatgtcgatgctgctgatgacaactgagatgcctggagctcacccttgatggagacttccttggtgattggagatgggggactctggtggcagaaatggctttggggtaggtgtgaagttgcttcagtccctctgagttgcctcttctggatggaacgtgtgtatcaacaacaatgaaatgcacctccgtgtgcatggaggcggctgatgagaatacagataggccagtcctcgctcttccctccagaaccggccgctcccggtctgacgttggagcacgtgaactaagagtgacaattttttctacttgcttctgtgaataaagtgttctacagtcagcccagcactaaactcaccagaaaagaggagggaacagcacggagccattcatctggaattactcgatgtgcagaggctgccccttggccgcacttgggaacatcgtggacatcttccttcctctcaggctcctcctgacagactcctggcagcactggagacctcaggactatggagatcagaattgtaatggctttgtcatctcagtgtggccactcctgaggcaagaggctcctcctgggagcaggagagagagagtttgtgatgttggttggaaaataggatttatggatgcaggagggccgtgctaggcccctctgcccgcttctctccctgctgttggcggtgaccaggtctcaggagcggagacgaggctgttgtgagtgaaacagaagcccctggcatagggccagaccctaggcctgaaaaggatgcaaagcctgctgttttcaggctgttgggaagaatcgtgcgtaccgagtgattatgatgaaacgtatcccagagaggaaatgaatgggacctgaaaagtgggtctgccacatccctggtagcccgcctccaagagcactacactccccccagccccaccggccacactacatgacgtgggaaggctgtccgttcatccttaccctggggactcaagtgtgctctgcggagtgagtcacagccctgatgtgcaccctgcactactctttccccaggtgcgccggagacgcaggcttgctcatttccgtcctgacacagctcgctgttcctgcggtggtcagagtccccctgtgctgtgtcagctcctggacactactagtctttcacatgataaagcgcgagcactttttcgcttttgcagtatttggggaaattctaacacatttcccggggatttgcccaggtccctccacctcccacggtgggtaactgtgtggattctgcacctggcaatcggcgctcccctttggaaacacctgggggccctgtttcttccagcctggtccttggtttctaccccagccgctttcagccggcacctgcatgggactgcctggagggccacggtccagggaaggacaggtgggaccctgaccatgacagatctttctaaaacaataaagtcccattgatgacaactgcagtgggatgaatgccattgcagcggtcatgctgggagctgccgagagcttacaacaaaagcagttcctctcaagacactgcttgcatcttccctccacgcctctcggtgcatttggaacttgtttatgcgctggtataactcgagtcagctgcttatttctgtgcccttgcactcacaggttccttcattaacattttaaataagtggctaaaaaaactcctctggaggttgtttttgaaagagacaggaaaaagaaacacacagtacctggattgttttgacttattttcaagcgactcagctgaaagccggtgttgcatacacaatttcctcacgctgacccagcctgactaagacttgataaaaggcacagcccttggcagcaggcagtgccaatgtggacagtgtacactaagctgtgagtgtgtgcacgggcgagcacatgtatgtgtactcatacatccagatgaactaaagggacactgggctttgtgctggcaaaggttacgatgctgctgtagcttggctgtgggccccaggcagtgtcagatggaacctgctttgatggcgtgttgttcagtgtactcagtggggtctcacatggcccgaggacccactgtgagcactccgcccgctgtggcacagaacacggctggggtcatcacagcccaggtctttattgaaaggcggctcatatagaacccatttggccaggtctgggccatctctctgcctctgccctatcttggctgcctggaggggcccaggcccaagaggattctttacccctggaagagctccccaggcattcagcctatggcccttgacatttggctgcaggttaccgtcagaatcaacaccatatcctgaggaagccctggtatttccccaagtctgcctatgtattagacactctaatcaatgctaacacagttcagtttttgagggaactagttttgtcataatactacacccctctattgtttttaaataagaaaaaaaaaaaccccacgaaactttccatcaaagcaatggtccgtgttggcctgatgctttaagaagtttgaggaggtaggtatggaggcaccttaacaccagtttttgagcagaagttctagaagctgatttagaactacacagctatggatacacctgatgaaaaccgcaaaaggcgatgacaggcccagaaatatgaccagcaagcccgtgagcctttggggcatccgactgaatttgaaaataataccccattcagatgaacattaaaagccaatgtactggaattctctttgttctgcccgacatttgggggtgtccaaggacctgtgtttttaacaaagatgactttatgaccgttctaaggattgaacagattcctgcacagggtgccaggtttcaagttaggtcctcttagtataagctctctttttttctgaatgtaaacctatttgcattgtcatttctaataatccagtaggtttctggatattgtaaagatactgagtacagatataactgtgtaaatttcatagtgttttattttgaggtgagagttttgttatagtttataaaagatattttcctattcagacctcagggctattttgggacctacaaataaatgtgattcccagcagcttcaatttttgatattcaaaaagttaataatctttaagctaaatataatgtgatatgattcagaaaaaaatgtttttcccttttaacttctaacaaattatgtatctaatgtttaaaaaatatggaaaaaagggataatgtaaaaatgtgggagaattgtggctaaagaataaaaaatcacttgttaaaacgca

SEQ ID NO: 3826 - DNA, 2465 bp, Homo sapiens
tcaagcaattctcctgcctcagcctccaagtagctgggactacaggcacatgctaccactgccggctaattttttgtattttagtagagatggggttttaccatgttgcccaggctgatttcgaactcctgatctcaggcaatccgcctgcctctgcctgccaaagtgctgggattacaggcgtgagcgaccgtgcctggcccatattttcttttattgaagtatactttcctgtttctttgtgtaccttcttgtgattttttttgttgttgtttttgaaaactggacttttgaatagtatattgtggcaactctgaaaataagattcttctccttctttggggtttactgttttattttatttatttttttgtgtgtgtggttgtttttgttttcattgttgagacctgtaatagtcttgttctagtaacttttcctatttttgcagagacttttctttgtcatgtgtggttgctgaagtctctgtcccttagcttgtattcagtgagtggggtttttttgtttgtttgtttgtttttgagacagagtttttgctctgttgcccaggctggagtgaactggcctgatgtcagctcactgcaatctcccaggttcaagcaattctcctgcctcagcctcctgtgtagctaagattgcaggcacatgccaccacacccagctaaattttgtatttttagtagagatggggtttcaccatgttgtccgggctggcctcgaactcctgaccgcaagtgatctgcctgcctcagcctcccaaagtactgggattataggcgtgagccaccacgcctggccttcagtgagtgctttgacagaattttacctgaatgtcaagagctaaaaaacaaaacaaacaaacaaacaaaaatacttttctcagtttttgccaattgggcgtgtactggggccctccttcaacacttagccaggctttcactgagcttaggaatcagctgtgatgaaacctgaagtttttaatcatgtcttttctgagcaagcatcttgccctgggcacatgcatggctggctaaattccctgcattcacaggtgcttctgattgtcctaacttcccaaagaaactctgttctcaaattttttgcccaagccttaggtggtttattgcatgtctcaactgtgaccttttgcctcaggccttgttcttctaccttatgatgattcaagcaatgcctgctgcttttccaatctgggttagttcagagttaggcaaacagaggtgagcattttgtgccagtccttcacgtacagacaggttaaaaccgatctacacaataatttgcaaataaggtctgctttgctccctctagaaccagggaccccactcccatgccgacagtatgggctgctgtcttcaggaccattgcaagatgtcagagctgcagcatgatctggaggctttcctcgctttcttctgcttcccctcccttgatccttcacaggcattttcctcaatacatctcttgcctggctaatcctgtctgatgagtttccagatggacctgaattaagtatgttctccagctagctgctagctagttaaaggcagatccatgtgccatactatggtagggatggttagtttatatataccttcttatctaactttcataatcatttactgaggtaaatgggctgggtagtatgattgcaattttatgtataaggaaacaggattaatttaggaacttgcctgggatatacactagtaagtggcagagctgagctgaaatttaaacttaagttggtattactccaaagttaccttaactactcatctgtggggcagttagactgagagtgaagttgacatcttatgagagttgaagtatctgaggaagataaacttgatgttctacagaagttgggggaggaagttctccaaatcagaatcaagtttttttctcaagcaatgattttaggacaataccaaatgtgtgatacccataccaaatgtgtgatacctatgtattgaatttatgacagagttaccaacgttctactttggacaattaactgaaaattttcagtctaaaaacataatgtggacatttataattatatatacatacatgattcatttgcttttcatcttttttctttactgaattatagctttagcaaatatctattgaatttttattatatgtcatgcatgatacctttaaggaaaaatatatatattccctttccttcccattatatttaatccgatttttttcttactttctgtcattatgaataagtattttagacagcctactgtttgcatggtactaagcaatagaaaagggcctccttcctgtaagtctaatcacaccccaccttagatggaagctgattcaatgggttagtgagcatgtagagaaagatctgctcagtcagtgtcaaagtttatttcagcggtaggttgtaagaggttcaacat

SEQ ID NO: 3827 - DNA, 2650 bp, Homo sapiens
aaagattgctgagcttcactcagcccacggtccacttctttacatcaacacatgttactataacattctagtccacaagagagtgggcgttcttttagagttcatgtatttgaggcagcagatgaggtaacctacacagaattgtacctaccaaatttaaagagcaaaaactcaaagaagaaaacttcctgatgtaggctataaggttaaaataatgctcctttatggttctactgggaaaagtaaacttttcagtaagaaatcaacagagcctgaggaaatgcattcagcagctagcttctccattaaattcaccttctatatttctcattttccattagctgcttacctcacccacatcacaactcagatatggaattagatctcagagcatgtggcaagaataaggtggggaggcaagagtaatgcaccttcaaaacgtccatgaaaaattctcagctcctcagatgacttaattactatactgagcaattcctgcctggttacaatggtgtattttagaaattttagattttgaagaattgcctaaacatgatatcaaactcaatacttcaggaactcattctgacaaaagaaaaaaataaaaccaagacacagataaattaaatactctgtattaaagttcccaaattccagaaaggaaatattagtgtctgaaataccttttctggttatggtatatgtcctttatgacaagatacttaacagaagtgttatagtggctgtgtgaaatgtcctagggagaataacttagtagtgctgttaccttgatagataaaagccacagcaatcaaatgagatttttgcttaaaaataatatctacttacaaaagactattttctaagttatgcaaatgttacttgctttttttccccccagtaaccaactaaagcaaaggctgtacttgatagccaagaacaaaactggcattttccccctgttaatcaatgtcaaccctacaatctttcagcactgagaactaacataccttcatttgtgtaagcagcacatacagaaataaccaaagcagaactgaagcatgggtattgccaagaattggggaaaaagttagaaagcaaagatgggacgtgagtctttgttttgcctaccaaaagaaaggagtcctacttcttgggtggcagttgctgtagcaaccaaaccactgctaaaggagattcagagcattaagacggaggttgtggagaagggcagaagcctgggggactgagctctgtagcgggacactaggagcagtggtggtcccccaacccccacctgatgatgttgaacatctgctcaaattagagcttgcgtcttgactaacgtctggcaagaaccataaactcccaagccaagtatcagaaaagagctaagtggggtgtgagcaagccgtctcaccgcagagactttaaatgcttcactgaaaggaaatgcagaggcaacagggaagctgtgccgtctcgaaagaaatttagatttgtgcacaacttgaaaaggacaaaatgaaagtgtccagggatcagtgtaacagtggtacatccatggtaccgtatatagggtagcacacctggatcctgttttatagtaggggcttaaagtgagaatatgtttaaaaaacaagaaccaaaactggccttgacttttggcccagcactcacaggaaacagcaaagaaaaagaagaaaactttgcaaatgcaattaattaacaaagtcatatgttttatttcaagagtgatcttagtattcctaagttaaatacagcattagaagaccagacctaagaccttacccaaacacactaaaataaaacataataaactgtgagagaagtatctgcccactctatccgcgagcttggagcaaatgagttagaaaagtcaaagctggaaggtggaggagagatcaatgattttagcaacactcacccactgttgctgacaagtcaaaagctcataagccacagaagatggtgttgctttgttttcatggtggaaaacacagctcgaagcttgaatttggtaatgcatactacagaaaagcagtgaatgtatggactgcagaagctacatagctcctcattcttcactctattttcataagcaagatgcaaatgataaagcagcaagctgacattcaagaaagcatgtttcagggcatatcttcctgaggttggtatgctttcatgctggcagctcataatttctagaaacacagcaaatcaccatgatttgtgatcattaagcaacagttagatcgtgttccaattcctccatttgtggggcagaaaaatcgtgtcatatttcagaaaaaaagatgcccaaataaaaggtcaaaataaaattgggtgcttaaaaatatgagttatttagctgtctctgtatttagctgtctctgaagtacaaataaccagaaaaatcaggccttttacttgtgtattttattatattatgaattcttgtgtaggctttgtaacgtttataacatattggtacagtggtataggcataaaatctacctataaataaaggtatgcatattagcggagtttgctctcacaaagttccttgagcaaaaacttaaagccctaatctagaaaactaagttgtccagataccttcttctcccac

SEQ ID NO: 3828 - DNA, 1443 bp, Homo sapiens
ctcgcacaccatgtgtccctccgcgcgcagcacgggggacttttcggtggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccaggtcagtgcgggtctgtgtagggccctgttaccaccggatgtggaagttgatctcttcgctggtaaaaaataattccacttcccccggaacccagatcatccccgcgatttcctgtttattgcattaaggcgccgggtttccggggctcctggccccgcttattccgcgggggtcggcggggtcggcctgggcgcccgcgccgccgctgcgctttgtccgctgggcacactgcttctgggaggggcgggcagacatggtggcggccgccgccccctcctcggccctagcatgccgcggccgcctcgcggctacccggcttgccggtcccgagcggcagccccggggtggcgatggggtcgcgccgaggcagcggaggttctgcgggcgactggaggttggcagtgggcgggagaaagaggaaggcaggcgcggctgggcctcggcctctggcgccgcggtaccctttgtctcggcagcctgacggccccgccgggctctccggagaggggaacgggcggcgagggtggcgggtcctgggcgccctgtgctgcggggccgagaggcgctcgggtcgcggcgggatcggccggaccagacagggttaatggaagagcctggccagtcccgcgcggggcccccgcagcgacagccttggccgcggggactggagtcctgagggggagaagcctgccgttctgaaggctcgggacttctgccccaaagacttcgccgccgagaactgcgggtgcactgcctcagggaagaagttgagaattttgccaggtcatctctgccagggcacagttcatcactgtgtgtttagtgtgtttcggtgaagctctccaagtgtgttgaatcagcgtgcctagcctcaagggtgcatcgtgaaaactgaaaccaaaggaatgatacaggcctgctttgtgtgtgtcttcccactttaagcttgttttcagtacaaatactcttgctttaaacctgattggactgtggcgagcggacatctgttcaaaggaggggccgagaccacagtacttctgaagggggcttgataatgtggaaacattttaagttttctctccggactgttttgctctctcaattcaggcaagttactgaagtacgttttttatctagaaaaaggtttgatgtagtctgtaaatggtccttgtaaagtacattgccatctcagaattaaaagatccactctcatttattatgcagaa

SEQ ID NO: 3829 - DNA, 5681 bp, Homo sapiens
ccccctccccgggcacgcggcgagggaggcggccggcggccggcagcgcccgcgcgggatcgatgactcggctggcgggcacggtcacctgggtgaggggcagcggaaggggcggcggagcaccgatctcatggatgggctccgaggggcttgcgggaggggggcgccagtgttcggggccgttttggcggctatgcaggattggcaggagctgcgatgctcacacttgcctcgccgaccgccatttcacatccagcagaggaggcgggggcagccgctgagacggtttttcacaaggaaatgacctcattcttgatggctgctgctaacttatggtgagatgctgggtccctgcccaataccacatggacatccaatcaatttacccagggacaagtccactcaagagcatcatttagaagagggaaaaggcactggggttatttgtttttggagtatgtgcttaaggaaatctagagtattcccacgagcattctgctgagatgaacaatcagatgacctcgtgtgagatttggaggagagaaggaaatggagagcatgcgtctgccgcttctgtggtttctgtcggctttctccatatttacgtgcttgtaactctggcatgacctttgctccagtctctaccagagggcggtgcctggattgaagtggaaaagccctgttttccagccatgacccagggagcaagcactgactcctcaggggaacaggagacctgccaactaggaccctgggagcccccatgctggcagtgccctgggtcatctcaggctcatcagcaaatcctggggggagagcggggctggagggcgaagaagcccaggagagttcctggctcagaacccctctctgaggctcccaatacagagcccaggccccacacccagggcctctgagtatttttgtttattgtatgtaaaatactagtgtatttttgtttaagtctcacaggtaaacaggttctctcatactttgccaagggaaatgtgatctgtgcaatttggcaataactatcagaattttaaaagcttatgccctttgacctagtaatttcacttctaagaatttcccctgcagagatatgtatatcttgtatgaaatgaagaggctacgaagacaggcaacgccgcagtgtttataatagcgaagaccagacacaacccacatgtctaaaggttctgatttttaaaactgtagtatatctgtacaatgagcactccacatcctttaagaatgaggaagggctgtgtgaactgaaatggaactatctctaagatttattaagttaaaaaaattcaagagtagcacagtgtgtagggtatgccatcatttgtatgatataaggtcgtatatctgccatctcaaatgaggaacagtggttgcctctgggaagggaattggatggctaggaatggggtaggaaagaggtttgcttttcagaacattttatactatttaagttttgtaacaagtgcatctattttgacttaaaagataaaaaatgaaaaggaaaggctccactagtgattctgatgctcacaaagattaagaaccaatgcgaatgaggaactcatgacaccgcccaggagacagtgaacatatctcttcaaatatcaaaaacctttcagcagagggtgagaacatgtgcctggggtaagcatgggtgggcatgagctgggtacagaggtgattcccagggacatacaactaccttgccctcctgggatcaggtcttcctcccaccttagcctcccatattgttgggaccacaggcatgcaccaccacacctggttaattttttttttttttttttttttgtagcgacagagtctcgccatgttgcctaggctggtctcgaactcctgggctcaggcaatccttctgcctcgtccttccaaagtgctgagattacaggcatgagccactgcacccagcctgacagtagcttttaatctctggactctcatcaccgtttggactgtgagctgtggttctagctcttggatctgatgggcatcttccctcaaatatgtcagtttctctctccaggtcccttgctttgtcttcctttttgcctcctcgggcctgatacctttctctgggcttctctactctgccccgagctgcctagttttgcgaataatgtcacatccagatgtcagcagccctgatgtccatgtgacaatgctcccttgctgtccatgtgacaatgctcccttggtgtcccagtgacagattttcccatgcttcaccctctctcttttttaatttttttttctgtacacagctctcagtcaagccccttgagctgcctccaactgtttgctcatgtctgttcccagcaatcttttcctcttttagcacaatcttccttaacttactagttttttgaaacagagcctattagtcttcacagcgctacctttctgatctcagagttcaccaaaaagcttttcctcccatcatgcctgcctccctttcttcaggtccgttagagtccaccgtggcctgtgtgggaagcaagtctctcccagggcacacatgaacagacttcatgcccacatccacagtgaacagtggcttctgccttccagatgggcttaccctaaatcaacacatattcctaggatgtgggaacatatgcaatacttaaatgcacaggctctgggttcagactccctagggttaaattctccctgtgccggctagctgcatgattagatttgtgatcttgacaaagttacctaacgtctctgggcctcacttttctcatctgcaaaatagggaaaatagcaacacttctccataggggtgtggtgaggataaagagtagatgtaaataaagtgttgaatgtagagcctggcacatatcaagctcttaaaaagcaatggccattttgttatttttaccgcaacgacaactgcagttattatctggcttcagagctctctttttaaaaacagtattccctggttttacacccaggtgctaatactattctatgaagctaatgtatagagaccatatctttttaacaaacgtgtatatatgagtcatttccggcacatttgatacacatcatctcgtttggtccttaaaacaagcctaggccataagcagggtacgtgttaccactttgccattcctgttttacagaggcttagacacattgagaagcttttccatagtcacttaacaagtgatgggtgaagccaaatcaagcctttagatctccaagctctttccattaaaccatataaatcacgggttggcaaactttttctgcaaaggggacagatagtaaatagtttaagccttatgggccacatgctgtgtctgtttcatattctgctccttttttatttttattttttttaagaaaagacaccctttaaacatataaaaaccattctgagcaacaggctggtgctaaaaacaggtcatggtaaccattggctctagggttgtagtttactgttgatatagattgtacactgataagccaaaatacaaacctaatgaaactgacatacttaaggaactttactctttgttagcaatcattgttaatatttattgaatggtgactacgtgggaaatgctgttccaagtgtgatagatatattaacttacttaatcctcacacccactctaatttcctaagtactattgtcagactcattttacagacaggaaaagcaaggcatagagaaggtaagtaacttttccgaggtcacatggctattaagtagcagagctgtgattcaaatataagcggtttggcaccagatcctgtgcacttaaccgcttgcatctcggttgggagcactgactggttcagctattgggagggaagaaaggggatggggaagccacataacccctaggagattctgtaataaatatgcttcagagccattcaccttgaagctgaggaggcatggaagcaggccacctgtgttctgtacagcatcaccaggctggaaatctgccatggctttccttcacgccatcacaagaggatacagatgaggctgcagaggcatcttgatttgagaaaagcatttgactggatctcattaaattttaatcattaactgaattcaaaataaattgaaaactggttgacagagcaccaacaaagggtgatgataaatggtgatgcatctagaggggagctatcttccaggggacaactctaaggcaaggacggatgggatttaatgaaggtgttatgtccccagaagaagacaaatagcacagcaaggaacagaggaaggacaggagtgagcagcctgagtaattaataaaccatattaacagctcctccataatcaggccttggtgatcacaactgcttggattttttcttaagctttctttgagtcaggaataggtttgaagcgtcctagagacacacagcatgaatatttcaggtggacattaaaaagaaatctataaatttacagctgggaggatcctgagatctacttcggatcagaaactttcaattacaagattcccaaggccttacttcattccccagagagtaatctttttaataaatgtccaaaagtcatggatttaaaaaaaaatctttaaactcattaatgtcctttgtttcctgcccaaatgcatgcaaactttcataacactggtttgctgagtggaaggttggttttgagtgaactgtttggctcagattcaaactccaatgaacaaatacttccaagtttacttgctgaatttcccatacagagaagttcttccactgggcttgccagaggatttgaaacagtggtgagccctggaaggaagggaatatttactggcccttggacataaacccagcacagtaagactcacatcaggctgaaggcagtgcagtatgaaccgacctgatttgaggaagtttgctctgggactcctctgagctactaaatgaggaggagaaggactaatgggaacacactgactccatcacattagaagttataataaacatttagagaacaacctcaaaccagcccatgttttttttttttttctgtcgttgtcattgttttggtttttgtttttttgtttcttcagataagatggtttctctaagcacatgtgtgatccctaattcagccacagccacggagtgaaggagaggaaggggtagaaaggaaaaaccaagagaggaagaggaagggagagaaaggaaggaaggagaacggaagagaagtaaggaaagtggggaaacgctgaaggatttttttgtatttgccttttattggtgtaggagagacacttatttacttgtaatttgtatgtagtgctgggtatgagaaggggcagttggaagagaagggaaagaatgaatataggtgaaaggtaagagtgtcatagggtaagctgggaggccaggaagagtttggacagacagctcagagtaggaagagagttcagagcggggagggagacctgttgactctgggaaggggaaagggaaaaaacactggcatcctgactgcagggaaacaatgaggcagcggagagcaagtatccctcattgctgagggagctgccaagaccccaggcagcctcagtctgtggggtgcggcctgtggggtgcgaggagaggggcacaggctgggagctccggtcagtcct

SEQ ID NO: 3830 - DNA, 2397 bp, Homo sapiens
tgattcaatgaaaatgtatcatatataacagaaagtacagagcgggagaacaagggtgatagattcaatagctcaacactatttgcaaggagactagttctttccatattcagtagctctcttttagtaaaaagggaaacatgtttcagatctctccagataacttcttctatttcactgggcaaaattgggtctcatgcctgtgcctgaaccagacatggctgggtatggtggctcacgcttgtaatcccagcactttttttgggaggccgaggtgggcagatcacttgagctcaggagtttgagaccagcctggccaactctcgaactcctaggctcaagtgatctgcccccctcggcctcccaaagtgctgggattataggtgtgagccacatctggccccagaacaatttctgatataaaataatacatattctagatggtaggaaaaataaattcctttcacaaacacttaataataactatttttatatagacataaatctacttttttaacataatttaaatcacaattggatcctttctaaaaattaagcttctttcatatgtgcttaccgggaagaaaaaaatacaattaggactgttcacagtggttattagaatatgaccgtttattttaggtagatgtttaaaggatcctcaaactctgaagtttaggaaaaactatgattcatcctaagacatatttgagaaaaaaatgaaaaacttcttagatatgagagtaagaatctgttactaacaaatgcctaaataaattaaaattgaattttttaaacacttgaaaaataaaaattaacttacctatagggtatcccaatgcaaagtcattactttgtgtagcaaaaatagggaatagtccagctttgctaaatcgactatcaggactggcaaccaataaggttaatacacatacaatgaaaaatacagaagctttggcaattaagatactatataggaaggaccagtccacattggaaaaattaagtacaaccatgtttttgaataataaagctggaagtgcaaatctggagacaaaatttcctagtcctttggcctgggttgatgttatgacattggcccttcctgctatgtagccacaaaggacaatgccaaagcattccagtaaggctggaaaaagccttgtaattgacattgaaggtgggtcattagtggaattaaatccatgcgttactgctgtaggcaaagtcttggtcatattgactgcaatggttaagttctctgcaggtaaattagaattcattttctctcaccctccaactccaaccagatctctggaaagaaaggaagaaagattcagtatggccatcaacaagaattctagttgaaataatacactggcaaacctagatttgtttacttattaaatggccaaataaatatacatacccctagatttatttacttattcaatggccaaataaatatacataccatcagggaaaatacaatggaaaaaaaagtggggggttgctaacaataatcgcttcactctcaaaggcaggtcagctcaaaatatttatgttgctaagttctatactcagtattagacatgagtaaaataagatccgcaaatattagagctgcagtgatgccctgtggttctctccagtgattctctccatcaattgagctccgcctggtggataagggcatcgggcacacatagtctccgctgaatgtccccatgcatccaaattctctggaaatttcagaagttctcaaggctacattgaggagtcacccagggaccagagtcctttccagcccgtggtcatatttgaatataggatgggaagaagggtatagtagagcactactaatcaactttaaaccaataacttttttttctaaagacagggtcttgctctgtctcccaggctggagtgcagtggtgcaatctcagctcagtgcaacctctgtctcctgggttcaagcgattcgtgtgccaccacgcccggctaatttttgtatttttgtagcgacatgttgcttaggctggttttgaactcctgacctcaggtgatctgcctgcctcagcatcccacagtgctgggattacaggcatgagccactgtgcccgacctgaacgaattaactttaacttttctgtgtctcaccttcttcacctgtaaaatggcaataatagtaatacctaccacatgggaacttgcgattattccactgaagtctttataatcacatctggaacagagtaattacttaacggaagttaaatataacttttggtagaacatgagagagagaaaaaaatgacgacctcccaccaatatacctttagctccttctacacccgccacacacactggccccagggactttgtgccacagggact

SEQ ID NO: 3831 - DNA, 4233 bp, Homo sapiens
ccaggatggtctccatctcctaacttcgtgaatggcccgccttggcctcccagagtgctgtgattacaggcgtgagccaccacacccggccccaaagctaggtaatttataaagaaaaagaggtttatttggttcacggttcttcaggctatacaagaagcatggtacccatcatctgcttctgatgagggcctcaggaatcttccactcatggcagaaggcaaaggggaatcagtgtgtacagagatcacatggcaagagcaaaagcaagaagacaggaggaggtgccagtctctttttaacaagtagctctcacaggaactaatagagcgagaactcacttactaccttgagcatggcaccaagccatgagggatccaccccatggcccaaacaccttccaccaggccctgccaccaacatgttgggtatcaaatgttaacatgagacttggcagggccaaacaaaccatatccaaaccacagcaatggggaagatcgtcctggaccaaaagaaaagttgttctggaaactgcagccatgagaagccctatacattggcaaggtagttatcctgatctttgaaagttatttcatcccctctgacgccagtgctgatattctcaagaactcatgttcccaagagcttctggttatacaggtctagagaaagcacaaatggtgtgaaccttctggaaaggtacacatgtgggaaaaagtctttaaaatattcatcttaaaggtcacaggaggccgagtgtggtggctcatgcctgtaatcccagcactttgggagtccagggcgggcaaatcacgagatcaagatattgagaccatcctggcgtggtggcaggcgtgtgtaatcccagctacttgggaggctgaggcaggagaatcacttgaacccaggaggtagaggttgcagtgagcccagatcatgccactgcactccagcctgggagatggagcaagactctgtctcaaaaaaataaataaaaaacaaaagaaacaatatttatatgatctaaagtatctcccccaaaagctacttgttaattacaaagtgtaaaatagtaactttttaatagagaacactggcagacagcaccttaaccaatgatcatagttaacaccattggttactggggcaaattaacactgtgcctcctaatgaggcactgaggacacaacctggcttctgttgtatttctcctgccaaaaacacagaacccaaatctaatcacaaaaaaaaaaaaatagggcaaactcaaattaaaaaatattcgacagaaccatcagtttacaacaggggtgtccaatcttctggcttccctgggccacattggaaggattgtcttgggccacacataaaatacactaatactaacaatagctgatgagcaaaaaaaagaaaagaaaagaaaaatcgcaaaaaagtatcatgttttaagaaagtttgcgaatttgtgttgggccacattcaaagccatcctgggctgcatgcgacccatgggccgtggattgggcaagtttggttttcactctttaaaaatgtcaaggttatgaaagcaaagacagactgaggaacaattacaatgaaaagagactaaaaagattacgactaaagacaatgtatgattctaggttggattctggaccagaaaatagggcactagtaggaaaattggcaatatttgatcaatagatcaatatttgcaatattggcaatgtctggtcgatagattacagtattggtcaatatgttaaattctctgactttggtaattatattgtggatatgtaagataacgtccttgtttttaagtaatatatactgaagtacttacaggtaaagaaacaatgactgcaacttactctcgagcagagcagaaaagacaccacaaaaagtgaaaaagcaagtgtggtgaaatgttaacatttggtgaatctgggtgaaggatatataaaatttcttcacacaatttttgcaacttttttgtaaatctgaaattatttcaaaatgaaaatttctttaaaagtccacttcaggttctttattatttttcttatgtcactgaaaagggttgactagtgtctccccaaaattgatgtccacctagaacctcagaatgtaatcttatttggaaatagggtctttgcagatgtactttgttaagatgaggacatactgggttagggcaggccctggtatccttagaagacatacacatacagagaaaaaggccatgtgaagatggaggcagagacaagtgatgcagctacaggccaaagaaaaccaaggattgccgggaaccaccagaaactacaaagaaacaagggtggacttagagaaagcatggccctgctgtcatctggatttcagacttctagattccagaaatgtgaaggagtaattatttgttgttttaagctaccaagtttgtggtaatttgtgacagcagccctaggaaaccctaggaattacagtcacccacttttaaaacaatggcgctctggtctacaagacgccatagtctggcatcctcaagtgtctgaagatgctaataatgataacgtttattggacatttacacacctaacactgtgttaagtgtattatatacattatttcctttaaccttcatatctgaatacactaggcttaattactaactcattacagaagggaacatggaagcttagagtggttaagtaagatgtgtaagattgcacagctaatagaggatgtcagcattgaacaccatctcttgggcctcttcctctttgtctttctttttttcttttaccctgaaacagggtcttgctgctgttgcccaggttggaatgcagtggaacaatcatagcatactacagtcttgaactcccgggctcaagcgatcctcctgtatcagcctcccaagtagttgggtctacaggtgcaccactatgccaggcttcctctttgtcctttaaaaccttctcccatccaaagtgcagcccacattccctgtcctctaaaaattttccagggccttctaggccacagtggtccatctttcttctttaaacttggcactcattgtactgttgcttggctctaaaatatactgaggattattctggatgtcatttggctttttaaaacattgtctttgcctccaactgaatattaattacatgcaggtatgtgccacgtatctaagcattgagacttcacctacccttatttctctaggtagaaacctatcattatagtcctcatcagattatatgcaagtagatgcttgacatttgcaatttgactgttttcaaataagttggaagtttatctgagactcttgatttcaattgcgtgtgtaaaagaagtcagctaggggctgagagcccggctaatcaatttaaatgtggctttatttgttcattgttggtctatgttgtattaatttttgttaaatgactaaaatttggtttgaaaggtccatgaaaataacacatctggggcagaaaatcattttgggcaagaaattaaattttgtaatttagggtggaaaactgagcctcacagtgagatttatgtgccgggccctctgtacaaagatatgatgtgtcatgtgctctgttaagtgctctagcagtgtaaaagtcactgaagtgagaaattcgtttgaaaaggtttagctatatggtggttcactactgatttggggcacagaaaacaatctgatttaactgacccaggagcctagtcaaacaatgccacattcacagatttggtgattcacattgtcttggaatattccgtgagatatcaggtgtcaagagccaagtaagtaacatcaatgagcaaaagggcagaattcaagaaaatagcatcagcacactgatacctgccaactgacacctgcacctggcttcagtgttacacaattaacagggggtggagggaatcgtcacgcactgcagcatgcagcctcacccggatggctactggatgctagttaactgtggcctggagtattgtggatctcatgttttttttgttgttgttgttgttgttgttttaagtctcgctctgtagcccaagttgaagtgcaatggcacgatcttggctctatgcaacctccgcctcctgggttcaagtgattctcctgactcagcctcccgagtagctgggattacaggcatgtgccaccacgcccggctttttttttttttttcaacagtcttgctctgt

SEQ ID NO: 3832 - DNA, 918 bp, Homo sapiens
ttctcccggaggcgcatgatgtcctcggccaggttgtcgcgctccacctcgacgcgggctttgtcgttggttagctggtccacctgccggcgcagctcccgcatctcctcctcgtagaggtcccccaggcgcgacttgccttggcccttgagctgctcgagctcggccagcaggatcttattctgctgctccaggaagcgcaccttgtcgatgtagttggcgaagcggtcattcagctcctgcagctccaccttctcgttggtgcgggtgttcttgaactcggtgttgatggcgtcggccagcgagaagtccaccgagtcctgcaggagccgcaccccgggcacgctgctccgcaggcgcacggcagaggagcgcgtggcatacacgccgcccggggacgaggcgtagaggctgcggctggtgctggggcgcagcgcgctgcccaggctgtaggtgcgggtggacgtagtcacgtagctccggctggagctcggccggctcgcggtgcccgggccgccgaacatcctgcggtaggaggacgaggacacggacctggtggacatggctgcggagggtggcgatggcctgggcggcggcggtggcgcggactggctcccggagaagaggcgaacgagggcgcgacagcaaagctccctttggatgacatagatttattacttagtagtatattatgtattggctgtcccacattttgaaatttaatggactcgtggtgatcagaataaaagaagccttcgatgtgaggcccaggcattgagtaccatgtgtgcgattcacaagccttggcatctgaacaattttttggaaggatccatcaggacaacacgtcgggggtgtactagtgaagtgattttccaaatgtgctactcagacctgtagcatcagcatcaccggata

SEQ ID NO: 3833 - DNA, 1176 bp, Homo sapiens
gcctccggctcctcatcggatctctcctcttcgctctgggcctccggcgtgggaggccggcggggcaggatctcggcttgcagctccagagtaccgtgggcagccagcagttcatagagccgctggatttcggagggcgggggcatccagggctgcccatccgcaggcagctccacctcctcgtcgctgcagggcacgcaccagtcctcggagtcctcctcggcaggctcttctcccccagcgctggggacttctccctgcgcctcctcgcccccggacccctcacgctcggtctcctctcggcctccttccccctcgtcctcggccttaccggccgaggcagaggggcctccggtatcctccacggccagagcctggaggccggaggtcacttccccttcttcagacagaggcgccgccgtactggccgcagtgtctccatggccccgagcaagggacataggccactagggcagggaccctgcgacgacagatactggagtccgaagccagggtcccccagggatcgggctcccctgggggttcgggaccgtttccagccaatcacgctcccgcaggggactccgcggccagaccgcccgtccccgggagggggcgctcagtccccaccaaggaccccgccccggagatcgaggttcggtactccgaggctcccgggccccgcagaaaccactttccgaaagagggaaagggggaggagagggacgggccactcttctcgcttccacgacgcccctctccacacccggacacggcgccttctccccagacctttcagttgtgggccacgtcaagtcagatgccgtacgcacctggagctaagacccgcctcccaggctgcgcagggtcacgctacgcaggcgcacagaaatggcgcgggaggctccgctctaggcaaggctacttggaagaggaaagcgagggaaggcttgcacatgcgcgagtaagcgcacaggcttcagcccacagtaaagatggccaccgggaagtcgcatgcgtataccacccagtaaggttctgccagaaaggcagcaccgccgggccggcgggacgaacgcaggaaccaaccgagattggaggcgagtctcatgcagtctccgtttattggtgtttcagactccgcctaagttgatgacgcaggaggcgatgatgatg

SEQ ID NO: 3834 - DNA, 268 bp, Homo sapiens
ggttcgtgctgaaggcctgtatcctaggctacacactgaggactctgttcctcccctttccgcctaggggaaagtccccggacctcgggcagagagtgccacgtgcatacgcacgtagacattccccgcttcccactccaaagtccgccaagaagcgtatcccgctgagcggcgtggcgcgggggcgtcatccgtcagctccctctagttacgcaggcagtgcgtgtccgcgcaccaaccacacggggctcattctcagcgcggctgt

SEQ ID NO: 3835 - DNA, 2289 bp, Homo sapiens
agaaagggcggggtggaggagggggaagggcgggggtgatgccgcgcggtcgcaggcttgggatggtgttcgcgcctccgagacccggacagaggcaagcaggggcgccgtgggtgccagagaggcggaagaggaggcctgatggggtcagcacagtgtttccggagccccacgtatcaacagcccagtgccgggagcgccaggggctccaaggaaactatcagacccattccctgtccccaggaagcttaccatccagcggcacagagaaggctcaccatggactccattcaagaacgaggcaggataggatgtgaataagtgcaaggtgtgagtgactgacagtaagtgcaagggggttcagagaagtggcagctccaagcctgcttctgctgaagctggagggcttatctgtcaagaacccccaactcaggaagctctgctccaagtgagctgagtaaggagagtctgcctccaagttgttcctctgcaggtgactgtgctccatgctaaatcattccttgcacgggcagaagctgtttggcattgcaccagtgtctgattttgtttgaatatggtgcctttggcttaatcagtcagacatgcattcaacaactatttatttatttatttatttatttatttatttattattttgagacagagtctcgctctgtcgccaggcggaggttgcagtgagccgagattgagccactgcactccagcctggcaacagagtgagactgtctcaaaaagtaaataaatagaaactcttggttccatgcgtagtctagcattttgtagcacttctaatcacgaagttatttttaatatttgtttggtctgttatacaaaatgtagactggatggcttataaactacagaaatctctcacagttctgtaggctagaaagtctaagatgaagatgccagcagcctgcttcctggttcatacaaggtcatcttctcactgtaacctcacagtgagaggaagggcctaggggtgactctgggatctcttttatgaggcactaatcccattaatgggggccccccaccctcatggcctaatcacctcccaaaggccccacgattgccttgggtgttaggatttccacatatgaattttaggggaacacagacgttcaggccatagcaaatatcttgcccaaatatctctagttccatccttttggtcactctcagaccagaacatttactgagtgattactatgtcccacaaaattcttatttaaccctcagaaaaaccgtctgggggaagcattgttatcactcctatttcatgagcagttatgtaacttgccccagataagacttggttatggcacagattctgtgttggagccttcagaccactctacttcccaagcaggggaggaacagaacattaaagattttcttggccttggctttcatttcttcatcgtggttctgaaaggaaaattggctacagtcttaaatgtatgtgtgggcccacgctagaagctcagctctcagtgccagccacactgagccctggtctccctaacttccgggcctttactctgcttgtcattgggctgataaccaagatccagcctagagcacaagaagacaaacgctgcgtgatctcgtgtgtagaacctaacaaagtggaactcacagaagcagagagtagaatggtggttgcctgttggaatggggagatggtcagagaatgcaaactttcagttggatgggaggaagaagttccagagatctattgtgccacatggtgacaatagttaataacaatgtactgggcggggggtggtggcctacgcctgtaatcccagcactttgggaagctgaggcagacagatcacttgaggtcaggagttctagaccagcttgtccaacatggtgaaaccccgtctctactataaaactacaaaattagccaggtgtggtggtgtgcgcctgtaatctcagctacttgggaggctgaatcgcttgaacccaggaggtggaggttgcagtgagtcgagactgcgccactgccctccagcctgggtgacacagtgagactctgtttcaaaaaaacaaaaaaagcaatgtactgtatacttgaaaattgctcacagagattttaaatgttctcaccattacaaaatgataaatatgtgacataatgcatatgttaattagcccgatttagtgattccacagtgtatacatataacaaaacatgttgtacaccataaatgtatactatttttatttgccaattaaatatatttttttaaagtt

SEQ ID NO: 3836 - DNA, 7668 bp, Homo sapiens
gcgacgtcagaggcgcgggtgttcgcctacgtcactggggcgctacggtgcctggagctgggcggtcttctcgtcagagtggggactggtgagagcgacctccccgccaggtcctgtgtgttgccggctgaagaagggtagctgaaaaattcagacccagcacagtgtttatgttggtcaaaaatagaaaactatggcgcggccgaggcgggaggacccttcaggccaagagcagcctagcaacatggcgcaaccccatctctgtagtcctacctcagccccccagctacttgaacccaaagattcaaggctccagtgagctatgatcccaccacagcattccagcctgcgagattgagatgatgattattccccaccttctaagagacaaagaccaacgagccaccacagccaccagtcccagaacccgccaatgctggggaacggaaaatgagggagttcaactctggccctcacaatccagtggaggagacgaaactcatctgcctctgtccctctgggcacgcctcatgccaggtgcatctgtggacaggggccacgctcctgggcttccaaagttggagaaagctgccaggctcaggtctgaaggccagaattctacagtaagtcctactgagtcaaggtgggagcagggtcggtggcttccgaggctctgcgggagaatccgtttcctggcggtagaggtggcctgcactcctcagcttgtgctgcccgtctcgaatgactggagtttcctgcttctgtcactacacctcccaccctctcccatcacctgctctgctcttacaaggatccgagtggagtcttgctctgtcatccaggctagcagtggcgtgatcttggctcgctgcaatgtctgcctcctgggttcagatgattctcctgcctcagcctcctgagtagctgggactgcaggcgcccgccaccatgccctgctgttttgtatttttgagaaatggaataatcgtatcgctgatctatgtaaacaaattgaagaattgtctgaaagaaaatatgacatgaacttatgaattcaacaggtgaagatttacaacttgataaatcagctttgtgagctcgagctgtaaaagccaaaggtccggtgatgatcccatacccttttttccagtctcatgttgaagatttttatgtagaaggccttcccaaaggaattttttttttttttttgagatggagttttcactcttatcgcccaggctggggggcaatggcgcaaccttgctggtcactgcaacctctgcctcctgggttcaagaaattctcctgccttagcctcccaagtcactgggattacaggtgcccaccaccacacgaggctaatttttgtatttttagtggagatggggtttcaccatgttggccgggccagtctcgaactcctgacgtcaagtgatcttcccgcctcgactcctgacatcaagtgatctttccgcctcggcctcccagagtgctgagattacagacgtgaacccatgcctggccaggaattttgtttttcaggaaggctttctactaatggaattcctggccttgagaggatgttactttcgaaggaaaggatttttttgttattaaaagagccacctaagctgaagattcccttgagaacaagtactgtcctgcggtttcatggcccttcttccatttgtggttcttgcgaagtggaatttaaatgacatcttatcaagatggataaaccctagtttcccagtgctggaatatagaaaatggatggacaagtaaatcccactcagcacccatagtccaggcatggggacctcaacacacctgagccccagacatcacctttcattctggacctaccatgaaagacttctgaatccaggaagagaaactgactgggcaacatgttattcagaaacaggaccttgccctgtcactcaggatggagttcagtggtcctatcatggctcattatagcctcaaactcccaggctcaagcaatcctaccatgtcagccttcccagtagctgggactacaggctggagtacagtggcacaacctctgctcactgcagcctccacctgccaggctcaagcaattctcctgcctcagcctcccgagtagctgggattacaggaagtgaccgcacaatgactcaagctaccacatactgttgattgtgaaatgccagttgaagcatatgtcctgcgagcttaggggtgctacaagttgaccactgcagcagtaaagatgactctgaagaatggcgtgggatggatcctttcgaatgcatttgagcagcggtctccaaccacagggccacagagctggagctggatctaccatgaaagacttctgaatccaggaagagagactgactgggcaacatgttattcaggaacaaaaagatttggactgtaacttaaaaatgatcaaataatagtgcatgcatcaagtgcaatgggaagctcttctggagagtgagagaagcttccagttaaggagatggggtctcaccctgtcacccaggcttgagtacagtagtgctatcacagctcactgcagccttgaactcctgggctaaggatcctcctacctgagcctcctgagtagctaggactggtctccctctgttgtccaaggctggagtgtagtagtgctatcacagctgactgcagcctcaaccttccaggctgaagcgatcctcccatctcaacctcccacgtggctgagactacaggtgcttgccactatgcccaactaatatttggaatttttgtatacgtggattccagaggggtgacagcgaaacgtgggaccatccagttgcaggaaaacaagcttaacacgcccactgattctacattatgctcctacctcctggcagcctctccaggcccagaactttctccagtcagcctctacagaccaagctcatgactcacaatggcctatttaggcccataccctacgtcacggcagtctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcggcctctacagtcccaacatctgtctcacagcagattcttcaggcccagcatctgcctcactgtggaccccccaagccaagctcccaacctttcagcagcttctacacacccagctcctgccacccagtggcttctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttggcctctccaggcccagctcctgcctcctgtcagcgtctagaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccagtatcttataaactaatctcagaagtggcatctcatttcttttgttctattctattcaatagaaacaagtacctgggaccagcttacactataggaaagagattatataagggtataaataccaagaggtagagatcatcaagagccattctggtagcagccacaatatcttatccagaatatttcttattcaggccttcaaatgtgctgtcttttctggtctaatggaaatgaaccttccttccatacaatttcttctcctaaattgtactctggctctcttatcatatacaaacgtctatgttaggtatttgtgtctgtcttgattcttggtaggcttttaaactctgtgaatgttggaatattcatattattttcttgttatatccttagccttactagacctttgtggtttctatggatgagggacataatatttattaatttattctaaacttcagtcactcatagagtgtgtaaagaaggcttgatggccaggaagcttttacagggaagtgacattggaactgagaccaaatacttaaagaaggcagttctttgaagagttgatgggaaagtattccaagaagtgggaatggcaacacagattatgcttcatacttgtcttcctgagtcttctttatccagaacaccctgagtttttgaatggttgacatgccagctggctttctgcagatgtacttctcgcgtgtaaatttccttctctgtgaggtattcatattgaacatgacctccaagtgtgtttgggtctgtgcagaagacaataggactgtgatttctgatgattaaaacctggatgaatgtgtccttctatccatgacctcagttcctgttggggagcctcggtgccaatccctcggtgcatcaccatttctaattagttcctgttttagtctgcttttgcgtgtgtgtgtatgtgtgtgtgtgtgtgtgtgtgtgttgttataaaggagaggtggatgttgcagtgagccaagatcgcaccactacattccaacctgggcagcaagagtgaaactatgttgtccaggctggttgcgaactcctggtctcaagtgatcctgccaccttggcatcctatgcaggtctactgtccaaagtacagaggttattcctagtgtctttaatattactgtccctttaggcaagattatccttatgataagggagagtgaattaagctattttggctgaggcatatttttataaattcatccaattagcttcccttgttgtagttttggctcaccaaacattgttctcattataatttagcatcccatataatttcatctgcagggagagtctgtactaggcatggcgatgcttacatgtcagcctgtgtgactgcaagagtctcagtacaatttgataacatggcactcagattctagacattattctctgtgtgcttagtgagtgtgatgacataaccttcagaaagattcatcctttctcacatattgataaatcaacttttacatctacaaagttgagagccagaaattaaaaccttattaattcactaaggcatccctatgacggcagtcttccaactagctccattctggggcactctgacatcattatacactttccacagattttcattttagaaagttactctgacatccatgtggaaaatgaacttgaaggtcacaaggctgatggagccaggaagaccatttgggaggtgattgtagtaatctacttacgagttcattacgagctggggaatggggaggtgttagagaagagaaaatggatttgaagagctgagggatgttaaaaaggcaaaactgggccagggatggcggctcacacctgtaatcccagcgtgatcttggctcactgccagctccacctcccaggttcacgccattctcctgcttcagcctccccttactcttttagatactttttacatttttcagctgataatttaattcctacacttttattaataaatgtgttaaggctatagattttcctctgatcactgctttaactatatcccatatacaggggtaggacccatgggagacagacgtgtttcttctttgtggtcgactgcagcttgttggaggtgtggataaagcactggggtctttgctcctttgttactctgggagcctctccctagggaaagtctgggccactgccagtaggtaagctcagctgtgggtggggcaactgatctgcagttatgagctgggtgctgtgcctggtggagtgggtggtgggggttcccaggggagggggctggattcctctctgtatggtggctgtggtgtgctgaaggtgccactgtagtgactaggcaatccttctgccttggcctcccaaagtgctggaattatagtcatgagccaccacacccagcccctaagtggacatttaatccatgtacattcaaggttattattgtctatatttgatataatcaaatacttggtcatttttaaattattttaatagtttcaaatatatgtaaaagcattcctatttctccacatcctctccagcatctattgtttcctgactttttaatgattgccattctaactggtgtgagatggcatctcattgtggttttgatttgcatttcttgttttagaagttccctatgtgttagaagtactagtctattatgtgagttacaagtagtttcttctcacttttaaattttctcatagttttattacgcattaaaaattaatttgatagtcaatgttatccatctttaccatattcatagattataaaaacattaacttgttttcttttaatatttgcatagaaagccaattccccatgtgacagccataatgccgacacatgcgttgccacacataatgagaaatatctgaacaaggcagcccttgaaagagatgactttgcgctggctgaaaaagtcagtaatcatcttgggggctgtgactgaagacagagacagatcaatgagtgagaggttggctagcaggaagtacatgggagagtgaaggtgggagtcagataccactgttatgacaataagaaggtttccaaacacgattcctccatagaatacaaaaaacaacataaataggaaggtctggagttcctgagaatcagagagacccagaaaaatgaattcagtcaccatagagttattcgtttcactcgttgattcattccaggaaatagcctctgcagttaccttgaagaagagaaggagaaggaagtcagaattattatattcaaattcaaagcctcattttatatcattctgctcactcttacagtgactttctataatctattacttaaagacattcagaattcaacaagatcataattctatctcgcactacttccctggctatgccttataattcagttatctcggcttctcagtgtctccattaatgttaggtttattcctaatataaaataccattatttatgcttgtctctctgccagattaagtctatgccataactctatgtttatctcctttttctttgaactacaaaacagtttgtagcacacatgttatttggtgatattaaagttcttaagagaaaaaaataggccaaaatgaaatgaaagataaaaaatagaaaaaaagaaaaaataatatcacaaatataatacttaaaaattaacagaggataaaagaatagggaattcaaaagtgaagtgagaaaaagtgaggaaaatgcaataaagtttaaatgagagaaagtgtgaaggactttcataggagataaaactggtaagagattttggaatgctttctaaagcatttctgttttattatagagacaagaa

SEQ ID NO: 3837 - DNA, 3590 bp, Homo sapiens
aatgacacagtctactgttttgaagagtgctgtgtatgactgactgagctaaaaggattgctggctatgagtgagttttagttttagaattcattttcaaagactcacaaggctcaagaagcttgaaaaccacagatgatgtatacagtagctggagttccctggaggctcctttctagggtctctcatttgaattggtgcagaactgaaagcagagagtcagaaagtaactctgcttgtaaaaatggcttaggaaaaggaacttaagattgtgggttatatgtgtgtatgtgtgcacacacatgtatgtttcctgaattctaacctgaaaatatcacatttgtggatacttaaaatactcatatgcattttgatacacaaaagcaattcaaagtatgtaaaaggaggctggaaatgtaagcttaacagtgatattctggagaaaaatgttgtaactgtcactccaggcctcccttaggagaaaccaaacttgtcagatattttggaatggtagctctttttcaggaattagaataactgaagtatgatactgtgttccgtgtgctttaaaatctgtgaccctcccctgttgctggtcatagcttcagcatttgagtgtccattgtctgtcgctgaggacattttctcatcggctcttttccccattgtcccattcctctcactcacacctgattaccaaatagctctaacgaaatcacagtcactccttcctgtgtttccaccattgtgtacatcttcatttgcacaccctattttttaatcaaagttaaagcctcaccaacaaggtacttagaacaatcacccacttctggccacttcgtgacgggaaatacatctttgcaggggaaggagctggatcagactgacagggtttcactcagactatttcaaacaatgaggagccttgacctcattcccaacttttgccgtccatagtggttgatttcttgttttctctttctctctttttttaacagaaactcttaagctcaaggctaaattacagtggggacttgcctttgtctacagtccatggtttctgtattggctcaagccttgaaatcttgaaacaagcctaaattaaaattttctcttagcttaagaaaaaaagttacatattgtcaagacccttatgtgtgtggtccattaaaaaggtcttgatattagaagataacagcaaattgtttcttatcccacaacagctttgcctttcagtgtcctttgtggtggttttcgtaggtcagtggtacaattcaacactcttccaataagccataataataattgttggcacaactgttattacaacaggacttgcctgggttccatctattaatttttacagacagtaggaagctcacaccgaggagacattggtaacttcctggacaagggcaaagaaaggaactagcatattgtacatactgtgtacgtgcacagaacactggtctgtgcctttggagtgttctcagaggggcaggccagaagggaggattcaggtaggaaatgaatctaggacttctcttgcctttgatggttactgatggcaattgtgtttcccactgaataacttggtggacaattttgatagtaaactgaactcataccgagcaagcacaatagtcaatccataaagaaaagggtggcatatcataatgccagaaaccttgtctccctaagaggtgatcatgaatttcctatacagggcaaaaaagggaagaatagcctattcatattctgtattcacagtttgaaggacccatcacaaatgaccttcaaagactgacagggggcaggtagaagggaggcaaaaatgcagagaaaaagatgttaccttgaaaaatgaagtaagaaatcctaatattcccgtagttgatcctaaagtttgttcccatgtctacggttatttctaaataacttcactacactttgaaattccttagtggtggtttatcagtaatacttaactgaatttttccgtttctattctttgctgccaatgaatgtaatctccacgacttgccgttcgagtgcacgcacagacacacacacataatggtatatgcatcatatattactcattttgtgggaaacacaatgtattataatgaaaaagattccagcacattctttcagtgtgtttcagtgataaaattttgtgggggaatagaggtatacatactctctttgctgaccatattgttgaaattatgatcttaagcaacactgttagaaatgcttgcataaagtatcttctctagtattaatgagttgattcactctgaattgaaggttcaaaaaaatgcactaaacaaatatttttatatctgtggtattttcctattaactactcttagtgaacacgtgaccatatacctgatatcattaaaaaggaaaatggcctaaacgaaacgttaaaagtggaggtatttataaagtcttctgccaaagaccattgtttaatgatctgtaaaatgtagattatcttcttttattatgaatgtgattgtaagaaacaccctaacattctctaacttttgaaaatgaatattttgtatttctaaggaccaaggaaaatattttttaagccaatgtagtacacagaagccttgtaaatgagaggtacaatgacttggatcaactgcataatgctagattagaattccagcatttgatgataaatttatcaatctttcctataattcttatactgcactaaattacattttggaaattttagctaatcttttcaaattaaaggcaccaacattaatgacagatcttctctaatatgaaaagcatcaaaacattccctttcaagcactttgaatggatgaaaattgccatataattttcccacctacctaaccattccatgtaagttaactgagcagtctaacaatgttgtacagaaggttgacagactatgtgcaccaagaatatttaagttgtgcagttagcaagaactagccatttcaaatatactcaaatgttttgtaaataaaaattttgactcctataattttgttcaaactgatgtcttttaaaataattagattttatttgaattttaaaagtaatctgttgtaaattagatgttactttgttgactctgtgattcaatgtacactcagccatattcctgtggggaaatatcaatcttactgactttcatggcatgagccagagattcatagtttcctttaggactataagtatgaagacaaaacacaccaaaataaaatgctagtgaagaaattagaaacctattgtataaaatgtatttttaaaatcttaagatatatgtgatttacactgcctgttaatctagtctctttgtgattaaaaaaaaacataatatttgttaagactcagacaccaaatatttgtgatgtttgtatagcaccatcgttatatgtgatttcaaagggtaagcatctctgtcgtaatcatgtaagcccacagaagaataaattcctgaggttatgtacaaccaactctcagaattcagacttcctgcagctgccatatcaccaataaatgagaattgtgaaaaacaatttttaaag

SEQ ID NO: 3838 - DNA, 2332 bp, Homo sapiens
gaccacaccggccagtgtggggaagggcaggaacccctgctgctttttaagcccctgcgggcgtttgtgatgcaatagggagttagaaaagtactcaatagtgagtgtcgttattcggtttgtcaaaaattaaaggtggggaggacaaaaatcaggagagattgattgcatctacttttctacggaaatgtctaactccgcttccaaaaaaagccgtaattatttttgtgcttcaaatatacgtttatgtttatatctttcaacataattttgtaaaacaaatgttaagttttactgaatgttgtcactgaacaaacttgtgatgagcaggtattttagagtcttggggtcttaaaagaaaatcataggactcagactgccccagagttatgcaatctaagagtatattaaccacttttaagtattatatgtttttctcttttttgagcttttgtcgatttgacacgttcatttcatttgaatgttggttctgaaaatgaagcatgtagttacttttccgttaacatacataacagcattttaaagtacctaaattccttttggaaggccgaggcggacggatcacctgaggtcagaagttccagaccagcctgaccaacatggtgaaacccgtttctactaaaaatacaaaacctagccccgggcgtggtggcacgcgcctgtaatcccagctactcaagagcctgatgcaggagaatcgcttgaaaccgggaggcggaggttgcagtgagctgagatcgcgccactgcactcagcctgggccaaagagtgagactccgtatcaaaaaataataataaagtacctggccgggcgcggtggctcacgcttgttatcccagcactttgggaggccgagacgggcagatcacgaggtcaggagatcgagaccatggtgaatggcgtgaacccgggaggcggagcttgcagtgagctaagatcgcgccactgcactccagcctgggcgacagagcgagactccgtctcaaaaataaataaataaagtacctacattcctaaaagcagtgcttaattctgcagcacatatactaaaattagaataatataaagattagcatggccccttcccaaggataacacgcaaattcgtgaagcgttccgtatttttaaatatatacacctactatgtaaccaaaaaaattaaaaataaacatataaattcctgaaagctatgccagtccaatccagataattcttttaatttttaatttttattttttgtgagtacatggtatatatatttatggggtacatgagattttgatacaggcatacaataagtaataatcacatcagggtacatggagtatccatcacctcaaatatttatcctttctttgtgctacaaacaatctaattatacttagttattttaaaatgttcaatgaattatcgttgactagtcactctcgtgctgtcaaatactagatctaattctgtctatacttttgtacctattaaccatccccactctgccccttaattccccactaccctgcccagccttgtaaccatcattctattctctgttagttccgttgttttaatttttagctcccacaaataagtgagaacatgcagagtttgtcattctgtacctggcctatttcacttaaagtagtgacatcagttgcatccattttgttgaaaataacaggatctcattcatttttatggctgaatgctactacgttgtgtacataaaccacattttctttatttgtctattgatggacacttaggttgtttccaaatcttggctgttgtgaacagtgctgcaataaacatgggagtgcaagtatatcttaggatatactgatttcctttctttggggtatatacctatcagtggcattgctggatcatgtggtagctctatttttagctttttgaggaatatccaaactattctccgtagtggctgtactaatttacattcccaccaacagtgtacaagggttctcttttctccacatcctcatcagcatttgttattgcctgtcttttggatataggccattttaattatgatgaaatgatatctcattgtagttttgatttgcatttctctgatgatgagtgatgttgagcaccttttcatatacttatttgtcatttgtatgccttcttttggtaaatgtctattcacatcttttgcccattttaaattttttttttttttgagagataggttcttgctctgtcatccaggctggaatgcagtggtttgatctagctcactgaagcttcgaactcctgggctcaagtaatccccccacttcagcctcctgag

SEQ ID NO: 3839 - DNA, 1704 bp, Homo sapiens
cacccaggaaatcttattccctttattctcttcaactaagcaacatgaccaccagtgacacaacactgttttggacacacaacactcaaaaatggggcctctcttcactccatggggacaagtccggtgactggggcttccctagtgagggcaaaggagtctgggagctgctgacctcagggcaggtcatggaaccccacctcttggctgtgatggcttcaagtttccccaccattcaggattcatgcccagttccaagttcccatctgacctccatgtccatagcagtttcaagtttcactctaagctctcccctctgctttccccactgactccctgaccctatctgttgggctcctccctccaccagggcgtttctgaggggcctggggcctgcatgtgattggacaagagggtttggctgcacagtgccttccagactcagttgtggtgagcaaatgctttgacccctgggccttcatctgagccgatctgagcaactctagccactgccacctccctgcttcaatcctcccaagacgtagctcactctgggagggaagctcctggttaaaggagcttggggaggtgggcaagagagaacacgccacaccccagaggtatcgaaccctgcccctttcctaccgcaagacgcctgaccctacgaactgtgcgctcacatcatccatcccgtacaagagccaagccccttagccctcacccatccctacaacatgtgagcatcctactaaatatgctacaccctagtccgaaacaggcctgcgccggccttcagtcacactgcctgcctccccccagactggcctctgagccccaaaagctgctccccaggcctcttctgggaacagattccttaggcctgtttttgagagcatctgcttctggctttgcgagaggtttgtctttacaacttcagtttctgctaccatcttggggagggggacatctccttagacttggcagacttctcattcttacagggcacccccttcgttggcgttctgttaggaagagacccacaggcagcacccccctcagtagtgcttcccttcctggcacttggataggctggggcgttatgcagatggcaacatggttctccgcacaatcctgaggcctgccttctccctctccccagcaggcctggcgttttcctcccacaatgtttgagattttgatccttttaaatgtgagggtcatcctgctggggccaggatagacaaatggcgaaggatttgcataaaggttgtgtgaaactttaggtcatggaattagaggtctcttccacagctttgcaaaaatctgggtcacccctctcttgagacgtgactcctgacgggccccacagctggcatctcagtcctcttactccaggacagcgcattactggggttggcaagcacttcctttctgacccagcgctgagcagagtcctctccttttgaaggggtctccaggattagggagtgggagtcttgttacagatgtttcattcaagagttttctgtcttccaccatctcatagggcaacagtctctccccagccacatatgcccaggcctgtgagcaggcttggctgtttatgaatgtgtaactgtgtggtgtgggaggtgagatgggcctggcaagggaggctttctcatccttctgtttccttctgaaggtttctggctaaggaggaga

SEQ ID NO: 3840 - DNA, 2056 bp, Homo sapiens
cctgatgttgaaggttcaagatcaatggaaattacttggattaagatggctgactgggttcctctggcaggaaaaaatatcaagtacccctaaagaaaatccaccaaaagggaagttagagggagtgatctgtcaaccgtaatttggaatcatcactcactgacactgggcaagcatgatttcagcaaagttggcaagactcagctatcctggtagaatagtcatgctttgggaaaagcagctaaccatatgatggaaaacctaatccccaggcccagctcctcaccccattttacctttggttcccatgggtgtggggcaatctttaggcacagagggcagaatacgagtgtaatagctcacgttggagaaagactcccagctgatgtagtcatgtgctgagttgtaggtggggggactggggataaggttggagcgcactgcagagagcaaaaataacggtgacaagggtgtttccacccccagctccatcccagttcttgcctcctcctgggttggggcttattttatcaggcatcatagactctccccacccactacccttatcagatgccaagaatccaaaaggactagcaggcttgcttgctcccccaggtcagggggccctgccccacacccacctgtgagtaccaggcgcatgagcatctctcggatgaaggtggcattgacaaactcccagaaccagcgcccgtgagtgagcaggaagtgggtgaaagaggggctgggccgcagtgaattccggagccaggtccacaggccagctgcaggggcaatggcagtcactcagttggtccctcctaccagaaccagaagtagccagggtggaagatggggcactgaggacaagggccagggtggaacagagtagcacctatggggaagtgggtaaggatggaaccttgggagcaatgacacatgacagagacagaaccgggcgtgaggacaggggccagggcatgtggtgaagactcaccatggaactcagaagcagggagtgagggtggaccaagagcgagagctcatgctgaagccaggtcagggagaggggcagaaccaggcaaggaaggagaacagggccatggtcagagaggagggtaggaagttagggtctaggagaaagggcccggggagcagaagggctcaagacggaaggagtgagggctgaaggcccagctcacggatggtgcagttggggccggaatagcccgtgcgggtgcagtcacactggtagcggtcaaggccgaagcggacacagatgccctggtgctggcatggatagtaacaacagggattcactgtgggtgagaaatggaggtcagagaccatgctagggtggcctcctgacccccatctagcccctgatgggggaatgaggggccagaggcatggacttaagtcgcagctccgtcctgaatcactgggtgccagggcttcagggttcccccaaggggacccctgttcccacctctgtgaacataaaccacccatcctgacatttccaggccctgctctggaactccagcctagcccacatcaggcccccaggggaagcgccccctccctccctattgccaccaaacggcggcaggagaagattccccggctgtgacactgaaagttaagaaagagctgataaaactcctcagccacgggcttctagagcgttcacttcctgcctagtcagagttcagtagcaagagcaggccggggcggggggtgggggggcggtcagaaaagggacgaggacgaggacggggacttctcccagaccaccaccccatgaacactaggaaaacgagatccctcaccattcctccatttctgcagaaggtagagaagagcaggtatcataatgtccacattgcagatggggaaattgaagccagaaaaagggaaagccagacctatcaccccacaagtctcaccagaccaaatgcccatcccttcacttccactccacccccacagcctcagcagccaagtctaaggaaagaagttttccagaaccctggggacagagggtgggtgtgcagga

SEQ ID NO: 3841 - DNA, 3738 bp, Homo sapiens
agaccaggcctcgcggccccggccggcgtgagccgtacaaaatctacgtcacttggggtagaaaaacaaaaacaccgaaaagcccacgccggccgctctgaccggccgacacgctcacttgcggcccttgggcactttggggacgctgggcttggccgccttcttcaccttcttgcccccggcggccgccgtcttcttggccttgccgcctttgtccttcttggcgccagcgcccttcttgtgcgagcgctgctccggcttctggcccctggcgggcttcttgtccgcgcgccgggagccggccgcgcccggggctgccttcttcgctttgtgcgcggtgggggccggggcggtggcggccgccggggctccgcgccgctccccgccgccctccagcttcttgcggttgagcttgaaggaaccgttggcgccggtgcccttcacctgcagaagcgtgtcgttctgcaccagcgccttgatcgagtacttgagatggggacaacgccgccgagccgccagccttggtcaccttcttggccattccctcggcggtcgtcactggcagggcctcctcgagctccacggacatggtagcaagaggattggtggcgggcggcgcgcggaagccggggggccgcgccgggaagaggaaggcgaggggccgagggggtgcaggggggctgggggcgcgcggcggctccaggcgggagcggccgcggccgggcctggggccgggcggcagggctggggtgggggccgggccgggccggagcgagggttggggggcccggagccggggccggactaggggaccgagttgggggtcagagaccgagtccgagccggcggctggagctggggacgtagacctaggccgagccggagcgaagagaaatcccgccgaacgcgagacaccgccgccgcagcttccactggcgcctctggaactcgctgggcgtgcgcgctgcgctctggcgggagggcgcttctctcggctttttatagcttcatggcggaccacgttgagaacaacaacagcctggtccggggccagcgccaacttgtgcttcttggagccccttctccggccgctggcttctcggaccgcgcctctccagcgccgccgcgcccgcagcggggcgccccggacagggcctgagctcccggcgcagtggagaggcgacttgcgtcctggaagggctcagcaaaggcgaacggagaggtgcaccctaggctgcgggagcgcgagaggaggggggcacctcgtttggaggccaatagcgcgggccccagaggaggccccacggccgggagcttggcggccggcaacccagagaacgccacgggcacccgagccttgtcccggcccggggggctccaggcctgcccgcaagaggagctttaatttgtccaaactaacacagggcgcgccctcacgtggtcggctggggcaacgtgaactgcgctaggacatcctcgggggttttccgccccatccaaaggggatggcggatgggaggcactctccagctgcaccccgggttctggttgtgcctctgggagcctaggcacaacccggggaatggaggactacggcaggacctctctagggacactgcctcgccgctccccccaccctgttgccgctgatgttcccagggcctcattttgtaatccacaagtagctgccgccggtccccccaaagccaaatgggggctccagggtgggacagggtgggcgggggtgaggctgtgacacccagaggaattcctgtgagaggatggggaagggattcgctcttagttcctgggtgcacccctccccctctcccgtgcacagggaaatgatggcgggaacacagcaaaggagaccatgtcctggagagggtcccgggccccaccctccccgggggggcttgtgcaaggctggcggcccgatctctgctgattccagtattgggggtgcagagaaggcacaggacagtttttgttgaagccgttgcagcctccacttggggaagctgaggccagggtaagatgctcgggtaggagaggggatccctttgggggtaggtgatgtagggcacaggagtggggctggggctggggggtggcagggttgcaggcaggagacagtctccagaggcccagcatagaaaagcgatggaggggtgaggggggacaggacgctggcgaattggggttcccagagtgagagacaggaacatttacaggtggacagagtaaaaggccctgaaaagggggtgggttggtgcatttgtggccttgggcccaagcaggcttctctgggtgagggctagcagcacctcccctcttctccagctcacccctttcacacacacacacgccccccattttgtcaccctgtcaagggaataaaccccagagaggaagaaattatgtctaggaggaaacggtgagcctggatgggttttttaggggggaggctggcaggggcatggagccaggaaacagccttcgccccccagagcaccaggtaccctgagaaaagtgagaagagagattgcagcccaggtccctgcagaggaggatgggctcctttcccaggaaggactggctgagtggactgtctccagggcacaggacaacgttgagggcctgaggcctccaccttcttgaagaaggaccatgtgaatttcctgacagagaacggggatgggtttctgaaagcaccacccagctgagcctgccgaaactgcacagctgtttccaggccaggctggctgcatggaggacgtgagaggaacagccagctgtgtgtgctgggcccactgatcagggtgctcaggaccaggagccttctgaggatgtgcagaggggactctggggagaggaacatggtggccacagctggagtgaccgcagtgtacagagatgggatgggagcaggaaacccaaaagagccggccctggaaccaggtggaggggaggcagcccggccatgacccagagcaggacacctgctccacttcaccttttgccatgagtaaaagctccctgaggcctcccaagaagttgatgccctgtgcttcctgtacagctgcggaaccggatggctttccgtggctttgctacagccactcctggaagtgctgcctgactgaatcctcagggcaccccggcaggatggacgtggtgtaccccctactttacagatggggaaactgaggcttgagagctaaagcagcccacccagctcccagagatgaggaggccgactctggcaggagtcactgtcggtgcatgggcatttcttcctgttacagcctgcggccccttccaggccgggaggccttctgcgcaggggcaccctccctgcatggcccgatgacctgcactcctgtttcatctccccgtgtggcacctggggcagcttggagcctaccaaggtctcaacaaggaaccagtaaataccaaaaaaaggacatcacgtcccctacagctaactgcaaatggtgaccatcccagcccttgtttgataacacaagcaaagcaatggcttcttcaaggacaccgagaggaacctcacctctttctaaaacctccaacacagggccaggcgcggtggctcatgcgtgtaatcccagcactttgggaggccgaggcaggtggatcacgaggtcaggagatcgagaccatcctggctaacacggtgaaaccccgtctctactaaaaataaaaaaaattagccgggcg

SEQ ID NO: 3842 - DNA, 8188 bp, Homo sapiens
ctctccgtccatccttcgtctccttctgttcccgctctcctcgctcctttcctgccttggcacttctgttttctcctctccttagcgctcctccatttttcatctacttctttttccgccccaggttgtccactttttttttgttttttgagacggtgtcttgctctttcacccaggccagagtgcagtggggcgatcttggctcactgcaagctccgcctcccgggttcacaccattctcctgcctcagcctcccgagtagctgggactacaggcgcccgccaccgcgcccggctcattttttgtatttttagtagagacggggtttcaccgtgttagccaggatggtctccatctcctgacctcgtgatccgcccacctccgcctcccaaagtgctgggatggcaggcgtgagccaccgcgcccggctgggttgtccacttttatctcctcttttccttgatcgtcctcccctttttttctcctcttccttttccttaagccttcgcctgtcaatcacgtcgaaacacagtatttgaccggagccagtatcttgatctgcctaaagacaagacattcaatcgtgaacagtcgaatattattccttcctcaattatacaaagaagagtaagttaacataccacttcagcctattaatggtaattcattccattacattaatggacagttttggtgctggggtcctagcctgggtaacggacagcagctgctgtgctccaagatcaaaaggtgttcagggcaaactctggtgtttgaaggtcagcagagaaatgactgggctgattcatgatgcttacatcaagaaatattagttgactgatggtcagggcacagagatgaatcagaccccacccagccctgagtaagctcacagtctaggggcaagaataacacccaacagacttaatattggaggtatattggtcgggcgcggtggctcacgcctgtaatcccagcactttgggaggccgaggggggcagatcacctgaggtccggagttggaaaacagcctgaccaacatggcgaaacttcgtccctactaaaagtacaaaaaattagccaggtctggtggcttgcacctgtaatcccagctactcgggaggctgaggcaggcaggagaatcatttgaacctgggaggcggaggttgtagtaagcggagatcgcaccattgcactcaggcctgggcagcaagagcgaaaccctgtctcaaaaaaaaaaaaaaaatttgagctatatgttgaaggcgtgaaggaaaaggaaagctgcctgcccacctatgtggcaaactaggataggctgctaactgcttcctggaaaatcaaccctgaagaaatgagagtgagacaggttccaggaactaacagtagcaacaaaccgaggcttctgcttcagtgaaggctgttgagagctggggatgtgggaaatgggttgctgttgcctggggtggaggagacctggctggaagggcaaggaaaggatgagggacaaaagctgttcagaggtgaagatgatccccctctccccagcacggccttgggatggtcatcgcttggcactgccatgacatcaggagtgacagcccaggcctctagcgccataggacactgggcaaagacagagcagtgcagaagtttaggagtcaggaagaacacatgtagaccagtaagctgcctgtggccatccctccacaacctcctcctgtacagcagggagttgtgcggccctgtgctgtacagagtatcccaggctgaggggccaatgggacagacaccctgcagggcctctcctccctgtgtgagtgccctggccgtctgtgctccagcctgggtgcctttttgtaatttggccagaggcagctacctcagcccggtgcggggactcaacgcctgtaatcccagcactttgggaggccgaggcgggcagatgacttgaggccaggagttcgagaccagcctggccaacatggcaaaaccccgtctctactaaaaatacaaaaaaaaaaaaaaaaattagctgggtgcagtggcgggcacctgtaatcccagctacttaggaggctgaggcatgagaatcgcttgaatccaggaggcagaggttgcagtgagctaaggttgcgccatggcactccagcctgggcaacagagcaagactgtctcaaaaaaaaaaaaaaaaaaactcaaacaaaacaaaacaaaaaacagagggagcaattcccttgtgactggcacgactgtatggaggaggggaggtcttgttgcacaaaatcttggtagcataaagcaacagttttactgtatctcatgattctgatgttcacccttggggcctcatgcctataccaaaggtggcagctgggtgttgaatgtctggcacctcgctgccccctaacgaggcctcccccgcagtgtctcatccttcagcctttgtgtgtggcccctttccccagcaggaggtgatcctgcacttcctacatgacaaccaggggctccaagaggaaagcgaagctgccaggccttctgaagaaggccacttcctcaatattctatgaattaaagcaggcacaagcccaagccagattcaagaggagaggacataagctgtggaggagctgcgcgtgcatgcagggcggggtggactaattggagccctctggggagacttgctgccaccaggagggtacgatagtggctctgctgtgcatgcccttttctttctgcatatccgaggagaaccccgcaaaatacctactcaccctttcaggccagatcaaagtgcccctcatgttaggccagacctcccattgcaagttataaaactcacaactcaatatttctttgcaagaaggagggaattgaattgaaagagggaatgctgaaccattcaggcattgtaaggtggcatcaagaatcgatctcacctcccaccctccatcctgttctctctgcaggcctcacaagcgggaaagatgccaccaacacctgcaggcttagattctaccagcttctccgcttagagaaggtgcttctttcctaatgattccagccaaagacccagggcaggctctcactggcctggcctgggccttgtttctactgcagtcaggcagtaccaaagcaggaccagtctgggattgatacgtgctaagcgaggacagcatgaattggtggcagccagtgccatcttccccaccacatggagagatgagacactggtgaagatgtggagtctcagagcaagggcctgacaacttgtttcagtagttttttcctttagctcgtgacctataccagaacctattccaggtatacaaaccaatactttttttttttcgcttaagtttgagtttggcttctgtagcttacaaccaaaataattctaatttgaccagtaaatgcgttgcacagagggatgcgtcaccagaatagggtcatcatccgatgtgcacagcaagtcaatgcgccaagacaccaggctgcagcagaggaggtttgaatcctagggccactggatgtggagacaagaagaaaccaaatctgcctccctgatgagtttggggctaggattttcaagggttttggagtgggctgaagaatggagattgctggtttgtcaaggagagcaggatgaagccgtgctgattctcatgctgattggttcctttgggcaagggttgggggtcttcaaactggttggcatcacctgttcgactggagttcaggatctgcttgagcacttctttcatatttatttacttatttttgtttttttatttttttccctgagacagagtcttgctctgttgcccaggctggagcacagtggcacaatctcggcttgttgcaagctccacctcccagattcaagcaattctcctgcctcagtttcccgagtagctgggattacagaggcacaccaccacacccagctaatttttgtatttttagtagagacggggtttcaccacgttggccaggctggtcttgaactcctgacctcgtgatttacccgcctcggcctcccaaaatgctgggattacaggtgtgagccactgtacccggcctatatttatttatgttactgtatttttgagacaggttctcactctgtcacccaggctggagtgcagtggcatgatcacggctcactgcagtctcaacctccttgggctcaggtgatcctcccacctcagcctccggagaggctgggactgcaggcatacaccacaccccgttaattgttgttgttgacatggggtttcaccttgttgcccaggctggtctccagctcctgccctcaagcaatctgcccgcctcggcctcccaaagtgctagtattacaggcgtgagccactgtgccaggctgcttaagtgatttttaaacaaaagccttaggaccctaacatcagaaatcccatctgtagtaacagcgggggtgcataatggtcagtgtccggagctacatgactttctgttacaaggaagtgggcctaagtgccgcctgattaatgcttaattataactatatttctgtccgggattcctgttaactctgagagggtggcctcagatgggtggttcagtaatgaaaatggacacctaggtgatggccatgattgttgatgttgccgtggtgtctgtcactcaaacatgactggggcattggaattccaacctgggactgatggagaatgttgctgtggtttgaatatttgtctcctccagcactcatgaagacagaattaacaatcaaaagagaaacaaagcagacaaatttgcaaaactcagcctggccatgtagaatgaaaaagtgtgttcaaaagcagaaaccaagggtggcccagtggtctttcaccaagattagtacagagaaaaaggatcatcaaagagcatggagctggtcactcacggtggctcacacctgtaatcccagcactttgggaggacgaggcggggtggatcacctgagatcaggagttcgcgaccagcctggccaacatgctgaaaccaaccccgtctctactaaaaatacaaaaaattagccgggcgtgttggcagtcgcctgtaatcccagctacttgggaggctgaggcaggagaattgcttgaacctgggaggtggaggttgcagcgagccgagatcatgccgttgtactccagcctgggcaacaagagcaaaactccacctcaaaaaaaaaaaaaaaaaaatagaagaaagacctctagggcattttggaggtctttgaggctacacttgctgtcacaggctctgaggcctagagggcctagagggcagaatggtttcaagggatggcccagtattgagaggtggggtctttaagaggtgattgggccatgaggactctcccaggctggcagatcgcttgagctcaggaggttgagaccagcctgagcaacatagcaaaaccccatctctacaaaaaatacaaaaaatgagcgggttttggtagatattgccaaatggctctttgaaaagtctgtaccagtttatatttccaccaacagtgtataaaagtctgtttccttttttcaagtcaactaaaactctgtctccgactctgtttctctctgtctcttacacatacatgaataagagtctaagggaaataagtatttgaatttcacagtatgtatatatgaaggtaaataattcctcaaagtttctctgacaatgttctcaaggttaggttaccctattttctttaactgaggtaaaattcagcccacatgaatgaatgaattcattcatggattaattaatgggttatcatgggagaggaactggtggctttgtaggaagaggaagacagacctgagctagcaccttcgcacacccatccctgttgccatctgatgccttgtgctgctttgggactgcagggagtccccaccagcaggaagtccccaccagatgtggccccttgactttggacttctcagcctgcagaactgtaagaaataaattccttttccatataaattacccagtttaagatactctgttataggcaaaagaaaacgaatgaagacaaatgtggaccattactgtatgggtccagcagctggatttgccaggggccccagagatatgcagtgtcgattacagactgaccacaagaaccaaaatgcgcaggagaatgatgaatgaagcaggtcccaaggtttatttgcaagaaaaatttgaacagccgtgtgacaaacccgcttctagtaggaaagcacattctagagggaagcaaagccattcggaggttgtttggtgagtctgaaatacagacctgtggagccattcagctcttaacagtctgacacctcctctctagggctgcaggcttagtggccaaagaccagcgctggtgacaaaaatttcccactgccatgcagtgccagagacatggacacaccctggacatctgtctccctttctctggacttgaggcttgcaggccacagttctccttagatagggcctggtatcgtagatgaagtttcagatcccaatcatatcttacccctattatcctttgtccctgagcccattgtattagcctgcaattggctgaaaacctaactcaaacagctttaagagggggacaaaggaattagttggctcacgtagcattaaaagaccaggaagatggccaggcatggtggttcaagcctgtaatcccagcactttgggaggccaaggcaggcggatcatgaggtcaggagatggagaccatcctggctaatacagtgaaaccccgtctctactgaaaatacaaaaaaaaatagctgggtgtggtggcgggcgcctgtagtcccagccactcgggaggctgaggcaggagaatggtgtgaacccgggaggtggagcttgcagtgagctgagatcgcaccactgcactccagcctgggcgacaaagcgagactccatctcaaaaaaaaagaaagaccaggaagagtccactagctgcaggtgtggcttgatctgggagctaatgccactcggttctgctcacctccatggtgactttatcatcaggtgccacattcaagaaaaggggataccatctccttcaaggttcaagcctggcaggaaagagaatgtccccaaaatggtcgaacagaggtcctaggcctgactcatttccatctctgaatcaaacaccatgttctggcatgtgtcatacaccagtcaggaagaagtcacatgccctacttgtggaggcagatcgtcttcagctgcactcaagcatatatggaaagagttgatgggggccgggtgcgggagctcatgcctgtaatcccagcactttgggaggctgtggcggatggatcacttggcgccaggagttcgagaccagccttgcccacatggtaaaaccctgtctctactaaaaatacaaaaaattagccaggcatggtagcgcatgcttgtaatctcagctacttgggaggctgaagcagaagaatcattgaacctgggaggcagaggttgcagtgagccaagatcacaccattgcactccagcctgggcaacaagagtgaaactctgtctcaaaaaaaaaaaaaaaattagtgtggagtagtcagaggaaaatcagggataccgttgctggaagaaagaggaatagaagcagcaaggaagaaaggcagaggcctgaggtccacgtagaagcagcaaggaagaaagaggcagaggcccgaggtccacgtagaagcagcaaggaagaaagaggcagaggcctgaggtccacgtagaagcagcaaggaagaaaggcagaggcccgaggtccacgtagaagcagcaaggaagaaagaggcagaggcccgaggtccacgtagaagcagcaaggaagaaagaggcagaggcccgaggtccacgtagaagcagcaaggaagaaagaggcagaggcccgaggtccacgtagaagcagcaaggaagaaagaggcagaggcccgaggtccacgtagaagcagcaaggaagaaagaggcagaggcccgaggtccacgtagaagcagcaaggaagaaagaggcagaggcccgaggtccacgtagaagcagcaaggaagaaagaggcagaggcccgaggtccacgtagaagcagcaaggaagaaagaggcagaggcccgaggtccacgtagaagcagcaaggaagaaag

SEQ ID NO: 3843 - DNA, 1035 bp, Homo sapiens
atggacttcctggttctcttcctgctctactggctttggtgctagttggttatgttatgacctgtttttgctagaaaactcatgatttgaaatgcctggtcagggcaggggcacagatattttcctgtataattccagaatgtcttcagaaagccatgtaaagattgcttcactacctcttccatacatgaaaccataccttcattatccttcacctggtcttgcaaggaatggtaaatactgaatatacctgggaaatactgggctaccgtcaaaagctagttctcctgtattaccttcttctgccctgtctgcttctgattgtaaacccgtttatttccaccctaacttgtgtaactgattctggcattataagaaaagcaaatgaattatttcttcaagtttatgaattcagtgatgtttctaaagaggtgaggtgctctacttatgagttacgaacaccagctcgatcaaagcactgactgcagtgtgtgcaccgttttgaccatcgttaggtttgggtgaacaactgcatctgggcttggaacgccagttattaatactttctcatctacctcttgatgttgacggctttggctgctgccatggccattgtgagcactgcgtttctggtcgatttggtggtattgttggatttgtactagacttacactgatgaccttggacacttccagtttatagacttgatttttcttatttagtacctgttcctgacctttctaacaattgtcttcatgctggggttgtggttggggggacgttgtaatggtcctgagctttctcctgggtagctacctgtgctttgctctgtacctggttgccatcaaccagactactaatgagtggtacagaggtgactgggccccatgccagcattgccccctcatggcctggcccccatcaggaaagctccaaatctaccagaacattcactcccatgggctctggagcaaactttgagagatctttctacctgccattccaaataatgagagaaagaagaaacaagaatgg

SEQ ID NO: 3844 - DNA, 541 bp, Homo sapiens
cccttttctcatggggcagacagaggaggcgggtggaaaagcagcttgggtggtggtggaagcccaggcttggcactgggttctaggtcctggctgggaggctttggcagcctgctaacctctccctcctcagtgttagactccagcttgaatagtaaagcaactgggtttgttttgttttgttttacctaagaagttgcacgcctcacacaaatttttagcatatgcgaggttttcacactttcaccctggcaagacacctcagccatctgattaaagaaatgctccatttccatgacccttgattaactcagttcatgaagcaacctttgatcacctattctgtgctcagtacaaagccacagagatggaaaaaacacagtccctgccctccggttacttgcagcctggtgatgccaccgagctttggggtcatgcgcctcacagcctggttagaatctgccctccaccacttgccagctctgtgacccagggctaggtgctcgacgtctatgaacctcagtttcctcatctgtaaaat

SEQ ID NO: 3845 - DNA, 583 bp, Homo sapiens
gactccgcccagccgcgccacccagaagctacaaatcttcagcattctccactctgtgaagtcagaggaatggcgggaccatagctctgagctcattggcaaatacaactaatttcaatttctggaatggaagcagtcagatattcttctgactgcacgcgtatgtgggagtgccatgttgaagagtggaaaatatggaagatcagtccctacaaacttaataggagaatgacattcagatttcccgagtattttgcatgtccaactgaaaactgaagtaggtttatgagagaatgcacgcctacctggatgggtctggggagtgtgtcactgtcaccgcagataattgacaagggctgatcaaatagcgatgctttcaagtctgtctccaaagccccagaaaaatctgatgcaggggagagccttctcatgagaaagggccaggacagcaccttctttctcttcttaacttctacagccaagaaaacaaggcaacgagaaaaattagactacagtgttaagaagcaaagatccaggtgacagcctgcacgccagatagatgcagcttctgttcgactctgta

SEQ ID NO: 3846 - DNA, 587 bp, Homo sapiens
tcttgactccgcccagccgcgccacccagaagctacaaatcttcagcattctccactctgtgaagtcagaggaatggcgggaccatagctctgagctcattggcaaatacaactaatttcaatttctggaatggaagcagtcagatattcttctgactgcacgcgtatgtgggagtgccatgttgaagagtggaaaatatggaagatcagtccctacaaacttaataggagaatgacattcagatttcccgagtattttgcatgtccaactgaaaactgaagtaggtttatgagagaatgcacgcctacctggatgggtctggggagtgtgtcactgtcaccgcagataattgacaagggctgatcaaatagcgatgctttcaagtctgtctccaaagccccagaaaaatctgatgcaggggagagccttctcatgagaaagggccaggacagcaccttctttctcttcttaacttctacagccaagaaaacaaggcaacgagaaaaattagactacagtgttaagaagcaaagatccaggtgacagcctgcacgccagatagatgcagcttctgttcgactctgta

SEQ ID NO: 3847 - DNA, 10129 bp, Homo sapiens
agctgctccgcacagccccgcctggcacgcagctccagcggctggtcgggtagtagtcggtcccgcccacccggtgcggtggcccctggggtttcagtccaaggggagggaccagcgctccaagaaggtgaggctgctgggatgggtgactccgccgtcactgcaaacacgggacgtcccgtctactcccttacgcctgcttggtctgagcccgagtctacctcttctctaagtcgccagctcggcacttgtacccgggacctgtgctcctcccacgtgagtctgcaccatgcgtattcccttcctggcaggtgacccaccttaggcgctggcgctccttccgccccccgggaagcaggaggtgccatcctctccaattcgctctgcagccggactgggaccggagcggcggcctgggccagaatccgcgtgaggagccggcttcaaagagcgccctgtcgccattgaacactccttttcctttggtttagcgtcggagagcggacgccaatttgccaggagagcgcggaaaattcagcttttttttttttttttttttttttttttttccgctagtgcactaggattgcaaacgtcagctctgaaataaaaagcaggatatttctgccccgctcctctattccggaagctgggaggttctgtgggagaaaggacctgcacccaataactcaatttaagatttaaggttttgaggggcgtggggttggaatcgccttggagaaacgggtttgcctgcttacctgagccaaaggaagttgccctcaaaggcaggtcagcaatcataccccgccaaaagcaaatgcacatcaaagtaacttcctttaaatgagattactgtagtttccatgtcttccacattagtaaataaatatttggaagacttcgaatttgtgatttacgtttaaatatatttcaccaacattgtttaattaaaaaaaaatcccatctaagagaaggttcctataggaaattggccctttaactcatacacagattaccctcggcactttcagaaaacaacacagtgaccagtatattctgtctttttgatacagccagaagcaccctgaaagctgagacctaactgtgcttttggaaaataagcttttaggagttgaatgaccttgtctacttcttttagtcagaataatgttggcatgtctattttaggttaaaaaaaaatacaaattctaaaaagtgactttaaaggcccactttgaaagccttagcatttaaactaacattagatttaaaagaagggcttttctcccccattataggaagctgtgtaaaatcatgtgtgaggttgtgagggtcaaatggaagtctaagataaagttctgccaattactggtgtctttaagcttccaccagcagccaagcacagtgcagatcatgagtccttcaaaatacggggtggttttaatgctctaagttggtatgattactttttctaaagagctcaaagtgctttggtgccatagtatgaatttcattacccattgtgagacacaaagggggttagcaatgattctgtttgcaccctggaagccaaaggcaggttactcacccacttagttccctaccacaagaccttgaaagaaactggaaccccaggtctccagcccagagattttgttggaagtttccatttgcaggaaatgactgcagggcacatgtgggaagtgacaggaatttgaggactaacattttagttttcctcatttctttttaaatctgagcaattgttcattgatcgataatctatgttcttacattcagataaataaaaacaccaactggctattttgttcttacttagttttatgtgtatgtccaggcatttgccactgctcctaaatagctctccctgaagtcttctggtcatgagttaggtttcttatccagaagctcatgtagtgccagagcttagctctcctatgacaacacaatcacattattgaaacatctatttagggatctgtcttctctaatagattataaacgccttgagcttgggtatcgtgatttaatgatgaatcctccatggtatctgaatcccagaatcctacaatcctgcatggtatctgaaacatactatgctcttaaaaaaaaaaaaaaaaaactttgtaaatggaacttccctcaaggagtcagggtttaagtcaaacatgtttccctttcaaagccgtgggcatgagaatagaggctgttaggagacacagtagtagttgactgcaaaagtgtctgtcagtcagttgtgtggcccaagactctttttatcagttccaacaactgaaaaatgagagggttttagtggaagatctctgtactgctaatattttaagatctcgaagtctttattgagcacctagtatgtgtacaacactatgccagttactaagagagagatgaaaaaataagatatctccattgccctaagagagcataaaatcttatctcaaggaaaaacaaggcaaacactcctagcctacctttacagacacgcacagacatgagttaacacagttgtaaactgttctaaagaagataaaggctcaaggagtgaaaaggcatgaaatagaaacaaaagcaactgacctatgagtttgggcaataatcagtaataataccagctaaagtgtatctaaggcttatagtgccaggtactatgcaaaatgaatcataggagctgcaccttttgttcattttacaaatggggaaacggaggtttaggagagtttagtgactcgttcaaggtgacatactaataagtggtagggctgatattcaaagagttctcacctgactccaaagtgcatcttctcaaccaatattagagattattagcccagacttccctattttataattgagggatttcattagagcactagaggaggaagctacccttccagtaaaaactagactcctagtctagtgctctatgtaattaagtaatatgcttatgtttgctatttttctggtttttctctttcccacaaaatatgtaataggagacgggaggtcaggaaaaggggagagagagaaaaagagagaagttgcttcttttgaagatgtccagaatccacagtagtctacctgctcagactcaatggggttttatttgtaacccccagtctagtgggcagccctgtatagcctttcttcccatcatggctgtttgaatctttcaggttaatagcatgaatattaaagactccagtgggactctttatccacaaaggaaattgggatcaggttaaaaatccaattttaataaactttccaagtcctgatttagatgaggtactaatggctcttactgctgaatcaccttaaaagtcaaatgtatttttaaaagggaagcttgttgggtattgtttaattgtgcattgcacattcctgtcttaatagaaaaagatcatctgtaaaacttatgagagcagataggaaatgccactatccacagagccagttgggtagagggaagggcgttgggtttgaaagataattttcactcgtttgaccaaaacaaagagagcatgattgcactgtgtgaaaatgatatcctcgaataactccactaatttgattgtgctgaggtctagaattgtttctatttcttttgatttgctaattagctagagcagtccgctagtgagaggggaaatgagggtcacagccataaaacatggaggattgttgttccttccaactcagctcacccatctcatgcctccccaaccatcccgtcccaacgcccaattttgtctctgtgtatgtaacaacaatccatccatctatgacaaattgagtgattcttttctgaaaacaggatttttaagattatctactttatgacaccaaatttgacacatcttggcatatgtggttatgaggtccagttatgacttttatgatgttttcctttatgaatcctgctccctgccttgccaagttaaaattatatcttatgattacattagtataaaggtgagtatattttcttctttatttaaatatcttctttaatctaaaagtttatctttttctgatttttagaagaaattaaatcatttttgggaagccctcaaggtaccataagctctgggcagtgtgcctaagacttctaatggagaatttagccctgtgcagatgatattgcagaggaggaatgcttagttaatttaggtaaagtatgcacagtaaatacaatttcataaaaaagcttatagtctatggtgttatgtaaacaactatagacaaatagaatattgcttttatttgttatcctgtgttaaactgtggccaaaattacacacatcagtgttagaaaaattgcagtattgcaggcttgaagtggtccccttgttcaaattactggcccctgctgagtgctggaataccttcagggcgatggaaaattgtggcactctctttgattttagattttgggaccaaagctggctgatcttttgatgagtcggtcttaatgatttgctcttttaggccttattcaaggatactgggaacctcacactcttcagaaaaaaaaaagttttcctcctggcaggcctatcagttcagttgaatcaatatgtattaggtacctcccatatagcagcctgtgtgctaggtacatgggtagagatttattaagaagaatgaaattcaatcccttacttaggagctcacagatgtgcattaacagaaaaattacaattcaatctaatcattctcatgagtccctagttccatttgtaatagaaggtccaaggagcatttgaactgtgactctcagacccttacctcttactctgaactctcaacttcaatcagcacatgctgtttctagcagctctcttctgtcttggagtcctcactgaagtcctctagagtatgtccctattgtccctgaaaactgatggtgctggcttttcctttcaaagccttgttttaattctagatttaaaatagcactaatgccacaagaagtctcttacacaatggtagagttctctttccatagactttggaacactgttcttttggaaatgtttacaatgacacttataagaactggctatatatatattaatctgctttgtggtggaaataaatattttgtagaatgctttgaagcttaggcaattagttctttttaacaaaaattaatttaattttcttttaagttccaggatacctgtgcaggacatgacatgcaggtttgtcatgtaggtaaacatgtgccatggtggtttgctgcacctgtcgacccatcacctaggtattaagccccacatgcattagctatttttcctgatgttctccctccctccacccccttgacaggccacagtgtgtgttgttcccctccctgtgtccatgagttctcattgttcagctcccacttataagtgagaacatgtgacgtttggctttctgttcctgtgttagtctgtggaggatattggcttccagctccaaccatgtctctgcaaaggacatgatctcattcctttttatggctgcatagtattccatggtgtatatgtaccagcagttagttcttaaattaaaaaaaaaagctttcatatttaatcaagttaggttatttcaatatatgcaccataatgattattgtaaagtaagttctgtaaactaaggaaaaataactattttgtgcaatctcagaaaaatctactagatggtatgggaaacaagaaagagaaatgaagaggcaaataaaaacatggcatttattgagtagctgtatgctgggagatttgaacattctcctttcctttcccctaattttacgtacagagaagtaacttcttgaaggttgtatgttccagcttgcaactagccatgttggatttagaaacaggtcaaagtcaagttccatgctttcttcctgtctcatgatagcattctctcccattctctacctgcacatatatatttcataaaactagaaagaggactccactatattttacatcatttcttcaaatgaagaagagatctgagttcttcataccttcaacatgtacttacattccaggaatttaactatccgtaaggtatttaaatcctacattcatgatattgttttaattgccctgagtcaactaattgacaaaggaaaatgctatgcttaaaagctcagttctcagtgtaattatttttctctccccacatataatcatcctttaaatataaaagctattatagagatgcagtttccagcaaactttatctcacattgaggcccttgactttatgtggtgtttcagatcagcttttttgtcaagggtcacacattcattccagcatcacttaattctttagctgttagtctccatccagcactagggtagaccctggagatgcaaaagcaagctagagacagtacccttattctcatggagctaaacattagagaggtattggtgtattcttcggagtatataatgccctttccagctatggactctgcctttctttatgtattcacctcttcctggaagccactttgagttggcagaaacactctgcctgcctcaggagacagagggaattatttgttgataaattggggaagaatggctctaaatgcttacatcagctctgtccttcctcttgggaatgagatgcatgcagggagcatttagcctgcaaggcttctctgctgctcttcagggatgcttccctgtaggagagagatctacctgggtctggggtggcctcttcctccctgggtgagtgtgcctagttctggggttcagctagtgggtatcttggctctgtcacagttataccctccatcatggcctctattggtaataaaggagatacttagctctcatctgtcttagtcttcgttccattagcagggaagaggggtgtcattcatcgtggctgatttaaagctacaaaactgatgagctttctgtatccctttctttctggctcctaattcacttatcctttgcccataattagcactcattatgcactgtcctgttcgttaattgttaccatggctatggctttttcttgatgtttttgtgagtctatcgtgtttatagcttatgtcttttaggccctacttataagtagaaagagaacaggaagtgagctcccccaaaatagacatgcagtcaatatcacaaaccccaagagggcaagttctggaaccagcagattccagctctgcaatattagctctataacttcacccacattacttaacctcagtttcttcctctggaaaatggggaaaataatgacacccttctcatattatcacacatgaagttcctgacacagagtacacactgaatgcatgtgtgctgttattacaaaaaggaattaaatcagatggttttaccttccttagaaagaattaatacagaaaaaaaaaaagctcctcaactctcttaagtactctgaatgaatgacctctgtattgcagactctttaaagcagcagtctccaaactttttagcaccagagactggtttcgaggaagacaatttttccacagacccgggtggggtgaaggatggttttgggatgattcaagcccattacacttaccattctattctcataaaagagcgcacaaccttgcatgcacggttcacagttgggttctggctcctgtgggaatctaatgccgccgctgatctgacaggaagctgagctcaggcagccagtgctggcttgccttacctcctgctgttctgcccaggtcctgacaggccacagagcagtactggtccacaacctgggggctggggacacctgctttaagggaacagttcttgagaacaaacaacatctgctccagaggtcattgatgcttgaagatcatagtgaaagaagaatgttctcaaagaacaagatttttgggtcagatattgctatgtttgaatctctttccttcaaatccacttacacatcctccctgaacctcattttttaaataaaataatacaatgatatttacatataatataatattttgagatttaggttaaatggtgcagttgaaagtcactaatagtataaggcatatggcatattgtacatcaatctattgtattttatatcaatatatgttgtattcaatattgttcattattcattgttcattattcaatatgtattcatattgtacatcaatatatgttgaataactgaatccagggaatattccttctgcaactgatttcaaatagtgccattacccagagctgtggatgttgcctgagttgacttgtacttacctgcaaagcaagtgaccttgaacgggcagagtaagaggaagaggccctccatggaaaactaaacaactggtccatttttgtttgaataatcaagtctgggaggtgttccttgtgcagagcacattattttctttctatattggatagctgtaccccattcacaggggtgacatgccattcatactgcagcagtaggaaagtccccatggtttctctttcctcattcacttttatatgtatatatattttttattatactttaagttctagggtacatgtgcacaatgttcaggtttgttacatatgtatacacgtgccatgttggtgtgctgcacccattaacttgtcatttaccttaggtatatctcctaatgctatccctccccactccccctactccacaacaggccccagtgtgtgatgttccccttcctgtgtctaagtgttcttattgttcaattcccatctgtgagtgagaacacatcattcacttttgatgtcggtggaatagtggcccccacaaagacgtacacatccggatccccagaacctatgaatatgttcctttacatggttttatggattgatctgtatgctgctaaaattaatatgttgaagttgtggcccacaataccacaaaatgtgactaaatttggagataggtcttttcagaggtaatcaatttaagatgagtttattagggtagatgctaatttaatgtaactttgttcccataagaaggaaaaaattggacacggagataaggacagaggaaagatgatgtgaagacaggggcagaagtcagccatctacaagtcaaagggagacatgtggaacagattcaccctcacagccctcagatggaagcaacaccactaacactttgctcttggacttctagcttccagaactgagagacaatatctttctgttgcttaagtcattctgtctgtgatactgtgtttatggcagccctggcaaactaatacagtcccacaaagatttggttgttgctttgcaagagaatgtataattcctggttatttctacaaataagggcattgactttataaagctacaagtataccccagtattctgtttctggtttttgtttactttcatatatgctatcttttcattcccaggtgaaatcatagtgcattttaaatgatattttaaagagcaattatactcgtcatatgtacttcaaataatactgattcctcaattgaagtaatggtaacatgagtgtattagttaattttttctgaataactagttacctccaaagttcatgccttcaagcaacacatattcattatttcacagcttctttgggtcaggagtcttggcatagcttagctgagtcctctggctcctggcgtcccaggctgtaatcaaggtggtggccaggactgtagtcatgtcagggctcgccagggaaggatctgcctccaagctaaccagtgtggcttttggcagaatatatttctatgcaggttgttggactgagtttcttgctggctgttccagaggttcccttagcatcttgtcgtgtggcctcttcataggtcaattcatattggcttcatcaaagtgagcaggtaagatagcaaaagagaatgcccaagatagaagccatagtctttttgtaatctaatcttagaagtgacagcctgttatatttgctatattctctttgttagaaacaagtttctagggctgggcatggtggctcacatctgtaatcccagcattttgggaggccgagacaggcagatcacctgaggtcaggagttcgagacca

SEQ ID NO: 3848 - DNA, 745 bp, Homo sapiens
ggcaagttagttgctccaaaaacaagataaaatgattgagttcttttctcaagcgggagtcggagtttatctgctctgagagccccagcagctactattaatgagtgtctggaatatgttcctggcatttcacctaccctctctccaatccttccaagaaactcacaaagcagggctttttcttgaacttctcttcctcacaacagttaaatcatccatttaaagatgtcaaacaacctccgtgttctaagaactatttactgagctctacggagacacagctacaagcaccacgtaagagtgtccatgtttttcttgcatgtaaaacagaaattgaaatgcaaaagcagattgccaaatcctaatactcacagaacactaggaaagcaaaaactggcatattatgggaactaaaaatgagaaagtgttccatactatacttattggaacacaatgtacaacaaaagtgctactgagattcatataaaaaattagagttaagcaactggcatgtttcatgtaaacttcaaagcagtaaaatcatatttctagaggcatactataagtgtgattcttttcaagaaatccactgcagaaaatgtggatcaatagaggcaacagaagatgatatgaagtaggacatattacaaattccctaggggattaaaatgaatagaacttttcttaaaagcctaacaaaaaagttaattcctttctaaatgaaataaagtagacatgtttcatc

SEQ ID NO: 3849 - DNA, 790 bp, Homo sapiens
gcaaaccatttatagccaccctccccctttgagtacaagagaaaacatacaacatactgtaggtttatttttattcaaaaagttactgtctcaagacataaatacaaatcagaaaacagtacaattaggacaatagaatgtggaggacaacaggttagagtaatatataaaacatttttagctggttgaaaacaaagctgtaagaactgctttcacaaagaagtactcctttcaagagtgagaaaaaaaatcaacttaggtttaaaatcatatatacagtcctctcagcagttctagttaatgcagtggtgtgtaaaacaacataggcaatacttttgcacataacaatatttgttgatggaaaatctgttagacaagtctggattcatttgttattaaccatgacttaataaaataattgtatcatgatctttttagctaacctatggtttttggctaccacagcccaatgcttgatttctgactaaaaactgaaagccttttggtattcacccatctgaagatattcttgtattgcaagcatattaaggcatggaatgattaaaataatatacctcaagaactgagagacgactgacaatagatagatacacatgtaatataagttaatattttgttttaaacgatgtctagctgcctaagcctcgcaaaatgagttgatgtcaaaatggcaagtagccactttctgttttaaactaatttatttgtgaaaggacataaaatgaagtttaaagcttagctttcaaagaatattatgggttatgaattc

SEQ ID NO: 3850 - DNA, 748 bp, Homo sapiens
ccgcctcggcctcccaaagtgctgggattacagatgtgagccactgcgcccagccttctttttatatttttaaatgtgtcttccccaaatataaatggttggtaagcatgccaaatatattcaataacccccctcctttatttttttttgttgaagtgaggctctccctatgttgcctaagctggtcttgaactcctggtctcaagcaatcctcctacctcagcctcctgctgtgttcatctacaaattgataagagtgaaagtcataatcctacaggaggattaccctatttatttcacaaaccctatttctaccggattttcatacaaggaatacaggcatgtgtttcacctcattaatttattttttcacttagttttgatgatattcacatatattatcaagtgtgcaaacattaaattcttgtgtacaaaactcaaatggtcttccaaataattccccattcttttttcttataaactttcacagctttacccttgacagactttactcaaggaaatctaagttggtcatatgtggctctttcactgattgctatttacttcattgtccagtagcttatgtatgaaaatataattataaaatgtaagggtcctacttccagtgaaactgaagggacttaggcccacttttatcctttactgagagcttatctctacttgataaaatttctactgtattcttggcttaactcaggtcctgtgattaaaaaaaaaatgcaaagta

SEQ ID NO: 3851 - DNA, 1798 bp, Homo sapiens
aataaaataaaataaagaaaagaaaaagtaaacttattagagaccagatgtcctgtcctgattcctggcccaccacactgccttccctgaagctgtgaggccagctggagccaagcttgtaatcggctcctccctagaagcccacagtcctggcaaaatggacctgtgttctcagctcaccaacacaaggagacattgtccccaaaatcaggcagaaaggtctttgccaggcaacatatcctttgtgcctacgtttgcacaaagcttacctgtagccaagagagaactatttccattcactcttccctttccatctccttcatcctaatcaaagtaggacatttaagccaggagactgtgtgaaggttttgggaagtcctcaactcctggataaggcaagttccaaggaagtgatactcatgtgatctaaatacgatctaaacacctcattgaacatagccagatcttccatttataggagacttggtagatgagtgccacagggtaactgaacccaggtttggctgctcaccacttaaaagccagactcaagagattagggatgatgggaggaaaaggtggtttatttggaaagccagtaacaccatgaagatggtgactagtgttctaaagtgcaatcttaaatttttcaggctaactggaggattttaatgggtgtgggatatggggaagaggagagagttggggagagagttgagatcaaaagatgaccagagactgcagacatctgggtgccaacaagagtccaaagaggttgggaactactctgtccttggtcaggttacaatggtcatataaatctttaacaaaacatagttgtttacttctttaatcccagagttagtttttaaaactacatgattgctgggtttgcatatttatatcagtgctctaaaattatcctatgtgcaggaatgggtaaaggccactttaaacaaaaatgaagtaagttacattcgttttttttgctgttccactgtaacaacaggaaatactgttaaagtccatttgggccaggtggggtggccgtaattccagctactcaggaggctgaggcaggaggatcacttgaggctaggagtctgagactaacctgggcaacacagcgagactccatctctaaaaatatatatagagagagagacatagtctcgttgtgttgcccaggctggagtgcaatggcatgatctcagctcattgcatcctccaccttccaagttaaaacaattcttatgccttagccaccccagtagccgggactacgggcgtctgccaccataccaggctaatttttgtatttttaaaggagaaaaggtttcaccatattgttcaggttggtcttgaactcctggacttaagtgatccacctgcctgggctcccaaagtgctgagattataggcatgagccaccatgcccagccaaaatattaaaaaattagaaaaatgattatttttaattttaaagaccatttagaataattgccttattccagaacaaagatgagctcatgaccgaccaggagtctcagtgactgagggacagaggctccccagggggcggacagagactcacatatctatggcatggccctgtccactagggctgttttgtccactggggctgccttgagaataaggaatgctactcgggaggtcgaggcaggaggattgcttgagctcgggaggtcgaggctgcagtaagtccagatcgcgccactgcactcagcctgggcgacagagtgagaccccgtctccattaattaataacaataaattt

SEQ ID NO: 3852 - DNA, 9136 bp, Homo sapiens
gacgcgcagtcgcccccccaggcagcctaggcggcggcagctgctgcggcgactgcaaaggccgatttggagtgctggagcgaagaagagcaaaagctgcgttctgcgcgcgcccgactccgctgcccgccccgccaggcctccgggaggtgggggctgggaggcgtcccccgctcccgccccctccccaccgttcaatgaaagatgaactggcgagaggtgagaagggaagagggctcccggctctctcggggcgggaatcagtgggccagagctcgccgggtggccgcaagtacgccggcccagcccgcagcgcgcccagccggaaggcggggaatccggctgacaccgcgccccgggttcccaggccacctcctctgttctgaggctgggctgggagaccgtggggctgtgaggagcgcatagaaccgtggtggagggcgaggctgggccaccggctcttcaagctcggaatggagggggaagagcgcagagggctggctgggaggaactcgggtgggcgtgaaggagacgagggcaagaaaagaaacttcccttcttccaggagggtcttcgaaaccctctccccacagcccctctcgtcattagcatggcaatgaggagtttctgtaattcgacttggaggggcggatgagccctggaaactcagagctcgccggaaaaggccgggggcggccgggctcttcttccccaccttccctctctcgtcgctctccgcccctttctctttcccactcagttttgcaccgggagccctccgggatgcggagctactcgaccgccggatttttaggggtaggaggcgggggagagagatgacgctggcggacgtggccagcgcgggggccgggcggtgcgctgcaggccatctgccggcgccctgagacccaggagcctccgcgctcccgcgtgggcctcacagggccggtccacagctccaacatagtagctgaactcccttcgttgcgttcctctttttctggaggggaatgttagaagagagagagagcttccttttataaccttcctcattctgctgcacgtctagagtgggtgtgggggctggcaggtgggaggggcggtggacaaatggctgatggtggacgggacactttaccccaacgacacctcctcccctttccaactggctgtgtagttgcttatgagaaccttcaagtccttccctagagagacacatgcaaatctgagcctcatcccaggccaggggtcctgttcctcatcaccctacttccctgaggctgctgaggtcgttaaattgttgtttactattaggtttcacgtcaaccctgggcttgtagagagaaaaagccaaacggagaccaagaattgatgcagtcttgggtaggagaaatcgagagcttgtccaggaagctttgctgtataaattataagcaatgctgtataaattttactccaaccatgtgtacaatgttggaatcagatgaaatttatagtgaatgaatgtatgtgggtttggggtttccactcctcttcagcctttcctcccgttagaacaaggaaggttttttttttttcaaggaaggtacatttcaaatatgttagtcaccctttcagtcttctgtattctgttctccacgtaccgaagttcccccaaacctgtcctctcaagagaaaaaacccatgctgactctggactccctcagtaacaatgaaacattctccccaaacatttcctttcagaatagtatttgtgactttgatccatcccaagcatggttaagagggagcacgggcaggaaaggcccactttctggggttgggcagccacccctgccccagtttcggctcctgggaatcctccgactggagaaggggaaaggcaaggcagtcctcctggaggcggcttccttgggagcaccagcttccagcggcggggagagaaggagctcctgtgggagagggggcaggatgtgagtaggtcggtgctggctatgcgagcaatcctccctccaagcctgagcaagtcggtacattttcccccgctgcctcattcctgtaccttggttgccctcctcagcctgggtttgcaggaccccctcggctgcagggcgcctgccacaaagccgaccccggcaggagccactctctctgctagttcgctgcctcggccctgctctccctcagcctctcttcttctctcctggcctcttttctggggcatcctgggtggagtgtttttcttgggatcacgagcttgcactcgcacacaggcccgcagacacacaggcccggcggccgcccttctccgcttactgttcccggctccccgcaggccgggtgctcgcagccgggctggctatgcctcgcctggcagcccagagcgccgctccccgggaacagcacacaaaggcagcctcccctggcctctagcccttaggcttctgtagctcagttctttccccacacccctcccccaagaaattctgggggccgttccaccgagtaggagatccttggccctctaggcaagtaggtcagcgccccaagactggagctggtctctttcaacgccttgggagactgggtgaaaggcgagcttggttacgcttaaaatgatcgcctacaagcggttctcttggctcaaaacgcctctttcagggctcttatgctagaaaggaaaggaataaggaggagataaaatgacgccgaggccctgaactgttcatggcatccgcggctcagccaagctgttgttttaaaagagcaataaaaatgaattatgactaaacgccttctaacttaatgctttcggacggggatccccggcaaataacgtaagaggatttttatttgtgcatgtgttcctgcaattgatctctttgatgacattctcattcatagaaagcgtttgatttatgagcgtaggacgaatcgcatccaggagctgcgcagccctggccgctgccgggacgccctgctccgcgctgagcttggggccagaaaccagccatagtccccacactccgccgccgcagctgagatttagcggaggaaggggcgagggaaggtagggagcaaacctatgaagaaacatcgcgttgtcattggaacttccaagcctttgctgttaagagccaggttcttaaatcaacccgccccacacacatgttgcttacatgctgcgttttctcacggtaagtaagtaggcatcagaagagagctcagaaagggaaaaataaacatggggagacctaacaagggaggggggaaaagcaacaacccagtgacacaccctagatcacattttattgatatttcatttaaagtgcttttctctctctctagaacctgcgttaatttataacctagggtgtagaaacacaccattttaaatctcaacttgctaacctgacttcgaagcattaacgatctattattagcaatgtaaacaggtttaagaatgaaatattgatttttctgaccctgaaaaaaaaaaaaaaatcctagagtgactgaaccagaggattggaaagaacattttctagggtgcattttccagatagtaatcactgttttgttttatttttgtttttctctatcttttaggtctgttttgcctgaacccatcaacagctgggagattaatcaaccacactgaaaatgtggagggatttatgggggagggggttgaaatgtgggtgtttgaaacaaaagtgtataaacaaatgaattgttgataacttagttattgacctggagactggtagcttattaaagaaactccgtgttactcattcctggagttgggggtttctgtaggcactttatttctccactttcaagagcttgggcttggcccaaatcttagactgtccaattctgcctctattaccaatttaaatctatggcttgaacctgtgcactgaaaatcaaatcctttaaaaagaaagaggagaagaagaagcaaaaaagaaagaaaaaacacttattagaagccctagtcattttttggctttctgttttgttgctgtccattgaagactttgaacatgccgccttaataaatgtattaaaattgaaaaaagaggataaattgtgacgaattttatttacgaagttagactaaaagaagaaaaagaacccgttatgagccttgaaaaaagagggggagaaaaataagctacttatagcaaaggagaatttattctacaaaaaatatgcatgacaatgcatcccaatgtaatacaaaaataaaaagaaagtgaagatacaattatatgatcactttcttgcaggcctcatactgctctcaggaatcacataaagggttgttgagttaggtttaaaacaactaaaactccaaaataatctgtaaaagatggctctgtttgaaactgggtcagggaatcactaaacagaaaatcctcaacacttaaaggagggaaggggtaggtcaagaagaaaataaaaaataaactcccaaataaaagaaggcaaaaccacctggtcaaaggagtttttgtttggtgatgctttgttttgctttaatgtttttagtaattcagatgctgcaagtcgattgtggtgagtgtgtctgtaaaaaagtctaagctgtcagctgaaatatctacgggactgtcgagggaacctggcaaactgggtgaaactgcatctgaaagctgcaggcaggaatctgtggagaaaacgctaaagtcctgcaaagaggggacctcaagggcctcaggactgtcattgtttaggccagctccacagttctggcccattgttgacaagcagttgggaacagtgggtgactggtgctgaaaatgtttcagatttttctcattgctggttaaaggcgagactgggaaactttgggagtcgccattgtgtccattgggagcctgctgctgagagagggcattttgctgaaaagtgtagccttccctctccagaagggccccagagacgctaagggcttgctcaaagagcgtcttctcttcctcgtcctcctctactttctcggagtcctcaaggcttttacatttcccttcgctgttttggttttccttgcactgggtctgcctcttgtgcttcatcctccggttctgaaaccacactttcacttgtctctcagtcaaatccagcagcgctgcaatctccacccttcggggtctgcaaaggtacttgttgaaatgaaattctttttccagctctagaagctgtgtgttggtgtaagcagttctcaggcgccgcgatcccccgccgctgccatcggcgatttccagggattctgcggaaagggaaaccaacaagagacacacgcacagttggaggtggaggggtccgagcggggttattccactggagaataaatatagcagaaaagatcaactgcaacaaaatggccgcccctggatgcagtagagctattgtgctgcctttcctgggagcccagcctgggcagaccccgtctcctccatctctatcgaattcatgcctgtggctccccccaacctcttcatccgggagcaaactttatattagccacaacacaatttataattaatgcgtcagctgcttagctgagcaagagcgatctatcactcttcattactgtcaaaaagccaaactctaggacaactagacaggaggaggtcagttccaactcaaataaatcatcccacattacacaagttcgggaaagtttccccccacttcctaaaaatatatatgtctcattgtagagcgcaggatcccctttcctctccatcaaacccactcctgaacccacaggggcagggacaaggcaaccaagcatctctccctctcctccttctctcccagcccactctcccctccccccacagccactctcggggcagcccggagaaggaagagggtcccagagacctggggccaagtctttggactgacctttgtggctgaggcaagcagggccggtggctgcggcggtggcggcggcggcggcggccggcagaagtgcggttttcttggccgccttcttctccttcatccaggggtactcgggcggctgcagggcgccggcgggcaccgggctgccgcggctgcccgcggggctcggcttggggcggccgccagcgccgtggcgagggtgactgccggggttcaggctgggaatggtctgctcaaaaggaggaggaatcagtgtcgagtgtgaaagcgtcgaggtcttgattgatgaactttgaaatgtatcagcgacagggggaaaagatgtcaggcactcagcgagcgacggctggctattgataaaaccaatctctcgctcaaattcgtaattcatggccttctccttggagccccctcagagaaaaagttccctcttttggaggggctttgggggggcaaggcctaggaaaaaggcgagcgcagaggaaaaaaaatctatcatagaatatcgctgctagggtgttttttttctaattcactgattacagccgtatggggaccgcgctactattaaactattgaattcatggagacaaggttgaaattggaccgaattggctgtcacatgattgcttctgcccaatgacaatttgggctttaatcaaaagaagccactgtctgtttgattgatccaaaaaagtcgggaaggaacgcctcattgggggccagcgaggctttatttacacttttttcagagcaaaaatacatatatgttggtgtgggtggggatgtcccggagtacgtgggggcgagggtgcctgcgtgcctcctgatctgcaaggatctatctagtgtgtgtgcctgggagtgtgtgtgtgtgtgtgtgaatgtgcgcgagtgtaagccctgctgtcggtcccgccggtggctgccctctgcctcccccgcacactccgcgcattgtttgggactgtcgggaagacgcctcgcacctcacaaatcatttaagcacctcagtctgacgcctgcagtcattaacaaagtaatccattaatcttcaaagttttgacacccgagggccctgcgtcccagccacataagttctgttaaagcaggagaaaggagcagaggaagagaggagatgagagagggagaataaagagagagggaagaagagagagtttgagagatggagaaagagaagacagaaaagagagaagaaaggaaagattttggttgggaaggggtcttccttttctttcccttttcctccttcacttttcctaaaagcagttcctggatctcaaaactgatctctctcggtctgttttccttcctgtctgtccctttccctctttttcctcttctccccctttctccctccctctctcttctgtccgcctccccttctcccctcagcctctcgcccccctcccagtgtccagcccagagtctgcgccccgggcccattgttagcaggctattccacggcagctttgcatctggctccggcgggaagcggaaaacgggaggcggctctcgaagcttcccgaccttcctgcgccatcaacttctcaggagtggctggagaaagatgcatgtgccaagcgagacaacaaccccaggtccatgtgtccaaatccccgtagccagggcggcggccagccaaagaaatgccgccccgagcaggcgcgtgcggctcctggcattctgggtttcatacccgtagggctcgggtgcggtgagtatttccgatttccaggaagtctgttggaagttaccagcagggaaagagaagatgcttgctcctctctttccctccctctctcttttttttctacccttcttcttgtccttgtcgctctggttgggggctggttggtttagatacagcgagtgctccctggcagcctgaactgcctcccacaccttcctgatccttgggcaccggggatgtttgcttccgggttctgttgtgggaaacagcactgcgggggagaggaggcgacccaaggaggaattataaaggttttcgttctccttcattatcttttttccaattcggagacttgagactgagcgcatcttggacagtgctagagggttcaaaagataacacctttaggtaccaaaaaataatttttaaaaaatccaccaagccagaaagaggtgaggaggctgagaggtagatctggaggtacctctttcccccccaaaccctgaggatggtgattcgcttttgcttcctttgaaatagactaactgatcagactcccccaggccggcaggcatcaatggcaggaaaataaatcattctgatggtcagggagagagaggttggagggggagaaaaatctacgtagaaaacaagaaaggccaaccaaggagcaaaggcaggaccccatctctgaggccagcgtcaaagagggtttggggtggaaattagacataagtggcctatatcattgaccagcccagagcattgccttgcagatagagatgctattttggaaaatgtgaggttttttagttttcttgcttttattccaaacaaagctccaaaggaagtctgggcgcgatcaatcttgctcaccaaaagccttgacagcttctagcccttaagaacacatttcagcttccagctccttccaagataaaatgtggccgagcaaagaggagagcaggaaatgcaagtaaataaggaaaactagtcttttaaaaaatatattttggcagtgaaaagggttatagggctccttttaggaagggtgctttgcgaaccctgggatggcagcttttggcatctgcttttaccagaaaatattacaggcttaagggaacgtgggcggggggtgcagagagggagcagcgctgcccccatatctctgaggctttgtcaggggctgcgtgggtgagagctttctgctgcctcagccgccttaattcaaataccatctggaagaaaacccttttctttgaccactcaacactgaaatcttccccaaatctattactttaacttatgagatattttaataaggatttctttttaatatctaggaaactggggggtgaagtcaatacttttttctttgaaagccaaaatgaatgtcttgactggtaagatgcgggaaatcacattagaatctcattttaaaatcttagccctgggggaaggaggaagcctccaaaccacccc

SEQ ID NO: 3853 - DNA, 1729 bp, Homo sapiens
caatcaggcactcagctggagcagacaggacggcttccgggtttggtggggcctttgtctctggcggcagccggagcttctggtgtagtcttcactgctctgtgtcttctgctcctagaggcccagcttctgtggcctcgttacctgcaggtattgggagatccacagctaagacgccaggacccactggaagcctagaaatgctcctggcctggaatgaaacttcgcatatctgggaatgggagacaggacagcctgaagttggagtgtagcctctcaagggagcaggtggatgccctgaggctgagaggagtctcctggggtactcttcctttgaaaagcaaacccttagagaagttaagattgtcttcaagcaacccgggttccatttctcgaagacacattgctggtcagccaatcagatggtggtaatgagggaaaaacaaataattactgccacctggattctccaagaattatgaaagagaaaatagtatcccaaaagacaaaaaaaaaaaaaaaaaaaaaatcaaacctggccccagtgagatggtgcagcaacttgcaaagtgaaatgcaccttggggcactcaatggggcctagtacagtgtctctggagagggtggtcactgagcacttaagtgagcaggatgggggtgggagaatctctcaagggattgggtggcctgacttgacatatgagtcaaacacatctgttttttaatgagcaccgtagctccctgggtttgtcaccttgaaaaggtttgttcacttattttgactacagttttttaactgtaacttgcattttattagtagggcttaaaaggtaagaaaatatttacaaagggcataaaagaggtggggctcagaagaaaataaatatctaatcctatattccattcttaagaatactcatttaaggaagactctgtctcaaaaacaaaaacaaaactcatttacctttttctttcccagaccgagtttagaaattttctcaggtgtgtgtttttgtttttgttttgttttgttttgagacggagttttgctcttgttgcccaggctggagtgcaatggctcagtatcagctcactgaaacctctgcctctgggttcaagtgattctcctacctcagcctcccaagtagctgggattactggcatgtgccaccatgcaccagctaattttttgtatttttagtggagatagcgtttttccatgttggtcaggctggtcttgaactccctgcctcaggtgacctgcccgatctgcccgcctttgcctcccaaagtgctgggattacaggcgtgagccaccgcgcccagccaggtgtgtttttttaatgacttggtgacatccaacagaattccaaggcttagtttttagagtgctacaaaggaaaaaaatagggaaaatctctcttccattttggctgtagaaaatgaatacatttccataagaaaatgtggtagataattggtgagttacattcatgaaaacatcagttcctctttttgcagggtacatttgttacagggaatacctctgttctgtactctatcatcttgatatgtgatgttaatgctaaattttatgagaggaaacttggtatctcctagaagtgctcccatatgactaattgtttactacatgatttttaatggaaataataacatattgtcttaaaggaataaatgcttttgtatttcttattgaggtatgaaatgt

SEQ ID NO: 3854 - DNA, 3571 bp, Homo sapiens
acattaccttgggtttaccttgctgttttctttaaatgtttaattaggtaggaaattagataattgtagttttattccaacataattaaatatataaatttcctccaaacactgctttagcttcatctcataaattgttatcttgcatttccacaatcactcggtccaaaatattttctgatttccctttgacatctcttgaccaactgattacaaaaaagtgtgtcactttccaaatacttgaaatttaattccactgcggtcaaaattcatactctatataatcttaatcctttgtaccttatggcccagcatgtacaaagcccagcatgctctgttttggtgaatgtaccatatgcatgtgaaaagaatgagaattctctagctgtaagatataacgtttaataaacatcaatatgatcaagaatggctaataataaatttcaaatcttctgagtaatttttttttattagttgctgaaagagttacattaaaatctcaatctgattgtggaactatttctgcctttagtcagttttcatgtattaagtcattctgcattaaataaatatacacttatgattgatatgtcctcctgatgaacttttgttactatgaagaatccacattacctgatacaaaatttttctgttgcaatctattttacctgatattaatatagtcacttcaatcttttactgttttcttaaaatatgcttttcaatctatttattttcaacttacctgtgtctagtatttctctgtaaactgtacatttatttttttgagataagtctggctctgtcacccaggctggagtgcagtggcacaatcttggctcactgcaacccacacctcccgagttgaagcaattctcctgcctcagcctcccaagtagctggggttatagggatgcgccaccatgcctggataatttttgtattttttaagtagaggcagggtttcactaagttggccaggctggtctcaaactcctgacctcaagtgatccacctgcctcggcctcccaaagtgttgggattatgggcatgagccactgcacttggcttgctttttagtttacttattattattattattattattattattattattattattattttgagatagagtcttgctctgctgcccaggctggagtgcagtggcacgatcttggctcactgcaacctccacctcccaggttcaagcgattctcctgcctcagcctcctgagtagctggcattacaaatgcgcatcaccacatccagctaattttttgtatttttagtagacatggggtttcaacatattgcccagactggtttcaaactcctgagctcagggcaattggcccatcttggcctccaaaagtgctaggattacaggcctgagccaccacagccagccttgcttttaatttttaatccatgatgacaatctgacaatctctttcattcaattgaagtggttcttccatttctatttaatggaatttttgaatgattaggtgtttatctaccatttttactactgtttttctatttgtagcctctgtattttgttccttagcttcccttccggactttgaacaatatatctatatatacattatttcaatatattttataattccatttcagtttttaagttatacttaaaggctctttacatataccttttggcattgctttttcagttattgctataggggatacaatacaaatctttaacttttcaaggcctacttacaatcaatattatactgtttcacataatatgtagaaacctgtaaccacatacgtccacgtgtacacatacaagaatcaaaaactccacaggacaatactattcccccccccctttattaaatggtcatatgtaatataaagaaattaagaagggggaaggagcaaaaaaaatggttattttcctctttatgaaggtatttaccagtatcagggtaaaaatttctatgtaatcaactttccatctgctctcatttctctttagcctgtaaaattccctttagcattacctggtgtgcttatctgctggcaattagttctgtctgttatctttcatttcaaaatggctttctttcacctttatttttaagatattttcactggttatagaattcagggttggcaatttcttacttttaccattgattgattgactgactgattgactgactgactgagacggagtctcactctgtcacccaggctggagtgaaacgccatcataaaaaaaaaaaaaagaaagaaagaaagaaagaaagaaagaaaagaaaaagaaaaaaagatattttactctcttctggctctctaccatgttctgataagaagtgagcaattaatcatatcattgttcccctatatatggtgtgtaattttttcttgctgctttcatgattggttctttataatcttcggcttttcacagttttaccctctgatgtaactcagtgtagtcttccttgtgttcattctacttgctgtttcttaagcatcttgaatttgcatatttatgtctttcatcaaatttgtgagatttttctgccattagttcttcaagtattttttttcagtcttatttaccctctttttctaagactccaattatacatatgtcagaccacttcacaggccattcctacctctcaattttttttctctttgttctttacaatggaacatttctattgctctttcttcaaattcacatactctttcctcaacagttatgtcatctagtgaattttttatttcagatattctatttttcagttttaaattttccattggttcctttttttgcttctatttctctgtaagaactgtctttctgtattttgtccttatgagactagttaacagctatttaaaaaaacaaaaacaaaaaatctgtctcttagttccaaaatgtaatggttggtatcagctgattttcttttgagagtatgatttactttcagagcttaattttaaactgtatcctgattctagattattttgacgaatttttttcttttgtttctggttctggttttgttttcgttttgttttgtagtaggcaatatcttgattcaattgagggctgcacactttgtttctcaggtgccaactatggtcttagttcacatctttagatgagatgcttatgtctactctgcacatataatcctggggtcagctacaatttggggattcccgttctcttttctttcccttctttttatctttctccatcagcagagatttctctgggttggaatgagtgccacctaatgtgctttgcctcaggctaaaagccaggaaaactagtattcagtgtactaacttccttccttcaaggaccaactctatttcagactctgcttacactcatcctacagagttccttggagtagctggtttttatcgtgcatattttagagttgcttattgcaggggattaagtatgacagaaatttactcattcattaccggaaacagaaaccctcaagttcttattttggcagttcaaagcccattcttccatagaaatatcaataatcc

SEQ ID NO: 3855 - DNA, 3952 bp, Homo sapiens
agccaaggccacgggtgagacaagcctgtgttatgcgcttatataatgcacaggcttcacccagagatggaaccagctcgaactaccaactgataatgtctcaagcagacaacaggtgaccaaattaaggaaagaaaccaggatcctggcagcccaggaagcagagccggtcatgacaacatgcagctgatgatgtgggggtgaaaggctgagtaagcggttgcaatctgcagtgagccaagctgaaaggcccgggcggatgtgaaggctggtggtaaggaaatgggaagcaggcagccaagctaaccctgtgtccactgaaggagtgaggtggccttgagcacagcagcatccctgggtcttacgtcggccagaagtagaaagggaagaagcctaaaggaagtgaaagtgttgctggatctcctgctggcattgcctcctccttcacacagcatcccggttctccctgcagccacctgatcttccctttgtccccttcctcaccacagccccaccaccttcaccactccaagttgatgcttctcctacatctggccaagatgctactcagaggtggatgaaagcaaaagtcactgctctaatacaagaaaagtcccggttttaggtttcagaaacagaattttcccgaatgtttaaaatggtgaatggttccataaactgtgttaaccaggcttcttacaggctagtcccagaatctgaccaccatgtgcaatactgtttctaagaaaagtgtgctccaagcaagaaccttcaaacatttaacctgaatgaatgaatataacctcttcacggttcagtgttttcataagcaaaacaagagaatagcagcattgatgtcttttaaaaaaaatttagggctgggcgcggtggctcacgcctgtaatcccagcactttgggaggccaaggcaggcagatcactcctgaggtcaggagtttgagaccagtctggccaacaagatgaaaccctgtctctactaataatacaaaaaaattagctggaatgtggtggcacatgactgtaatcccagctactcaggaggctgaggcaggagaatcacttgaacccaggaagcagaggttgcagtgagccgagatcgagccactgcactccagcctgcgtgacaagagcaaaactccatctcaaaaaaaaaaaaaaaaaaaaaaatttggaaagcttcccatttgggatctgtccacctacacagggcaacacgatagtattgacatctcttagcttttacggaattttctgcctacaatgcagagggcaaagaaggggtattgtcagcttggctttgctgtctctgagtgacagtctcttgtatacgtaaataagatgaattttcataaaagcattgacagagcattagcttcacctcagaaagaaaatgaaaaagcaaatgacaactgtagtcaaagaagaaattaaaatatagttaaatagtaaacagatcaagaaaaaatcagtgaaaacctttaacttgcaacctattctttttaaagacatcagtacacaaagattgggaaagtttattaaaaatgttaccaaactttaagttcttcttttttttttttttttttttttgaaacagggtctcattctgtcacccaggctggactgcagtagcacgatttcagctcaccgcagcctcagcctcccaggctcaagggatcctcccacctcaacctcccgagtagctgggaataagttcttactcactccgttaggttgagctattcgaacatcactgtttcccatgtaaacgttgagaccttcattaggctctccttgcttaccctgccatttcacttcaggtgtcaccacctttaagaagctaccccttgccaggtgtggtggctcacacctgtaatcccagctcttagggaggcagaggcaggaggatagcttgagcccaggaaattgagacctgcctaggcaatatagcgagaccccattctccacaaaaaggaaaaaagcaaacaaaaaacaagcataagaagctacccttgaacccactgtatcctcaatctgatttttgaagctgattcctgggagcccagcatcctggcacagaggcactgctaaggcaaaggcattggtctgccctccccaccaactctgagctcttcaggggcaggaatatgatatatacaagcagttcatttaatctctacgagctgaaatgattcatttgtcttaataatgctgtcattttaaagtacagaatttgagagctggagggaatctcagataccaattattccaacactccactcttttctgaggctttaaatgacttgctccaagttagaaaagaatcaggacccaaagccaaaccttgaaaatgctgttctaatgctttgtgcctgcatcccatgccaccttgcctttgtaaattcacaggattaaataagggaatcctaaaaaaatgtgttcaattcccccttcacttctaaccctggtcaattttacaggcaaagaaacaccactggaggcaatgaagggccgttctcacaattacatggttcacagcagagctgggatgaaaactcggatctaatatgagggaccatgttcttcccactatctcataaaaattcaactttcaagtacaggtcatgggtgtagagcaaaggtcagcatggcacaggggccaaatcctgtgggccacctgtttttgagtatggcttgcaagctaagaatggtttttacattttaaaatggttataaaacaagaaatcatactttgtgaggtatatgaagttcaaatttcagtgtccacgaataacgtttggttggaacatagtcatgatcatttgtttaggtcctgtttatggctgctcttgagtaatagggcagagttgagaagttgtgaaagagacctcaagaaatgaaaccacacacctaacaccatctgatcttcaacaaagtcaacaaagtaagtaatggagaaaggactccctattcaataaatggtgctggctagccatatgcagaataaaattggacccctatctatcaccatatacaaaaattcattcaagatggattaaggtttaaatgtaagacctcaaaccataagagtcctagaagaaagcccaggaaataccattctgcatcagccttgggaaagaatttatgactaagtcctcaaaagcaattgcaacaaaaacaaaaatgacaaatgggacctaattaaactaaagagcttctacacaacaagagacactattaagagagtacaaagacaaccctcagaatgggagaaaatattcacaaactacgcatttaagaaaggtctacaaatcaacaagcaaaacaacaaataaccccgttaaaaagtaggcgaaagatatgaacagacacttctcagaagaaggcatacaagcagccaacaaacttatgaaaaaatgttcatcatcactaatcatcagagaaatgcaaatcaaaaccacaatgagataacatctcacaccagtcagaatggcttttgttaaaaagtcaaaaaataacagatgttggcgaggctgcagagaaaagggaacacttacacactgttggtgagaatgtaaatttgtcctgccaccgtggaaagtaatttggagagttctcaaagaactaagagctgaactaccgttcgacccagcaatcccattactaggtatatacccaaaggaaaataaattgttctaccaaaaagacaccaaaccagatattgaatgttctcactcataagtgggagctaaacattgggtacaagtaaacttaaagatgggaggctgggtgcggtggctcacgcctgtaatcccaatactttgggaggccaaggcaggaggactgcttgaggccaggtttgagacctgtctgggcaacatagcaagaccccgtctctacaaaaaaaacatagtaaaataaaataaaattagccc

SEQ ID NO: 3856 - DNA, 1155 bp, Homo sapiens
gcacgtcctttgcgctcccgggaggccagaacaactcccaggcctccgccggcccgactcccccgaacccgagcctcccctcgcctaagcctgccgtcttccctcccggccccacgtcgcccaatgccgcaccttgaggtggctgcgcaggccgccagcgcccccagactggtcggagatctcgtacgcgccagtcactagcaggtccttgtgaatctcctcacggaggcacttgcgagagttaatgggcagatggaaggagatggcaaggaccaatctggggccgagcaggaacaaaagcagcaacgctaacggaaaagggccgcgccgggctggtgggccagacaaaccagacatggtgctggagactcgttcaccaccgaaggcctcaaccgcgccggaaccggggggacccacgtgactcacctctgaccttctgatgccgtccgcgccattttggagactggcatgtagagaaagactctatagcgaatcttttgaaaagggaagaaaggataggtaccatgtcaaaaccgcaagtttaagcagttaaagaagctttaatagaatactattgcaacagttttatttttgttgaagttagtgactactgagtcggccatggcaagtatgggcagccctggaagtaattctcctttaatttccgaaagatgtacccacgagtttaaaggcgagtgacaccatagcaaccaagccccaataggaaacagccacaaggcccttcgctgggcccgcccaccggccgcctaggcgcgagggcggggaatgaggctgtgtctccggggatggggcggtttgcaggcactcccaagcgcctttgacaccttgatgacacctggggcactgagacactagagaggaaaatttcgaggaaagatttcaacttggctattagacagtgtggaccttagagaagaagttttaggggtcacctgatgaatgtgtgccgggcagacatccggttcatgtcccatagcagggtatttgggctggagtaattgtctggctaactgaatgtacatggtattattattattattattattattattattattattattttagcaaacattgaatgtgttctaagctatattcaaaataaatttgaatttggtatttaaattgaataaa

SEQ ID NO: 3857 - DNA, 273 bp, Homo sapiens
atgcccaagagaaaggctgaaggggatgctaagggagataaagccaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtga

SEQ ID NO: 3858 - DNA, 2192 bp, Homo sapiens
gccaagtcactggggcggtggggacgatacttctcatttgtagcctttcaatttggtgctctgtctggctgttttgagagctaaactccccattgctcttctggaaggagagctcgctgtccagtactgcgcgggatgaccgagtgaacaggggactggagacgagatgtggctggagactgagagaagcagaggagtcacactccactcacctccacctcccaaagtgccgggatcacaggcttgtgccactgcgcccaaacataactgaaggttttacagacatgtctgtggcaccacagaacacgaacggtcccaatggaaaccccacgcccaatttcctcagggaactgctgtggcggaggcttgcaccccacgtggtggccctaggtacaacggattccggcgggcagagcgccttagatcccgagtctgcagcccagggcagagtgccaacttctcctcatcccttcgtacgccatagaatggaaagacactggggctcctctgttaggagcgtaggagggacaggctggacaaaagggctcccgaacagcaggttcggaggagagcaacccggccctgacccccgcccccaacaccgttcccgacctcgctccccaatatcccggctctgcaccaattcctcccgcaagccaaggaaccccgaggcactcctagtctctaaaccgtttatttctccccaccagaaggttggggtgggcgggcctagaacacagcgtgcggcgggttcccgggtggagccagcgcagacagcgtgggtccctgcggctcttaggcgaaggtggagttgttccagcccacattggccgcgttcatgtcgtaatagttgatgtagaccctgcggggggaggaggccggactcagcgggtggctcagtcccgggcctggccgcgcgccgccgcccctcccccgcccctccgcgactccgcgtacctgtccgggctgatgcgcaggcgctcggccagcaggccgcacagcagcttgctgtaggagcggttctgcgcgccgccgatcttgccgatgctgtgcaggctgcagagcgcgcacggctcgctggagccgccgaaggccatgagctggtccgggaccacgtgcaccgcgatgtactgcgaggaaagggcgcggtcagcccgccccagcgacctcgtcgggccccgaacgtccacttcgggcccgagccaccgtcctccccccgccccgccccccagctccgttcaggagtcgcctccccagctcccagcgcggaacccctcgtccggtgggcacccccctcttcctgtcccctcccggcaaacctgggggggcttgccggtggcctgcgccagctgctgggtgagctcggagaggaacccgtccggcacggaggcgcggggcacgttggtgtttacgatgaacatcggcatgatggcagaaggaccaggagacccgcgcagaggcacagacgcacgcgccgcggccgccgctgagctacgtgcctgacttctcggacaccactgtggtcccgccttttgtgacgccaccgccggcgccaggccccgcccccgcgaggctgcggctccgccccgagtggggaagtcaccgcctgcctcggctcgacccccgcagggcaggaccctgggcgactccgcccgttcctccagcaaccgccgctaagcccggcgcaccgctccaacctgttctccacttggcggctagaaatcggcctgttccggcctcgcctcgggtctttcttagtcctttcactaagtcaccgatgttagtcgccaggaggcgctgtgccgggggtggggatgcggcggtgaacccggaagatggccccttacccttccagagatgaagcccagttcattccactgcacgcactgagcccctgtacctcctgtctttgggccacatgtcctcaagggctccagtcccgcatgcgtgagcttgtgtgtttgagatggggcggggtagtcatcgcggcaggtgagaggggagctgcccctgcgaatcaccatccagggaacttccctgaacccctgctctttaaagaggataggatgctgggaggcaccgaagggaaggaggcgaggtccagagcaggttcagtggttcaaacgtgctcagctccccttctctgggcctctgggcaacttcagctcctcagggaagccacaccctagtca

SEQ ID NO: 3859 - DNA, 879 bp, Homo sapiens
cgctcccacgttcgtggagacgagtgtcgccctgggacccagcaactccgctcctacattcacaccaaagagaaacgaagacatctgttcacacaaatactggcccaggaatgtccgtggcaccactgttcacaacagccaaaaggtggagatgacccaaatgtccatcaacagatgagtgaagaaacgaaacgtggtccatccacatgaggaaacatcattcagccgtaaaaaggtatgaagaggccgggtgtggtggctcatgcctgtcatcccagcactttgggaggtcgaggcaggcgcctcacctgaggtcaggagttcgagaccagcgtgaccaacatggtgaaaccctgtcgctactaaaaatacaaaaattagctgggcgtgatggtgcacgcctgtaatccagctactcgggaggctgaggcaggagaatcactcgaaccagggaggcggaggttgcaatgagccgagatcaagctaccgcactccagcctgggggacaagagcgagactccgtctcaaaaaaaaaaaaaaaaaaaggaatgaagcactgatagaccctctcccatggacgaacatggaaggaagacatgatgctcagtaaacacgctggtcacaaaggccacaccctgcagggctccattcacatgaaacatccaggacaggccagtccacagacacagacagcagatgggtggataccggggaagggggggtgctgtgggaaggaggatggggagcaattacttaatgagtgcacggtgtttttaaggggtgatgaaagagttttgaaactagacagctggtggtggacaacaacgtgagcacgtccagtgctgctgagctgccctctaccgtaaccgtgtgctacaa

SEQ ID NO: 3860 - DNA, 1355 bp, Homo sapiens
gcacgcctgtagtcccagccaatcagtaggctgaggcacgagaatcgcttgaacccaggaggccaaggctgcagtgagccacgattgcaccactgcactctaacctgagcaacacagactccatctcaaaaaaaaaaaaaaaaaagaacttggaaatgcccccatatatactagttgtgatgaagcattatttttagttaagtcatataagaatgactgtgtatgaccaaaggcaaatatatgtggaagaaactcaccaggaattcttttgtgggtttttattcaatacatgtcagtaggggagttataccccctttttaataagtttgtgttaacctacagtctaaccaaggcatcttatcccagtgaatgccaccaccattcaccctggttcccaaactggtaacatagaaataatcttgacatatcttcctatcactttgtcatcaagtcctgtcatttttaccttgtaaacatctcttaaatgtgtctacttctcaccacaccctaatctaagctaccatcagcaccttttgcctgcatgactgcagttgtctcctaactgttcttcctgcagcgactctggccctccctgtattcactcgactgcaagcagaattctcctttttgttcgaagttcaattttaatcaagacaacccacctacctgcacttgcacccctagcttaaaatgctcgaatggctttttattgtccttaatgatgaaaaggaaatattttatgtgaccaaatatatttgacctatgaggtcagatatattagggccactatctaaagcatagttccaagcattaaaatagttactgtctcagattaaaacagtggctggcacatcacctcaatagaggttacctattcttgttgccacttagcctcatatgtaccatgttttacttaataccttcattgtcctttaagtattcggaatgagaattacagtgcttcattcagcataagacttttgttcatgctgtttctttggcctgaaatatctatcccttcccaattgcctaattaattcctatttgtctttcagatcttagctagttcatcacttcctcagggaaacattccctaatttctgtcacagagtaagacccgttgttatacgtctcacctgaccatgtacctctacttagcatttaacacgtgtaattttgtatgtattggtttgattaatgtcagaaccactagattgtaaactccatgaggaccggaattttgtttctgtcattgtcattgttcaactttgtattttttatgcctcatacagtgcctggcacatagtaggtgctcaattaactttattgaaagaataaaatgaatggatgaggta

SEQ ID NO: 3861 - DNA, 1876 bp, Homo sapiens
aaagcctgcaaaaacccaaagagttcgtggcgctggtggctccagctgttagtttcccgggcagtctccgggttggatttgcaccctggggtctacacgggttaaaaacgcggaaaaaaggcgacgaagaaatacaaactgccagggtgtcgaaatgaaaggagcgactgtgaaaggggtaaggaaaaatccaagccatctctacggggaggatccagaaagcaccagccgcgccagggggtcaaccaactccgacaccgctcggcgtcagctgggcgccaccaggcgcggacttcggagcgagggcaggtgcgcgggccggaagcctcgggcgctcacctggcacctacctggagctcacctggcgcccgggccccgcgccgccgccccccgcccagcccgccgcgcccgcacctcgcggtccttgaggcccagcaggagcacttcctccatcagggtcagccgcgtttccttggagtcgcccttgtcgtcgtcgtcctgctcgtcgcggcggctctgcgcgtcgtcctcgctgctgccggcgccgccgcccgccgcccgctccttgtcggcggcgttgcgggaggcctcggtgcgccgctgcaccaggccggagctgcgctgggtcagcgaggtcatggctcccgccgaggcgccgagccgggccgagagggtcgcaggaccgaccgggtcgccctcctcctccccgcgcggcctccgatccgggtttccgtgttaaatccggacgccggggcgacgtccgtcggcagcagggccgggggcagtcatgaggaaacaggtcagggcgaagcgggctggccgggcgtcggcggggcaggagaggagcgccttcctgcctgtggccgcagtccccgaaacaccccgagctccaaggcggaggcggcggcggcgcctttccaatatggcggccccggctgacgtcaccggaggatgtggcagagtcggcgcgggagagctgggccgggaggcgccggaagcggcggccggggatccgctgccactgcagcctacacccttcccggccctcggtgcttgtcttttctttggcgttcctgcgccccctgacccgcggtcctgcagtcctgctcccgtgacgtgccctccctccttccgttccccgtttccccttcactacccagggctggagcctgaacctggcggggccccccgtgaatggaagagcctgggccacgcgaaggtggaccccactcagcctccagccgtgccctccacgccccagacaccgccgtcttcggaggcgactccgcggtcgtgtggacggggtcccatttggactccggggtctgcaggatcggcaggaaggactttgctctctgctgctgggcggggaggggtacgctatctgccgggactccctaaccctttagaaggagcaagtgcgtccaaatggtttgaaagtggacctttattgttttccaggagtaagaagatagaacagttgaccagttttgtttgtaaaacttctttccttgcctcggacttgtgctataaagtgaccagggcgtagtgagtacagttagtaccgcacacgttagcacgctcgaccttaacgatctttttatagagacaataaacctgcagcgtttcatgccacgtctttgtacgcatcggatgtctctccgtgtagttactaggtgaaatcctcttggcgtgcgcaaattaggttaaaaaaatagctgtcaaacctgagacaggagttggaggagtagagggtggcgcttgttaagtgaaacatttaaccaggaatggtattgtgtgccatcctgtattaaacaatgtatggacagagtggaacaacagcaaagcaaaaaataaaaattttttaaaaaaagtg

SEQ ID NO: 3862 - DNA, 2751 bp, Homo sapiens
aacagtagctttaatgaattaatgcacaatattttgaaaaatctttgaccttgctcataagcagatgcctgccttgaagaaacactccaagtctgccgtgattccgagcgaaatgccaaggcagagtcaagacaatcattacctttagggctgaaacctgggcatgaggctgccccttctgggatgcctcctaaccagtctgatgtactggggaaggaggagtgaggtggggtcttcctcgggtcccagaagctgaaaacccagcccttcctttgccatcagttctgtgccaaggctggaagatgctgctggagtgcagggcttcccccgtgtgggtgctgcagctcacacaggagcttggtggaggaatgaaggatggattctgggggtagccggaggggagggggctcactgggagcccagagaacatggctggacctccctgtgaggagccagatggtgtcgcagccccctgtgggggcttgagcacgtggagcaggaaggccgaggcctggaaccccaagaactggtcctcagggttggcaaaatgtaccatgcagaaccaagagaggcagccactgccggcctgggccacagagccctgcctcaggctgttgggatataagccgcctccagaaggcagagcctgctgtccatcaaccaggcaggctggtgggcttcactcctgtttccaacctggattgtgatcactggccccagtacttgttagttgcatcagctacagccatggtatcaatccacctggtgtaaacgactttcaggagcctctggtttttaaagcacaatactacctgccatggttctaagaaattacatggttatcaaaattgatcttaataagctccaaagtatgaagcagggccaagggctgtgatcagacccagtccacatccctccccttcctcttcctagatcttgcaagatggttcccttgtttacaactccactggatgatcccttttatagccagcagctccctagatgcaactggtgactggatgtgaagatggctaccaccatagactgtaagagcctcttccctgaaagtgtcttccttcaccagggcctgccagtagagaaatgcagggggctttgaacctcagctccaaactctaaaatgccttgccagcaacgtgattggagcatactgctaagtgggaatcaaagaagctggaatttcacactgattgcaggaagagtggcggagaaggttctgtctcagatcaggagtggatggttgggctaggtttctagcagcctttaagctccctcccttagaagcttttgttgtctctcaaggagagacacctctgcccagccctaccgttcctgagtcgtctttcatctgggggagaaaaaaagatgtgaaagatggaacctgctgttctgtttcagcacagcaggccatgaagacagaaggattcggtgtggattcttcctcccagcaaagggtggtcccaggaatccaaggcccttgagaggtgggccaccctcgttcctctctgagtaggggagggggcttctgttctcagatgttgtttgaaaatctccgagtaatcttagaagaagacagatgtgaggtgcaagcaatcctttcctcaggggtgtcttcgccactcatggataaggtcgtggcttagccctcagaattgaatccaggctgacaggcagttgacacatttccagggtgtggaatttgggcaccaggtttcagccacaattctgctaggcctgggtgtttctgctccataactccaggaactgggaaccctgccagttgtttgttgcctgaagttcatcccaccacactagagagcaggacgggattcttctgagcagcaagatggacccaatcattgcagaacattctatgggattccaaagggaaggcttcggggagttgctgtcatgtgcgggccaccagcatttttagagtgagaatgagaggagatggtctggatctgcgagatgactcgactctacggtctgtgcatgatcatgggggaggtaccaggagcaggcagctggggatggtccccatgtggctcccaggaacatgctctcattttggagagcagaccaggttttttgtgaataattcagtattataaaagtaggaggcagtttctcccaccagttcaataccagctgagagcatacttgtttctcacgggttagtatctctcagcaatgggggactgttgcattattatcatgtgcagaatgtccaaggtgcttcctcgtggggtatctggagagagaccaattcacatcctgtgctttgggggcaggtgtcagaaaaggtgcaggtcataagcctgggcccaagggaatgtcacagatgggggaggttcctttatccaacagagaacagggagatgacctccagggtagctacccaggccagggaggcactcctgagacagtctctgagctggcatcaaacacctacttcaaaatgaccgatgtggcataaacccaacctaaggggtcatgacatacagcagattgagcttttagacgtttcctgcctcagtccattagggctctctatttagagttgccagtcatgggggaggtaggggaagttctctgaactcaagttgcacatcactaatggctccttgccaaagccacaggaatatccctctggaaaagtgagctgtgacagtgccaggtgtctaatgactgttggtggaaaatgcagtgaaaggaaccatgccccccccc

SEQ ID NO: 3863 - DNA, 3894 bp, Homo sapiens
ctcatcctggctgctctcaccgtggcctgtccagatgcaggagctcctctctgaatctggggctactggcagaaccagtaaacacggagttactcctgtactgagctgagtaaaataatctgactgagaggatgcgctgacctcagtttcgacaactgcgtttggtaccaagccctgcaagggctccacggagcagctttgggggagacctgcctgcaggaacatgtaccccacggagcagctttgggggagacctgcctgcaggaacatgtaccccacggagcagctttgggggagacctgcctgcaggaacatgtaccccacggagcagctttgggggagacctgcctgcaggaacatgtaccccacggagcagctttgggggagacctgcctgcaggaacatgtacctcacggagcagctttgggggagacctgcctgcaggaacatgtaccccacggagcagctttgggggagacctgcctgcaggaacatgtaccccacccgacacgtcctgggagcctcgtctgaggtacaaacaacaggaaagcactgatgcatttttcaaaatccagcaggagggaacggtgggctgtggatgctggctgggaaagctcctcgggcacagccctgtgggcagggaggggaggagggctcagcccccacacaggccgcctggcaccaggagtcacaggcctcagccgtgggatgtccccagagttccaaccgccactcttgcagaagcagcccagcagggtgagggtggggccacatggggctcagctgcaggagggacgccaggtcctgcacttctcacccgcagtgaccttgggcagggcattcattccttgggagaaatttcctcgttggtgaaatgaaatcactgcttggcttcagccacataatgttaggcacgctaactgcagcctaggcaacctcagaccctcaggaaatcaacagaggggtgccagctccctgcacaggtcccggcctaactcgggatgccactcagggccctcgtcttcccatcctgtggctctgtcttcacaaggccccagaggtgctcttgtcccttccctttcagtccctcagccagtgggcagcacacggccacccaaacacaagaggccaggaccatggacagcagggagcacagagcccaggcctccgtgatcctaggaacacgcagcatccgggaacacggaaagtaaagatggagacatggggcgggaggaagctaagcagggacacagtacccccttgcatcacggaaatgcctggccagagcgacctgccgcaagaagccagcccagctgctcctgtccctgaaatgtccggagagagggccagcagggaggctggcgcctgggccaagagaggggctactcagttcttccagaacattccagtgtggcccatggacaccggccttctgatgtccagagaggggctactcagttcctccagaacattccagtgtggcccatggacgccggccttctggggtccattctgtcctgtgtcacttcagttgatgagctgcttgagaccagaactgcccaaatccagaaccgcccactaccttctgtgaggctgtggccagaaagcaagccagacttctgaagctgcctgggcctgtcgggacccaggagaatctggccgtgaaggagaataaaggaggaagccaggcctggcacagggacagggtggggacccagtgagatctccaaggaggaagccagggctcctacactggggctgctgttctcccggaggaactccacccaaggagagtctgggattatcatgagagacaggaccgcatctgtgcacagtgcagtacgtcaggtgctggccaggggccgggggcctcagggaggagagtcacccaccaggccaactaggacagacgaaacgtgagtgcccctacgggagaaagcaaagctgagacagcatcgcgagctgagggagaaactgacagacggcagttcaccaaaacccaaaaactggtcattctctggcctttaacaaaccaaagtatatttctccctctgaaataagaaacacaggacaattattaagttccaaaagtacgtttcattttggaggcatgttgttggtcccctttggaatcatgaacccctgtgagcgaaacacctcccaccattgattctgacagggtacggcgggcagttcccggcccaggtagaggcagacaggtgcagagccacagggccaccactgcagagtctggccttctctccagccccgggtgcacccacggttatcagggacccagcactgcctccctgcacgcacatggctctccaggccaccactgcagagtccggccttctctccagccccgggtgcacccacggtgatcagggacccggtgctgcctccctgcacccacccggctctccacagcagcaaacggggtacattagggtggacgggatgtggggccagggccctgctagggctggggtggactgcggagggccggcaccaagcagttccaggtgtggagggcggccctatgtcagctgttagacacgcaggggaggcacctcagatggctacaggtttgattgtgtccccacaaaaatccatatgttgaagtcctaacccccaacactgccgaagatgaccttatttggaaatagagtcatcaaagacatcattggctacattaagataaggttatactagagtagggggacacctagcttattatgactggtgtccttataaaaagaaggaaactggacacataaagggagaatgccataggaggacggaggcggagatcggggtgaagcttctctaagccacggagagcggcctagaaccgacccttccctcacagccctcagaggacagcctggaaccgacccttccctcacagccctcggaggacggcctggaatccactcttccctcacagccctcggagggcagcctggaaccgacccttccctcacagccctcggagggcggcctggaaccgacccttccctcacagccctcggagtgcgacctggaaccaacccttccctcacagctcttggagggaacccaccctgcccacaccttgacctcggacaggtggcctctagagacctgtgcagtgagttcctgctcccagcctgtggtccttccatgtggaagcaaagcaaactcctccaggcacattcaccgccattggcatgggcctccgacactgaccagggcctcccgtcacctctgcccctgcccaccactccccagcccaggtaccatgctgtaaaaacagcctcaaaaagaacatgaggtccacagctcctccaggagactgggccagccccaagcacatccagagaggtggctcctctgactggaggctcacgccaaagccacacagagacagctgccattctcgctcgctcatgcttcccccgagcctaaaccctgaccagccagctctatacatttacatctttttctggcctcacacactgtctagaatgtccagtcgaatgttgagaagtcgtggtcaaagcagaaagcccagctttatccccagtcttagtgggtacgtgtttgctgtttcacgttaagatactggctggcagtggggcacagtgactcacgcctgtaatcccagcactttgggaggccaaggtgggtggatcacaaggtcaaaggattgagaccgtcctggccaacatggtgaaaccccatctctactaaaaatacagaaattagctgcgtgtggtggcggacacctgtagtcccagctactcgggaggctgagaccggagaatcgcttgaacgtgggagcagaggttgcagtgagccgagatcgcaccattgcactccagcctgggtgacagaacgagactctatctc

SEQ ID NO: 3864 - DNA, 2785 bp, Homo sapiens
aggtccacggaggagtgacttctaagcaagaatctgaaaaaaatgaggatatctaaggagggaacaaatggttcaaaagccctataattgcaagcaggcatgatgaagcaattgtagttgtcctgactctcaacaccgtggaactcaaaggagatggaaagattctttctctccctcatatattttctctctgtctatatatatagaatatgagacatttccctaatcattatgtgtaattacaattacatatatatatgtatgtaatatataaacatatatatgtaattgtaattacacataatgattagggaaatgtctcatattctactcaaaaataagcaatatagcaattactgttttttacattttacagttacagtttcagagaaagctttcccccactcaaggattattctaatgtcagagtagaataaaaaataagtgcagcgatgctgactcttccaagcttaacatttctcacaagtcaattagctttgtactgggaggagggcgtgaagggctgcttgcggtagttgtgtagcagcagcacaatggccgcagacaaggaaaacagtttctaggaattcctcgtatataattttatatttttgacaagattaatgacccatgctcccttcctctccatttctttttttggaattctgttggtatgtagttactatattttattaaaggaaattagccttatctcttattatattttattaaagaaaattattatattattcctttatatttttattaaaggattttattattattaaaggaaattagccttatctcttattatattttttatgaccttcaaagtagtgtctctgcttaaaagtgtaccctggccgggcgtggtggctcacacctgtaattccagcactttgggaggccgaggcgggtggatcacgaggtcaggagatcgagaccatcctggctaacacggtgaaaccccgtctgtactaaaaatacaaaaaattagcagggcatagtggcgggcacctgtagtcccagctactcaggaggctcaggcaggagaatggcgtgaacccgggagacggagcttgcggtgagctgagatcgcaccgctgcactccagcctgggcgacagagcaagactccgtctcaaaaaaaaaaaaaaagtgtaccctgaagcacacatcaagcgacatgtagagttcataaattctggccaaatggtcatacctcaaacctcatcagcagtaaggctctttacttgcactgacaaatatgaacgctggggaatttggaaatgatatataatataaaatattatatatataatagatatataatatataatatatataatacatatatattatatatgtaatagatatacaatatataatatataatagatatataatattatatataatagatatataatatataactttccatgtgattttcctcttaatttttttctagctgatccatatgaattcctcttattaagaaaaataaagcatccaggattcaatgaagaactgactatcaccttgttaatcattcagaaacatgttgcacgcttaagccatttttgatatagatactgaaacaattacttgctaagagcaatcttgaaggtatggataaggccctgagtcatcttcctgagctgaatgatagttaagctgaatgtacgtataaaatatgattttctaaccacttgctcgccaacaaggaaaacttttaagtagagcagaacctgaatagacaagacatttctttcttttggtagaaaatgatttaccatcactgtgtagttaattgtagactaggtaattttaactttgtgatttattgccggagacattttcttctgtactgtaaagtgtgtgtcaaaaaaaaatagcgattttggaggattaggggactttgataaattgcctgcaattctggcagtatgaactgcatattaatttctctctgtcaagaacatttttatttattaattccttacaaaaactccctaaactttggaacagctctcaattgcctgtattcttttttttcttattatggtactcttctagagatttggcttgcatctgtgaataagccaggacatcttcagaaattgtctgattaaaaacaccaccaatggagtttcattaaatttgtattgctctgactagtgaaacacacacatctatgttgctgaggatattttactgcagttcgagttgtaataatagctctgtttaagatccgtcagtcacttgaatcttctctaaggctttgtatgttagaagttaatttgctttcttacaaggccacattctatcttgtaactaaacaactgaattttatgtcttagcgtagatggtttattactttctggtttttctttagtaagaatcctataaaaacactagtatttttctctgagtttaaaattcaatacatgcctactgatatggttaggctttgtatccccacctgaatctcgtcttgaattgtaatccccatagcccccataatccccacaggtcaagggagagaccaggtggaggtaattgaatcatgggggcagtttcccctgtgctgttcttgtgatagtgagttctcacgagatttgatggttttataagggattctttcccctttgctcggcacttcttcatgctgccttgcgaagaagctggcttgcttcctctttgtcttccgccatgattgtagatttcctgaggcctcccaagctgtgctgaactgtgagccaattaaacttctttcctttata

SEQ ID NO: 3865 - DNA, 5273 bp, Homo sapiens
aggatgctgcgaggcgttgccagcggagggaacctgccgccgcctcgtccccctccaccctcggagcccggccggggagtcgggcccgggccggggaggaggaagttgcggcccagctgggacagcagcaggtgggaagctccgcgcccggctgttgcggctgcctgattgcagcctggccttgggcaaagcttcctactccgtctggagccccacacacttcccggttcccccgctcttgggccgcttgccctgcgtgctcctcgaggggcctgcgaggtgccagcgccgggtagagacctttgccgcaggggcaggattgttcgtcggtcccggcgcgtctccctctccactccctctctgccggagcccctcggcccttcgaagccccccgcggaggctgcagcgcccggagaagccactgagtcaatggggcgagggactggggcgggcgcgcagagcccccaggattgagacgcgcgcaagtgcggccactgcagcgccgcttggctgtttgttctcccgactgttcgcgaattacttacaaggcgcctaggcttctccgaagggtggacggctcgttccctctcgccttgtccgccctcagtctctccaccaccgcccggcacgctttgctgatctaaaatcagaacaattagagagtaatgattttttttggaatagcaactcctacagacactcagatctgccctcgcttcagcgcctcccagccctccttcccagcagccaggcgagagcgcgcagacccctaaaaagcaacttcagtgttaaccgggtctggatcctggaactttataaactaatccgtgtgtgtgtgtgtgtgtgtgtgtgtaaaccgaagagtaagtgcctattatttctgagtacttcggtgtcctaacgaagctttgctcctaaaggacaggatatattttaggagtctttctttccactgagttttttaaatgtttattttctcgagcgatcaaatgtgtcttttgtgcagtttatttaaacctcgtaaggcctccttgagtcgctgaactaattcagcaaactagctggtattgtggacggcgcagtcggggtggatttttgtgtgtaggagaggtgaaactgacaattcaaggaaaggttctgtgcgagtccccacctcccatcctcatatccacacgtggcccctaggaggtgctggtgaaatatgcttgcttaggtttcgcagatccgcacttactcctgccttaacaagtgtgccttttttcttagcactgagcaaggtacttaaattaaaagggtgtgcaagagatgatgcactcggtgtggctgctctgatagccaaatggcgatgtggtcccagttaatgtgttgagattatactgttcaccaagccctgttacgaactctgttgccatgcacgtgggaataatgcctgccccaagggaggtcttctttaacatctatttagtcatgtgttatttataaacagcttgaattaatactgtaaaatagacggatgtctaagaatctaggctgtagcctaaagctaaatgaacctgagggtagacaagttcactctgtattaaccaaaggataatgaatgagttcaccgctcagttcaataagcttcttctgaaatatgcttcctcctggacttctaagaaacaggccaaaagtttaattatcccttaaaacatgttaagcctaaatagaaaaaggaaattaatcatttatagattttctcttctttattatgattcagttggtgcatctgtagatggctaagaattttccaaaccacgtgaattcagagaggcaacacttttgttgttgttgtttttccaggtaatgagctcgctttgaaaaccagtcactcggaaagggatggcatttttatgcaacttggattgaaatggttttgctttagtattctactctaattagaaagaatacaccacaggccgaaatagtttcatatgataggaaaatctttaaagaaaggaacacagagttattagattatggttggctgtataaatttagctgggcagcgggaggaaggtcataataaatgtatcctgctctctctcatcaattatcagcagcacatcccccaacattctctcctcccaaagactgaaggatgtgcagcaaagcttagatcttgaaggagaaggttcgggaaaaattaatgattttaattagaactttccaatctaagtagaatcattaccttaattagctaaataaggaagtatgaaggatgaaattttgcaaatgaaattttgtaaatgtatggtagcgtagaatacccccattgcttcattttaaaaaaagaaaatataaatgcattttaattaataaatgacttttcatcatgtccctattaggaaaattctgtgtgccaatgctttcagtgtttgatttaatacatcttttgaagtgatgcgtgatgcagatttctgtattcagagtctatcttttttggctgaatcaggccttatttagcaaaaatccccattagtcttggacacgaatgcaattgggtgttgggatccatctgtggattaaatttttccaaggaaatgacaattatgctcttactgattctctccacggtaaccacctataatattagagccaaatattagtcacaatctggatctgcagtcagattgtgaatagctgtgtgacgcagaaggtgattgtttcactagaagcacagatctttcctttgcatttatataaagatccccaacaattagacatactttcagacttacattaaccatgtatatgcagttcaaattcacaatggtaaaacatcaaacgctcctggcatttgtatccactggatattaaaaaccactttctaatcttcaaagtaatcatcattagcaataaatagtaaataaatcattgtcagattgcccggaaatgtagacaggctgagtttgcaatctgctgctatgagaacaagccacttactgtggtattttaaggcactgtatgtaatcttatttattggaaaacagttttggcctttagtttcacttactgcattgataatatttaatcttcatatttttaaattcagtgaacgtatttgttgaaataactacgttgtactttggctatatgctaggtgagatgaaagacagaagtgtcctagcgggagtaattcctcttcttaagagttcaaaatgtctaactgagaagatgaacaaggcagaagtgaaacatttaaatgattaaacaacaatataaggcagcttatgattatgcactaaaatggatcaagcaacaaataaaacgataatcttagattttgaagaatggaatgaagcagggtaagactttgtaatggaagatttaatacatatgacatattactatgtgtagtggtattaaggatgctgagaacacgtcagaagataggagtggctcctcattcagttaatttcttaaatgcctgctatgccccagacctttctatatacaggtaatcaagcatatgaattataagttgtttctaagaataaatgtcagttacatggaaatgaatgaaaggaacagtatgttttagtataacttttgatgattactcaatatgattataataaacataagctatttcattttttacctgcaatacagtaggcctatcaggttacagtagagccttttctcctgcattaaatgaccctagactaagcttatttaagcccttctgcttgttttcccttctccatcaatgtgagccttccgttctcatttttgcttctgataatgtgccttgaatctgtcagactgtcaccatgctctgcctaatttgttgattctaatctgtgctgggctgataaattatgtaaccaaggttgctaaagtaatgtacaagcaaatatgatttaacatatctaaagatgcatttttgaaatagtatgagcagatgctgaatttggagttaccttcgcttggtcaacctcctttttgggtaaaaaagcttcaggatttggatttatggcatctattttgcttctcagagcatttaaatggcttagtctttgtatttgctgttataaatagctgaggaaaacttctgagtaagtgagatacccgcgtgtttgcaactatccatatgtttatatgtacacataaaatcatgtactgatgtattgagaaaatatttcagtgcttactttatccgtttattattatgacctttattttccatcaaatatgttaaaaccaaaatcaataagtggggctgttctttaagaagctcacacttccagagcctccatgttattatttagtaaattacctattctgtcatgctctggaagacttcatttatctcacatgagtgagacaattacactctgaaaataccatattcattttagggccagaccctacattactatgtttcttgattcagtgattacaatgatcatttcatctgtgttttctgggatacattaggtctcccaaaggtaatgagtttacagcctcggtttaccctctataaccacggatggcagttccttagatcaggtagccttgccgtaagtgcacgtcattggttagaagaggtgccagctgagaaaacatcaatcattatgcacagactcatcactgccactggggaaaggcaagccttataactggaagggtgtagtatcatcatttaatcatagtaatcaagcagtaataagaagactaataataagctagcctctacggagggttttccaggaaacaaacactgcttttgtgctttacaggatgtgctattctgatgttctgtattgcacgtacatttgcatgggaaaataatgaagagagggaagataggaaggaaggaggaagtagaggagactagaaaatattcattagaaactattggttctaaaggagacacaaacacgttcagtagccactagggaaagtgagactgccaccagcatccatagtcaccctctacagcacagtaagaaatgctttccagtgagaggtgccaccattagcaaactgaatctcatgtttaaaacacctgtaagaatgtctctttgctttagtaatacatctttggaagatcatgagagtcatgcaacttgactttttccagaacttataaaaacaaaacaaaaaattaaaacaaacaacacaaacttcagacagccaaaactaatcactattgtagatatttatggaatatgccacaagctacgaggaaaatgcaaaacatattttcagtaacgtcaacaacactg

SEQ ID NO: 3866 - DNA, 4752 bp, Homo sapiens
gaatgactgacagaatggctttggttcacctgtaattcacagtttagctgatccagtgtactgtaaagtctgtttcactccaccagccaacaaggagcaggcggccgtggttttctcatgttctgggggaagctgtttgtcagtgttaacctggctaactttggacagctgcaacaacaacatctatcccttggcatatggtgtgtttagatgctaaacactgcctcatcttcttagaaataattgcagtgaacaatacaggtttgagctgcacaggttcacttctatgcaaagtttcttccactgctgccacccctgagacagcaagtcctactccacctcttcctccttctcctttgcctactcaacatggagacactaaggataaagacgtttatgatgatccacttccatgctggaatccagaatgcagtggcactatcctagctcactacagacttgaacgcgtggtctcaagtgatcctcttacctcagcctcctgagtagctaaggctacagagttttgctctttagcccaggctgatgtgcggtggagcgatctccgctcacccgcaatctccgccttctgggttcaaggatcctcctgcctcagcatctcgagtagctgggactacaggcacctgccaccacgcgccaggctaatttttgtatttttagtagagacggggtttcaccatgttggccaggctgctctcaaactcctgacttcgtaatccatccgcctcggcctcacaaagtgctgggattacaggcgaataaactgtactgagccacagcgcccggccaggatctgatgattttataaggggcttccccctgcgcttcgcactcactccgtcctgccgccctgtgaagaaagagcctgcttctcctttgccttctgccatgattgtggctagtcacggtggctcatgcctgtaatcctcatcactttggtaggccgagatgaaaagactgcaaggagttaatgaccagcctggacaacatagcgagaccccatctcaagaaaatattcccagcttccaattgttttgcctagagactttaaggcctatgactgccagaatgaaagattgttacctcttttcccttgcttattaagatggccagagggtgtgatggctcctacctgactgatacaattgaaatcaaagacttgccaagttataccagcaactccagcaaaactgtgaacttactggccttggaggactatggattgaaacacacaaaacatctttggctgtgcatgcccttcacactggctgcctagtcccctcacagaagattgtaccatgtggtagttggcgtaagaaaccattgtgtatatgaattttgtcatgaggacctagtggtcagcactcttgcacattacagaacaaggaaaatatagtatttataaactcttcagcagtccctattagggagcccaaattcaattcacctaaacgggaaaagtgcaaatataacaaaggattagatcagttatcaagctaaatgaatcctaaagcatattgccttctaaactaattttattcaatacatagctttaagattactatgtagatggactttatttttttcaattagctttgtgccactcaggaatacaaaaaatgtttcagatatcttttttaatccattgtttgttcccaaatatatataaacttctttcaattttaagctataattctgttgcacactgtgaatataaagtcagctgaatcataatgtcttgttcatccagcttctgtgaacaggtagacattgactggaatctttccaagcccttggaaatggaaatttttagctattggttaaggcaacactctttgcatctgaagcagtgaatacgatgttaatgcttaagctatcttaattttccaaatgctaatggcatagttgaaagtgttaataatatgactatatcagatcttgactttaggggggcttaatttatcctatccttgagcaaaccatctggcattgctaagcccaaagttgcctgggcctgtgtaacactgggtgggttttaattcttttgtctagcctagtaaatcattcaatatggttagtttttgaatgccagcttgttttcaaaactgaaatattaagagctgatgatataaaccaaaattgaaactagaagaaatttctccttccttattttacacagaagtgggctggagctgctgcaatcacggggatgtctgatattgcaacaaaggaagcaaaacagagctaaatgaatcctgtgcaatgaggaggcattttcaggtagtggccagaaactagaaactgctcttttctggttaaaaacgtttgtgacccataaaaccttctcactgcttactaaatagcacagttctgagatacaaaccagcaaatttacaaatcacaatgcttttcctgctgaatcaatagctgtagcaaatatatatatgtaaaatgcaatggaaaaatgaagacctctttagaagcctgcagaaaatttatactagatatgaaagtttgagcaatcacgtaaaagccctagtcccttaacattgcttttaaggtcatcagtgtcctggacgttggtgacttccctgcacccatttcttcactccccaccttgaacttcatgtttaactcttatttcttccagtacttagtgaacactgtcttctctctaagccttttcctggaggaacattctcttgtctgacttcctaagtctgagttaagtggtctcctatgtctcctctaataaacttattttaccctgtcattattcttagtgcacttatttaattccctgtttactagcttatcctgcttctaggttacaagctctggcatatctgttctgttcaccattgtatcctgaatgcctggcacttagaaagccttcaataaatacttgttgaatggcgttcattgcagaagcactaaagaatttttgcatgtttttacattaagaaaaatcttagtagcaggatcagatctcagtcatatagtacactcagttgtgcaaacatgattccggtaatttatattctttaaataaactgaattttaattccaaactactatttcactaggatgtcaagaaatttcatctcagtcatttaggggccagatccttccctgggatctcacagaaccagggaggtttatatgagatccacgaaatggctgaaagggctccactgtctttctggtactgctcctagtccacgcatgaggaaagaagccctgtcaatctctgctcctaagctacacagggtttcaataatctgagctgcttctgggaagcccctgcccagagccctgtcttcctagttattcctgcaaggaatttgctctgaagcctggtcactgccacgccttctccagttcaccctaccttcatcaattctgacctcttttttgatcttagaaaaattttacctcctccacttccttctcatttctcccctgaatgtaccctccccctttcattggcacttaacctttcaaaataggacaggccttagaataacaaatgccaggaaggcatcttgttctcaagccccataaatctcgggcaagaaacataaacgtcatggataatcagttacaaataggaagtggaaggaaatatacagagaacaaatatccaaaataatttttcaacagagaagacaactacaaaatcctgctacttctcgatttccttatgtaaagatttggccagatggcccaagatgttaataatgttagatacaggattggagatactgcagatgggcaaagatcacaaccacttccctcaggcacaagctaaaatgggtaccagcttctagaagcatttggaaattaacatctaaaacacactgttttatttaaagtttacttttcctctttttctttctcttttgtatttatatatacacacatatatatcaatcatatgtgtatgtgtgatgtttgcatacaataaacttacatatatacatgcatacatatataatacatgttatatgtaagtatatagtataacatatttattttgtatttgtttattgtatattaaattatatattatatttatataatatatatgttaataatattagatagaatttgtatattacataatattgtatgttatataatgtgaaaggaaaatatcttgtgcccccaaaatcactaaggtaaggggaaaattcaagctaagaactgcttagggcaaacctgcctcccatgctattcaaagtattccctttgctcactgagataaatgcataactgattgcctcctttggaaagactaatcagaaactcaaaagaatgcaaccatttttgtctctcacccacctgtgacctggaagccccctccctgctccaagttgcttagggaaaaaaaataaaaattaaaaaaaaaattaaaattcagattattacatctgtgtatctctttgtatgcactttcaaagtacttatgacattgagttacagggctttgactcttgggtccacaaagggacaccaagtcctgctaaattttaaacactgacagcaattaaagccccatcttcaggcccagtacaagatgtcaatcaaaataaactgcattcctgaaacatagagccagaaattaaagctattcaactcctcaaggcccagggactatcatggaaaaggtgggtgtgtgagaatgtaagagtcaatcctgagttcagtttctctataaattaatcattaatg

SEQ ID NO: 3867 - DNA, 589 bp, Homo sapiens
gatgaagtggactctgttatttgtgtctttctttacaagtgaggaaatattcagtcagtgtgctggaaagttctacagatttcgccatcagactatccattcctattcttgaaaaatctgcagtgctggagttatttgcaattcccccccgccaatctttaaataattgtctcagagatatagatagatatagattgcccacgggtgatttttttaatcccggttaccacttgtaataaaagaggttgaattttggagagaattgatatttaaattgcatgtttttttttctgtattataattatgcacattgatttagttttaaaattagtgaggttggaatgttagtattttgatttgaaatctgggatctttggaggtgatttaagattatggtttggtaagagaatcttcattttctctctgggctaaagagtaattgggagagtcgtttaaattgtggaaaattgctttaaatttccattattggttttatttctgttacagataagaactccattttctgttgatgtggagacatagggtacctccaactttccggggtttcagaagagaattttttattgaa

SEQ ID NO: 3868 - DNA, 3245 bp, Homo sapiens
actctaagacccgctcttggtaaagtttacgtgaactgagatcctcttcacgttgagccatcttccctgagccttttccaatgccagaagaattcagattccataggaagcagggaagactgctctcaggagaaggtgggaggggagaatgtagtcttaattttgggaatgtcttggggattccttcccccacttttttttttccttgagcccttgctacttgatgatatgaagccacagtgaattagcacccagaagccttcccttctgtctctagaagtctttgccatttatgaagataaaacccttatatctcatttgaggactgtcaaatatgcccaaataacagagacttaaacacatagaggtttatttttctcatgggacatgaaggaattagggaacccatgtccacggctgctgctcaggatcactcatccatccacagcctggggtcctctggctatctgtttcactatccccagatcttggctttcgcttcatggtcctaagaagcatctacattctgagcagaaaaacagggggcagggaggacagagagcaaaagacgtatgagagatggatctatccctttttcaagcaggaaaatgacaacttttctagatgcagtggctcacgcctgtaattccagcactttgagaggccgaggcaagaggatcgcttgaggccaagggttcgagacctgcctgggcaacagagtgagaccccctatctctacaaaaaataaaaaaaaaatctagttgggtgtggtggtgcactcttatagttccagctacttgggaggctgaggtgggaggatcgcttgagcctgggaatgggaggctgcagtgagctgtgatggcaccactgtactccagcctgggccacacagcgagaccttgtctctaaagaaggaaaaaggaaaatgatagcttttctggaagccctacccagcagatgtgtacttatttccaactggctgacattgtatctcatggcaattcctagccgcaagagagtttgggcaaatgagtattaattgggcacttcccgaacctaacaaaattgggaccctgttggcaaggaaaaaggggagagttccaaaattatacagatcttgaatagcaaatatggggagcaaaaccaattataagcctaaaatatctatggtagccataggaagatgtgggattttagagggggcttttatcaattgtgttattaacaggtaacatacatacaaaaaggtgagctcaacttagggatacagctggatgcatgttaacatatctgtacatttgtgtatgaccacccaggttgagatgcaggccattttcagcaccctagaggcccttttattccctctcagtcagcaaaccttccactcctaagataaccacttttccagcttctacctcttttttttatctatttattttatttatttatttatttatttatttttgtgagacagggtctctgtagagtgagtgctcatatgagcactcccaggctggagtgcagtggtgcgatcttggctcactacaacctctgcctcccggtttcaagcaattcttctgcttctgcctcccgagtagctggggttacaggcgcatgccaacacacccagctaatttttatatttttagtagagatggggtttcgccatgttggacaggctgatctcaaactcctgacctcaagtgatctgcccacctccgcctcccaaagtgctgggattacaggcatgagccaccatgctcggccttgtttctattttctttgacacaagcactgtttatcttccagtgtaagaacgcaatcaaccatagcactgtgggatagcagccaggaggctggctgtatcctgctgcagcagccaccacacatggagggcggagggacagccaccctgttgtgtagctcggagcagctgtgtccttcagtgcaggtccagccaagagccgtgggccacagatgacgctggtggggaagcagagggcagactaggcagaggcaaggctttcctgtgccctgagctgtcagagatgggccagggccttcagcttcctcgatagggcagaagtgaccacgctggctccattcagcaaaggacgtggacggagctgccgggcttgtctgagaggaggagaaatgtggaattgagtgaggctctctaagaaggttctgctggagttgagaaaaattagggtgaggcacctccccgattttatgtcctttttcctgggtccagcctcctgaacagctaccattcgcttctgtgagacacctgtcggtgcctccttttccagcccttaatggaacgttcctctcccagccacctcagacttcccataccaccctccctggacaggaagcgtttttacaggagtttgaagcttcaggagtgccctccggccacatgaagacaaggcgctaacaaacatggcgttctgcaaattgcaccatcgccaactcctgtcttactctcacagaggtctcttgggctcttctgagaaggtttaggataataacctgtgcagagagagggtctcctgtcctgaagtcacagcccggatctccaggctggctctgctgcctctgaatgatttgtgggtcacacacgccaacagcatcgccaagggctgacatcagcctgcttgagccacggaaactgaatgggcaaggatgagttccccagcacagagggaggcatcctctgtcaagaccatctgcgcatgtgctgtgcagtctccagtctgcactgtgagtgtgtctcaacggcttttgagaactgcttcgagaggggaccagatgcgcagagacaagcttccagcctggctagggacggaccctctggggatgctcctctctggccgggcagcagtagaagcacctgcctccatccacatccagacgccattcccttttcttcaccgctgcttcccatcagatggtccccaggagtggcaacctcccacttggtctcgcaggagtcccagtgcttctcaggtgtgtgtgccacatccctcttctctgaacacacagtggtcagggtgcctgcacagggaagggcaccacagtccaccctgggaaaggtcttcagtcttcgggaaagagcctgtaagcaccttgactgctcttcttctctagggcagagagctttcttatccacaggggtccttagtcagagagagggagcgcactcggtgagctctttcagaggcagcagagccctctgcctc

SEQ ID NO: 3869 - DNA, 8839 bp, Homo sapiens
ggaacctgctgcaggcgccggcgcgggcggcgaggacgacctgtttttctgacccagcccggaagcgctggtgcaggccttgagcttccttttttcttctcgctgtggaaattgcctggaaagctatgaactgttggttcttgaatcagttggctgccccggatgtctgaatcccttggaaggaacctggaggagttggctgatgggctccaggtgctaccggatcaccctaacaaccctctgggacctgtggccatgtgttcacaacagcagccattacaggtgtttcctgaactcttgtcgcgagcctctgtcggctccatctcatcgatcctcccagcaacccacaaggaagcttcacagagaggcagatgccacacaggccacccacccagatgcagagccagattccctgcgtggactggacgggagtttcccagctggagttctctcggccaagctgcctgtgacatggggttggaggtgctccagagagtcatggccacccctggaggaagtgacttgtggctgactgctcaaggggaagtcctgtggcagtggagtcgtcagcattaattcaaataagatctctccctgcacacaatctgctttcgtgttcctgatggattgaatcaagagtgaatgagctcctacttcgcgaaagcaaaacaaactaaacgcatcaaccacgaccgcagagcccccatctctcccaggaggaggcgccgtgtcccttttgtcaaattgcggccgaggagcagagcatcggcatcacccggcagctggttagaatgcagctgctcaggccccgcccagacccatgagtcaaatctgcattttcaccaaatccagcaggtgattcctgcacgtgtacgtctgctacctgcttccctggtcttcatcccctgcaatatgcagaaatgtttccatggagaattccagaagagttgacagcctggccacagggctgttcttgcgagattggaatttattcctaagccacacggggaagcctcttctcaggcttatgggaggcagcctggaagccactggtgaaatgtgagctgggagtgtgagcctctgtgcctccgctgacttctggaggcatctcggggagatacgtcactcctccaagattgctttctcctctgtaaaacagggataataaaaaaaaatctttctttctgggttgttgggaacacaagcagatccacagcgtgtggagggcctgccctgagccaggtgtggctgcaccctcatgacaggcagaaggctgcgctggaggaagctggagctttggggctgggccccttatcaccaacgcagggacagtgcttgctgcacagactgtccctaggactaagtgaaattctgtgagcaaaacaccctgaaccgtagcgttatttttataacaatcggcttgtgtaactgccctgtgtgcagtgccagcccttgactcatacccagagacaggtgggggcaggtggaggaagggaccactgttggctgaagcagtgtcttctagattgttcaaagaggcaccattcaccttagcgtactcaggcctagatttctgagagtccgtaagaaggtgcagaagttaatgtgccatgttgctaagtagatttctttttaaaaggtgttctcttctaaggtagcgacagatgtgagggttgctatggcaacaggtgtctgtttggagagcaccgcacaataggtgagatggctcaccaacaatttatggtcacggaaggtgagcttcctcccaggaaattttagtgacggatcaccttgctctgggtttacattttccgaagctggttttattttgtgccttgggagactgggcaggatggggaagcctttgtgtggattcagagcagactccgtgcgcagcagatggtcaaagggtcagagtcttttcaagaattgaaggagattaaaaaagagccttgaaaaattcgatggtctaagatcctccgagaacatttcaccagcctgcaaatttctttgtagcaaacagcactgcaattttgcagagttaggagtagaatctgtagttggccacaactttattctttccatagaacaagtcttcaatgagtgcctcctgggtacattgaaggtcatgtgctggggaggggaccaaggtggcatggcaggatatgaagatgaataagacctgggctctgcccttcagaagtcaaggtgggagagacagatggacataggccgattgtggagaggcttaagctgctatgaacgtatagctggggtgtagtggatgaatttggaaaacttggctggggatcatggagcatcctcagtgtggggttgaggagtctgaactctctccctctggagacttttcttctgggaatgagatgtggtcagccaggcccatcgtggttagcaggtgagggcagcatgggagggagaggacaggcagggggctggaggactctgtcagggcaaaaggtgacggatgggcaccagtcctcagtcctgcatgccaagactgtccaggtcccagctaacagcctgggctctgctggttccccaaagtcctgggagtttgctgtctcttctaggcctgggtcagggtggagaggtggttctctgcaatccccccagagggcttccaatcttagccagaggggaaggccattggtgaagtgcctgggtcccgagttctgggccagagccctcttgtgcatctgccgggcacctttctcatcccagacattcttctcctggtgggttcctggaccccagtcagctctggccaggatcagattcccaggccttgctctctaaccaggctggcccatcctcgcctggagccactgcccagagacccagcatggcccgtggatgaaccccagggatgtaagccttattggactgagataggagagccaggagtaggaacagaggaggatgtgtccagagcctgctggaaagagccgtcatccacaggagccccctggaagctctgctgcagcacctggcaacctctggtgcaacagccacgtgactagacacaagctgaaccccagaacagggcagggagccagatgggcacctgagctgtggatcctcagccctgtctaaggaggacacagatgagaccgcacgggaggccgggccagaggggctcttctcgccgtggattctgcaccctcctctgcttcctgcccatctgcacttggctgcaccagtggacagcgagccctggagagccacggagcacccatctgttctgggcagggcatggtctcagcttgctccccgccttccccagccataaagtagagataaatcgtacctgcttgggctgcctcagttcacccagggggtgatttaatgcaaaagatttgaaagctctaactaggattccactccatgggatttgaaggatgaaacaaaaacatttattttgttccagaacataaaactgatacatgttttcagcatacaatttggaaaatacacacaaaaaagagaagatagaacaacccattatgccagtgctcagatgcaaacgctgttcatattttgtaatattaactgccattcttttctctgtgtgtagacacacatttctaccttttatttcctttggtccaaataggatcatagttcatgaacagctttgaaaacatttcttttccatttaacaacaccttagaaacatgttttcttatcaaaccttcggatgtaacatcatttatgattgcctgtaatttcatcctatgtatgggtcccacattttgttcactgggtgtcttcaatgctcctttaggttgcttccaaattgtctctactgtgagcagtagtgcaatgactggttttgctgtgtacctctgccttttgaactgtacagttgtaataggagatatcttagtgtaggcagagtcttcattctagggaaatgcatgcccaggtctccctgtcgcctcaggcccggcccacccatgcttcatgctgagcacgtgctggtctttgtcctggcattttccgcgctctgtgtctttgctttgatttttctgtgtctcttctgtcttaaatgtgaaaaaaggtgcccctgcttctgagaacagagagaaccaagtgacaggccccgaatttcctggtgcaccagtgaatggccacttcgcttgctgtccgtgagctgatcgtgaagctggatggtttttaacctgggccaagccatgggttgtccccgcctttgtcctgtgatgctttcttctcctgcgccagcactgagctcgtcttccagggcttgcctcccactgtggttctatctattccccagcgcaggtgtcctcctagccactgatttgctggtcacagatgcaaagacccacccctggagggtggaggccctccctgaagatggccccaccccggcaatgccatttcctgcccagcattcaggactccatgaagcagaattgtagggtgcatgctggtgcctttgaggggcagccttgagtcttcccctgagagtgtccccaccaggcagagggaaggaacaggaaccactgttcacttgatatctgttaggacctaggtcctggcctgggcactcacctgccctcagattcgggctgccttgtcacactgcggtcagagatgtgtcaggtggaccataggatgatgtgtcagcaatttctaacccacagatctagacccagcagccccctccaacaggtttgggaggcaagtcacccagcacacaactcagctcagacagacttggtttggatgacaatggtgggaaccatcacacagccagctgcatgaggccagcaggcaaacttctctagtccacgggccggactggctatgcaggttcagcaaaatcccaaatcccgctctctggagcagactcccattaaccctgtgcacagtactgatatatatggcagatgtcagcttattattactgttagtattctaccattttattgaggcctgactgacatatgaaggctgtccatatttaatgtatacaacttgatgagtttggagctaagcatacctctgtcaaaccataaccacaatctacactgtaaacatttccactgtttccaagagtgttctcctcccttctttgcttattgtatcatgttaaatatttttttgtgacaaggctgggcaaggtatggctcacgcctgtaatcccagcactttgggaggccgaggtgcgtggatcacgaggtcaggagatcgagaccatcctggctaacacggtgaaaccccatctctactaaaagtataaaaaattaaccaggcgtggtggtgggcacctgtagtcccagctactcaggaggttgaggcaggagaatggcatgaacccaggaggcggagcttgcaatgagccgagatcgtgccactgcgctccagcctgggcaacagtgcaagactccatctcaaaaaaaaaaataaattttgtgacaagaacacttaacatagatctatatttttagtgaacatttaaatagacagtactgaacgatgttgataatgcaatactgaacaatatgagatactgaacgatattgataatgacaggcactagactgtacagtagacctctaggtcttatccgccacacataactgaaacttggtgccctttgaccaacccctccctgtttccctgtcccccggtccctggcaaccaccatgctactttctgcttctatgagttggactatttcattcatagattttttccgcttactgagttatcattgacaaatattgtataaatttcaggtgcacaacatgatgtttgatacatgtatacattgtgcaagggttaccacaatctaatttacttatccatcaccttatatagttaacttgtgtgtgtatgtggagacaacttagggtctacttactatcttagcaaatctcacgtatacaatacattaactctaatcaccatgctgtacatcagctctctagaacttattcattctgcataactgaaactttgcatgctttggccaacatctccccatttccctctccttccagcccctggtaaccaccatcccactctctgcttcatttctggcttattgcacttagcataatatccttcaggttcatccatgttgtcccaaatgataggatttccttcctttgtaaggatgaataacattccctgctgtgcatatgtgtgtctatcaactcttccttatccactcatccatctgtggacactgaggttgtttccatgtctctgccatcgtgaataatgctatagtgaacatgggagtacacatatctcttcaagaccctgatttcaaatcctttgaatgtatatccacaagtgggataagtggatcctgtggtatttctatttttaactttttgaggaaccgccatactgttttccacagaggctacaccaatttgccttcctgcctacagtaacaagggctctttcttttccatatccttgccaatacaaccttttttttttttttggtaattgccatcttaacaggtgtgaggtgatatctcactgtagctttgcatttccttgattattggtgatggtgggcactctcatatacctgttggtcatttgtatatcgtctttggagaaatgtctactcagataacttgcctatttttaaattgggttatttttgcaatctactcatctgacaaagggctaatatccagaatctacaatgaactcaaacaaatttacaagaaaaaaacaaacaaccctatcaaaaaatgggcgaaggatatgaacagacacttctcaaaagaagacatttatgcagccaaaagacacatgaaaaaatgctcatcatcactggccatcagagaaatgcaaatcaaaaccacaatgagataccatctcacaccagttagaatggtgatcattaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagcaatcccattactgggtatatacccaaaggattataaatcatgctgctataaagacacatgcacacgtatgtttattgcggcactattcacaatagcaaagacttggaaccaacccaaatgtccaacaatgatagactggattaagaaaatgtggcacatatacgccatggaacactatgcagccataaaaaatgatgagttcgtgtcctttgtagggacatggatgaagctggaaaccatcattctcagcaaactatcgcaaggtcaaaaaaccaaacactgcatgttctcactcataggtgggaattgaacaatgagaacacttggacacaggaaggggaacatcacacactggggcctgttgtggggtgggagtagtggggagggatagcattaggagatatacctgatgttaaatgacgagttactgggtgcagcacagcaacatggcacatgtatacatatgtaaaaaacctgcacgttgtgcacatgtaccctaaaacttaaagtataataaactgggttatttattttgctattgagctgtaggcgttccttatatattttagatattaacccccattatcaaatatatggtttgcaaatattttctcccgttttttaggttgctttttcatcttggttatggcttcctttgtggtgcagaagcctttcagtttgacacaatcccacttgtctaattttaagtcttgctctatttttgttggtctgtagtgttgtttaagtctgttgtttcctcactgattttctgtctgaatgatccatctattattgatagtattgaattatgctattattgcattattttctgtttctgtcttaagaccagcctggccaacatggtgaaaccccgtctctactgaaaatacaaaaattagctgggtgtggtggcaggcacctttaatcccagctacttgggaggctgaggcaggagaatcacttgaacctgggaggtggaggttgcagtgagccaagatctcaccattgcactccagcctgggggcaatagtgagacttcatctcgaaaaaaaaaatttgtacatgtttactttataactttagctgctatgatgttgggtgcatatacatttataattgctatatcttcttgttgaattgacccttttatcattatgtaatgaccttctctgtcccttatgacagtttttgacttaatgtccattttctgtgatataattatagctaccctgctttcttttgcttaccatttacatggaatatcttttttccatcccttcactttcagcttctgtatgtccttaaatctaaaatgaatctcctatagatagtatatagttggatcttgttttttatatatatatccaggctatatcttctggttagtgaatttaatccatttatattaaagtaattatttatagctaagtacttactatgaccattttaaaaattgttttctgttttgtagtacttttgattctttcttcctctcttgtatatcttggtgatttgatgatttttttggtcatgatatactcaatgattatattatctttatggtatctaccacaggtttttttcttgtggttatcatgaggtttgcataacattttttatagttataatagtctgttttaagctgataacaacttcaattacatacaaacgctgtacacttttactgctcccctccttcactttatgctattgatgtcaaaatttaatttatattgtgcattcattaataaatgtttatggttatagcta

SEQ ID NO: 3870 - DNA, 1542 bp, Homo sapiens
aaaatttgaatgtttttgaggattaagtaaagtaatacatttaagacacttatcctggtggcaagaaatagtaaatgctcgataaatattagctaaaagtatatatgccgatatacatgggttaatacagatactacgatggagtattagataaagttctagctcactgcagccttcaccttccagactcaagcgattcttctgcctcagcctctcaagcagctgggaccacagatgtgtgccaccacacatggctatgttgcccaggcaggtcttaaactcctggactcaagcagtcctctccccttggcctcccaaagtgctgcgattacaggtgtgagccactgttccagccctgaggttcttgatagtctaggtagagaggaaaattaaagaagttatgtggaaaacatacattctttaggagagtttttcctggcaccaaataaatattcatcccacagagttagagggatattgagtactggacttgattatgtccttgaccccagtactaaatttgtgaacttggacaagttatttaacctatcatgtataaatgtattaacatactgtatgtttacttttagtcacttttgagattgataaaaagtgctgaataaagtgttttgggaagtgcctttttcattcaatcctgtacacctaaaacttgtttataacaactagtttattcatattcatctctgtaatattccattgtgtgattatatcacaattcatcctttctcctgtcaatgggcatttaggttgcttccagggttttcgctattgcaaatggctgtggtataaaaattcctgtatagctctcctgacactcaagcgtacttcccctccaataacctggattgtagattctagctgtttcagcagccggaaacctccactccgcctcctcagttcagcaataccaccattctgagccgcattccttgcaccatggttgggaatgtcctcccatggagacagacatggtgaacctgggattcaccttgtgtatttcctttcttttagatatcagtctgctttgactagtatccaattcctgaaaacagttgcttcatatattttgtccagcattaactgttgtttggggtagcaagataagtccacttaaaattatagccggaagtggaagtctattcatccctattttctattcaaatatttagttttgtttcggttagttaattcttaatacagctgtggtttatttgctcaaaccaaaagcccaagagaaatttcatttaaaggtaatttgaaggatacaatatcttagatattcttcaagatgcacttatcacatcacagtttcataatgctcaacacttcttaaagtgctttcacatggaataattttcacgtacctaaactattggcctattaggtatctggctttctggtgaggtacttgtcatgttttccattgaattatatatggatttttttcccaattatgtccagaaatgaaatatattccaagatccctatgagaaacttaagaaataaagaaactcccattta

SEQ ID NO: 3871 - DNA, 1770 bp, Homo sapiens
aacagattgctaacccacccccagattttcagattttattttatttatttatttatttttttatctgactgattttcagattttaaaaatctatccctagattttctggggtagagtttgaaaatttgtgtttctaacaagctcccagatgacgctgctgctactgcttcagggaccacatttcaagaaccattgatataactctaaaccattcttgtcttcttcctatgtattttccacatcagtcaaagtgatcttttcaaaccataaatctggtcattctactgcatagttttgaaatccattgtcttcccattgcttttaggacaagtcaaaatcctagaagtccctacacagtcccctcctagcctactcgttcagtgacatctcacactaatgctgcccctaccctcaacccactcttcgctgcaccagccaccatggtcacctttcagttcctcaaatttatcaagctccacccttccccaaggtctttccacatactgtttcttccaccaagatgttctccctacccccaagccctccctgaccacaattttgctcggttaattcctacttctcctccttgtgcaatgcgggattggttattaggatcttaacttaaatgtcactttcctaaggaagccttttctaactgcctcagccaagacagatgtctctggtttcctaactagagcctttaattatacatttgtttaatgattatttgagctacttactctactaactggtaagcatcataagagcacagaccatgtttttgtttgctcacaactgtatccctgtgccctgtacacatgaatatttggtaaatgaatgattgattctggaatatttggttgaagaccactagtggacttaggagttcttcccaaagaactgcactttgatctgaaagctcaaatttcttcagttctccttttaccagtacttacaggtgaatcgtctgcagctccatggacttttcttctcataaaccttagtatttcttatttgtagacttactaagtgtattaaggtttaataaaattcaatatggcgcattgttttagtatatataaaatcatgtgtttgagctcatattctttatttttttttcttttgagatggagtttcgctcttgttgcccaagctggagtgcaatgtcatagtctcggctcactgcaacctccacctcccgggttcaagcaactctcctgcttcagcctcccaagtagccgagattacaggcgtgcaccaccatgcccagctaattttttgtatttttagcctggccaacatggtaaaacgacatctctataaaaatacaaaattagctgagcttgatggcgggcgcctgtaatcccagctactcaggaggttgaggcaggacaaattgcttgaatacaggaggcagaggttgcagtaagccgagatcacaccactgcactccagcctgggcaacagagtaagactctgtctcaaaaaaaaatcgtaaaataaaataaatagataccttccttatttctaactccacgcgtccactcatccactggaggccatactttatgactatggccaccattttgagtttttgtaacattgagatatttggaaatttcatgaactctaccttctagaagattttcccacagaacagcatttaagagtccccactcagtcctcaagcatacgtcaatttttggctcaccatactcagacttgagtgccaaagcccacaggcctacacttctgtctttgaacatgctc

SEQ ID NO: 3872 - DNA, 562 bp, Homo sapiens
accgcccagccgctcgcaggcgccgcacggagttgcgtcccggggacttggggccgcagggagctgtgagtacccaggaagctgcaccgtgtggcctggagctgtctatctgtccttccagccacctgtctgtccagccacccttccacagactgaggcttgacaccggagcatctgtacagagcaaggagaagacaagaacatgctctaaagcccttcacagcaagacccaggaagccgcgggcaaactcagactcgaaggtaggaagctgggcggccgggtggctggacccagggcgctggctgctgtgcccacgtccagatacctcctgcggggcccacgctctctgtctgaacagcggtggacagtgaatgaagaaagtcaattcagggagcgagagggaggaataagggcagggaagggacgggcgcggtggctcacgcctgtaatcccagcattttgggaggccgaggtgagtggatcacctgaggtcaggagttcgagactggcctggccaacatggcaaaaccccatctctactaaaaatacaaaaaatttagc

SEQ ID NO: 3873 - DNA, 380 bp, Homo sapiens
ggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctccgatcaccttcggccaagggacacgact

SEQ ID NO: 3874 - DNA, 7038 bp, Homo sapiens
gggctgctgctgccgaggtcgtgtgcgacgtgccgctcccgggccctgtgtccccagccccagcagggccgcgtggacggcgcggcgcccccggaaggaggccatgtgctcagtgccggcgccaactacgcacgcggcgccctccggcccgctagatccgaagcccatccccactgcggccagcggcccggcggggcgctgcgctcgggacccgcaccgagccaggctcggagaggcgcgcggcccgccccgggcgcacagcgcagcggggcggcgggggaggccctggccggcgtaaggcgggcaggagtctgcgcctttgttcctggcgggagggcccgcgggcgcgcgactcaccttgctgctgggctccatggcagcgctgcgctggtggctctggctgcgccgggtacgcgggtggcgacgggcgtgcgagcggcgctctcccgctcaggctcgtgctccggtccggggactcccactgcgactctgactccgacccccgtcgtttggtctcctgctccctggcgtgctcactcggggacccgcgactagcgaccggcacgctcgctgttgctacctcttgcctcttgccagagagcgcgcggaccgtagcgtttataggaccccggccattggctggcgacgccggtgtgtcaggggtgtgtgggcaggacctcggggcggggcctggggcccagcctgtcctgggcggcgctctgcggggagggggtgaggggagtggccggggccggggccccccctaaccactgcctcgctcaggctgccgatcggctcgttctctctgcgttgggaccgcggagggcattcgctgtgtgactcagggcaagtgtgcgcacctctctgagcctccgcggccttctctagcaaaatggtggagccggtacccggctgtaaggcaagctgggatgcgcggagtagcgggtggaaagctggactggagttctcactcggccgctgggtgacttcggtgcactagggatagtaacagtaccacctcgtagggttgtagaaagaccaagtgagttaatatttgtaaagtgtttagaacagcgtctactgcatggaaagtagtatttatttgttagagagactccaggaggtcttgcccagggattgacttctcccttccctgtctccaccccccacattcccgtttgtgagccaagccttgcttttgcaccggccgggctctcttgcctggaaatgcatacccatctcaaacctgggctttaaaatcacctcctctgggacgccttcctctacttctcacagttcaggtgagtctatggtgacctgtaagtgtggaaaatatgaaaggcaggctaactgactgacatgataggacattaaggacatgatagacctcgggtttgaaccagctcaactgtatactggcccggccgcgatcctgggcgagttcctggccagtgaggctgttttcgtttttttctttaatttttttttttctcagacagagtctcgctctgtcgcccaggctggagtgcagcggcacgatctcggctcactgtaacctccgcctcccggattcaagcagttctctgcctcagcctcccgagtagctgggattacaggcgcccgctatcacccctggctaattatttttatttttagtagagacggggtttcaccattttggccaggctggtcttgaactcttgacctcgtgatccacccacctcgcctcccaaagtactgggattacaggcgtgagccactgagcccggccgaggctgtcttcttatgagtaaatggaattcccacaccaatctcattgctatcaggagaggtgcaatttccagataagctcatgaagtgtttagcatggaagttctcatttactggttggtggtattgttggtttatttatttagtctgttagtaaataaataaatgctggtctcaaactcctgggctcaagtgatcctcccaccttagcctccgtagtagctgggagtgcaggcatgtgccactgcactggtagtggtattgctatcatctgacttcaccttatttcctctagaccagtgccttacttgagacacagtgaagggaaggacccccagtccaaaggtctgatcaaagtcttgagggtccctttcccgatggagggagtcatggtgggcttactgtctgtcggaaaccgggaggctgagccgaccagatgacccctggagttctctggcaatgtgtccagttctggctgaggggcaccttggttgagtatggagccctgaaacagaaggcaggtgcattctgggcacccccctgcccaaggcttcaattcctgtggtctctctatgctcagcctggaaagcttgggccacctctctcctcacccctggacagaccaagtcctgctgactccgctgtctacaccacctcatcctccttccctcccctgctgtctgcagggcctccatctcctctggtcttttgtcctccagtcctgcaccctgccactctcctgctcatctgtctgaaattgtcatggagggagtaagggccaagcctggccatcacggtccttcttcatggcaccagtttacacgctcagcctcgcccctcacaccagcaactcacatccacacatttgctcagcttgtctcctctgcctgggaagccctccccgacctcaccatgccaaaaagcaccatgggtccttcctcctccgggaagtgtccctggttctcccaagtggaaatctttctctcctttaccatttggtgttttgtaggttgccacttgtcctctgtctgccttccctcagcctgtgagcaccttgaggacaggttctgcagctgaggcacgtgggtgaatgactgaaggagggaaggaatgcacgaatgagtgagcagctaatctacctgtgttgaatgttccttcccctccagtccgtcctgctgatacttccagtctttccttaagtaccttttgggttttgctacttccctcctcaaagtctctccacagctccttgtttcttagcacatccagtctatgccttttcccagttgcgggtctgccttactcagcccatgggtcacactcaccaaacagccaccttgtccttctctgggccagccccatgctggccactttcccagggacagagacatgtgaccccattgttagcctcatggaggccccaagctggaggaggagcaagaggggaaatgagcagcaacaataccaagtcaagcgtagagggttaagaatctgtacaggtgcagaacttgtaccacaggggaaggagagtgagtagagagagcatctgggaagggggaggtcatgctaagcagggtttggaagactgaataggagttcaccagatggattgagggaaggccattctcagcagagagaagagcatgtgcaaaggcagcagactgccagaatgattacctagggaacgtgagaatctctgggccactcttagagattcatgatggagccccagatccggactctttgagtcccagctctgctatttacttgcaaacattcatgggcaaacaatgccttctcttctctgagcctgaagacccacatctgtaaaatagatataacaaacccttcctgggtaggcctgagggaaagtggatgtttataaaggcttagctatgtaaactgtactcattcttgacgtgagaagttcagtcaaatccccatcccatggtagggcggtgcttgaggaaaaagcacagtggccaaaaaaaagcttttccttcacccaccccaccccacctgcccacacacagacccccattaccttctctgtgttcctctctgtgaatgttttatgacccctggaggctactggtcagaagcaaattcatcagaagctattgacgctgcatcacagactagattctcaggtggactggtttgttatttgggtggctgattccttggaagcagaatttaactccaactagggaatgagccctagagaaggccccaggaaatagcacatgagcagagaaggtttgggtgcaaggggaaaggggagcaggaggggcacctaagtagcccctgtggctggggcatgggggcttagggaggagaagagactgaagaagtggaatcacagaggctcccaaatgccaggtataggagttagggctttatgcagtgggtagtggcgagccatggagagttattgagcagggaaaggacctgaggaaacctcagtgtccccacaagcctactctacctgaggcactaaagggggtgtgaggaggctgtggaaccccagcattcagcttgaacgacctagtgccccttccctagtctgcgcccacactgacagctttattccctggaggctgcctttagtcctggacggaactcggcctcttctgggtccgattctaagcagttccagccccagctagtctggaggaaaagagctctctgggactggctagcagggaggtgtcaggtgccaggcggatgctggagcctagtgtgtgcctcagagcacgcaagtgggtgggggaggggtggtggtggtgatggtggtggtggcagggccgtgcagggcgggtcctagcagctccagagttaggagtgagtaaggcgggctgggaaaagactctgttgcctttaaaggcaagcgtccctggcagccaggaggaaaggttttgctgagtcagctacaattggtacaagaggggatagcaggggctgggacggaagcccccctaatccaaagggtgttttgcaattcaaatcctcctggattgcaggtaaacacagtgatggattccaggaaggtctgatgggccaggcaggacagttttgtgtgtttaatgttttcattctgatttgcacatctgcttgaaccacctgctttcagaaagcttttcggcatcccttctttatcttctgtatgccctccgaccctctgcaaatgcacttatcagggctaccacctgctcgctgatgctgggggaattgaaggcacatactcccctcccttctctcctgactaccaggcttttctgtccagctgcctccaggatgtccctctggatgtcccacaggtccctcacactcaccatgctcaaacctgaactcattatctttgcccatcccttcctgtccccaccctagaaatggctcctctagccaccaaattgccctagccagagatctggtatcttccctgacccctctctgtctccctcattccccatatccagtcaatcccgtggactttgcctgcccatcccgtggactctgcctgccctctccatgcagacagtccctcctccagcataggctaggaccactattcattcatcctcctccctgccaccacactggtctctttaaaatgcacagctgaccacatcactgctttgttcaaacatctttccatggcacgcaataatgtggctgaatctcacagacatattgagtgatagcagctgtgcgaaagagtgtgatgtcatgtgtataaagtttaaaaacaggcaaaacttatctccggggtaacagtagttacccttggaagggagggtcgcgactctgggggcgggtgctggtaatcagggtgaggcaggtggagaccagatcagcagtactgatgttttttccttttgcctcgagctttaatatgactcagcacagcatgttactaatcctgtttttatttaaaattttgatattttgtcatcatggattttttgcattaattctggtttttcaaaaatactgcattaaaaatattatttatcctgatgacagagtccgccgcccccctctacccccctccacccctgcttaaattttacaggggaggtgagtgcctttcttgtgacaccctgtttctgaccgtgttggtaatgttgtttcctcatcagggtgctggttgcgggtgtgtttagtttgtgaaaatgcattgaggtgtgtacatttctgattttcgtactcttctgaatgcatattttgcttcaattaaccaaattgaatttttttttttttttttttttacttaaaatatttctgtaattccaagggagtgtctccatctgcttcttccagtgtccccagcaccaaaaacagcacctgcctcacactgggtctcctacatttttgttgaatgaaggaatacaacatttcagttaatttaattccaacagcaactctatgaaataagtatttctctattttcttttttttttctttttttgagatggagtctcactgttgccaggctggagtgcagtggcgcaatctcggctcgctgtaacctccgacttccgggttcaatagattcttctgccccagcctcccaagtagctgggattacaggtgcgcaccaccacgcccagctaatttttgtatttttagtagaaacggggtttcatgatgttggccagggtggtctcgatctcttgacctcgtgatccgcccgccttggccttccaaagtgctgggattataggcgtgagccactgcgcctggcctttttctctctgttttctaaaggagaaaactgaggctcagggaagtaatttgcccaaaatcacacaggtagtgtgagttccagcacctggattgaaaaaataaatggagtcaggtgtggtggtgcgtgcctatagtcccagctactaaagaggctgaggcaggaggattgcttgagctcaaaagttcaagtccagcctgggcaacatggtgagaccccatctctaaaaataaataaataggccaggcgcagtggctcacacctgtaatcccagcactttgggaggccaaggcagggggatcatgaggtcaggcattcgagaccagcctgaccaacatgatgaaaccccatctttcctaaaaatacaaaaattagccaggcgtggtggtgtgcacctgtaatcccagctacttgggaggctgaggcagaacaacctattgaacccaggagacggaggttgcagtgagttgagattgcaccactgtactccagcctgggcaacagagcaagactccgtctca

SEQ ID NO: 3875 - DNA, 9648 bp, Homo sapiens
agagacgcgcgcctgcgctgcggacagagcggtgcttctcgtctgggccccggttcctggacgacctgggacttctaggcagcgactcccagacagaattggaggagaaaagatgcgtgtggccctggggcctgagttctcggccaggcttcctgcgatatcagtctgtttcttttttctttttctttttgagacggagtcttgttctgtcgcccacgctggagtgcaatggcgcgatctcggctcactgctcccgggttcaagcgattctcctgcgtcagcctcccgagtagctgagactacaggcgtgagccaccgcgcccggctgttttttgtatttttagtagagacgggggtttcaccatgtcggccaggatggtctcaatctcctgacctcaggtgatccgcccgcctcggcctcccaaagtgctgggattacaggcgagaaacatcgcgcccggccacgtcggtccgtttctgctcgttcctctagcttctccacagaccagctgacgttctcattttcattgattcacctaggacattgttgttgacactccacttgcactgcgggtgcaaaggttatcatggctgggccctgcactcctcgaactcacagaccagtgagaggaaccaggaaactggatgacaaaaggatgacaaatgctgacaaacgctatcatgggaaacggacatgaacacagagcagagcccccacagccagtctatggagtaatccaggagggcttcccagaggaggcagcatgtgttgactgctgaatgacaaatggggaaggacattctttcttttttttttttttttttttttgagatggagtctcgctctgtcgcccaggctggagtgcctgggcgtgatctcggctcactgcaagctccgcctcccgggttcacgccattctcctgcctcagcctcccgagttgctgggactgcaggcacccgccaccacgcccggctaactttttgtatttttagtagagatggggtttcaccgtgttagccaggctggtctcgatctcctgaccttgagatccgcccacctcggcctcccaaagtgctgggattacaggcgtgagccaccgcactcggcggggaaggacattcaaagcaaagggagcagagtgtaccaagccacgtgaagtacagagttctcttctcttttgaggctttggggtcacctgcccagataattctaaacactaaattgtagccaggggcatctcctactctcactgccctcatgattgcctctggactgtgttcctacgagtgtcgtgctcgctggtgctctttcgtctggctgcccctaatcgcactgcaaacaactcccactgagttttctaaaatacagatctggccgggcgccgtggctcatgcctgtaatcccaacactttgggaggctgtggctggcagatcacctgaggtcagaagttcgagaccgggctgaccaatatggtgaagcccggtctctactaaaaatacaaaaattagccaggtgtgttagcgggcgcctgtaatcccagctactcaggaggatgaggcaggagaatcgcttgaacccaggaggcggaggttgcagtgagccgaaatcatgccactgcactccagcctgggtgacagagggagatcctgtctcaaaaatatatatatatgtatacaaatctgaatgtgttgctaccttgtgtaaaacttttaacagtcttcaggtgttcaaactcccagtttagctcagagcataaaattgggccacagtctctctctctcttttttttttttttagatggattcctgctctgttgcccaggctggagtgcagtggcgtgatctcggctcactgcaatctccgcctcccggattcaagcgattatccctgcctcagcctcccgagtagctgggactacaggcacccgccaccacgcccggctaatgtttgtattttcagtagagacggggtttcaccatattggccaggctcatttttttttaattaaaaattttttctggccaggcatagtggctcatgcttgtaatcccagcactttgggaggccaggaggtcaggagttcgagaccagcctggccaacatggcaaaacctcatctctactgaaaatacaaaaaattagccggatgtgctggcaggtgcctgaagtcccagctactcgggaggctgagacaggagaatcacttgaacccgggaggcagaggttgcagtgaggtgagatcgcgccattgcactccagcctgggcgacagagcgagactccatctcaaaaaacattgtttttctttatagccgagcgtggtggcacatccagctatagtcccagctactcaggaacctgaggcgggtggatcacttgagcccaggagttcgaggctgtattgagctatgatcatgccacagcacttcagcccaggtgacagagtgagaccacctctctaaaataataatcatcatttttttaagagatgaggtcagctggtcgctgtggctcacgccagtaatcccagcattttgggaggctgaggcaggtggatcacgaggtcaggagatcgacaccatcctggctaacacggtgaaacgcggtctctactaaaaatacaaaaaaaattagctgggcgtggtggcgggcgcctgtagtcccagctactcaggaggctgaggcaggagaatgggtgaacccaggaggcggagcttgcagtgagctgagatcgagccactgcactccagcctgggcgatagagtgagactccgtctcagaaaaaaaaaaaaagagatgaggtcttcttatggtgcccaggttggactctaattcctgggctccaggggtcctccttcctcagcctcctcagtagctgggattatagaggtaccactgtgctggtccacagtctcgtttaactgctcctatgtgaatgctgggtttctttttcctggaatgttcttctacccactttggagtctcaaattcaaatgtcttccctttctttttttctttttctttttttttttttttttttttttgtttttgagtcggagtctcgctctgtcgcccaggctggagtgcagtggcgcgatcctggctcactgcaagctccgcctcccgggttcacgccattctcctgcctcagcctcccgagtagctgggactacaggcgcccgccaccgcgcctggataatttttttttttttttttttagtagagacagggtttcaccgtgttagccaggatggtcttgatctcctgactttgtgatctgcctgccttggcctcccaaagtgctgggatgacaggcgtgagccaccgcacccggcccaaatgtcttccctttcttaaccatcccatcactccctctcttcatcaacagcagtatgtccaaattattcccatgacagctcttacccattttactgtaatttttcatttgcagttctgtgtatgtcctcaaaggccaagcagctagtctatgaggtgctccagaagcattcaggaccgctaacattgattcagagatgaccatctgccaggcacagtgctgactgcctttgtatggatcatctcatttaatcctctcaacaaccttatttgacaagtatccccatcttacaaaagagaaaactgaagctcagagagtttaagtaatgtgtccagagagacatggtcgcagagtgaggagctagggttcaaatcctggaaggagagacagctatggtcactctgctctaccctcaattttctgagataggaattgggaggaagggttggcagaaatctacatttttaaaaaagcagtaagctgtggattatggtctaaggaataacacagtcctgctggactcaccttacacacccttgggcctgctctggggaagtggggggtgggggactgggaggcacaagggcacctttcctgctgcaggtgactcatcgtgaccctggcttagtgacagcctggcaccgtgagccagcagaagcagccgtcccagtgtgaattctggctggtctgtgagctctggaccttacccagagactgcctgttccaaagcagtccctctgagatccctccctagggcatacggaaattacaagaaaaataattttttttttttgagacggagtttcattcctgttgcccaggctgccgtgcaatggcacgatctcagctcaccgcaacctccatctcccgggttcaagtgattctcctgccccagcctcccgagtagctggaattacaggcatgtatcaccatgcctggataattttttgtatttttagtagagacagggtttctccatgttggtcaggctgatctcaaactcccgacctcaggtgatccgcctccctcggcctctcaaggtgctgggattacaggtgtgagccaccgcacccggccaaaaaagaattttttaaagaagaatagaccatcctggctaacatggtgaaaccccgtctctactaaaaacacaaaaaattagccaggcgtggtggcgggcgcgtgcaatcccagctacttaagaggctgaggcaggagaattgctggaacccgggaggcagaggttgcagtgagccgagatcgagccactgcactccagcctgggtgagaagagtgaaactccatctctaaataaagaaataaaagagaactctggggcaccatgtgaggggaactccaaggagagtcttgggtagagacggagcgaggagcacaggcaggatgctgcgccttccaggaaaggtcagtaagatgtccccactggcaatgtgattctgggaccatcgagaatgggttatttgctttgctgcgtgcaaactcctctcatcgctgcaatcttttagggaagctgctcacacaaaggccttcttgcagaatcaaggagaaggtacccatttcctctgccactcttctctgcccccagccttcttccctttcctctcaggagactccacgttcctcgagggctttgccttgctgttccctctgccttgaccactcttgctccagatcctagccgtcacttcctctcctcgttcaggtccccgctctgatgtcatctcctctgtgaggccttgcctgactgcaaactacacaccaacactccctctccccttgtctgctttgcttattttcctagcacttatctctttctaatatgttaggtattttccttacgtattgtctattctttgctagagtgtaagctccatgagagcagggatttgggtctttttgttgttcctgctatatcccaagagcctcactgagatcctggcacattgcaagcattccttcaattcatactggttgaatgggccgggcgcggtggctcatgcctggaatcccagcactttgggaggccaaggcaggcggatcatgaggtcaggagttcgagaccagcctgtccaatatggtgaaactccgtctctactaaaaatacaaaaattagctgggcgtggtggcacgcacctgtagtcacagctactcaggaggctgaggcagaattgcttgaacctaggaggcagaggttgcagtgagccgagatcgcgccactgcactccagcctgggcgatgcagtgagactcgtctcaaaacacacaaacaaacaaacaaaaacctgttgcccaggctggagtacagtggttccatctcagctcactgccacctccacctcccgggttcaagcaattctcctgcctcaggaggccaggttggtctcaaactcctgacctcaaatgatccacccacctcggcctcccaaagcgccgggttgaatgaaggaaggatgaatggagaactggcggaagctcttgtctagagccagcattagcttttcccataattggcagatatttcctggaggtcactggacttccctcaggatgtgagctgagggcacaaaccagtcctggttacctctcaaaaggtcagagtaggctgggcacggtggctcacgcctgtcatcccaccactttggagtgaccactttgagatcgtgccattgcactccagcctgggcgacagactctgtcacaaaaaaacaaacaaacaaacaaaaaaaggcggacgtctgggtaatgtctgtgatgtcattctcgcgtgcattctggtttgctagagaaaggaatgtcgacacagttataaagcatgtaattgcacttaatacctatcttatctatcagcttcttggaggcatcgttactgctgataaagtggacgaataattgtggtttcatttttcctcgggaaaattaatcatggagagaggtgtcaaaatgtaggtgtgcgtacaggatcgtgtcaagcccaaaacaccacgttgcgtggtatctccttgtttgagaatctctgccccaggtttcaaatctaagctcctcaggcagctggcctgaccccgggccaaacctgttcttgcctctaagctccacatgcaccgttccctccacccacagcgcgccgccctcttggaaaaactcacagccatctgctgacgacgagctccgtggttgcagcttgaagcactttcttttttttttttgctctgtcgcccaggctggagggcagtggcataatctcggctcactgtaaccttcgcctccggggttcaagggattctcctgcctcagccttccgagtagctgggattacaggcacacgccaccctgcctggctaatttttgtatttttagtagagatggggtttcaccgtgttggccaggctggtcttgaactcctgacctcaggtgatccacctgcctcagcctcccaaagtgctgggactacaggcgtgagccaccgcgcccggcccactcattctctttcttgtggaggcgacactgatttcattttggcgagtcatctcctcccactcttggttctgtggtttccggtgtgggttccggtgtgcccctggtagctctgtctccaggggcaggcactcgatccaggcctgaccaatcagaatctattcctctccctggctacagtgattgggtcagggtggatgcctcattcaaggtgctgcactgagaatccgctctgagacttccacattttgggaaagaggcacttcctctttctgcctccaatgctgaactgacagaatgaaagcctggagctgtgggtggctgttgctgccaccccacctccaggtgagaatctgcttgggaaagaagccactgtagaggaaggttcagccaggcgatggttccagacacattcctgacagtgtgtgagcacctggaagtagccttactctgggactaaggtgctaatgcttataaatatcctttttttggcccaagccagtttggactgggtttgtcacttgcaacagaatttgaacgagaggtgtccgggcacggtggctcatgcctgtcaccccagcactttgggaggccgaggtgggaggcatcacccaaggtcaggagttcgagaccagcctggccaacacggtgaaacccaatctctactaaaaatacaaaaattagccaggcgtggtggcgcatgatgtagtcccagctactcaggaggttgaggcaggagaatcacttgaacctgggaggtggaggtcgcagtgagccaagatcacaccactacactccagcctgggtgacaagaacgagactgtctcgagaaaaacctgcaacacgaggcccttggttgccttccggggccctcttcgtttcctaatattcataaggagaccacattggcaaacacgtattgctttatttagtgtttctctggattgcagaagtgtcagcagtgggctgagacccccagaagggcatagaggcagctgggcagcccccaggcccttgagggtaggagcagggagaagcagcagaaggaggtgatgcccctgccgctcctcccaaggccagccccgtccccacgctcccatgccagggaggggtcaggggccagaaaaggccctacatccttgagtggggcccgagtgtgcgggcaagctgtctgtcatcccaaggcctggactctggcagaggcgcttttcccacctggtggctcccagggccgattgctggtcaaggagccagatatactcttaagacatgatgtgggttttatggggctccctggctctgggagtggcagtgaggcacgctgaggaagggctgccatcttggttttgtggcaacctgccgtatgaccgtgggcaagtgccttctcctgtttgggcatctgtcttctgctctgtaacatcaaggggctgggctggatgatctctcagcgtcttccaacctctatggtctaagacggccttccccactccagcactgcctcaaactgggatgatgaggacagtaaaagggcgttctttttttttttttttaagacggagtctcgctctgttgcccaggctggagtgcagtggtgtactcttggctcactgcaacctccacttcccgggttcaagtgattctcctgcctcagcctcccgagtagctgggattagaggcgtgcaccaccatgcccggctaattttgtatttttactagaggcggagtttctccatgtaggtcaggttggtctcgaaatcctgacctcaggttatctgcccgtctccgcctcccaaagtgctggggttacaggcgtgagccaccatgcccagcctaaaaggacattcttaaggcagaaagaagggggcaggcaagggtggtctcagcccccagatggaagtcagagtgggctgcaaaagatgcagatgggcaggcagggagacaggtaaacagacagaaagacaaggtgccaagggaatcaggaggagaggtgtcctggccagggaagagggcaccagagcccagcccacacaacctctcggctacattccttgccctgctggagtcagggaaaacacatccactgtgtccttgggtgggaaatggctttttttaaaaaatagtttcctataaagcatcaaaaaaacctcagagaaaacctcagcaaaagttcccttctctcaaatatttggcatcggcagtagggctggcatggctcgctctggccctggctttcctattgctgtggcccggcctggcccactcctggggtagctcctggcccctgctgctccctcaagagagggatgggcaggaggtgggagattgcaggtgggcttcggggtgtccctgggtccctgtctggaagttcgagtctttggtaactgggaaggggaggaggagaaaagcaaagcattgggcgttgggagggtccagtgggcgcctttatcaccgagaattcagccgtggggcgacctgtgggggcggagagagacggccaagtggtgaggggagcagacgggggccccggtactcagacttttcttttcgtccttgttttttcctttttatggagaatggggtctcgctatattgtccaggctggtcttggactcctgggctcaagctgtcctcccacctctgcttccctaagagttgggattacaggcgtgagccgccgcacccagccccagcgctcagattcatgggttcgatgcaggcaggagtggtgggggcctagtggtctccatcctggagactcagacctgactcccataggaatgcccaccgccctggccagcgtgagcctgtgagcctgtcctccctcc

SEQ ID NO: 3876 - DNA, 880 bp, Homo sapiens
ccgaggggagagagggtgcgcagacggccagccgggccgcgccagggacatactggagacaggaagtggctgagagggggagagagttggagagagacggccgcggaggacacggggacgggaaagtctgagagacggggagagcctgacccggcgggacacaggcagaaagaaacacgcgagccagacagacgcagaagaaacgtgcctggtactggataggaacttcatggaatggagctaatgggccgtagggcaggtttgagtcgtgccaccctggagcagaaggtggagggtagggataagggtggagagaaactaggagaaaagcacaggatgtagaggtctattcggcataatcttctccctcattttcatcttcaccatcaacagagagagcagcatacttgcttgcagaactgaacttggaagctggattttcctcaggtttctttggctcaggtgcagatctggagtcttgatcctttttgccatctttcctatctgactccttccagtggtctctgttccctccgtcgcctggaccacggctagagttcccagtttggccttttggggcattcatcccatctactttattttcatctgcttgggcagtaatgtaaacaaattaaaggcaagtaaaagtatcaatgtccctctcctaagatttcccttaagctgaagaaaattgtgcccacatgtactgagggaaactaacctcaccccaacccagacttccttcctgaagcccttctttccacatcctctacagcacacaaaaatacaaaaaacaaacaaaatccactaaaaagttccatgtagggatatgccatcatgaaaagcaagctggaaataaagattatgacgctctgtagtg

SEQ ID NO: 3877 - DNA, 1045 bp, Homo sapiens
ctctcggaactggggcagcggcccgctcacctcgtgtccgttgctggccgggatgatttcagactcgttcaccaaggaagacttgatgtcagctaaatcgccttcctcttcgggatgactgatctcggcgaagatcttttccttctgaggatcgccctcgtccttgaaggggatcatctcgtccgtggcgcagagttccgggtcccccccgccgccgccacctcctccggagagttggggcatcccggcggctctgtaatctccgctccgctgtgggagcacccgcgcaacagcaggaaagacagaggggcccctttgtgtgactaaatttggcaagaatatggatctgagccagtctttccacgtgtgctcccagctcccagctgagaaggccaagggttctcttccggatgcagcctttttgaaatttattcttggccaaaagaggaagatagttcaaggattctatcttgcttttggggggcaatggagaaaccctgaaaacacttaaggaaaacctgaggccttctataagaaaataaactccctgaaaggggaggcagggccaaggaatttacttatttttataaatctctttcctgggtggatatggtaatggatgtgtttcttgaattgtggtaaatgtacctcataaaatggatggactggggctatattctcaggcttcctgggctctgttggcattgggcaagcacgtaatgcctggtttgaggctagaagccaaagccacaaccttcttgcagtaccaactgagccatagggagattaatgcagaacaaggtcgttagtctcattgtttatccagttactagccgcatagattttgtgtaaatttcagctacagtggttgcagcctgcctttgatgtgtgtaatctgtacattttagtgctccaggaaagtacctgattgacaagatctacatccaatgcccagaaaacacatcctacacaggcacagtgaagcgtggagttgaagaattttccagtgagttccatcaaagtaaataaaccaacctagagcatc

SEQ ID NO: 3878 - DNA, 277 bp, Homo sapiens
ccttcttacctctcgaagatgagccgcaccatgaagatacagaaggccaggggaaaagcgagatagaggtcctcagcctgcgggaaggtggcctcctccgtgttcttcaggtccgcccaggtgacattgtgcgggagccaaaacctctcgttccagaaccaggctaagatccctgccatcttgctttgtccactcctgtcctgcggcacccgcagcccgccaagctctccaccgcgcagggcgcccggggatgcgcgcccggctggccccgagcctg

SEQ ID NO: 3879 - DNA, 564 bp, Homo sapiens
ctcttatttaaaccaaattgcattgcactaatcccacagcatgctctttgaggacccagctctgatagggcttctgaggtgccagaaacctccagctggaatatcctgccttcaggacacatcagacatctggctgttcattagtccaatgttacaagtcctgcagtccacctcccattctatctggctccctgctctaccagagacaaatccaccagagccataacagatgcgctgccgggtccccatcagcatctgcactgagacctaccacgggacaaaccaatgatgaaaaacccaaagtccagaaaatgaaaatggtctcagagagactggccaatcctatttggggtcctctagaaaattctcccatcactcttccctgtcctaccatttccacatattgatcatgacttggtgcttcgtttttctgcccctgcactagaacacaaactccacaaaggcaaggagtttatcttgttcttgatgaatcccaggcacttaaggaagtatttgttcgataattagttgttgagtgagtgaataaatgcacctgtcctagca

SEQ ID NO: 3880 - DNA, 5252 bp, Homo sapiens
gctggctccggcagcctgcttttattgtcttatctggccccacccacatcctgctgattggtagagccgagtggtctgttttgacagggtgctgattggtgcgtttacaatccctgagctagacacaaaggttctccaaggccccagcagagtcgattggtatattcacaaaccctgagctagacacacggtgctgattggtgtatttacaatccctgagctagacataaaggttctccacatccccaccagactcaggagcccagctggcttcaccaagtggatcccacaccagggctgcaggtggagctgcctgcgagaacggcaccgtgcgcccacactcctcagcccttgggtggtgatgggactgggcgccgtggagcagggggtggtgctcgtcgaggaggctcgggcagcacaggagcccatggagggggtgggaggctcaggcatggcgggctgcaggtcccgagccctgcccctcggaaaggcagctaaggcccggtgagaaatcgagcacagcgccggtgggctggcactgctgagggacccagtacaccctccgcagccgctggcccgggtgctaagcccctcattgccgggggctggcagggccagccggctgctccgagtgcggggcccaccaagcccacgcccaccctgaactccagctggcccgcaagcgccgtgtgcagccccggtgcccgctcgcgcctctccctccacacctccctgcaagctgagagagccggctctggccttggccagcccagaaaggggcctccacagtgcagcagtgggctgaagggctcctcaagtgctgccaaagtgggagcccaggcagaggaggcaccgagagtgagcgagggctgtgaggactgccagcacactgtcacctctcaccaacattctaaatcataaacacccaggccgggcgtgtggctcacgcctataatcccagcactttgggaggctgaggtgagaggatcgcttgagctcaggagttccataccagcctgggcaacaagggaaaaaaccctaccaaaaaaaacacaagaaattagctgggcgtggtggcgcgtgccgatagtcccagctacttgagaggctgagccgggaagattgcttgagcccagcaggtcgagaccgaggtgagctctgaacgcctgattgcgccactgcaccccagcccagtgacagggcgagaccctgtctcaaaataaataaataaaaataataaacaaccgaattcagtggtcccgttagaatattccaggctccgagaagccaggtgctcacagcgtcgggatttgcccccagccagggcctccgctccctcttgcctcgggcagatgctcctggaacacagagctgcggcctcggtgctgatgctgagtgctgtgacccagcctccccctacttttttcctaagggtataagcttcactctgcctggggctttggctgtaagttggagtctggctttacccactgtgggcacccaaggccaaggtgggtctgattcaccactgtttcctcagccctgccaggctctgaatatgcctttaggaatcattctggaagatttctttcttcactggactatataagtgcctctgcgagaaaacaggccctaggggcaggtacttagtcagtttagtcatctgtttcctcagcttgaaatgggcttggcatacagcaggagcccagtaaatgttgctttaatgctcatttcccaagagatctttattaagcacccactgcatgtcattgtgtctaggcttattcactgtgtacctctagcagaaagttaaggggaccctccatgcttgatggccagaggtcactctcagctcctacaggtcactctccggtccttaaacgtggccctctccatcttcaaagccagtaagagcatgtcggatccttcttatccttccagcctctctgtcatccccttctgctcccagctggagaaaactctgcttttaaggggcttgccatggtccaaatatgtgagtccccccaaaattcatatgttgcaaagcaatccccaatgtgatgatattaggaggtggggtctttgggaggtgatgtggtcatgaaggctcagctttcatgaatgagattagcaccctcataaaacaactccacagggccgccttaccccttctgctgtgggaggttatagcaaaaagatgggcttctatgaaccagaagtgggccctcaccaggcaccaaacctgctggcaccgtgatcttgtactgctcagccttcagaactcagaaaatacatttctgttgtttagaagacacccagtttctggtattttgttagagcagcgtgaacggactaaaatagtgcttatgtggttgtgtaacagcatcgattccatgttaaagaacaattttgcttgctcaattataattattgctttgcttaagttttagactatgctaaaaacagcctcaggaccttcagcactgatcaacaatcctgggcatgggctgaccgacagttttcacccagagagtgaagatcatggaggagccatcttaaattctgcccagcgcaggctcccaggaatcctaatgtcacgatctcactgcagccaatgtgacaaacacagcagtaattaagtctagagagctaaacacacctcaaaaagaattgtctcttggtatgagtggaatggaataaaatacatggaaacccacaaaagtttcgaggtgaacatattagcaaaaatgctctagcttatccaagcgacagttcaaagtgtcaaaggacttctagactcccaatctttccaccggcagaaagcaggctcagtagcccaaactggcgcattttaaaatgcccttttcagaagtgtgatggaaaaagaaggatgtgtcagtgcaggccagtgtgtggggaccaatggcaaactgcagctcctgaactaagaaagactttcatatctttaaaaaagaaaaggagaaataggaatatgtgatagagactgtatgtggcccacaaagcctaacatatttactgtttagatctttacagaaaatgtttgccaactcctgtgctgctgagccacttccaggttgcagaaccaaagccttacattccctagctttaaagtagaggacctggcaatgtttactccaccgagtttcaaaatagctatgtgactgctatttcaccccttcattcttcccttaccaatgggccttatcctgtccctgtctcatcactgaatgttgggtctaagtggacaataacttgtcttttcaaaaagtgcataagcttctagaccaataaaagccatattaggacctgatgtggctcacaagatgctagacttcttgcttgaggccatgattggaagaaagtaggaagggggtccttagatgggggtgggcaatttttccatgaataatgggggcagtgggcacagatgatggtaggtagtataaatgaccccaattccccaccccttcattcatccatgttctctgcctcatgtcttgctttggccaatgagaggttcacagagaggacacaagcacaggtttgaaagaggctttcgcggttggactcgctttcctctgcgtctctgccttcgctatgagaagaacgggcaccggtcttgggaagatggtgagagaaacacagaaccaagctgctctagacaggcctagcctagaccaggtggcccgcagaccattactgagcccagcctggatcatccaactcccagccaaactgcagaccatgaggaatgtttattgttgtcacggagatttagggtggctcatgcagcaaaagccagttgatggccgtaggtgggattataatcccggatacattaaaatgccagtctcttcttttccccatgtcttcatttgctcactctcaggtgaagggatcttgcttggaggcccagacgttctggattttctctttagaaactgtggcttgaagcatcctcttcaggaaacaatatttactccttttgtatctccaaaacccctcctcaccccttttgcaacccaaacccaagtgtcttctgtgtcctatttttcttcttttgaggcagagtcttgctctgctgcccaggctggaatgcagtggtgcgatcacggctcactgcagcctcgacctccctggcccaggtgatcctcgcaactcagcctcccgagtagctgggactacaggcacataccacaatacctggctaatttttttgtatttttttgtagaggtgtggtttcactatgttacccaggttggtcttgaactgagctcaagcaatctgcctgcctcggcctcccaaagtgctgggattacaggtgtgagccactgcgcctggccagcttgtacattttacaatcaagattacaagactactgccagctgtaggccacatcaggctctgagaagaggggatgtggacagaggtaaccaggacaaaaggaaaaaaaagtccttaatttcaccttctctgatgccatttagttcatgccgatcatctgtaattcacatctgtgaactttcagcccgtttgggagaagccttccctcaagtgcttaattatggcacaggatggtctcttttacacaaacgactgtgcaaagacatagaaagtggaatttatttctatcagaattaattcagaaaatctgggtaagttccacactccatttaacactcattacacataataactggtcagaccacattgtgtatgacttaacccacattacatgaatagtctaggaataacaaaagaatttactatttatttatctgaaacaatgttgattctgggtttggtaagattctgggctcgacacaattctgagtcatgctaaattcttccaccaaaggcagctgccataatggagtgtctggtacaggaagcgcgagccactggagtgtgggacgcatcacggccacaacaacaaagctgtctccacgtccactgctagccgggcggggcagtaaaacgtggtgtcttgcacgttgtattttcaagaaacggccacaatgcaattgctaacagttgcacctgctcttccagaaccttgccatgcccatcaagaggtggagtctgtgtctcctccctttgaccctggcgggactttgtgaaggtgatatggcaaagagatgctatgggacttccgatgcttactctcctgggttttgtacatttggacgccaaagccaccatatacgaagtctggctcccctgaaattgc

SEQ ID NO: 3881 - DNA, 2236 bp, Homo sapiens
caaatgctactgaagtgctgtgtgtgtctctgtgagagccttcatataaataaattcatgcatctaaagagtccctggtcaggccgcatgctgatattcaatttggggaatggtgatgccaccacatgcatctgggggaggcagcagggaggcgtagggactttgtgtggcctgctctatcacagctcctgggagaattacagatctgagcccagggcatctctgggcttttggaaagggttcctgcttttcctgagttcccatggctgccctgctgccggggctgactacctcctgaggtaacagcaagtcccatttagaaggggaaagtattcgaatgattggctgatgccagccttggccttgggtgaggcctgtcccggcctgtcctgctgctgctgtgctgggcctctcttctcctgccaccagaggtagctgtgctgctagcactgacactcccagggtagctctgggccataggcaggcccaggcccaggcctagggatcatagccccatagggtgccactgctccatggtccctggtgggcaggaagagcactgggccttgcccataggaaaggcccagccaagtcccctctcgggggctgctggcttagctcctagagcacagagccctctggccccaccactgccggcccaacctgtccagttctgtacagtagcatcaagctctgattccctcaaactccccttgctccctcccacctatccaccaaaatagtctctgctttaaaatatacattatatattagacatttcatcttcaatatgattctctcatagcatcaggtaaaattagtgactctagaggaaaggcagcctttgtgagtacaggcggcactcggggaccaacctgagcctccccctggcaggaggggaagggcaggggacagagaagagccttggtttcctgctcagttctccttctgggctaagcctcaccccccgcccctctgcaaagcctggtctcaggctaacaaggagcccacaaagtcatgggtggctgctcattttgaggaagggctgggcattttctgagcctcagaggggcacgtgagtctgccctggggagctggcccctatggagacagcaaccacctcatcacacggccagaggaaggccaccaagcggaggctggtcagagagggcgctggggcgtgagcgaagggtgggcaggaaggaggcgcctccagttattgcagtctggtgtcctgggaacaccaggaattcctggaacccttgtgggagctgggagaggcagggcagaggcttggctttgttttcagtggacattttagcacattctttgtggaaaatcacctgggacctttctctttttttgcataaagtgtctaaccattaaggtaggtccagtgtctgatagtctaatgtataacaaaaatgtctgttattttttagaaaattgtgctaaggatttctccaatttctgatttttttttttttttttttttggcaagccatatctgagaagccatctctgcccttcccctgcctgcatcccccagaccatgagccgggcaccggccaatgcattcagggtggggacgcagttcctgccgtggctgtcctttgagagacccacatgtttatttcatggaagacggagttggtgacttcaggaagctccttgtggagaacatggtaggcaccttcataaatctgcaatgaggagagacacggaatcagagctgcaccatcagaggcaggtgcagggagcggagaccgtgggcagtgggcaggggtctgcagcattctccggaccctctccctatgcccgaggacctggccctgacctcccattattaggaggccaacacctttctatcagaagatggttcaaatgtgttacaatgtcccagtgtgttctcgaacttcctttctcaaatgcaaaccttccctcactccacatctctccccatccctggacccgtttctgtgtctctgagtcaggcaaccttctcaaaagagggggttccactcccggcctcacatcctgacctccacggggtcctcagctcatcccaagccgacttccactcccgccaacccacggtggctagcctggcgaggtctccagggacctccattgctgtggcaggggacactgtgctggtcattcataagctgctcactgtcaccttctagaaacactttcctcttgtggttccatggctttaacttttgattttctt

SEQ ID NO: 3882 - DNA, 1049 bp, Homo sapiens
ctctcggaactggggcagcggcccgctcacctcgtgtccgttgctggccgggatgatttcagactcgttcaccaaggaagacttgatgtcagctaaatcgccttcctcttcgggatgactgatctcggcgaagatcttttccttctgaggatcgccctcgtccttgaaggggatcatctcgtccgtggcgcagagttccgggtcccccccgccgccgccacctcctccggagagttggggcatcccggcggctctgtaatctccgctccgctgtgggagcacccgcgcaacagcaggaaagacagaggggcccctttgtgtgactaaatttggcaagaatatggatctgagccagtctttccacgtgtgctcccagctcccagctgagaaggccaagggttctcttccggatgcagcctttttgaaatttattcttggccaaaagaggaagatagttcaaggattctatcttgcttttggggggcaatggagaaaccctgaaaacacttaaggaaaacctgaggccttctataagaaaataaactccctgaaaggggaggcagggccaaggaatttacttatttttataaatctctttcctgggtggatatggtaatggatgtgtttcttgaattgtggtaaatgtacctcataaaatggatggactggggctatattctcaggcttcctgggctctgttggcattgggcaagcacgtaatgcctggtttgaggctagaagccaaagccacaaccttcttgcagtaccaactgagccatagggagattaatgcagaacaaggtcgttagtctcattgtttatccagttactagccgcatagattttgtgtaaatttcagctacagtggttgcagcctgcctttgatgtgtgtaatctgtacattttagtgctccaggaaagtacctgattgacaagatctacatccaatgcccagaaaacacatcctacacaggcacagtgaagcgtggagttgaagaattttccagtgagttccatcaaagtaaataaaccaacctagagcatcagga

SEQ ID NO: 3883 - DNA, 10772 bp, Homo sapiens
aaaaaaaaaagtccaattacttaaatgttaatctcatccaaaacaccctcacagaaatatgcagaaaatcttccatcacatacatacctgggcattatggcccagccaagttgacacacaaattaaccaccacatatggtggaaatagagcttcaaaatgatgttccaaaggcaagcaatattatacttttaaaatctctgggaatataccccttttgtatactattttgaaatccttggaaatacacaatttttttatacttcagtgtagttttaaggagcactgacatgctgcctagcatgcagaggccatgcgacccttggggaggctcctacttgccttggaaaagtagctcctcctcttctcaaatgtaataatggaaaccttacatgggtggatccaggggtaaagctctttgtggtgtatagcaacagaatgttaagtcaaagtggttgtcaacaaagtttatcgaacagcagctatattttttataatgaacactggtttgcctggaaccttgaagtaaccatgaatttttcctagaccctaatactatcagaaagaaacaaatcacccaacaataagatcagtaactaaaaccaacaaatcccaaaggcatctcacagtgctggcatatgtctctgccatagctcatgctcataaactgcaatgagccaaccctggcatcatgaaggaccccgattttaaaaatgggtaaagaagttctgaaagcctgggcaacatagtgagaccattctcttaaaaaaaaaacaccttggcctcccaaagtgctgggtttaatgggctaggtgtgagccaccacaccccaccccttttctctattttaatgaaatatagacgcttgttatcctaaagttttctttttctttctttttttttttttttgccatgaagttcatgaacacactaaaatgttctatgcagcatatttttaggagcagattcggttcagataatttattatgtctgtgctgccaacttgaggctgcctgagagtttgttgggagctccaaactctccagtcaccacagaagccaccttttcacccagcgggcgcacactcgggatctgaactctctgatagatgggccatgctggggagacagcagcagcctgaaaagggttcacagccctccaagaaaaagggagaaaagaccctgcatttgactgcaacactaaagaaccctttcattgctcatgaaaagagtttggagaggcaaagttaatgtcccctggagaaatggatggatgattggatggatagacgagagtttaagaactcttcatggaaagatagccaaaccactaaaatactatttcaacagaggaggtcacagaatggtggaatggtagatctgtaggactaaaggagacctcagatttgtcactcttatctgactcatgaaactgagacccagagaggtgaaagggtgtgctcggtccggtagctgtgttgcagactatgtgaatggcacctcttggtgtcatgcaatgcataacaaccacctgtgcagcctcatggccctgcacaacctcctgaccacagcgatggaataaagtggtccagtcaggggcattttcagcctctggggatgttgatatagtaactcctcctcttttcccataccctgaaaaaatgcagcccaagaagctgccgatgctcttacagctgtgaggggaggggctgcccgaggagagaggtaacctagagttgagagatggaggaagagatacagaatctggatggctatgctctgatcctgtaatccgactatgcctgaatgtggatctaccttccaaaggtagggtgcttttcgtttgtttgagccatctggtgtcagatgttctgtcacttactaccttgttataattaatagaggagctcaaagagctataaatatctaaggaggaagagttcaggttgcaaagccttcctagacaaggttgcttcaaaggaaggtctgaaaggaagaatgggaggcaggcaggctgcaaagggagagaaaattcagggaaggagaagaccaggaacagaggcctgagatatgagagcctggtactatggactggatgcttgtggctccccccttccccctaatcgacttgttgaagcccagtccccattgtgatggcattaggtggtgtggcctctggaaagtaattaggccatgagggtgaatccctcatgaatgggattagtgtcttcatgaaaagacaggagagagcttgctttctatcctctctgccatgtgaggacacaacgagagaatggtcatctgcaaacgaggaagaggtcccttaccagagccgaccatgctggcgccctgatctgacttcccggcctctagaacagtgagaaataaatctctgttgtctaagccacccagtatatagtcatttataacagcacagagtgactgagacacctggggtgggggtgtttggggaatcatatttaattaagcctatttggttagagtgttggatatccaaagcaggtaacgggggttaggattaaagatgtaggttcctaccagtctgtgagtttgttcttttgtattttggataataattcagcaagagaggagggatgagaatgaaaggagagaactggttgcgagactattggtaatttttgaagtatgagagtccatggcttctaaggtgaccaactgttctgatttgcccgggactgaggaatttcccaggatgtgggactttcagtgctaaaactgaacagttccatgcaaatggggatgattgaacaccctgaaacatcacccaaaccataaaggaagatattgatagatttcattccataaaaaataacatgtgaatgaaaaaacagaaaatagtctgaatgcatctaaactgtttttctctagaaaaaaattaaaataaatgactatctctttgggactcaagccatttagtgacattgcccttcatttcctgattgccagtatccaacctccttgtgcctgaaccccatcagtactaggagccctgtcgcctatgaattcccaagttcctacatctcactttagccaaaatcatccatgtttgcagcactctcttgcctgtcatggccctccaacctcctggagccctctgactcctccattgttgctctttctttcttctgtcttccttctctagctagtcaagatcacctaatcagtcacttcaaataacttggtcgatatcataccctgtggtcctctgcacttggcaaaattctggactccagatcaattccacgatctattcaccttctgcacaaaggatgtggaaaaaccgcagatgaattctcaactgcagaccaatgcttctttatattcttctctcccacttcccacacaactttgagcccctgctctaccactgaactagctgtgtgatttggggcaagttgcttcatctctctgggtcactgttttctcacccaaaaagtgagatgttgtaaggaataactgagttagtacgcataaaatgctaagcacaggcaatggcatgtaataagcacctcataaatgctggcttttactgatgctaggattttgaatgcacacttagaggggttaagtcagtgtgtcaggaagtagcaggtcatagcattgtgatgtttggcaaataaatgacacaggacactaaactgtgcaaaattttacttttgcaaagatttaattccacatttcaccaaagatgatgctttggtcatcagtcaatgatgaaggcatcattgactaatgatcccttatgatcattagtcataagggaaatgcaaattaaaaccacaatataccactatgcatatgttacaatgtctaaagtttaaaagactgatcatcccaaattttggcaagaatgtgaagaaactagaactctcataccctgctagtgggaatggaaaacatttgaaagaacagtttactgtttctttttcattttttggcactttcttaatatgctagataaacatctaccgtaagatccaactattccactcctaggtatttacccaaaagacgagaaagcgtaggtccacacaaagatttgtacacaaatgctcacagcagcattatctataatggccccaaaactggaaacaagacttctccagctccatttacagtctggctcctgggcctttggatcccagcagtgtccgagcaggagctcaaaggacagccccaccatgggggatcagccctagaagctgtcactacatctccaacggacgcaactattttccaggtaataaagctgcagtgaatgccacctgtcaactagttcctttcaaattctgacttggtttggtaagtctgtggcttgttgtcataccactggcagaaaaggccccttccctgtagtcagactgtagaggccacaggggctcttctgaaagaggaagcaagctcttttccaagcgttatttttatttgttgtacattttagcagattaagcacttagggttgggattttaaaaatattgaacaccgggggagagagccaacaacagcacagtggccccggaccgtgacccttggactgaaggaacctacagatgtggttttttttggtgacattttacatgcaactccagatttcaaactcttttggagaagcaggcaatctggcaacagtcgttttggattctcagaaggcaataaagaacagctgccaccttccgaggggcacggtggatgccctgttctgccagaattgccaacacgtttatcgtcttagacttgcccaaggtgtcgcagttagagactgcctcccttattcacgctcctgcctggtgcccgtgggcttgaatttgctccccttggagtggggtgaggctctgcagacacttctcatacacctcccctgcagacagcaagctcctggaacacaagtcacatgcatttcatttcctgctctcttgctaccacccaacatgggctctcaatacatgttgaaagcaaggatcaatgaataaatgggcaactatcagctgtagacttgtatgtgccaggtatggtgctaggcatgctaggcaccaaaagggccacagaggtgttacatgccaggatatcagggagttcatgacatagtgagggaaagaaaaagcttatgcagtgtgtgtgtgaaactttaagcaaacatggtgcataacaataacaggaatgactttgcctgcccctgatgaaacttcagcagggctatgccctgtcttgccacctttaggaaacagcagtcttatagtcctttgcccctctgagttacaaccactgtctcctttcaggagaatgcccagtgttatatcataatcaaggctttgaacttgatgtggcattacatgttcttccatctccccagccacctgagaagggagatggggtagcttttctctctcactctctctcccccaacccctccttttcccaccggcaggtgaatgagcttcctgcccataggagaaagggtaaaatcacaaggtggtgcccttgtctccaaatctcaaggtcctctggatggcaggtgagtaaaggtgactcttgtgattatgggtgttttgggtgttcctcagagatcccccaaactggggtcttgtccaccattcccaggactctgccatgtggagccatgggaatgtgaagttcacctcacacttcctttcagctgaggtcaccacacagcccctaccagcccggctatattgggtgggatttcagatgcccccacaatggctgccttggagactttccactggtcctcaagaagcaacaacgctccccttgctctgcctttggtggagggcaattcctcctctctctctgcctggccccaggctgcttccactgtctcagaaactggtccccggattcccccagttacagagaaccctcatcaagctctcaagtggccactgaaacccaggctctctaggctctggagtatggaagtgacagctccatttaatttctcctttcctcttgtaggcttacagcatagcactctcccaagaaatcatccaaaaattacctcaaccattctatagaccccaagctgaccaggggagggaggaccaagaatcttgaaacgtaaatactacatttgatggtctccttcagacttattttgggatctgatatctctttaacaaaaattataaaaattgaggcaaagagagccccattttttatatactgttctaataaataacaggtacccttagaagaatgcagacaaacactcctatggaaatttaaaggagcataagacttcttgcagtatagggagagaaccaaggaagacttcctggaggaaatggccattgaactgggccttggacatgtggaggtgagggatgagagtattccagatgaagagtccagcatagggaaggcccacaggaaggaattgtgctgtattaatgctgtcttagaggcatttccattgccagacacagatactcaaattacttcagagagagagagagagagtattgaaagggtttctgtgaatacctccacaactgtggttctcaaagtgtaatccctgggccagcagcatcggcatcacctgggaacttgttagaaatgcagattcccaggctgggtgcagtggctcacgcctgtaaccctagcactttgggagtccgaggtgggtggatcacctgaggttgggagtttgagaccagcctgaccaacatggagaaaccctgtctctactaaaaatacaaaaagccaggtgtggtggcgcatgcctgtaatcccagctgcttgggaggctgaggcaggagaatcgcttgaacccgggaggcagaggttgcggtgagccgagattgcaccactgcactccagcctgggtaacaagagcgaaactccaccgaagaaagaagagagagagagagggagaaagaaagaaaggagaaagagagaaagaaagaaaaagaaagaaagaaaagaaaagaaaaaagaaaggaaaagaaaaggcaaattcaccagagcctttgaatcagaaaagaacccccaggggctggtggtagcagtccttgcacaggccctccaggtgattctcatccagggaagcctgcgagcccttgaggtggaatattctcaggaatccctgagatatgtgaagaactgatggcataggctatttctagggaggaaatggggctgctgggtgcacagatgaggggaggtgggagacctctgtaattgtgtaccatgtgcatatattacctattcagagaataataaaacaatgcgtttaatcccccgtcttcctccatctacttctctcgtaccccatagctgctctagcacctccacctccctcctcaaatggtgttctttgcttcctaggcaagctggttttctgttctcccttccccggtcttctcttgcctggtctttattacaaggtgtgctaagcctcataaggacagttgaagagaaaagaagtgagactgtgctagtggctatagaattctgccaggagagctggaggtggggaggaagactatgaattcaaccatgccaataatttcagtcaaaaattaagaaaaagcccatctccgcccccttttcggttatcaaatatgcattgttttcctcttttgttgggcttttgtgtctgtttcattctcaccttgactcagcccctgtgagcttcaactctaagcctaactccagccacggagaaaccacggagaggtttgtccagtgtctggaagatggactgactgctgaaacaggagcaagaagaacctcctagcaggtcagacatacccaaagacagccacatggaaatggacactgttgcaaggacgtgtgtccagcagagcaggggcaaatgcccctggtgctataactccttaaaggctcaaatatctctgctgacccagtgagtgcccctcagcttgtggtgtgagactgaacttacagacaccacctcaactcgaggaattcaatgcagtgatgagctgatttatggtgtttgccaattcctgtggtgtaaataactcatcgcatggccagtttcaggctaccaatgtgaagtcactgaacccaaagtttggaagagatttacataacagtggacatagttactgggcttcatagagaaagctactaaacacaagtgcccctggggtccagaaatcaacttctggttggaactgacctatatggtgccaagtgtgcatcttctaggaggacactagcattagcatgtcatccgccagtcttgcaacaagccttttccgtaagagcctttgactaacatttgttgaattttgtattcactgggggctggacgtggtgacttatgcctgtaatcccagcactttgggaggccaacagccagtgccactgatgaccaggcctgaggttaaaagattaacccccgactctaaccgcatgtgctctcaatctatcacgaccctttcacatggaaccccttagagttgtaaggccttaaaactctggcttcctggagctcggttcttgagacgcgagtctgccaaaactccccgccgttgagacgcgagtctgccgaggctcacagcccaataaagccaaatccttcgtagccgggtgtctgaggggttttgtccgcggctgtcctgcttcatttcttggttccctgaccaggacttcagggagccaggatgtcagcagcctggagagctgaagaagggaagcaaacatcttcaagacgtctcccggcctgcccactgctctgcccaggcttggagggagggagaaagggacacaaaagttcatgtcacactccaggctaaaattctcccaggtgccctaccattacctacaggcaaacagcctaattcctgttttcccaagacaggagaagccctgcacaacctggcctggcctctcccatccctgttccaggcatgctttcttgtgtggatcactcactcccaccctcagaggggccaggcatttccacacctctccacttttgtctcaaataaaaatattctggaattagatagcgataatggttgtacaacattgtgaatatactaaaaaccactgagttatacactttaattaattaattaatttaagacagtgtcttactctgttgccgagactggagtgcagtagcatcatcacggctcactgcagcctcaacctcccaagctcaagtgatcctcctgcctcacactgccatgcctgactaattttttttattcttaattttgaagagatgggggtctcgccatgttgcccaagcttgtctggagctcctgggctcaagccatcctcctacctcagcctcccaaagtgctgggattatgggcatgaactactgtgcctggcccagttatacactttaaagtgctaattttatgttatgataattatatttatagcatttaaagcccactcaagtgtcatatcctctataaaagccattccttagcctcttctgtcacccaacccatcttcccaccccaaaacagatcccatttcttctaggatccctttgtccatactcatcaatacccgcctggtccactgcatggtagccagcagtatgtgtatctccccttcaagggtgaagccctggagggcgagagatatgagttcatctttgtgtgccccagcgccacagcctgcatgctgcatataagaaatgctcaacaaatctttgaaaccatttcaactctttcctatgcaatagagctgtcaatgtatctgtgtctcttaaacctctccttctgcctgaagacactttggatttatctggcttgtgaccaggcggcttctgaacaaatagggactttgatcagtttcacaaggtgcccacaagtgccaagcactgtgctgggagcagtggccataacagaactaaatggcatggtccctgccttcaaggaattgataatccagtagtgggagatgaggcaagagtccatacccctttatccacagtttcactttccgtggttgcagttacccatggtcaactgaggttcaaaagcattacatacaataagatattttgggccacagttggttcatggctagcactaaactaatgttagctgtcgccactcccacctaaggccagtccctccaggaacctgacacttttggtgttccatctcttcttctcaaccatattcctgtcatggtgggtagcacccctgttcatccagttgagccagccacaagcctagaggtcaccccactccccatccccacaaaccgtcatcaagtctcatcaaccttattaacttccttaaaaacttccagatctgttcccctctgtcctactctacaacttctccccagagctagcccagtagcccccaagtacaaccatcccagccactacccatttccaccctgcggccagagtcctgctttgaaatgcagacctgatcttgtcacccctccctggactcgccctgctgaaatctcttaatgactttccactcctcttggggtgaaaatcaaaaccctaacaccatgcagactgagtctgttagaatatttttgaccctgaggatcagaaaccctagcaaaccagatttaaattacaggcagtttattagcttcctcacaggtagactggatagggtgggcttcaggcattgtatgattccagcaggttctcttcaacaccccagccctggagagccgcagattggacaacgggcagactttgttgaacagatgaacaactgtggctaaatctgttttggaaaaaaaaaaa

SEQ ID NO: 3884 - DNA, 3543 bp, Homo sapiens
gcggggttggagggactcagctacgcgcctggggaggccgcgggccctcgcagactaccgaacttccattctgccgccgggttttcacacctgccggccccgaggaaacaatgacgttgggattttggggggccgccccttgactcgggcgaatgggacacgaacggcgaccccttgctctcttccatccgcctgccgccgttgctgcccaccgactcctacagctcatttctcgctcctgcaggctccaggaatgcaaataatttctcactgggttttggcgggggcgcggagctgcggagaagcgcgcgcccgacagctttcgccgcagctgggtccccgggcgctggcggctgcggcccccagatacgggcggaggctgcaatatgcacatgcggccacagtgtggctccaggggcccgccgcgggacacgctcggagcgcgacgccccatcccatcatttacggatcaaaccaaataatctagaatcaagttgctgtgtgtgtcatactcctcctgttttttttccctaaacttttagtagagtcatttacatagttcagtttttacctcagctatgttacacagtggcaggaaaatattttgtctccaaactacagcccaagtatgagagcagcgtatcctgaagctaattagtaaccagaaaatcaggaaggtaaagcaaatctctggaggcaagatctggactctatgatatcgccgcttctccccacttgaagcgtctctttgcagtgccgcacttggagatttggacttaatcgttaaacaaaaagaacagttacattctgccttcctacagggcaggggcctaggactggcaacatttttgttgtctctagaaatagaggggttatgagagagcctcaaaagagagggcaagaataacacatccatttctcatcatgagttacccccttgtatgcctagaacgcgtatggagacattctcttttagtaaagtcaaagagaaaagccatgaactaagtatcctgaacacagaggcgtgagccctctcagtctcacagtcccttaggagtcatttatctcagaagttggttgaaacaaaaacagttcatacagcatggtaggcagaattctaaaatgatcccaatgactcactcccttgcataatccccttgagtgtgggtggaacctatgacttgcttctagccaacagaatatgacaagggtgatgaaatgtcactcttgggattgctacattatgtaagactctatcttagcagtctggatggaaagtctcctcctgaacttgaagaggtaagctgccacgccaggagagggcctgcaagagtgccacaaggcaagggcctctaggagctgagagtggccccccactgatgggcagcaagaaagcaggaacctcagtcctacaaccacaaagaactgaattctgccagtgaccttgtgagcctggaagagctgcaaaaagaaacacagcaaagtcaacaccctaactgcagccttggaagactctcagcagagcactcagctaagctgtgatgggagtcctgacccatggaaactggaagatcttaaatgtatgttgttgctaaatttgttacacagcaatagaaaacaaatacactccaactcttgacaaatttgttaataggaccacgcatcctgagacaaacacacagaagggcaaacatccagatataaacatcctactacattgatatgaatactcacatatgtaagatcaatgatatcactagcaaaacaagctccaagtcaatgggtttttcctttcgacaaacacctctacacataaccaaaaatgcttcaactacttttcttttctccagaggcagttggtttggctaagtaaaaatggggttcttaggagactaaggcggaaaagagacaatagtgcctttttcccctccagaacttatctaagaatggaagacaggtgtttctatgctatacatagcatgaattttacagtcatggatactgatataatgcttccaaatagaattaattctcttccctcccttattcccacccacagccagcagatgctgaaagactgcactgcccaaacactgccatctttgctttatatatccaaaagagtgggaaatgctgtcacatctccatcagaaactgtcaaacactagtaatggtagaaaatatctgaatgacacaattaataggcttgattttgtggatgctctactttagaaagaaaattcatatgcttttcaaacacacatgcaatattagaaaaattaagtgtgaactagaccacaaagcaattttcaacaaatactaatgaactgataccatgtttaacacaaattctaaccaaagtgctataacattagaaatcaataacaaaaaactaccctccaaaaaacatctaagtaattcatgaataaaataatgtataatggaaatttatgagtttttaaacttaagtggtaatggtagtattatatatcaaaactcaagagatgcagcttttagcagacattactaatttcctactcaacaatcattcccctaccttcatgactttggtgtcagccatatgattagggctcgggtccaccaaccagctgcattttcttggtcttagcatatactgattaaattgaaatgactaagagtcagtgagctgcaattgaattccccatggctgactgtggcgaaacattttaaaatagggcatagacagcaccaaccaaaaatgttggtgtattgtactgtagtaaaattaacaagtcttgttcattgaaaacaaacaaaactttaatattatagtgaaaagaaaagccacagagtgggagaagatatttaagactcttgaaaaaggacttatatccagaatatataaataactcctataagtcagtaagaaaaagacagacaatagaaaaattatcaaaaagaccttacaaaaaaggatacccaaataggtaataaatgtgaaaaatggtcaatatcatagtcattagggaaatgcttaatttgcatttgtatatccaaaagagtgggaaattgtaacatacctccatcagatactgttgaacattagtaatggtagaaaatatttgaaacatgtaaacaaaaatatccacagcattactatttgtaagtggtcaaaaccagaagcaacccgagcccctcagcagaatgggaaaatatgaaatatacagtaataagaacaaatgaacttcaatttacaacatgtatacagttcacaatcataatgttgagaaaaataaaccagacacaaaagagtacatcctgtcccataccgtagccctttatatgaagttcaaaaacaggcaaaaaacctatggtgctggaagtcagtgtcaggggtggactagaaatgggcaagaaggagtttctgaggtgctggaaatgtctaaaatagatctggatgctgtttactttgaaaaaatttactgtggcgtacatttatggcttattgtacataagttatatttcaatgaaaattcacattaaaatgtaatgtaaaaaaga

SEQ ID NO: 3885 - DNA, 1146 bp, Homo sapiens
ggttctgtctgcgctgttacgtattacctacacttctgggtttttttgttcttgttctcagcctctctttaagagttcttgggccttccttttccctctttctattttaacagttttaattttagaaccatttacattccagtaggtaattcactatgcgctttatatgccttagggcatccaaataaaaaacaatagggtaaacatccccaaaacccacctttaaaaaaaaaaaaacccatacagatttccatatgtaataaaaccccgtgttcttggatagatattaataaggttgtaattccaactggtgacataactcctgtgagggataagaatgtgtctgcttatagtaataacatcagaacctctttgtgaaattgcggcctttaatgtacattttaatgaaagggtgcattagtattgtacaggggtcttgtaaagtcatcaaaacttgctatgaactctaattgccatttgaagctactgattggcagtggctctactctaaaactgctttttagcaattgtatttttttcctgattatattttttaatgtactttgatgtttatgctgatgagttttttatgtacttttggtgatgtttcagtcttatgtactcttctgacgtcagaaaagtaccactggttgtttgcagtcttattgtgtaatcagcctaccgcaggcttccatgtataataaagtaattaatattgtgcaagtgtaaaacacttctgttataaaagcagtgtttggaaaataagaaatattaaaaatggttacaaagtattagttaatttccttttcccactttcctccctttagctttagcagctaaagggtcaccaacttgtcattgcaagattcttagaaaatgtacttaatcttaaatacgctgagtactaaaaagtgtttatttcttatttcagtaagtgcggtaagttctattgagtacagagtacaagctgtaatcaaaggatggagaggacctttaccactgtatctcttaagctgtatgatttttctccagtttgttttatacaggttttgaatttctttaacttttattgtgtgtactgaatactgcatatgtattattctgattgtttgctctagtttactaccaataaaagtcctgttaatc

SEQ ID NO: 3886 - DNA, 5409 bp, Homo sapiens
ccagcgctgggccagtgcaggccgagccctgcgtccctgcctcgctgggtgggggtccggggcgcggctgtccacagggccgcctcctcctgcggcccgcggggaaggggcgcatcccaccccgctctgcaggccgcccttctgccagctgggaggcgagggcacacgtcctaaggctgcccaagggggagaggaatcgcgccggtaggagagcgcacgggaaccaggaacgcaaggcgggcacaggggagccgaaggagccagacagggcccggccacgcgccctcctcgctcggctgcgctccgtgacgggaacccaggctcccacgcacggggaatgcctagaacggagctagaatggaggtgggagctggagtcattttgcgggccacaggactgctcatttcgtgggcaggacgtgacattcttgtccctcctttctgaaaaacttttctcaggcgcctgaacttggcatggggaccggcctcgaaaagccggcgggtagcacggccgcggtatccaacccttcgccctccttcccaccggccctccgcgtccctcggcccgccccccgggtcggggacgcgcgcggaaaggccgctcgcgcgctcgagccgtgccttatatcggctgagggaggcgcctgcgcacggccccgcgcggcggcgcggcctttgaagtcgcggcggctgccgctttcatcctttcttttttccctcgcaggcccctttgtgtgactaaatttggcaagaatatggatctgagccagtctttccacgtgtgctcccagctcccagctgagaaggccaagggttctcttccggatgcagcctttttgaaatttattcttggccaaaagaggaagatagttcaaggattctatcttgcttttggggggcaatggagaaaccctgaaaacacttaaggaaaacctgaggccttctataagaaaataaactccctgaaaggggaggcagggccaaggaatttacttatttttataaatctctttcctgggtggatatggtaatggatgtgtttcttgaattgtggtaaatgtacctcataaaatggatggactggggctatattctcaggcttcctgggctctgttggcattgggcaagcacgtaatgcctggtttgaggctagaagccaaagccacaaccttcttgcagtaccaactgagccatagggagattaatgcagaacaaggtcgttagtctcattgtttatccagttactagccgcatagattttgtgtaaatttcagctacagtggttgcagcctgcctttgatgtgtgtaatctgtacattttagtgctccaggaaagtacctgattgacaagatctacatccaatgcccagaaaacacatcctacacaggcacagtgaagcgtggagttgaagaattttccagtgagttccatcaaagtaaataaaccaacctagagcatcaggattgagcctcctttttctcatgacatgacttttgagtgtccttgggaatggtttgtatttgttttcatttgaaactgggtaactgctttaaatccttatttacctctcagaggaagaacttggcctgtatgacatttgaccttgaggatgctttctgttttaaagcacttctgtccataaaaacagactccttgagtgaggttacctgtactcatatatacatttatccaagacacagccaatttctagttccttccttagctttgtcttgcttgtatggctacgcttaaactcagaattaacaacgatgggagtgaattcagatggtagagacagccagtgcaaatagtttaggctacaaaattgtcatctggctccaccaaacacttttctttggccaaaataaagctaatttgcctcatctgaatttgacttaaaggtcctgcagtcccgctctgccaattaacagatctcaagtccacttcccttaggttaaattggcagaaagcaaaggacagagataaactactatcctatgaggttagacggtaatttttgactgccagttctgataaccccagactcccaaatatattttgagattcatttgaattaccgagatatttgatttttgcagttcaaattactaggataattttttacattgttttgctttgtatctcacagtggctgagtaagacagaccttgttgaagctctaactctctcactgttagccctccctgtcctgcacctttgcagttgcctcctaatgagtctctggctttcattcttttttttttccgagacagtctcccactatcgcccaggctggagtgcagtggtgtgaactcggctcccaggttcaagtgattctcgtgcctcagcctcccaagtagttggaactacaggtgtgcaccaccacagttggctttttgtatttttagtagagacagggttttgctgtgttggccaggctggtcttgaactcctgacctcaagcaatccacccaccttgacctctcaaagtgctctggcatccgttcttgctgggttccatgcatgccccacaatagtccatgcctcatagagcagccaaagtcatcctttaacatttcctacttgtggcttccaagtccctatgtgagctgttacctggcttcctcttgctcactgctctctagcaccactggctctccagctgttccttcagagtgcaaagcacatgcacgcacgtgtacacacacacacacacacacacacatgcacacacacacacacacactatacacctcagtccttgttgcctctgcccagaagctcctggccaggtagatgttcacagggctcactccctgacttcattcaggttctgctcagatagtccctccttagagcttgttatcttaaaaaatagccatccccccaaaccttctgccttcactccaattccggtcactctccattttttttatggacttcatcttcttttactgtcactgcttggcctattttttatacttacttactaattagctttctttcccactggttcataagttccatgagggtagggactttgctttgttttatccttacttcctgtggcagctcttggtgcatagaaaatatactagcaaggtgtgtagaagaataaattaacatgcctttgacaacctcaggtttcttatctggaatacttcccttatggaagattacaaataattgttataaaattacctggcatacagtagatacactcagtaggtgataactgtaattatgcagatcagcactgccaaatgaaatataatgcaagtcacatatgtaattttaaaaagctagaaacagattaaattaattttaataatacattttatttaacccaaatgttgaaattattaccattttaatatataatcattatgaaaacttactaatgaaagattttacattcttttttcatattaagtctttgaaattcagtgcagtttacttacagcaagattcagttcttttttttttcttttttgtcttttgagacggagtcttgctctgtgcccaggctggagtgcagtggcacgatctcggctcactgcaagctccacctcctgggttcacgccattttcctgcctcagcctcccgagtagctgggactacaggcgcccgccaccacgcccggcttttttgttgttgttgttgttgtatttttaatagagatggggtttcaccatgttagccaggatggtctcgatctcctgacctcgtgatctgcctgcctcggcctcccaaagtgctgggattacaggcgtgagccaccgcgcccagcaacttacagcacgattcagttctaactggccaccttttgagtgcttgagtgtggctagaggctactgtatgcagtcagtcaactgtttaatgacaagtttttgtcagattcatctttgtaacccccatattgccttacacatttccctcaaaacagtagttgatcaaaaatgtatcaaagaatatcataacaatatattgttatatactatttttcatggcaaattcagactttcaacttattggagggtgaaataagtcttggtgaagtaacttgagattataatcattttaagtgtattataacagtgctttgcccataagagaggtgtgcaatgaatagttgtggttctcgtgtgttgctgagttgagtacttttctacattgtaaataatagatttaccattgaactttaggaaatacataagttgaaggttttctgtatcatattctctagaataactttctcctccctgtaaaactgccaaacctgcacttctataagagtcatccaggatcaaaagtttctccagaaatatataccatggagagtgcctactcccactacagatttcattttcaggtacaattcctgaactgcttcttggtacacatgggccagatataatagtaagtctattctgtcctatgccttgagttttcactaaaatgctttaataaggcattagccttaggcctagcaaattcttttagttgcaaaagtcattcccctccatttcagagatttaaacctgatgcaataagaggaggaagatgaacaaaagagcagggtcattttctggaagaaatgggtaaagactgtttgttgagagatgtacctctaaagccttgatatgcttttatggtagagaagtattacataaacatactatccttactgtgactaaaaatgacccataggccaggcacggtggctcacacctgtaatcccagcacttttgggaggccaaggcaggaggatcacctgaggtcaggagttcgagaccagcctggcccatatgatgaaaccctgtctctactgaaagtacaaaaattagctggtcgtggtgtcaagcgcctgtaatctcagctactcaggaggctgaggcaggagaattgcttgaacccaggaggaggaggttgcagtgagctgagatcatgcccttgcactgcagcctgggtgacaagagcgaaactccatctcaagaaaaaaaataaaaataaaagtgaaccatagattttcagtgaagtacagagagtaggctgggcacagtggctcacacctgtaattccagcagtttggaatcaaggcaagaggattgcttgaagccaggaattcaagaccagcctggtcaacatagcaagaccccatctctaaaaataaaataaattagctggatgtggttgtgtgcgccagtagttccagctagtcaggaggctaaggcaagaagagcacttgagcccaggagtttgaggcttcagtgagctatgatcatgccactgcactcttgcctgggcatcagagtgagatcccacctcaaaaaaaaaaaaaaaagaagaaagaaggagaagaaaagaaggaggaagagaagaggaagaagaagaggaggagaagagga

SEQ ID NO: 3887 - DNA, 652 bp, Homo sapiens
attaggtcttgaaggaagactttaactttggatttttcaatgtgtaatgatgaagaatggaaaggccattctaaacagaaagataaagagagcaaaggaaaacagttcctcctgaggatttcagagaagagctggacttcctggctgactctcacattctcttcttctgaactgcttcttctggtagctccctgtcactttggacaagctcgcactgccctccttggctgttctggaactgtgtgatggacttcatcctactaggacacagttgcttcttgaattccccagataaacacccacccgtgtgaatgacaagccataataaaaattaattgtcaaaattaatcaacaaggtcccaaacaagattgagagccaggggacagaagtgccaccggtaattatatagtcacaggcagacctatgaggatgttcatctttcctctaagacaacttgaagttacagacgtttcttagaacttaaaaagtttgatagccccttacccaaagaaatagaagcattggaaaatatgttaaagaaatttctatgaaattagaacaaaatgacttattttgcaagagaaaaaataagtaaaagcctaactctgagaagtccacatccatctaataggtgttccagaatcagaaaaa

SEQ ID NO: 3888 - DNA, 3309 bp, Homo sapiens
aaatatcatgtttattctgggggtgggggggaagagggggaagaagaaaaaaaaaagaggaggggaggcaaaattggcaatagtttttcccctaatcggccatatcctcacaaaggtattgtatatacacaggcctaagaagctgatcagagtcagccaagaaaaagttgattatcacccagccaattcccactagtcaaatcccaatttgacagttcctttgtaaaactcctgttagtcttaacctgtttctgcaaaaacagtatcaaaggctaacattcctaatgttcgtagtaaaacaaaaaatatcataaaacttggatgaataaagcaacaattaaaatcaacctacaggccaggcaaggtggcttaatgcctataatcccagcactttcgaaggctgaggcagatagcctgagctcagaagtttgagaccagcctgggcaacagagtgaaactctgtctcaaaaaaaaaaaaaaaaaaaaaaaaaaaagctggtcatggcagcacatgcctgtagtcccagttactcaggaggatgaggtgggaggatcaactgagcctggaaggttggggctgtagtatgctgtgattacaccactgcactctagtctgggcaacagagcaagactctgtctcaaaaaaataaataacatcaacctgcaaatgcaaaatcattattcttgtagtattttaggatgtttttgtggttatctctaaattcaaaatggatcccccatctgaggaaaccaaactgacttacgagcaaaataggaaaaataaatttgccttattacccaaatattctatgctcttctaaaaacttacaatctgtactaatacctttacctggttttataagaacaaaaaagggggaaagaatatccaactagaaacccaaaaataggcttatacaaagagtaagtaagttgctcttttctttgaacagtctcatgcaaaaccaacatttctagtttgctaagcttctgtaacacaggatatttcagggagtctgggcttcaatgtgcagcataaaactcttttaagggcaatgtaagcaagggaacaagagaacataaaagcagtagcaaggcccagattgtgttgaggcattttgagcagaggaatggtaggagatgacttactctaaagaatcattttggccgggtgtggtggctcacgcctgtaatcccagcattctgggaggccaaggcaggcagatcacgaggtcaggagttcgagaccagcctggccaacatagtgaaaccccatctctactaaaaatacaaaaaattagcagggcatgggggtgtgtgcctgtagtcccagctactcgggaggctaagacaggagaataacgtgaacctgggaggcagaggttgcagtgagccgagatcacgccattgcacatccagcccaggtgacagtgtgagactcagtctcaaaaaaaaaccaaaaaaacaaaaaaaagaatcattttggctgttgggtagagaacagtcaaggctactgggggtaaggggcaaaagaagaccaattagaaagcgtcattaaccccagcaagagacaatatagcaatgaaaaggtagtagagatagaagtggtgggatgttactgattctggatatactttgaaaatactgcccataggatttgagtggattaattaaataggatagaaaaagagaagtcaagctttttgtgtcagcaaccggaagcaaggattttctatttattgatgaagagcattgtaagaaaaatctattcttctcgtgccatgcagagacagctcaacggacaaggaacaagaaattaaagtttccattttagacacattatgtttgaaaacctatcacatatccaaacaaagatgccaagtaaagtgctagttaaaccagactagagatcaagaagatggagcctagagatataaacataaatgtgggagacatcagtgtgtgaatggcattaaagccaaatgcaggagcaagtataaatggagaggctaagatgactaaggacaggggttttgggtgcaccattttttagaggctggaaggatgaggaagaaccttatggttcagtaacagaccaagttggagtcatcattcttaaccactcttcaaaccaagccaaacttttgtgatttggcctagctcaagaactgaaactaatgtaaaattatctcatttattcattcttttcaataaatatttattcaatattttctacactccatgcactgttgtagactttggggacaccactgtgaacagaaattcatggaacttgattttattgttggtctttctcattagaaacaaagaaacagataactaatgttaagcagtaggcaactgctgcaaagaaaattaagcagagtttggtgatggtgtaacagaaatgctactttagataggaaggtaaagatgtgcaaaaaggcacttattggaattaaaaaggagaagggcaaaggcagagaaaatttgagggtatgaacttattaaaagaacgggatactgttataaagaaccttttcaaaaaagaaacatactgaattacttttaaaaaactgtcctaatattacacaaaagatatttgtgttttagaataaaatttctaaagatagcatcattgacacattcaaactgctgtatcttaaacaatttaaatggaagtgaatttaatgcattttgcaaaactattaaataacaaaatataactccagtgaggaagatactaatgtcagatgtagatggaatgtgaaggtgaaacccccatacactgccggcaggaatgtaaagtggtacaacctctgaggaaaagtgtggcagttcccaaaaaagtttagagtcatcatatgtcccatcagttccactcctgggtatatacctaagagaactgacaaggtatgtccacataaaaacttctacacaaattttcgtaacagcattattcatgatggccaaaagtgcaaacaacccaaatatgcatcaatcaatgaatggacaaacaaaatgtgaatggataaacaaacaaaaaatacacacacacacacacacacacacacacagtatatataatggagttatccagcaataaaatggaataaaatactgatacatgacacacatagatgaaaacattatgctaaatgagagaacctggggcacaaaaggccatatattgtgtgattccatttgtatgagatgtccagaaaaggtaaatccacagagacagaaagtagattagtggttgccaggagccaggttgagggaagaatagggagtgactgctaatgggtacaa

SEQ ID NO: 3889 - DNA, 2052 bp, Homo sapiens
agctgggcggtcacatctggaaatggaaagccgacctccccctcctcctccacctcctcctcctcctcctccttctcctcctctcacccaggatcacttccgaaaccagttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagttctgtttcatcaaatggaaatgggacatggacagtttctcctatcccatgcagaccatgctcctgaattaaaactgcagaatgtgttaaagcatcattcaacatcgtgagcacatttgagatactgtacaggacaacctgcttttcatattctctgtgaatttcaaagacgactgggattttcttcctcctctaccaccctgaacagcaagaccaatacatcctgtatttcctcctcttcagcctacttgtgaagacaaggatgaagacctccatgatgagccatctccacttaatgactgtctcacattggccggcaacttgttccagatgaaatcttgctctgtcacccaggctggagtgcaatggctcgatctcggctcactgcaacctccaccttctgggttcaagcaattctcctgcctcagcctcctgagtagctgggattacagatggagtctcactgtgtccccaggctggagtgcagtggcgcgatctcaactcactgcaagctctgcctcccgggttcacgccattctcctgcctcaggctcccgagtagctgggactacaggcgcccgccaccactcccggctaattttttttgtattttcagtagagacgggatatcaccatgttagccaggatggtctcgatctcctgacctcgtgatccgccctcctcagtctcccaaagtattaggattacaggcgtgagccaccgcccccggccctcaaagattgttatgagtcctcacagatgtcagaggacgatgctgtgacctatatttgcaaacgcccggaagacttaaagctattgttttgcaaatgcacagataacaataataacatgatgctgtggatgagcatgaaagtttttctcttactcctaattataatgttttccctcttactgctttgccctgctgatggaattcagtaaaggaatctctaccagcagacacttggtttttacccttcctaggacctttaatagatatctttttattactaatctttgctctttgcttgtttaacctccttgtaaagtttgtgtcttccagattacaataattccatgtaaagatgatgctggcacaaggctttcaacccatcccctcttctgacccagaagataaagacatcctacctttgagccttttagaacaggtatccagggattttacctctccagtgctaggcagggtctatgcccataacatcagcaggaagcagttacagaagatgaacctccgcccttctgcaagccccttaagattaaggaggagtatataatctctgatggggaaatgaggtaggagaccagaaggacttattttccattcccaaccccattgaacagagcaggatctggtcaaaacagggtgcagtggagaagcctgctgaaaccagcagatgatgatgaaagtgacctctagttgccctcactgcttatgagcataaagacactaccactgggaccatggccagtttacaaatgtcatggcaacacaccttggcaatggcctggaagttactttatatggttctggaaactccctgcccctttcccagaaagttctgaataacctacctcttaattggcatgcaattaaaagtggctctaaatacaactagctagtagcccacaggcacaaactctgggcacactgcctataggttagccctgctctgcaagaagtagcaccagttcaataaaagttgctttctctca

SEQ ID NO: 3890 - DNA, 4600 bp, Homo sapiens
aattccagggaatggagctagtcatgccacacatctttgctgttttcacgaactgagagacagattcttcttatgttgctattttaaactcctgaactcaagtgatcctcctgccttggcctcccaaagtgctgggattacaggtgtgagacactgcaccctgcccaagcacctctgctccgtgccatgctcttggctaattggagttgtgaaaggcatgaggattctggtcatggactcagctctcccatagggttctgacaccaaagcaatggtcacaacagtgaaaggaagaatccatctggccaggctcaggtggttcaaggccttcagaatctgccttgagactctcactggctttagactgaaaaccatcttggccccgtccatccgtgtaagcaatttaacgacagcttgcaaagcaccgagctttaacagaaagaagagatgagcacagcgcaagaacttggactccagaagagctgcctaacagattatttttctgtggcatttcatgagaacaaacgaagtaggaattttccttttgtttgtctggcctttggcatcgtttactttctttttattcttctgaaatgtacttcgagccctggcagcatttctgtcctaaaatcttattgtcagaggtttatttttcagcttttcaaatcatatctgatagagtgagtgtactgcctggactcatcactttacttcagaagaaatacagctcaccctttaaatgacaatggtgactgtccacatctttatgttttctacactgaagtggcaggcttcatttaaaaataatgttttccctcatcaaaagagagctagggtagaaccgtcaactctgctgttgtctgggtagtgacctaacacccacgttttggacaatcactcactgtcttatattgggttttcattgcatgtaggataattctttgtcaatggtagttttgtcaaccgtgatctgaggtaatgaggttttctacttttgcttgaaattttgaaaatatgcaagctttaaacatttgcaaagttggattctgttttctttagaaagcaatctgatttgctgatattctctccatctgtcaggggatgcgtgatgtggtgtagacttaatgtgctgcctttctggaacatggacagagtagcagcacagaaaaatgagcatttcagctctgtgatgatttgtgaaaaaaaatctcagatcattgagcaggcattttgctgacacctgtgaaaagtaaccacatgagagagcatggcgtgatggtcggaggccacgtgctggagctggactgcttgagtcaaatcccagctgctcagctgtagtgaactgaatggtggtccccaaaagatacatgtatctcctaatccctggaacctgtgaatgtgaccttattaggcaaaagggtctttgcagatgtaattacattgaggctctcagagatgagaacatcctggattatcagggtgggtcctatatccaatgacaagtgtctccttataggagacagaagaagttgcagacccggaagagactaagtaaagatggaggcagagactggagtgaggctgctgcaggccaaaaatgcctggtgccagcaaaagctggaagaggcaaggaaggacctttccctggggcttttggagggagtgcagccctgctgatgccttagtgttggatatctgggctatggaactatgagagagaaacttctgttgttttaagccacctagtttgtggtactctgttatggcagccacaggaaactaatacactctttaccacctgagtgaccttggccaacttacttaacctccatgaatcagtcccctcaaaggaccaccctccccccagggtcactgtgatgataaagtgctttagcataggtgactggtttagaccagggcctggtacctagcacatgctatgccagtgtttctatcatggcagcagcagatgcagtggagcttagatttcaactgtgtccatgctggttagaaaagtcacagtctgggacacaggacacttctggaagaatctccctcagtggatcccagtgttccagcaatgttttccaagcagctgaagaacaggaagcaggaacagggttccctacaagagccattattcagatgcctctacatctgactggtttcggagaagtgtgacttctggaggtttatgtgctgggactttaacagcatacgtactaaaaaccacatttatgtttcctcaaatgctgggctctctatgagccttgacctgcctgagaagattagaggcggctgcctaatctgatcagtcaactcagtgaaacaactgcattgattaaagccataagatgttaggattctctgttcttggtggcctaaaaggtcccattcctttcccaaagtgcttagcttgatcccatcccagggaacaattttgggtggaggagaacctggccacagatcataagatcatgtatgactaagtctacttgccttcatggaaacatacatggagttttgggcaatttctttgaagcccctctagaggcttctaaagattgtttagtgccatctggtttttaatcctggatgtcaaacttgttgatttttgccctggaccatctgtttttcaacttcccacggaacctttcctttgggccaagtagggaaagaaatactatatttttaattctttttgttttgccttctcatcccagtcacagcattagaaagggaaaatcgactgtctgacaaagctctgaaagactggacatgaagtgctggccttgctatctgcagggcatctccctatagattggataccttttccttcactctctgataaaaagtgagacagactgagcatagtcctgtgaccatttaatgcctgtgcccagaacatgggtctgtaccacttgcaggagtcacagtggggaggagcagggaccttggggtctgcctgcctctgtctgaattccagctgagcccattcctaggccagtgcctgggaaagttatctgacctctgagatccagtctactagcctcacaagtgagactgtgacaacacttacctcaatgaggcactggacatcatctcatttaatcctcaacatgcctcagtgtccagcatttaacaagctcccataaacattagttactctcattccttaatatgaatagcatttaaaataataaagtgggagagagcaatgctgcatgccctacaactggccagagagcttgcagcaaggagaatgcttaggtggaacatacaggccttttctgtgttcatcccattccaaaggatttggtgttgccatatatggaacatgaagattagaaatggccatttccaaactggtgaatcccttggtgcctttttctccattgtgattcatccggggtaccctcagttttcagtggtcatggtcattccaaaccagccatgagctgggggaacattgtactgtggtaaacccagggccacctgaccagagcttctccaattttataaacccaagttgtaggtgggatgatggatgcaggcttccctggcaaatgcttcctgggcattgtagacactgtcacttctagggggctgcagttgcctcattgtataattctggtcatcagaaaggaggcagtaatggatgagctgcccttctggacaaaatgacatctctcttattgaaaaaggctaagaagctattttcttttccccctctgcaaccactatttattgcatgagatttcagaatgatgatgataaaaaagcaagtttatagagacatcatgaggttgtgtaaataaaataaagtaatatctgggacagatataccaaagaaaattgaacccaaaatgtctaactttgcagtccatactcagccagaactcccaatgaattaaaacacagactgcataattatgtacacaaaatgcctttaaagttgctccataaatttggagaaaaaaggatagtctgtgtaaagctactagggcaaaattccttactgtgggtttataggcactagtacaagtggttcccaaatccccgtttttattttttaattataaataagaagaacacagtctccccttgcaacttccacttcgtcacagcctccaggcacagaggacagagttcctggaaaaaaggaaggcttaattccaggtctgtaatagcaaagttacagtcagactgaacattgattatatttaaatccaccatatttttcctttgaaaaccacatattatttaacatcttgaatgctttacattgaatttgttgaaaaattctccctgtgttttcaggcctttatcataattttgtttttatttcttaatttttcttttcaaataagtgagagaatcaagttaattgagcaatgatatgtaagtcattcagttaatatggaaattttgggccagccatggaggcttatggctgtaatctcagcattttgggaggccgaggcaggcagatctcttgagcccaggagtttgagaccagcctgggtaacatggagaaaccctgtctttcccccaaaatacaaaaattagccgggcatggtggcatgtgcctctagttcca

SEQ ID NO: 3891 - DNA, 557 bp, Homo sapiens
cccgcgtggggcccggtgggcttcccggagggttccgggggtcggcctgcggcgcgtgcgggggaggagacggttccgggggaccggccgcgactgcggcggcggtggtggggggagccgcggggatcgccgagggggtccccgtggcgtccccttccccgccggccgcctttctcgcgccttccccgtcgccccggcctcgcccgtggtctctcgtcttctcccggcccgctcttccgaaccgggtcggcgcgtcccccgggtgcgcctcgcttcccgggcctgccgcggcccttccccgaggcgtccgtcccgggcgtcggcgtcggggagagcccgtcctccccgcgtggcgtcgccccgttcggcgcgcgcgtgcgcccgagcgcggcccggtggtccctcccggacaggcgttcgtgcgacgtgtggcgtgggtcgacctccgccttgccggtcgctcgccctttccccgggtcggggggtggggcccgggccggggcctcggccccggtcgcggtcccccgtcccgggcgggggcgggcgcgccggccggc

SEQ ID NO: 3892 - DNA, 5984 bp, Homo sapiens
ggtgcagaggatttgaacagaatgagagtcctcctctgtgcagggagaaaggcttcagtgggtctccccctccctgctagggatcctccttgccagccctgggctgggcgctggcaggcccgttcccaggtctcccgccgagggcaggagaggagccaggcctcaggagagaagtgcttactgagtaatttaccaagagcgataggcttcccactgagccagacgggatccccaggaggggagtcagaggcgggcctggcatgcatgcacagagagagtgtgcccacttggggagtgtgaagggccttgctgtgggacccgagaggatgagcagagtcaagtggcaggtgggacacacagtctgcagtcacttcttaaaaggccctgggtggtgtgtccttcaatgatgaccattgtccacaatagtgagttccagagggtcgattgggacagttggatagccaaggaccagagtcaggaggcaaggctgatgagcaagaggctgttgccattggccaggcgaggcgtgagggaggctgatggagcgcagcagcagagggatggagaggcaggaatggcatctcctcacaggccaggctcctctgccggattgggtagggacgggaagatgatggcccccaaccctgggccaaggaacaatagcacccatccgggggcgggggacctgctggagtacttctcctggaccactgctcagtgggcaatagagggaacaatggtgtttctgaccaggacgggggaaggcaggggaatggaggaagatactgacagggtacagaggaggtagaatggagcgagggccatctccaccgggctaggaaatggggctttggtgggccacactccattgtgctggagcactctggcatctccattggcagtggggaggggcttgtgacctatcagcatcttcaccctttctgagtttccgccgggctgggctctccagccaggagtcacaggtaccgggtggttgttcatgctgaggccttttgcttggcaaaaagttaatccatttgtgttcatttttaacctaagcaagggttggagcttgttggattcagcatctgtggaacacagtctgtagcccatgggaagacgtggacattctttcccaagttcttgaaggacggaaaggaccatgaacttgtgaggtgaccggaggattggttttgggtgtcagttttgtgtctgtcccagtgctgccacttttgctttgaaatggacggggagagctgaaggccagcatgggtttctgcacctgtttcctacagctctgctggggactgtggctcaggtggcagctgtggacacggatcctgtcagcctttgggtggccagagctccaaggccaggtgtctcttagctgcaagcagccttcactgttaatcaacaggctacacaaatctcacctctaaagaggtgaaatgtgaaaatatatgggaagcgctgccttagccctgtgtccacaaatcctttctgtaaagggccagatagcatttcaggctttatggaccatgtggtctctgccacaactgctcagctctgccactgtagcacaaaagcagccagagacagtgcgtaaatagatagcatggctgtgttctgatgaagcttcacttacaaatacacagggctgtagtttgccaacccctgcaaagtagggagtattttgccaaacttggctgtatttcaccaaccccttagactatagagatgacttaccctttggcttaatcatgactggaaacttccttcccatccactgcctggatccatccacctccccacaaaggcttcctgagcatctcctccgtgtgagcactggctcaatgcacaggacgatgtagttcctgcccatatggaacttaggttttgagtgacacgtgggacattggaagaggagagcaggtggctaaagagcatcatacagaacagggctcagggaagtcccaggtgatagaatctcaaagagaagggctgagggtgaatcaggaaagccctgaaggcaggcagctccggagtcgggtttagacgaggaggctgcagttctccaggaagggaagcaggaccagataacggatgagattgtgtcaaacaatgaggaggcctgcatagtcacacaggcgcatgaggtctgctcgtaaaggaccaggagggccaggctcaggggtgtggactggattctctgggctgtagggagccactggacagctgtgctcaggagggtcatgtgatcacaaatgcttattagaaatgtcactggctatggaggaccatgtctgtggttgtaagttacgcctttccgtttagtctggacttcctggtcaaggtacttttggtattagagtggggaagagaggcccagagagttggacaggttttctgaccattggcttatagtcagtgagcaccccacctttattttgacatgacagagctttacagaatcttccttcttcaggcgttttctttcctgctatcctaaagattcacgtacgagggcaggataaatgaaacattctgtctccaatctaagttcggcttggggcctcagaatatgaaggtaaaggggcggggacggactgactgccccttgcttcagaatcaagtcacatggcgggaacgctctatggagcagattgcttcctttgtacatgccctaggcccgtgttcagcaggcctcagagaagcagaggtgctggcctctcgtctccagaggctgccagctactaagggaggtggaagcaactacccctgggggtggactgctctgggccgggcccgacgtcaggcgtaggggactgaggtgaatcagacgtggtggctgcattgaggaatgctcagtgtagttggggtgtttgtagcgctttctgctgagcatggtctttcctctcagaggggtttctaggcacgttgaagggagctgccgttcagagcatcggagaggtgccagggacgtgagctgctgccagtctgacgtgaacagaaggtgggaatagctggcgctgccgtgcgttgataggagcacagtgtccgctgcgaaggggcggctagggctggagaaagatggcctgatagaagcgcctccacaggcgctgattcagcgaagccccagcagccccgcggggcaggcgaggatcacatgcagctcggagaagaggaggcacttgcccctctgcctgagctgggaggtggtggccagctgcacacagggctgtcccaggatgctgacgaggcgggaccagccacaggccggcagcgctgcactgtgactccctttcacggggcccagccttgtctctggccttccgggactgagtcaggaggcgagggctacgttgctgccccagcacagtcgggccaggtgtggggaaaggcgggagggaggtgtgctgtgctctgagcagcctggcaggccctggagaggcaggaagccactgcaaacttcagaaactgggtgctgcttcctctcggtgaagttgtgttttgctaatctctgataatcaggtcagggatacagaaggaagagttgcccctgggtggctgctgtctttagacttgtcgggctccctctggtacagaagtgcctctcggattttgctgcctggtcttctctcttatggacatggagtagctctcaggctcttatggtacagctctaagaaggaacacttcttgcattgtctagtgaagtttctgggtttatggaagggaaactgacaaactggagccggcacagatggacactgggtaaagagaatgcagcctgtccctggctgcagtgccaggtgtggcctttcctgtgacagcaagtcacgtgctgtggctccagcttcataggaaggctcttgtctgtcaggcagtggagttacttacagacaagagccttgctcaggccagccctgcccctgcctacaggcacaggtgctttgccatctgtcccgttttcctgcttagggaaccaagatggtcagaaagttgcttgactctaacctaaatatttctgccgcttttgcgagtcagactctttttcttttccttgttcatggaaatggatcaaggagtaggagttttagatagctagggaggtggtgagaagttccgtctccacctgtaatttacaagtcgtgtcttaggtttccagcctctttcctctgttctgggtatctcgtgctctccaccctttagggattttggtgtggtgggtccgtggcaagacactcgatccagacacacgcatttccgaggcacttccatgtcacttaccaagcctccttgtgtgtggatatcacttcactggctccctcaggctgcagccctgacccccaaggtagtgatggcagctggtgcatgaggtttgatttggaagtagccaggcaagccctggttgcaaaaaatacctcttctattccgacagcgggccagaggccgctgccattagacgcatccctctacttacccccgatcacttttcatggtcaggccggccttgcacaagcaggttctgttcactgcgcacccccatttcttagatggggtactgagcactgcttttcccttagctcacttcatgtggcagcttctcagggatgggacctaccatggctgtgggagatgctttgctactacttactacctttccgagggaggagggctcatttttagaaatgttactggggagccaaattgtaggcctccgaccagagggcctcgctctctccatctcccaggaaccaagggtagctctggctctctgaggagctgtctccagcctccaggtggacgtcctttccagcataccagggcttatggaggcaaaatgaaagctggtccacgtgggaactccctactgttgtcctttccttgggcagacaccatatactttttagctcctagcagtgtttatcccgttttccccaaagcatccttggactcaggcctttcatcctggacccatctgtctggcctgttgtgctgagcctttggtctaagtggttggttggtcccagccacttcttcaaaagaaggtttcctgaggtaaccataaattagggcaatcgtacttccaggaacagtgaggctgatgggcctgttcccaagggtactttggcagggggtgctggggaaggggctggcctagggccaggttcatcataccgttagccctgcagccccatgcctgtgtgtcctggtttacccgccgtgtagtggtcctgcaggagtggagcctgtaggacttgcttctcagcggctccaagcagaactctgtctgggaaggtgggaggtgcagccagtctagacctgaagccctcacactaaggactaaggtaggcctgctcagccttagcccttcgtcaggcccaagggtgggggaggcaggaggaggctgagcgtagtcgtggatagaaacctttccctaccgcacggttacacacatggcatgggactcctggctgtagctcactcgggtctactgaagaccaagttggtttttagaaatctatttaaaatatctatcatgtatctatttactgtgtttttctgaatacgcaagtgtaaatagtataatttgcagtgcaaaatccttggcaataactttgtgtattatgtttaaaaacactggaaaccgtgaccaccatggactgcccttcccctctgaggcaattattacatgtaggactctgaactttaaaccttcagcgtgactgaagcagcagcctgcacatgtggatggtcatcagtgcctcgcccagagatacctggccttcatccaaagggaccctgctgccacaagtcctccaggcagcacccgcactgtggctccttcgcactgagtatgttggactctgccatagactgaccctcttgtctggctgctgcagtttgtctgtaatgccctgacatgttgcattctccccatttggataaataaaaacaaacaaatgcttctgtcacacaca

SEQ ID NO: 3893 - DNA, 3326 bp, Homo sapiens
gaagttaagtgatgtccctgtttgcagtgtcaatgagattgagggcttgggcttgaacccaaccttctccctccaaatagcctgctctttctgttatgtcatgtttcatatacaagtttgggagcctccagccctgactatcccaacatatacaacataatgtatatgttgtctttggaaatatcttctgtgaaggccaagcatttaatattacaggaaaccttgaagtggatatggaagcttggcagccagcttggatcttcctaagagcctctttccttcataccatcttcagattgttattccgtgacatcttatctacttaagcagctaacccatgaggcatccaaaacagagagaaaaaacagagtgaacattttgccttatggaattgtcaaaagttgcggtcgaaacacaggcaagatttggaagaatctgtaatgagccagggccagttttcctagttatagagcctaggctggaggaggtacatgggctggggaaggagagggaattagagattggctgttcctggaaactctctgcctgtactccatggcctgagtcccaggacctggaagcggctgaaaatctgagatatagaagagactggtgctgcctttctggggagggcttgggaaaacagcaagttccctgaatttttccatggcacaggagcagatgaaatgtcatgattggtgtccaggctagtggactgagttaactcccgagagtccctgtactctccagcatggcacgaggagaagcaaaccattttcctatgcagccataggaaaacggtacaaacacgacactgaaattcagctgaccgcaagagcttgatggtcagtgtgagccagatggagcaggaacatgtatggatggaaaacccagatccaaagttcatccccctctcccgtggatgctccagcacattgcaaggtttcccagaaacttagaggcaaccttggcacaaggacatgatttgttggaaattaagttttgtcacctgggggactgcgagcttgatacggaaattaattcagttatataattataaaaatgatgcactttctacacatctgattttgtgaacccaaattagtttccacaacgcaactgtgttaacatttgccaacctctggggcaacattggttgtctttgttgcttttttctagaagttttcagctcaaactcatctttcccttttttattttcatttctaaattctggtgagtggtgttttgataagtagatatcagctatttcctgtcttacttgaaaagtcttctctgtattaaataacaaaggtcacttagataaatatcttctcattaccagagggtagggaactgcttctcctatacataacttctattatctttcaatccagaaaaaaaaacgtggcaggaggacaagtttttgaatgttatgaatcgtgatttctgtgtctaaaatctgctcttttgttaacactaagggcaacttccttcaaagtggttcatcttggtctattactgtgtttgtgtgtgtgtgtgtgtgtgtgtgtgtgtagtaaaaccaaagtttcctattatttttgaaggtatttggccctgctggaagacagctatgtataagttgaacttggcagagagaaagggaaaccagatcttactcccaggcctcctgtcaccagctgtgtgactttgctgaagtcatttctttcccctaagtctcagttccaatacctataaagtgagtgttctgcctgtgtgtgttttaggtctttattaatgttgaaatgtcctgactttatgggttctcattcactgtgatgtggtaaccaaaacaagcagagattaataaccaggactcaataatgtaaaacactaaaaattatatttttgcaaatttttgtaaacgcgggatcatatctctctcagtgacagtattggtgtgatccattattgtacatttagtggataaacagaatgtaactaagaagtgttatctttgttatcaggggaacgtggagttggatgtgtatgatggggatgggcagttaattcataggttaaacactcaacgagggaatatctctttatcgctatctccaaagactccccactcttcctcaattttcttagtaactcactgctcagacttagtttccccagaagcagactatgagaccaggatttgatgcaagcagtttttttggagttgatctcagaaaggctaagagagtagagaagtaatacagagaagtgaagaaagctaatagaaggtcccggtgctctctcctgaaagagagcgctggaagactgagtagaacatgccccagagttgtccccctctgctggggcaagagaactagggtactgatcagctaatttccgtgcttcactggttaagggcattaacctccccaaacttctggcctgtgccccagatagaccaggcatgcttctgtggccagagaaagcccgaggatggagagtcacagatgcttgtggtaggtagcaggtggtgtgtatggaaatgggaatgggatgccaaggggatttgggcagggcaccaagcatctgccgcattaccctaatccaggcaataacactcacagtatcccagggattccccttctagcctcgaattcctcttattctcatttattttgtatttactttctagaccatagtttctcagatagtaaaggttctactgactttcctcatctctctgcaacctctttcctgcctagcttctcttccatggtcaagccaatacacacagaattttgccttccattcttcactcaggtgtttcttccacttggaatctgttcctcagtcattttcactaatccatgtccctcccagtacacagaatttttcacagaaaacatagttaatcctttaaaaatatatttagattgacttgcatgcccctcttaaggttttttctttccaaatgccttttttaaaaccccaatttaagaatttctttagccaatactacaacaatgcagtccttgttctccacttctttccttttatctactcaatgttattaatctttttagtgtaaacatcagtaactcaatcgagccttttctgatccccatgattaggatgagtttttgtgttgcctactccaaaaggtctgtcctttttaatgctcaccacacttgaggtttctgttcacacttcaaaggctgtggggcccgataccatgattttgctgcactcctagacctggcctactggtacatagtaggcattgataaaaatttgctggagcattgcataaataaactatgccatttggggctgattaacatttt

SEQ ID NO: 3894 - DNA, 3478 bp, Homo sapiens
gtgagagtcctcactggtttatctggccaccaaacgctcacggcacagacccaacacttccatgacccacacacagggctctgctctggacccatggtggatgtaggacctgagagtcctatttggtgtggaagtagaagagctacctcatcacctcctcactgggagaggagggggtttccaggacgtgacaggcatttctctatcctcaatcatctaatgagagttgagattgtttctctattttaaacttagttgttgtaaagaacactacgagcacaattggattaattccaagtagagtcaccacatgaatgtttatcttaaaaactgtttacaagcacactggtggtaactgtggcttcccaattcgtaattataaacaaagactcaataaggattcacagatggaaataaggggacaaaacaagtacagtaatataattgtgaaaattcagtagggcatgcacagattaccaccacctctgtaagaagtatatagagacacatgtttgaaatatgcataatgagatgtagaacaatgtctctcttggttgttgtgttgtcctagctcaaattttgcagtttctgctgtcatcacagctgggaatgagaaagggaaggggctccagttggtctccctctgcctctggagcacacgtggaggacatgaggcttccgcaggaacagctctgaaagctgagttctcgggtccctgtgaaggagggaagcttgcctgccttggagcgtgaaaaagtcttgctggacagaagtctcacggtttaaaactgggaagggagaggattgagatcacactagaatgcacagaaaattcttaaaacaaaaaaatgagagaaacttcatcagaatgtgaaaagaactataaagctacagtgctgaagagagggcaatactggcactagaatgagaagattcatggaacacagtggaaaatgcagtaagagagctgcatgtatgtaatattttatcatgtgataaagtgatatattaatattcacaaggaaatagtcaattatttaataagttctctttttggtattgacttactgtatggaaacaaatattgttgcatttctaccttactagttacaaatagtgatttagttgtaataaaatgaaaatcattagacttaaacgatgatgaattgcatagaagttctaggtgagattggcctttctaagcctggcatcaaactagacaccctagaaaaatggacagatattattttatttttcaaagttcaattcaccataggtgccaaatgtaaataataacacatgaggagtaatatcttcaacacattggataaagggtcagtatctctaaaatagtatatattaattcttacgaaccaataagaaaaaattaatcctccaaaaggagaataggcaaagagtatcacaaggcgattctcaaaagaagaactataaatgacctataacgttgtcaaatattgctagtactcctaaagatgggggaatgcaaatcaaattaacaaatctcattttcagaaccacagagcttggattgccatcattattaaattaaagtatatgacttagggaatgttaattaaccccccaatttcttatgttacattcaacggtactttaaacccttaatgaagtttctgtgtagattaaataaaatgtgcatgcaatgtgcttagtacattaactaccagaatgtcagcacccatatgtaccatcaatattattattatcattattcatttttttgagacagagtctcactctattgcccaaactggactgtagtagtgtgatattagctcactgaaaccttcaccttcctggctctagaaattctcctgcctcagcatccaaagtagctgggattacatgtgtgcgccacaacagccggctaattttttgtatatttagtagagacagggtttcaccatgttggctgagcgggtccaaatctcccggcctaagtgatcctaatgactggactggccaaatgctgggattacatgcatgagccaccgggcgtggccagtattattgttattaatacagtaattattgtataaaaattcctgatggatcaatgatgccatcattaaataatcaacacataaaaacattcaaataaatgatatggacgtctttatgcatacttatgaagtatgtgcacctttagaagtaagacacacaatccagacacaggaaaatataagatttattaaaatgtataaaaaccaaatatcagaatgaaaatataaatatggcattgaaatagaaacaatacatactctgctatgacaaacagagtgaaacagctcaagtgaactgacaaaaatattgttacctgtagtgtcagggagaaaagaggaacaagaaatctacaatggaagctaaaatcttcaaatgcatcaccttttatgattttgacttcagttccatgtaaatattttatatatacaaaacagatttgaaacaaaacaaagtaatacaacaaatttccaaaatgtaaaaatgaaaactgaacagttaaactagctgtataaatgttggcatgaacaaatagagaaaaattatttcaaatgattttgtggaaaaagtattctcattatgtacccaaaaaggaaagaaagagagagaaaaacaaggaaggaaggaggaaaacaaggaaggagaatggatggaaggaaacaagggaggaagggaggaaaggatggatggagggagggagttagggagggagagaaaaataaaaacaagcaaagaagtaagaaaaaagagagagagaataaaagggagggcagagggagagaatgttcaactgcatacctaggcctagtgttttagtggtcattatactattgcttatattgttatagacataaggaataagcaccactctcagctgtgatctctggaccatgactggataaatgattcagtataaataaccttcctatttgctgtccaaaatatctagattcgcagctggaccctagttgtacctgtctgtcataggaagcagagtgagtgggcctcccccatgtcctaggagagctgagagaaccttactctcagccaggctgcttaactgaggcccggagatggcagcttgatcttcaggaaagttgtgggggaggggtagggaacagggtgcagctgctgccaggacagtgtgatattaggagggagatcaggagttaagctgtctttctcttgttcagaatacagtaaatttggtggcaggaaatgagagggggcggctctatcttgtgtaccagaggcagccacaaggcagatgttcagtgtggtgtagggcagatctgaatcactgtgcctgccccaggtggcacagtaatagaccccagaatcattttcaattagattttgcagtctcaaattccagctccacctcctcggtgtatgagtataatactttccaagactgagacctgattccaacacatcc

SEQ ID NO: 3895 - DNA, 2544 bp, Homo sapiens
tcatttcaaatactggaaggaaatctagggcaaagtgtctaccaaggacttccttctatttctttccctcttgggcctattgttttaaaagacttcattaatttattaattaaaatgataaaacaaattaagatatcaagatttaactctcaaagacaattcctaggaagtatagaataaccagtgctatcccagcgtaaaatcctgaaaaagcaaaaagactaggtgtttaacctagcctttattcaacaggtcaatgcaagtcatgagaatattttattcagtgctcaataaaatattatgcaaattattaaaagaatggcattctaaaattgagttaaaaaagggtattcaccacatgggttgattgtagagctaagtgaagcaactccagtggaaaggccaccttttgaaactactgaagccacagaaggtgtcgaagatgaagttggtgtagtagaggaggctgctgaggatggtaaccgttctccagactccatatctatgagaagggaaaatgttaattctcagtatcagataaaaaattttttcaaaagaattcaacataaactttttgtatacttttaaaaatataaaataaatttctaaatacatgttctttggaaagagaaaatatggagtagataaaaacaatataatttaaaataccaacttatggaataagtttaagtataccaaatcctcttgagttttcttataccccccaaattaatagtggtttgaatatagtaatttcacacaaaatgtgtattgccacaaccataaattaacatgttatattcgtcttattcatcccaaattacctcacatcagttcacttgcaacagaattcctatgttaccttaatgaataattaaaaaaaaacaccaccacatttgaatggtctgcccccttatcttctaaatacagatagcaatatacttgtagctcttaagtgtccaagaatctggcctgggaatcccccccatacccctcaaaacaggcaaatacatttcagagtttaacttgaggcaagtttaaactatgatttcaaaatggccttagttgtgacccatttaaaatgacaaaagcacttctaatcatctttattaatttgttgggctttatggttgtagccttgcattggttttattgcaataactaatgctgatattaaaaatttggaatataatgggcattttatattcattttaatactctatgcatgcactgatcccacaatcaagcaagaaagtcattaaattcacagatgctttaaagagaacacgatctacaataagaaaaaagatactgcttgcctataaatgaatttatgatcagccacatgaaaactcttaccatttaaataatctaactatagaaagatttctgtattgaattctacaggcaactcacagaagaactgtatctttactaagaaaaatagttggatttcatttaaaaaattgactaattaaaataatgcaaggctagtgtttgcctaattgttgattgaatccataaagtatgtagataatttttctcataagataagatatatatggggaaggtaatcttaaattgacatgcaacatcattagaaagaccatttcaatgagccttctaatcatatagaattcaaaaacttctcttcatattctagtattgctgtaaatcacttccataaatgacagtactgctatgatgagtctgtccatattcttacagaatttgtatttctctttatcagcattcatcatgggaaaggcatagttgctactgatggctgcatgcaactaatgtttaaagagtaggttttgggtcagcaacagtaactaatgaactctgagacatgtggctgtctgatggtaaggcccataaaaattatttttaccaagtctaattttcactaaatacaaaaaatatggactctttacctagaagtgagtttaggaaaaagctattttttctttatagctggtaacctcattgtcttcaagaattctatctgctacgtaaatatactatgtaaaaaaaataatggaaggggtttaaaaaaatttgcctttgtactccacagcagaagtaatttggtgacataataagataagcactttagctgagtacttggcatataagagatcaatataaaatagtcattaactttttataggataatatgctatgaagtataggtatttcttattgttgataaaacctgattcaggactaaagtaaggaaaatcaagaaggcaaaagaagtagtcttgtatacatactgcttaatggatattactttccctgaagaattaatctgaataattatttaaataaacgcacatgcacaaatatgtgtgcgcgtgcacacacacacacacactcacagataaagtatcattaggtaaagtgatatatacaacgttgtttgctacagtactgcttaaaaataaaatttaaaactggcaatgagagtagaactagagctagtagtataggctggggccttttttagtttcagtaaaggtgtaattttttttcttctat

SEQ ID NO: 3896 - DNA, 2108 bp, Homo sapiens
atagtatatatatataattgaatatataagtattcaattagttctgtccctctagagaaccctgagtaatacactcatctctactaaaaataaaaaaattacccaggcatggtggtgccgcctgtagtcccagctactcgggaggctgaggcaggagaatcccttgaacctgggaggcagaggctgcagttaactgagatcaccccattgcactccagcctgggtgacagagagagactatctccaaaaaaaaaaaagtattaactgttaagagacttgcagacatattctcaagccatcacttacagccacaataatagaacatatttcatacatttcctttaagattgaatgagttaaatgcagaccatgtaaatatgtgaggagctcctagcaaaattcttcgcacatggtctaggattgggatgatgagtttcccaggcaataccattgctgctggccactggaccacgctttgaagggcacagagtactgtgtgtgggagagactgaagagacttcagagaaggaggacaaagattcctcctgatgtccacgaattcaggaaagagcctcaggagctctaggaacagagagatgtctgtctgcctagggcttgtgtgagagaggacccaatagatagtctgcagagcccactgcatcttcccagagaagagtcagcttgctcctccacgaggccctcccagtgctccctgcttgaactgctgccaggcctggagaggggaagctttccagggaagtgagggactccctatatcccccctctcctcccactcatccttacctcgttaccctccagcactgggtacaggaagacttacaagggcccattgggaaggtgggctggcggctgctgatgtagggaattttctgcatctcatggttggcagaaggctagtggctctgtgcaccttctgagcccagaaggaaatataaaattgcttttaggtagttatagttaggacttccctgcctcacatagtgtggtatatacaggcggatcatcaaccaagtcgcatccctttccccctagtcaaagagtaggtctacatgtcccaggcccctcctgccaggtgcagctccatgactgagttctggcccatggaatgtggaggcacgttaagccatttttaggcaggccatgaattcctcctgggtctgttccctgtgctctaatcctcatctactggctaagcaaggagcacccgcaaaggcctagaggaggctgagccatgagacggacggacccttgatctttgaatgactgtgtcaactgtgacttaagagagaatactaaaatagaaggacagctttattgtgtgaaaccactagagcctgtggttgttaaaacaaccaacttgagtaacaaacatagataggggtgggaagtcaagacaaataagaaaactgcccacaagtgccacctaccaactgtcaggagcaaaactgggaggtagagtgacttgtacctttaatgaatttttctcattgagtctttgtgggcaaacttttggcttctgaagactgtgggcagcaagtattatgtctttgtagggtttgcctttccttctgaggctgaaaaataagagttcttggtacgggataaaaacacgtcagtaatgagacagtgtcacctctgatttcctaattccttaccattgacaccctgagcatccgaggccatgactcggtggatttcttgtggcctctttttctcttttgctgggaaaattttcttgcttttaaaaatatagacggtcatccttttatgtaacagtttctaagcccaagggaatgacaatagttctccaaccacaaaatgcagttataattgtctgaagaactagttcccctacaaaacaggtgtatatagatgacctatttgtattaaaaagtgtccaaaacactagctttgtgatattaaatgtaattatcttattcaacaataatattgatgaagaataatagggagtggtcgggtggctatgctcttcttattgccacacaaaagtctaatgcaatttatcataaacattaagttcggaaagaaaacctctcttcaaatatgacagaatgtatacatttttc

SEQ ID NO: 3897 - DNA, 803 bp, Homo sapiens
cgtcaggaagttaccctatatggtctaaaaaggggaggcatgaataatacactcttgtttagcatatcatcaaaaagtaaccataaaaacgggccatcagcagccctcaggcctgctctgtctacggagtagccatgcttttattcctttactttcctaacaacatttatttccctttatgtactcgccctgattctttcttgtgcgagatctaagaaccctctcttggggtcttgatcgggacccctttcttgtaacacaactcctttttttggagttttacttgcttccaacaaggaaggcaagttttcctgcttccatgacggtggaaggcagataactcctttccggagttcgagcctgctttcaacagggaaggcaaatttgagttttcccctgcttctagaatggaagatggcagtcttcagcctgagacccattcctagcattgggcacattcacattcttctgcaaccatcgccagcatccgtcggcagaaccttctcatcttcccaaacggagactctgccccaggaagcactcgctccgcatttgctcccagcccccaggcctccattccactttgtctctgtgcgctgggctcccctgtcacctccccacgtgggtgggcatctctgcgtgtcttcagcgtgtgtccttccgtgtctcacgtgctccactcaccacagtgtcctcaagctccctcctgttgcagcgtgtgccaggatttcccttcctttcaaaggcgggatggtattccattgtattcagtgtgtcctccagggtctcgccaaaaatataaa

SEQ ID NO: 3898 - DNA, 554 bp, Homo sapiens
gcagacgtgctgccctctttgaccactcccagcagcgtggcatggcgcccagtttgcttgtgaacacaccgacctccaactctaagaccagcatcaactcctcctatcacagccagcacgggccacacctctatgcaaagagtcctcagctgcagctctgagagtaagtccaacggtctgttcggtgaaggatacggatgagctgaatagtggcctcagccagcactgctgctactggactacaaatagggtctcctggaaggcacaccgatggatcacggagttgcatgcagcagtgtacacatcctgaccctcaggaaggtctgtgctgacccttcgctcttgctgagactgaggaggtggatcatcagctcgagccccagaccctgccccactgttcattctatctcggtctcggctacgagctacttcacgggctgagaggaaacactgaaagatttctgtaacatgcaacacaaaaacaaggtcttaacacatggggagagaagagcaaagaaaataacaataaaaatagtcaaaaagtttggaccaaa

SEQ ID NO: 3899 - DNA, 2716 bp, Homo sapiens
gcggtcttgggtccgcccggccgtcagaacaggcctcagcggccggttgtggaaataaacccagggagcggaaggagtaataacgaaaaagctttactagtgttttaaccgtgtacaaaacactgtagcaataagagaaaggcccgtgctatctgtgtttaaacaaaatgcagtggctgcggggcttccaggcagggctggggaacaggccgggcgcccgccttgggcgcatctccgcctcttaggggtaagaggctcagagcctaccccttaggcctagttggatgcgggtcggtcctgcccaaggccccagtgaggggagccgaggctaggaaggggcaagttttatgtgtttgggagggggtgtctcttcccggcctctgcgtcttccccctggagcgtcagtatggtcaggctctggtgacccagccgctttgcctcccgactttgggaagagtagcaaggagaggtcctggcaagtacaccctgggtgacaaacggctatgagagttcccaggtgatttctcgagcagcttcagtttaccggagcccagccaggagagagaattttagcacaggaaacgcaatcccgtgtccaagctcctagaatacccaggactgagaaccaaagcaacagacttttcccagggagccacactgcctccccacctcttctttaacccctcacttggcagctccaggagttggctgctgaagacagagtacaggagggcatttcgttgacgtaaaaaagctacaagccccttccggggcaaggtccagcaccatctgttaacagggcagccagggagaaaggatgggaccccagcactctgagcagaataaatctctcttcactggccgaagaccctctgcctcaaagggccctacccagactgctgagtgaggatcccatccccaatcttcccacccctctcaggaagagctgggtcccagaaactcctatgacacaataaatccactttctctgacagtgtcagagcttcaagccgatactgcagcctacctcggatttaagtgcacaggagactccccaggttggaaattatggctctagagcccggtgtgtaggccaaaggtatggcaagcctgtgacagtctcgggtgacattccccacttccttcatttcattaacatcccctgggagggggcagtcaggccagtgcagtcaggagattggggtcttgctctgtggctgctaagtctccttccttctctggacctcaggaaataaagaggatggaaggaatggtcccgcagtcccttccagacacacgggtggatctcgaacctggagaatgcctaaatagcaggaaggagagaacccatgtcccctcccaaaacgcaaccttggaaatgggtaaacatttaactcctgaaaaagaactggccctggtttcctgactcaaagggcccagacttagggcctatcctgttcctcacattttgagtggctcccctgggccctcttctgccaacactgccgcagctccacgatctcctggccataccagtcatgcagggtagagaagcaggaggtctcaggggacacagggctctgccccttgcctaggaggaggctggcagggccctgcagctcccactcagccaacccccaccctgcagacctgctgcccgcttcttcaaccaagcccacagggctgctgtccttggagaggcagtggccattctccaggcccgcagctcggtggttaggagcctggggcttacagcggctggcaacagacttccaggatgagcggcgttgcaaagccaggctctggcgtgcgtcctgcaactggctctccaactcgcgtaccaccaggcgcatgtagccaaagcttgcccgggacagcaccttcacccaggcctcctgggccgccggcccttctgcggccagcaggtgtgggcgcactccaggggcatcaaagcagatggcaaaggcaaactcctcgggcacgggagcctcggccagttccactgtgcagccttccagcaccaccaggctcagtggggcccggccctcgcgactctcaaaggagaatagcaggttgcccttgaggacaaaccagcatcttcggccagtgccactgggggtcggtggggtccctgggcccccccaggtgcgcaggaagcccatgtggtccgctggggagtcgctgagtgcatagtgggctacactcctctcgttcagcttcatggctcccacgggaactgtgaggcaagagagatggcagcagatcagagagggaggtggttccgtgccctcctggggaacagcaccggctccagaggcaacctggaccccagccctgggactcctactcgcttgctgtgtccctaaggtccctaaagtctcctgagaagtgggctcgtctttccttccttttctctcaaagggatgtcgtgaggatcatgcaaaaaaaactggacactggcggacttcgagaaaagaataacgagattgcatcagacaggaggcatggcaggacctgggcacggctttctaaaatccaaagaaacaggccccagctgagctgaaatggaccccagacccatcgaaaccactgtgcttaaactatcccctcatctggggtcctctcaactccaactctgaggccaagcttccagggtttccatgaccctcctgggcctctactggcctcttatttgcatatagctgttgaatcttat

SEQ ID NO: 3900 - DNA, 2022 bp, Homo sapiens
actaaatttgtactgggcgctggcgaagggcctggctccgccacgcgcggccctctcgaactgcccgtgggtacggcgcgcgctgctgccctgtgtggcctgtgcggggaacccgagggccgaagtgggccccgccgcagcacagggggacaagagaaccaggagcgggctgcctgggggcagattcgaacccgtgctcccagcggatagaagtagcacttggggactcctaaaatattcagcccaatcctgattccagctgccctctctaggcacctttcctctacccttcttccagtttacaattctggtgagtagatgtttctctatctcttctcttccaactcctgcgcccagagccaggaggacttctggagcccgcccagcaagaccctctctctcccatcttctgctcaagggctcgaggtctcagtggacagagctgaagaaaagccgtctatggagcctgcgccaggcgcagactgggtcgtcgcagtctgggtcgtcgcagtctgggccggggcgctggaagtcttactcacttctcaagaacccgcaagggatcaggcctgaccctttgcaagtgacagaatccaaagctttgagctcatgggaaagtggctggaaagaaggtcactgtagggccgcacaggtctctggcgaggctacccaagaacatttaaatccctgcccagagaagaagaggctccagctgtcctgcaccttcctgggaactggcagtccctccgcgcaggggttctgcagcgaccggcagcgcgaggagacaaggatggtggccagttaacagaaaatcaaggcagcgggaaagggaggaatggcctacaggggccatgcaggggctgcatggaggaattggtcagtacacacagaagtggatggcactgggccaggcacagtggctcacacctgtaatcccagcactttgggaagctgaggtgggtggatcgcctgagcccaggagttcgagaccagtcaagacaacatgacaaaactccacgtctactaaaaatacaaaaactagctgggcatggtggcatgtgcctgtaatcccagctacttgggaggctgaggcaggagaatcgcttgaggtggaggttgcagtgagccaagatagtgcccctacactccagcctgggtgacagagtgagactttgtctcaaataaataaataaataagaagtggactgctgtggtgtgagaatgcacctgacagacctccaattatggagagcttacacagccaagggccccaactgctgctctctgaaactcatcctgcttttgtgctgaggccacacttcccacaggctgctccagccagtgaccaagcacagcatggacactaagacaggcccattctgggagacgtgggactcctctgatggccaactttgacttggggactccctgatggccttgccaaacctttttgataaagcactttggtctaggaagcttctacccgaccttccttcctctctccttcactcagggtcagacttataatgtgatctgacagttcccccagcatttcctggctctttctcctttcctttcacaggtgtttctcctgagaaaattcttgcatgtttaaacccaatttgagggattattgggaaaattattgggaccactattggaacagttgacaaactgtcactgggggtgtgtagattaaatgtcagtatcgtataaatccatgttaatttcctggtagtgatgacagcactgtgattatataggagtgtgtccttggtgtttgggaattacatggtgaaatgtttaggataatggggcaacttactttcaaacggttccccaaaaattctagatagatagatagatagatagacagacaggcaggcagagtgagaaagaaagtgagaatggtaaaacaaatatatataatgttttgtggggagaatgaataggagttttttgtagtattcttacgacttttccataagtttgaaattatcaaaaataaaaaatgtttaaaac

SEQ ID NO: 3901 - DNA, 10260 bp, Homo sapiens
actctttcaccatttcatgatggcttattactcgcacacggcattgtcaggttccagcaactctgtgtgcagcaggcagaaatgcagtgtttatctctgacaggcaaacattcttaggctcatcggcatgagtatccacgctgaactggctatcggggaagtagatccctgcatgggaaagtcaagtatccccactgtgtagagctggtccacaatggagaggaggaaaagttttgcattggaccaaatcactgccttagaaggaaagagattgcaatcccattcatttttaagatctgcaatgggttgggatgatacccatttaaaaaagaaaaaaaaagaggttacctctttggcctctttggcaaaggatatgaactagtaataaagcctcagcatcaaggcttgggagtctggctcaaagtggctaagactagaagcatcttctaacataaatatggcagcattaggaaaatagcttggcctttagagagacccagattatcttcaccttaaaaactaccaagaccctggtccagcaagaccaccatcacagcagtaaatacatagccaccaacttcacagaaggttttccactgagacattgtgaaaaccacaatccattaccggtggatgagtcccagctctcttactacctggagcttccaagcaagacttacctgtcctttgttccagattggttcctgggatcctggaccaacacaaagagaagaggaaagcctcaagggaaataaaagtgaaggtttcagtgatagtttaaatatatatttttaaatgttagcttttttttaaatacttcacagtgatggatggagtatttcaaccacaatggcaaagaatgaattaccggcagtgtcagagtttcttgttgctgtgggaagacagctgccatgttgagaggtgccttgtggagaggctcatgtggcgaggaactgagactggcttctatccaacaaccagtgaggaactaaggccctaaagtcctatagtccacaaggaactaaatcctaccaacaactacatgagtgagcctggaatctgattttccccagtggggacttaaggtacctacaacctggctgttatgggctaaactgcatcctgcccaaatttatatgtttgagtcttaactcccagcacttcagaacatggttttgtttggagacatagtcattaaagaggtaatgaagttaaaatgaggtcattaggatgagtcctaatccaataggactggtgttcttatatgaagaggaaatttgaacacagacacatatacaggaaagaccatgcgaagaagacacagagaggaaacggccatctacaatccaaggagagaggcctcagaacaagccaaccctgcagataccttgatctaggcatccagaattgtatgaaaatacatttttgttatttaagctacccagtctgtggtgctttgttatggcaatcccagaaaactaattaactaattgactgcagccttgcaagggaccctgaaccagaggacccagttaagccatgtgcagattcctgactcacagaactaggagataacaaatgtttgttgttctaaggtgctaaatgttgggaaaatatgttatgtggctatgttgttttgcacatgtgccacataatgatgttttggtcaacaacagaccacacatatgatggtgggcccataagattgtaatactgtgtttctattatgcattctctatttatagatacacaaatacttgccactgtgttacaattgcctactgtcttcagtactgtaacatgctgtacaggtttgtagcccagaagcaatagactataccatacagtctgggtgtgtagtaggctataccatctatgtttgtgaagtacactctatgatgttcacataattatgaagttgcctagtgatgcatttctcagaatgcatgcccgacattaagtgacacttggctttatgtctatcatgcatttaagatattgcaatatagttaacttatgttttaatacacctcttaattctgttttgatcccacaccaaccaagatgcaaaactaattttttcgcccatttccataaaaaacacaattacaatgggcctaatgtggtttatgtcattttccctgaagatttgtggtggtataggaagcagtcacagcaccctgtataaagctcttccatggcctgcccccttttcgcagtcacctctattatttgaaggaatggtccaaccaacctcaaagctctggaaatttgccccaaaataattttaccctgaagccattgaagcttaagtttcagaccccagtttcacattcctgtgagttctgcaagtcactgggagctatagagtcttctacgtagatttgggaaacaaggtgaaaatacctcaagaaatctcagaagccaggggcctgcatctccaagcctctggcaattttcttgtggtttctatcctcactctagatatttgcttttgagactgattttgaattcagaattttatattctctcaaaaagagaattctccaaattctataagcttcaggctctacaaaacttgtctattctgcctaactagatttatcatagcacgtaccaaagatggccctgcctcatgaggacttttcatatcagacccttagataataatattccctcatgtaagtaataatatttccgcatgtagttatgtatgaataattttcattcatctatatcatgttggccatagtcagtgtccatgtccaatttattttttgtgtccttggtgctcagaaagttaccagatgttcagtcagaattttatttaaaatattttgatgaactagatttaaagatagattaaattaattcctacacatgatttaatttaatggataaaataagggactgagcattagcctgaactgtgtacttgcattagccctgatgttccccagagggaataatatgtgaagaatactgcataggctgaaaaacaagagttcccagcagaccaatattctttctttctgcaagctgtgagacacctggggaaagttctccacatttggtttttcagctactccacccatgactagaaggaagattttattttattattttattttattgtattttttaacagtaaaagaaaaattattgttattttaatgaaaaagaaccacctggaaagtctagtgacatttttgaaggcagggaccactttttccagggatttgtttccctatgctagtgctccattcacccttgcaccacttcagcaaagcacatagtaggtgtagcagggagatgttaagatggaaacttggccctgaccataggccaagccagggtgtctagtcgggatttatccataaacatcaatatttatcactagatgatatattgatttcttatctgcctcctatacctattgatctatttttcacagcttatagtggggagggtcatgttcagttattatccttaaaccaaaacaatctcttcttgaaaaataggatgctatgctctgatgtttgcagaggccaggaaattcttgctctgagagttccagaaaaaaagatttgtccagatttgaactaatttcagaaaaacaaaacaaaaacaaaaaaccatccaaggttaagaggtgacttctgactcacagaatgaacaagaaggcaggggaaaaaataagtcccccaagattcaggtcaaaggaaatgaacagaaggatgatggagtggcccagaggaggatcacgtgacagaaaagtcaagataaattagtggcaggacagaggaaaagaactaaagacctgcaggatcctgaaagaaagaatgaaaggaagcagatgaagattctagagcccagctgaatagccaggccgcctgagggtaaagagggagagaaagaggaagcagtgaatcaaatcaaaaaaggatagaaaaatacagagaaacaagccagggcacggtggctctcacctgtaatcccagcactttgggatgacaaggaaggcggatcacatgaggccaggaatttgagaccacgctggccaacatggcaaaaccctgtctctactagaaaaatatggaggaatgtttgagagattgtgcactgccaggggtgaggacataaatttatttgctatgtgaatgttttttgagactcatctagttcctttacaattttaatttagaatttctttagctccaaatcaggatcattagctgggagttcttataaatcaaaagcaaaacaaagctattgcaaacaagtgggagttctcataaccttaatcagaaaggcttgagttgcatttccaaatcctgtctctagagaccatgagtttttaatgatagtatttccatgaaagcccaattgaatacaatcaccacccagaccaaagtgtaggggaaatcataaagctactttcaaatccgagtcttctttgaaatttaaaattatattccatgataatggttctcataaaccttaatgcaagggaaaaaaaaaaaactacagcagaataaagaagatttaaaaagaagcaggataggaaaaaagacaagccagaggctagctatatcttttcataaagcacacctggtctcataagcacatgagagctaggcccagaagtttcgagccttggagactcacttcaaacaaattccagggaaagacactcaattaagtgttcaggacaattgtatatccccagtgcactcatgtactggaagtgcttaaactctgccctcagtggtcaataaaatggtattaagtcacagacaacccattgccattggtattggctgatgtctctggtagtttatgtgatgacaaacattagccttaacagcagagccttcctttctttgatttccgtgtgaaattctgtggctgggagatgtttatgttcacatgaacataactgtaagcaaaccatcttatggtagacatctctccagaaaaagcaaattccatctttttaaatagaaaaaaaaaacagcagcaaaatgaaattaatgcctttggctcattgtgttgtaaaattatccttgaagttatttcacactgccctaaaaaatcattgaattcagattataacacagctcttatgaagctgttaggcagttgcatctttaatgaggctgagtaggtaagaggaacagatactctagattgaaagccatcgcaaaaaatgtgaaacaactgtattaaatttaatttaatttaaccaatgggtgtatttattccctgccttcttccagaaaggatttagggagcttaggtaatgtggaggtctgaaggtgtagatactcatgaaagcctcagattaatatctagaacatataatgtgtccagatagttttcaattatcaatgcattaatctaagcttggaaaggacttttaaactgcaatgaaacctcaactagtttcaaacctgcattttttagtaagctattttgtcatttggagacccacacaaaaaacctattgttcctttaaaaaggagagagagaaaaaaagaaaaacaacctgctggtgttgctttgttcatcttatcaccttatcattcagcagcctattcaggatcaaatgtgggaaagtctgtgtgtgagattaagccctatactcagcacaggaatttcttggataaatgtctttcttaaatggatagctatgtaaaaaacagaagagaaactctattattacaatgcagttgggtttttttgtttggtatgtttcaaatctaatatttaaaattaagaaaattcaaagcaaaccatctgtgtggatgttttcatactccatttttgtgacaatagcttgcttaaccgagattattagtggattctttcaataagaggaagagagtaccatcattaagatggtatgcctccactagcctttatttttgagattaaagaatgacaaaaatatttatatatattttttcattattaagacggagtctcactctatcgccaaggctggagtgcagtggcgccatcttggctcactgcaacctctgcctcccaggttcaagcaattctcccacttcggcctcctgagtagctgggatcacaggcacccgccaccacacctggctaatttttgtatttttagtagagatggggtttcaccacattgcccaggctggtctcaaattcctgacctcaagtgatccgcctgcctcagcatcccacagtgctgggattacaggcatgagccaccacaactagccaaaaaatatatattttctttaaaaaaaagttattttctgcctaattacttcaatatttcatgaacattgtgggggaaagaatattcatacagttctctaaatatatcagtgagttgaggtaccaaatacagaattctattgaattctaattgcaacactgaagcagacttactctaagatcctgctacctggactaaccacagactatacccagattccatctgcaagatgtagtggagccaaacatcacatcactgaggaatatttattatatatctttctgtagaggtgagagagtatttatagatataacaaacaattggtcagatactactggagatttggaagcttcactaggtttttcactaaatttgttgatagccaactctaaagctcattctactactactagccatcttcccttggacaatttcatgggcatcgcttcactgaaaagaaaaatgagtaagtataatctcactagtacatgaataactattataaacacaatactttctacaaggtttattactaatctatgtcatttaagttctagattttacagtattttggagtgatgaataaatagcatgctgttcttctatagctagcaaacaagactcagctttggagacaagaagaaggaatacaggagatgtttccttgaatgagtcttcttcctaaactctgctagaagtatgtcagaaagcgaaggttacctcagtctccaagtcatgaaaacatgaggtctttctgttttctagggaaagtatttcatcatttcctagtgtggctttttgcacaccccagaaggaggaagacaagccatcgtgtcacctttacatggtagttgagatgcttcacatttgtacataacatcttatatgatcgaaagaggaactcaaactcgacaggggagaataaggaaatacatctaaaactgacaattatgttaatccctcaattccctgggcccccaaaatagtctcctctatttgccatttcaaaatagctaatgagagggtaattggacatgtagacactgaatttccactgctcatggtttccttccctgggctcccagtcacccggaaggccccggattacctcaaatgtcataacgggttcatcgcattacgaattacctccttctgccaataaactacaagttctttgaggacagaaactgtgatttatgggcatttgtatccccagagattcaaagagtgcctgatacagagtggtgatagatgattttatcatcttatcatcatcatcctcatcatcgttgtacctaaatagaggttacttcctgtttcttttatttaacaataacctattataatatatactatgcatttttaatgcactttacaaatattgtcctcatttaatccctgtaaggtgaatactattattggctccattttgcagataagacactgagtcgtgaaaaggctaagtacctcacacaagatcacacagccagtgacagaactaggatttggctggactcttaaagactctggtttgccatttaaaggtacgctgagctccacaacactgccttagaacttgctcagagcaattgtcatattactatggtaggtttccctgtctcccttaagacttaaagcttctggagatcagaaactgtattgtttacttgcaaaatcatgggcttaggagccagaaagatctcgatctaagtcctgcctcatctgcttcttcttcatgggattagtagactgattttccccttgcttagccatgcagtttgaatggaattcaccccattctcagctacaaccacggatcttgtttgctttaaaccaatcatcactgcccaattttctggcctttgattgatttaaaggtgaacacatgaccgctttggaccaatgaggctcaggtggtattttgtgagggtctctggaatagaaaatcatttctcttctgacagaactacaaggcaaggcgcaatcactgatggtgaaagataaagatcattatattaggaactgttggctgtcatactgctaatgtgaggtgagttagccttagaaagaggatgctaccttgaaaggcagggcagatctatggaaataaactgagtttgtggtgacattgatagccactttagttcatcagctgaatcccaatctacttggttttttcagctctgtaagccaacaaataccctgctagtgttttagcctatgccagttgttttttctgctgcttgttaataagacacatacagtcttggacaaattatataaaaatatgaatctttggccaggcatggaggctcacgcctgtaatcccaacactttgggaggccgaagcggtcggatcacagggtcaggagttcgagaccagcctggccaatatggtgaaaccccgtctctactaaaaatacaaaaattagctggatgtggtggcacatgcctgttgtcccagctactcaggaggctgaggcagaagaatcgcttgaacccgggaggcagaggttgcagtgagctgagatcatgccactgaactccagcctgggagacagaatgacactcggtctcaaaaaaaaaaaaaaattctgaatctttgaatgttatcgtatagctttttaaaagactagattaagctatggatgtaagcaccaatgcatttttttaaaagtatattggatgaatgagttaaagtctaagtgaattcagcaagtttgtaacccttgagctcttgtgagctcaatctgccctcaatcatctgagaatgaacaaaacagactcaaccattttgtgtcatccagatgaatagaaagggcctgaatatattctttttttatattttttgtcataggccctagcgttttcatctgctcagtttttgagtgtgcttgttagggctttaatgctaaactcaatgtaagctgggtttatgtaatttagtggtttctagacttaggcttcctaaatgttccattagacaagaagacaaaatatgaaacaaaataacatcaaactaccattaacaattagcattgtcagagtcagtaaaaactgttttgaaataaagcagcttttcaggccagtatttgagaactaatgatagagtttttttgtaggcaatgaatgaagtgttgtggaacaaatgtggatttggactttcaagaccaacttgaaccagagtcttgaatctgcaactttactagctgtggcttctttttaattgattaactttctttttctgtaaaatgggaataatgattcctacctcttacaagcgttgtggtaggaggtattccaaatgagataaatatgtgaaatcactaaaacttccagaatacatggaaataatatatgtctgtattggcaaattatgagtgtagtaatgagggatttacatggacacatttacattctttagttcagactccctttgacgacacataacaaacacacacaagaatatttgccctgtgtccagcactcttttgagaatttctctcttctcctccttctgatatcccaaccaaccaaccagtaggaatgtgccctagaaactatgttttacagctcagtccacatcttttcaccttacaaattacttattgttagtttcttgggaaagtaaaattgagatattaagattctatgaaattggttggtggtattgaagactgtgctgctgctgctgctactgctccagaactctagtggagatattacaaatgggagcagaaaaagtgagaaggtggtctgtagagacagagcacagcacagaggtagaaaggttgagataaagaaacaatgcagtgagagaaggagagaacacagacatagaaacagagacataaaggcaccagacacgagagcagagataatttaataaggccgtagtttctcttggatttccagttccttcttttagtcaattctgatatttagcacactgcactgcaccagatatcttgtcgccttcaaataaagtatttttcccccttaaa

SEQ ID NO: 3902 - DNA, 562 bp, Homo sapiens
tttacatgcctgaacacacatagtagatcctgttgatagtttgttaattttgaaagtataagcaaagacttcttgtaatacttaaatatatcaagatatatagcctctaggtttcctatagattcactttaagccttttatgaaatttaccctttacttaatatccaggttcagattttcaaagaatatatacagtaaatgaaaatagcaggcgtgagccaccgcgcccggccatagccttttttaaagtgagaaggaagatatatcagccactcatccctaatgtctacaccagatcatctttggtgccagtggcccagttttaggacataattagctgggttaagagacactctggtaacttttaagcacagcaggactaacctgatgaaggcagcaacaatttaagtaagtgaacattagatatctgattcactgtgctaactaagctaagccacaagctgtgatcagcacttttactaaaatgtagtgatgcggttcttaaatttaaataaatgtagaaaaataaggttttatatattagaattggttttataacttt

SEQ ID NO: 3903 - DNA, 3560 bp, Homo sapiens
ctaatttttgtatttttagtagagacggggtttcaccatgttggccagactggtctcaaacttctgacctcagcgatctgcccacttcggcctcccaaagtgctgggattacaggctggatgaacatctacttattacataatctttttaaaaacgtctctcttttttttttttttttttttttgagacggagtttcactcttgttgcccaggctggagagcaatggtgcaatctgagctcaccgcaacctccgcctcccagattcaagtgattctcctgcctcagcctcccaagtagctgggattacagacatgcgccaccacgcctggctacttttctatttttagtagagacagggttggtcaggctggtgttggactcccaacctcaggtaatccgcccacctcagcctcccaaagtgctgggattacaggtgtgagccacagtgcccggccttaaaaacttctttttaaaaattatttatgtatttgtttatttttgagacagggtcttgctatgttgcccaggctggtgtcaaattcctgggcttaagcaatctacccacctcagcctcccaaagtgctgggattacaggtgtgagacaccgcacccagcctaaaaactttttatcctggagacagtgtccacaaacttaatctggtatttcacaagttgctgaggcataggaaactcttttctttctacaatattttcagaccaccaagccatgagaggtgacagcagtagcaaatctcatgagctcttcggtgagcagccatttcttagtggaaaggactgtatctgaccttcagttctcagcagttacaaatgtcaaaggcagaccttttctctcctcccaggctcccctcccacactcctgtcctgcagcttccctccctgtagataagtgaatgctgatgaggtgtgactgggccaggactgaagggtccctggcccaaaatatcttcctctgcccggaaggctgggcttctcatcatctatatcatactctgaggtctggggaaaggggcttccccttcaaagctagcactataaatatgtctccaggttgtcaccaggagtccctagataaaccacccctctgggaggggcattaaccttttatcttctcaacccatgtaggaactcaggactcagatggaggatgaggagaggcacctcccagaggcgcaggtcaatctgacccgcttcatgtttcgtggtgtacttcgtgttttcaagttgttgttgttgtttcagtgacttatcaaaaaaacaaaactctaatataaaataggaaaaagtatagatgatacaaagtagcataaatagtcctttattctgaaagaacttagtgatttaccgagaaaaaatatgcatgttaaatttcaaataatgatacaattctttttctcctttcttttttcttcttctttttttttttttagatatggggtcttgccatgttgcccaggctggacttgaactcttggcctcaagtgatcctcccacttcagcctcccgaatcgccaggactacaggtgcctgcaattgtacccagctcgggacacaattcttacattttcttttcttttctttatttttttgaggcagagtctcgctctgtcacctaagctggagtgcagtggcatgatctcagctcaatgcaacctccgcctgccaggttcaagcaattctccctgtctcagcctcctgagtagctgggattacaaacgcccaccaccacacccggctaatttttgtatttttagtagagatggggtttcgccatgttggctaggctggtcttgaactcctgacctcagatgatccgcccgccttggcctccgaaggtgctgggattgcaggcatgagccaccgcgcccggcccaattcctacattttgaaagcattttacgttttcatatccatcatcttcttagagataacatctccttcagctgagcccagtattaaccttcgcatgaccccattacctgccgtgtctgtgcctgatcagacccaactccttgaggccagagacttcttgctgcttcttcaacaccaagtgcaaaaggcgcccaaaaaatgacaggtggggaaccaaagacctctgatattttgtgaggatgcaggacaatgttgttagagcttctatttttgtgttttagtttttcaagagaaattttaaaatatccaggttttaaaatacgtattgacaagttatttaaaaaaaaaaaatgtgcctttaggttgggcccagtggctcacacatgtaatcccggcattttaggagcccaaggaaggaggatttcttgagcccaggagtttgaaactagcctgtcttaaaaacaaaaaacaaacaaacaaaaacctttaaaacactgagtagacccaacaaaatacaacgcgtcagtaaatagaaagtaaaaatataggccgggagcagtggctcatgtctgtaatcccagcactttgggaggctgaggcggacggatcatgaggtcaggagttcgagaccagcctggccaacatggtgaaaccccatctctactaaagatacaaaaaattagccaggcgtggtggctcgtgcctgcaatcccacctactcaggaggctgaggcaggagaatggcttgaacccaggaggcagaggttgcagtgagctgagatggcgccattgcactccagcctgggtgacaggacaagactccttctcaaaaaaaaaaaagtaaaatataaaaatagcagtgaccatttattgtctactctatgccagccattttacatattttatttatttatgtgtttattttttgagacgaggtctctctctgtcgcaggggctggagtgcagtggcacgatcatagttcactgcagcctcaaactcctgggctcaagcaatcctccccgctcagcctcctgagtagctaggactacaggctttcaccaccatgcccagcttacatatattatttataataaataatagccaggcgcggtggctcacgcctataatcccagaactttgggaggccgaggcaggaggatcacttgaggtcgggagttggaggctagcctgactaacatggagaaatcccgtctctactaaaaaatataaaataagccaggcatggtggcgcatgcctctaatcccagctacttgggaggctgaggcaggagaatcacttgaacctgggaggcggaggttgcagtgagccgagatcgcgccactgcactccagcctgggcaacaagagtgaaactccatctcaaaaaaaaaaagaaaaaaaaaagataaaactaatagatggattgctcttgtggttaaaaaaattcacaaaaataacattacatagctgggtgcggtggctcacgcctgtaatcccagcactttgggaggccgaggcggacggatcacgaggtcaggagatcgagaccattctggctaacacgatgaaaccccgtctctactaaaaatacaaaaaattagccgggcgtggtggcagacgcctgtagtcccagctactcaggaggctagggcaggagaatggcgtgaa

SEQ ID NO: 3904 - DNA, 1611 bp, Homo sapiens
tggcggcggtgctgggccaggggaaggaagggacacggaggccgccctcgccccgccacctcctaccagcttccccccagccccggctccgggagatgtgccgggcggggggcccgggttcgccgagccgcaggagagacacgctgggccgaccccagagcggcgctggacagagccaacacagatctatagatttctttgaactcggaatctcatagcaccaatatttttgcacagaactcttacttacatgtctcatcgaaactccagaacaaacatcaaaagcttgtcagctcatttgcagcttacatttttggtttcttccacaaaaatgataagccatcaccaaactcagaaaatgaacaaaattctgttaccctggaagtcctgcttgtgaaagtttgccacaaaaaaagaaaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagccacatggtgaagtcttactcgttgctatttagagtgactcgtccaagaagaagagagtttaatggaatgattaatggagaaaccatgaaaatattggtaatttttttttttactagattttatcactggagattaagatggtcattgaaaatgattgtaccagtgttccttcatgatagtcatggtgctgagtcttaaagcaaacagtgaattcacctccacctcaacattttgttgtgcaaattttcaaacataaaggacaatgagaagtattttatagtgaacacttatctacttacctcttagattcaacaatgaatattttattatacttgttgcatatttatccccctacccatccctcttttcttccaacaattgtgaattcatctttgaggtattcattcaacaaacacataggtgctggggatgatttaatttaatcgaagatgattaaagcattcagtcctgtcctccaaagtctcacaacctagtgtagggaaatagacatgaaatatatcattgctgcaaaatgatgagtggcataatacaggtatatgtgaagttcagcagagaaacacgttggaagaaataatctttgactcttgaagtattgtttgaagtttttgggagttaccacgagtgagaaggagtttgcctagcaaagataattctaaacagaaacattagcatttgcaaagatgtggggttaatgttgtgagtgttaaaaagaacatatagtaaaaatgcaaaattggaaacgtggtctgtatattattgcaactttagtgtaattcctacctcatttgggataaatgtagcatgttttatgttaagggaccatatatcgtaacacatttttgttctaatatttgatttatgagaaatgtttgttaaatttagatgtcagtgaagagcttccagccagaagaaaatgaaatcgtgaggatggggaaaagacatttgttgcacaaatgacagtatttgataaaaacaggtaatgttgatgaacaagcgaggctcccacaatgttctggaaatgttttcattctgaag

SEQ ID NO: 3905 - DNA, 2237 bp, Homo sapiens
agttcaatgcgagctgagcagacagggctgcaaggaaatctggcgcggttcaatacctcgtctagcctgggttccagtatctaattttttttttgttttaactgacaaactcatttctctactgggacaggatgctgtgctggctggaagttccatttctacagcaagaatcctatctggaaacacagaagttgtcctctagccacagcagctcgaacttttttgattgtcgttgctgctttctcccatcacccccatccccttttgacaaagatccaactgtaaaaagtcttacgtaacagttcaggactacttcggttcttttactgggtaagcactttcaattttttttttttaactaaaagccattttaaaattgaatctgttgaggggcttgactaaaatcttttaagtaatttgtgtaatggaatactgtcagtggattttttcgtctcatttctgcacgtgctcctttgttctcagaacagaagctttttatacacatcccataacgcagctggagagagttatgaagtcagttattataaggaacacaaaggttgctttccattctttgcctttagataattaatttttttgttttcttaaaatggagtatttaaagaaggaagaaattcacaagaaataaactgttggagaatttagaaaagtttgaagtttttaccaccttttctatctctagttttgtgtggccaaacacttgtgccgcctggggcggtgggggtagaggcaagcatagacagagaggaactaagccagacatggacaaaggcacgagccaaaaccagacagtcctggccgttcgataggccagcagtgggtgagacaggtcagccagctgcaggggcgggagcgggggggcgggtagggacatggatgtgtgaggtgctcatgcgtgcgatcgtgactagattctgaaactgccagccattttcccagctccgctttgtgcaatctaaaggaatgcatcccctctgaagcagtcttgccagagcctagtgagggagagaagtatggtaaataccacaacatatggaatcagaaaataccgggaactggagtgggcaagggggaatgcagagggtgtggaaattttttagtgatctggaatgtgttgagtgacaggaagtgccccaagcttctcccccaccaactcttctcagtcgcgcctgcttttgtctaactcttgtaatctacacactactgcttacaaagctgtctgagtttaagacaaaaagaaacctaaaagtctccttacttcatagtacctgtgatatggaaggaatgtaaaagcatgaccctttaagcctatggacattttttcaggtatacaggagaaagataaaataattttccacagaaaaatgagaattatgaattatatagttcaggttccaaatctaatttttaaaagaattctgattctgctacactttacaaatgcttaggttggttcctaatttgaagcagacttgttttatttggttaatgcattgcatttgaacttgtttctattttctttgcataaatttggactttgggagaaaaatgcaaagtaataagtagaatgcacttgggggaaaaaaggaggatttttcccttcatgggttggaaagtattttaaagggttgttttcttgaaaaaacaagctctctcttactttctgcatctatgctataaagataactatgctataataaatgtaaggtagaaaactttaaagagaaaataacagtgttctaagtgaaaagctacttagcattttcccaaacttacacattatcaacagaaacactaaaaattaagagaaaagcagccaactaattaaatagctagccttattttgggggtatgggatagaaaattaagtgtgaataaaatgatacttgggaatgtttctccctcgtaccacaaaggatgttagtggtcagcctacgagttaatccttcctagcatggctctgagccttcatgccgagcagacgttattcacatgacgattcgaaaagtccattcatatatctcgctacctggatttgaatagaaaccagacagcaattctttagttccagccaccattcgccccactggacaatagcgatttgttagcacagagtcacaggctgtgggacacaaagcttggagctgcagaaagatgggggattcagagaacaggaaattacaggctcgatgcactcctggcagctctgagaatac

SEQ ID NO: 3906 - DNA, 323 bp, Homo sapiens
taaaaagttgtggcaaagatggcttccatatccgggtgcggctccaccccttccacgtcatccgcatcaacaagatgtcgtcctgtgctggggctgacagagatccacatctcaaagaagtggggcttcaccaagttcaatgctgatgaatttgaagacatggtggctgaaaagcggctcatcccagatggctgtggggtcaagtatatccccaatcgtggccctctggacaagtggtgggccctgcactcatgagggcttccaatgtgctgcccccctcttaatactcaccaataaattctacttcctgtccacctaaaaaa

SEQ ID NO: 3907 - DNA, 1920 bp, Homo sapiens
tgggtaagatggctacatttaaggtgactctgaatggtggggttctagcttggtcactttcatttcttgccatcataaaaactagtaggctgtggagtgcgcttcctgtttgtgtcatctggtcgtagaaccttttccaaacagaagcatctgcctttggctgttctgtgacctttgaagccagtctcagtggtttaggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtatttta

SEQ ID NO: 3908 - DNA, 2057 bp, Homo sapiens
gtgcagcagagagctgggcgatgagccgggtggggtgggggtcagcctgctccaggcaggggaggcagacagcaccccggccagggacagagctggtgcacccggcacgcgtgtagtgacgtgcagccgctgcgtgacgggagacggagcccaccgcccctccggggagctcttcccccaaacccaccatgttggtctcaccaggagaaagcattagagagtacaaggttttataaaatccgtgaccagaatccaatcttgacaatttctcattcttttactttattgaaaatttctccatctttttattttcttttttggccaacttttcagtctttctattaaaataatcacctccagttgtcagagtttggaggatgcggtgaggagacccggtgaccacacgcagtgtgatatcctgggacagaaggaggacgctgagggaaacccaagtccgaatcaagcctttcattcagctcgtcacatggtatcaccgtgaatttctcagagccacagacgacttaataagcacatcaatgtgagctgcgttagcagagggggagcgggtgacaggcatgtggacgctcgctgtggcgtctcttcagctcttctgtaaatctaaaattatttcaagacacaaagcaaaacaagtaatacttccaagcctctatttcagtgatctatatttgcagcattaatgagctacaagaaaaacaacatgaaaaagtccagccgatgaagcgtcggggacactcttggggccttcctgagtgtggtggggaatgaagcgtgactgaaggacaaaccccctcaaagccgagctgctgtggaccccgggctctaaagtccctgatacaccggctgcacctctccaggccacagcctctgtcccacctgggctccatctgtgggctcaggggtcacccaggccaggcccgtctgggttccctggagccttaccctatagtacatggccaccatagctgagggaacccacgtgtgggggatggatttccaggctggaagcctccggcaatgctgtccacctggtgggtccccttctgtgtgtctgcctttccctgtgacagctctggccatgtcaccgacaaacacctctgggtctcggccgccgccacacgctcctgcgcaccgcccacctggaggcaccaccccagagacacgagcctcgttcttctgaagagccgtagtctacacctttattttattccggagagtcattaaagggaaccaaatccgtatcggggcaatgtctgctttggggcccagtgtccccccagtttgtcagatagccgtgcttctgcgtcgctgcctcctccaccctaaaatctcagccgaggaggcccaggaggacacttggaatatgcagagggggagacgtggacgagggatgaccaacaaaccaataaaaccctgacctggaggcgaaggttctaaacacggagtggggagtcaccggtgtggggtctccttcacaagcggccttcgaaatcagaagagattccttccctgcttatgccaggggaactaagaatcagcccacaggcagtggattggccaaagtgacctttcaggacgctggccttgtgcctctaacatctcccgaagagctgatgaagccgagccacttgctgttgtgtgttgaaaatggtgcaagaccctacacaatcatccctgaacccataatgctgatgctctgatgtaaaaggaatattttccccttgagataaaatgccatcagatgccatctgtgccgcctgtaattttagccataaatcctcgttgtatttattggagatttgtttttcaagatggctaattttagtctccaattcaaccgcacactaattttcttgtttctttcttgctgagaaatctgatataacagctcctcatagaaagggcttggcaggtttccaaagcccaacagcctcatttacttagagagaggttattttttctttcttcctctctcccctctccctccttgttttggtagcacggttagaattcagaagggttgaaataaaaacaggatt

SEQ ID NO: 3909 - DNA, 999 bp, Homo sapiens
tttaagaagaatatttttatttcacatgctagttacctttattctgtttgaaactatcaggatagatgatgtaaaaccatttcttctcagacaaatgtttctttactaaataccataaatagaattttgttggacaaattgaggatggcaaacttggcctatatgttcttctaaaatttgaagctgtgattaggattgagccctaagtgagctgcgttaatgtaccatcattagctaattttcaaaaggaaataaatagaggttcaaagtgtaaaaacatgactgaatgaggtcacgcagtcattttagtgtttactttctctgatgcacagaatttgtatcctgtgccaaattatgtcaggtaattggatgatgaaaaatatgttgattgataaaacagtatcattattattggatgtacttactgaatcctcagaggtagaagacaaaggctgggaaatttttaattttttgaagattaataattaataactaactagcattttatattttagcaataaaaacgttcacttaagaggccattttcatttcactgagagatctaggaataatgccttttttctttagtttttacacccaagacaaattttcctgttttgggcaaactacccatattttcaaacagttgttgtaccttgtattcaagaactactgtaatgcattagtggtctggcttcattttgtatgatgccagatccttaatttacccagcacaatcatttcagtagtttcctatggctcctgcaaaaatgcaaacagaaaccaccacaggaacagccccttgctgcctcctgttgctgaggtagtagtcgctaaagaaaattgaaggctccttacaatctatatttgaaaactagaacttctgtagaaacacacagatcccgatcttagaagttgtacaggacaatctggtaaaactgacataattgtgatttattaacatgaattaaaatgcccaaccagtgcttcagtgtgaca

SEQ ID NO: 3910 - DNA, 870 bp, Homo sapiens
aacacgtagtacatcacgctctggcccgccatgaagtgctgctccgccgtctccaggaagcgctccaggtacttctccagttcttagactaagaggaactggacaccaggagcctcataccaggactgcccagccgagccactcgattcctgacccacatggcccttgagatgacaagtgattgctgcttaaagtcactgagttctggaataatttacatcatggcaataggtaactaatgcagattctggtacctggaaaaggagtgctgacatcaaacagctctatagatgtgggcgtggcctcagaactggccacaggcaggagccagaaggactctgtggaaagcgtgagtgtctaaggtgctttgagagactgtatatagaagtctcatggcctttagggaagctgctggggaggcctaaaggaaagtgaggaaactcttagtggagattggaagaaacagggtctctgttatgaaataaaagaacattttgtaaaaatgtggttggtagcagaaatgtaagttgaatgtacctcatgaagtgggtggtctagctaaggagattttcaggcagaatgtggaaggtgttgcttggcttcttactgctgctcacagtaaaataggagagagagaaggtaaaaacaaacaaacaaaactgttcaacataaaggaaccgggatctgccggttttaaaaatgcccagcctctccagatggcacatgatgctaacattaagaaatggtttctaggcaaagatcaaattcagggcacagtcaagaaaacacggtctacagattaaacttaggatgtgacttaaatctttttgtgaagacttcagaaagatctaaagtgatgcctcaaagagc

SEQ ID NO: 3911 - DNA, 1899 bp, Homo sapiens
agaaggagttgggcctgtttgctcatgagcagctgtcgaggaggcccactgtgtaccacatatgcggctcctgaggtcctgaggtggaaggtccctactgcatccaccaccccgcggggcagagaaggagcccagagaaggaggggcgtcccacctcgtggaaggccaggaatcaggaagaccagtgtcccttgtgctagggcagcacagtggggtccctctctctttctccctcacccccatgctcctggtcaacctcctcccactccagccctggctgccagggccagccccccaccttctctatggggtgggacgctggtgagccacgtattcacgggaggaccctcagcacagaatgagccctggacagtccatgcatgtgactgacattgctcacttcaccagcccatctgctccctcccttcctgatgcaggcagcaggagaggggcagagacacagacatcccaggagggaaaaccttctggaagagcctacttgacatgcctggtatccttggctcccagacaagtctggaccaccgatcccacatggtaaaaaggacccttccacaagatactcccagacacagccagatgccccatagagaaggtggtgggcaggtcctggtggtcccggccccacccagtcctccgagggaagcatccacagctgtttctgctccttggcctccgacaccccagtgccatccccggagggcctgggctgcccctgcacggtgagctccgggccagtgacagccgggggccctgctctcggcaccaccctcttccaggggtggagacccaggccttgggtctgtgagctcctaggtctgtttctggatgcagctcagctccctctgctatgcacagagtaagtgcccagcatgtgtgccatggctcaagtttgggatgtaggagtctgggctgggaggaagggcctggcttccgcctctggcttgggatggagagggcaccaagctcatggtgtcactcgtgtcacttggccgttcactggtgctcggcagaggttctctcgcaggctcctgtgtttactgtatggtgtcttccgctgtgcagaaatttcaaatatggcccagtaaaatatatcaggctgtcttcccttgggctcacatctaagaccatggctgctccacccttcctatgtgtagaaattcttacctgtctctccacggtatgtcgcttgtccagggaagattccatgcctgcctcgtggaaacacccggagcagaaaaggcagcatccccgtggcagggaggcctgaaggccatagtgtctggcattgtgtgccttgtttatgccagctttctcaaccacaagattacaaaagtgttttcctgtatttcttcctatcctcttgcatatgtagataaatacgcatgtgtgagacacacatgcacacacacacacacatgcacataccaccacacatttgttgagccaagtgggtgatgctccgtcgagtgcaccaagctggcttcttcctcggggcttttgtgcctgtgcatgggtcccttttcatgggctgtttgagcccagcttctcccatgacagcccctgtgtctgcctcccacccgggcacagagcaggaacagcagccctgctctcttcactaggcaagcgtgctgtgcacaggtaggtgttcaatattggatgaataattcatactaacaaaccctgttcaacccaccaagtgtaaactgctgaggtctcccaatattcctggggacacactttagaattcacagttcacccagggcgggtgaaagcttgcttttctttttcctcttcagccacggaacttgccgatgcccacttttccaatgccagcgtgaaagccccagtgagtgccctagaggggcaggacaccagctg

SEQ ID NO: 3912 - DNA, 3262 bp, Homo sapiens
gttggaaaatcccactttacttcaagtgaagtcactgggttgtccccatgaaatatctccacaatgggtgtgctagacctttactctctgtggcaccaccaagaccccctcaccctgccagagccctctgaagtgtactcagaatggaggggctggaagtggggccagtggtcctggtagtcagcctccccttctgacacaagaattatcgtggaacagcttgtgtgaccgatcaactggtctctccatctttaagccattgtcttgttgactctgttactgcagagtttggggaggtctcatggcttctcgcatcctatttcctgagcttccctgaagccaacttctggccactggtatgtgatgcgagcacagtgcctcctcctgctcctccaggaagcttctgctgattgaacgcaggccagatggcgagatccggagcaaccttcttagatcaagggaagaaaggggcacaagaggggagtaggtaacaagataaaaggagctccctccctgatgactacagagccatcgtggcagccctgggcctccatttcagacgttcatcttgcctaagccaccaccatcagggtctcagtcagtcatcattctcatttactcgggtggctgggtgagggcggaatactaccttccagctgtctgagattaagcctaagccaccaccatcagggtctcagtcagtcatcattctcatttactcgggtggctgggcgagggcggaatactaccttccagctgtctgagattaagcagaacagcagctaaagcagtaacagcaggtctccttcagcagcttgccacagggaagagggtcccgcgtgaaccgaactcaacttccacctgcgcagaggtagctaccatttgcgtagaggtagctgggtctttaaggttagagggaaggcgcagggagggagagacggcgggtgggggttgaacaaagtggagattcacaaaagcagactagggcgggcgacgtgatcagatgacctgtgcgggcggcagcctcctgccctcctccccttcgtgcgccggctggagcgaagagttcttttgacagccgtgagcttccccgccaggaacttactggggctgcatcaccctagaaacgtggctttgggctgtggaaacgctgcctctgtggaagtctctcctcgcgggggtggacgggtcgctgcgcgcccagcgttcttctgcggttctcacagcccgccgccgccgccgcctcggggacctttgcggggaggcctcaggtcagcgccgcccttgcgatggcgggagagcagagcggccccagggcctctgagctccggccccggcacgtcccgccctctcctccgcttgcgggagccggggcgcctcggagggaaaccttccggacacaggccgggagaagaggggccgtggcgccatcgcgcagcttcctggtttcggccatgtttttttttttttgagacggagtttcgctctttttgcccaggctggagggcaatggcgccgtctcggctccctgcagccgccgcctcccgggttgaagggactctccggcctcaggccgcggtgttcttgtaaattagaaccggcctatgcgccaagcgcgggtctcgcggctgcggagagaggcccagcagggggcggggacgccgggaggcggggcctggccgagctgcgcacacccgggtggttctggctacgggtacccggacctgcccaacgaccgttctccattcccgacctccgcaccctacccggtccgcagggcaccttcctcctctctctcaggcacgtcctcgacctcagttgccacgtgcacatgctggtgccttccaggctggagtatagtggcatgatcatagatcactgcagcctcaaactcctgggctcaagcgatcctcccacctcagcctccatatagctggtggggaccaagtttctaacacatgaatgttgggagacacattcagaccatcgcagtggccttataaaaagagacacaagagcttgctctctgccatgtgagaataccacaagaagactgtcctcagcaaatcagaaagcgggtggaccctcatcagacaccagatgtgcctgcaccttgatcttggacttgccagccttcagaacagtaagaaagaaatgtgtgttgtttaagccacccagtctatggtaacttgctatagcagcccactaggagaccccaagatatttaaaaactcatcagcacctgctttctgcatctggaccctgatcttctggtgggtttaccagttacttgtagagtgtccctgtgatagttttaggtgtcaacttgacaggattgagggatgcctagatggctggggaagcactgtttctgagaaggaccatgtttttggaggagactgttttatgagtgaatttcaggggacacattcagatcatggcagtggcattataaagagagacacaaaagcttgctctctctctctgccatgtaagactaccacacaaagactgccatctgcaaaccagaagcaggtgggctttcctcagacaccagatctgcctgcaccttgatcttggacttgccagccttcagaactctaagaaagaaatggtagcatggcttggtctaagttggaaggcctgagaaacaagcacatggtggaactgagttcaaggataaagacttgagaatacctgctcagtggactgagtagggaagatcaaccctcaatgtaggcaggcactatccaatcacctgagggcccagatggaacaaaaaggtggaagaagggtgaattctctcttccagagctgtgacacccttctcatgcccttgtaccacacaactctaggtcctttggcctttggactctgacacttgcaccagtggccctctggggctctcaagcctttagccttgaacttagttacaccatgtgcctccttgtttctcaggccttccaacttggatcaggccatgccaccggcttctctgattctccagcttgcagatggtatattgtgaccctggcatttaataactatgactttggtcttaagcaattttcttcctctgtggattgatatttacatatcaatgtggataataatttcttaccacggtaactgttgtgaggtaaaaatgagttaacataagtaaaaccgagcacatgcaaaccatccgaaatggttaatacttactatttgtacttgaagaaataaatgtttttgacaataaacttcttgtgcagttttcctc

SEQ ID NO: 3913 - DNA, 3667 bp, Homo sapiens
gtcttgcatggatacatttgagcctgcatgttgcgatctgtatccaatgattgtaacttctgtattgtatccttcaatgagaaaggacagctctggtgtgaggagtccctctcccttctcctaaactcttctacaaaacaggggtttccaacttccgggataaggacctgtaccaactcatggcctgttaggaaatgggccacacagcagaaggttagtggtgggcgagtgagtgaaacttcatctgtatttacagcagctccccattgctggcattgctgcctgagctccacctcctgtcagatcagcagcagcattaaattctcataggagcacaaaccctgttgtaaattccacatgcgagggatccaggttgcgtgcttcttttgagaatctaatgcctcatgatctgtctctgtctcccatcacccctagatgggaacttttagttgcagaaaaacaagctcagggctcccactgattctacttgatgctctccaggaacacatctttgaagacaaaatgcctccaagatccccagtactgtagctcttctcctgaagcaactatttccagccttgaaagttatcagctcaggagaggaagcactgcaagcagctcctgggccctggggtatggttgcagattcatcacctagctacttgtttgtggtgttatcatctttttttccctgacatattttggaacttgactacatctgatatatttctcaacatttctccagtaccattcactccaactccagaggacaccatggaacaccatttcctcggctggaagtgggaccatctccggcgacctctgcttctcctctccttttctactttacaggagcacttacagaaacacttgaaaaagttccccactcataggagacctgtcagttagcaaattgtaccctgaagttttggtctaggatatcaaagcataacttattttggggctgctttaccagattgtgacataataaactttacttacttcaaacattttatttgtgatgagatcacgatcacggaggccctcgaggaatggaaatgtcttttttattgcatttgaaatctccaccttatttcttttgaagtgcttgaatacaatgtcatagagcagcctgtcatctacaccctggtcttccgtgaacatcctagggaaaaaggacaccatgtgaaaatggtcatcaagattctgagatgtttgtggaggctgtaagagtttacatataaaggacaagctacaaagaatgaacatatataaattaggtggtcctcagtagaggccagaataaatgcaattgaagcaacaaaaaagatgtaatagaagaaatggaggttgtgaaaaactaatatagaggactgaaaaagttctgtctaaactgaacaaagccattgtaaagataccttcacctaaccatatatggaatattttttgaaataaaaattaaattcctacagaatctaggtggaataaacaggtcatccacagagaaatgaaaaacaatggaataaaaataaaatctaaccttgaatatgcatcttaatcaactgagagaaaacaaatctgagaaagatgaaaataacatgtccttctctaatctgtagctgttaagaaagaaatataatcctacatcattaattcacaaataatacaatgcagtttaataataataatgagaccacattattgagaatttcatgagaatatgaatgatatctcctagaatgcctgattctactttgtattaatatcaatctctctgtattattgctatatatggtgaatcattttaggcatctgaatttcagaaattgttgccgtttcctatgaaagtaattttaaagttgaatctctaattctggttcttagttgattactttattgctctgataatgttttagtcaacatctcagtatttcttaatattatgaaaatttatgagcccttccttcccaactagaagagaattattggcactgtccagtatctaacatgaggcaggaaacaataatgttacattattgttttgaatttctgtaaaaaaagtttctggttaaagatcactaaaatgataacaaaggaattagattcacaatgacaaagagaatggcagaggacaatgagcagataagagatttcaagtaaaatcttgaaggtgaaaagtggtcagaaaagtgctagttgcaatagcagataggggatggatgctttcagaggttaggaatcatggtgccctacagaatttgtaagaaacaatggagatttgaagggagacacagagccaaaaactgatgtgttatttgagaaatgaacagaacagtgtgtgccctgcccgtcaacccacatcctgaccatatgcaaccaggcagtctctcagggcaaccactgctgtcattttttccatcgtatcttaatactgcccgctactggattttgtataaatgggataaaaggtatatatgcttttgtgtctgccttcttttgcttatcattcatgttgatgtgttgaacagtagtttgttcatttttgttgttgagtggcattccattgtgtgaatataccacaatctgcttattcagttttctgttcatggtcattggagttgattccactttgagactagtataaataaaattgctgctcttgtacaagtctttttgtggcaagatgttttcacttatcttgcataaatatgtagcagtggaattgcttggtcattgtgtaagagtacatttaaccatttaagaacctgccaaactgtttttcaaagactatcagagatagcctttctagttttagccattccagtgtgtgtgatgtgatatgtcattttcgttttaatttgtatttctttaatgataaaatgatgtcaagcacattttcatgtgttaattggcaatttattttttgtaaagtgtctgttcaagtctttggcccatttatattattcaattttacttattgatgggtaggcattttttaaatatattatggatagaagtgttttgtctgatttatgtatggtgaatattttcacccagtctgtagcttctctttcattttcttaatcatgtcttttgatgggaagaaatctgtaattttgatgaaatccaatttatttttttttcttttataattaatgactttagtgtactatctaagaaatatttgcctactccaaggtcatgaaaatattcaaaaaacaatttacaatattagcatgggtttatatatgtactttctatgctataccattgatctatttgtctacccttatgctggtaagattttgccttaaatatcatggcttaacaaaagtcttgaagtcaattagaaaagattggcttggattttctagattctttgcttttatacattatcttttcaaatcagtttgtcaatttcttcaagaaaaaactttaggacttttttttggatttgaattgaagctacagataaatttgggggagatgacaacaacattgagcttccaatctgttaacattgtatatctctccatttacttacatgtgtttaattttacccagcactgcttatagtttttagaagtcatgtacatctttcattaaatttattcctctccaaaaacctattgaaataaaaaatttaatttaattaaatttaaaaaat

SEQ ID NO: 3914 - DNA, 621 bp, Homo sapiens
tagcaggattggaagcttcatgccatgggagctgtcaagaaaggcatcccaaagagaactgaaatttaaaaataataatagaccttcaggaataggtgatttgaagatattaaagctagaaattggaactagaaaatcaaaagaattcaaggcatcttaacgtgacagttgaactcatttgattatacttaaaaaagtttattgcagttattgactctcaattttttttttttttttttgagtgcagtggtgccattgttgctcactgcagcctcaatcttccaggctcaagaaatcctcccacctcagcttccagagtagctgggactacaggtgcatgccacaccctgataatttttttttccccaatataaacgaggtcttgctatgtcctccagtctggtcttgaactcaagtgatccacccaccttggcctcccaaagtgctgggattacaggcgtgagccaccaaacccagccaccaattttactttaggtaaacttttattttcaagcttttgttggtgttgcaagtgtaaatctgttttataaaatgttctataaatataaccactattccttgtaagctatttaaaataaattttaaagtctttcaagtaaa

SEQ ID NO: 3915 - DNA, 606 bp, Homo sapiens
gacttaggatttgagcatctttctgttatgctgttgccccactcctattgcaatactccccttcttaagaaagtttttctagactaatgtctagattaaacttcttttctttgacaataatgatgccatgacttggacaaaatgcccattgcctctgggtcctgctttcttcacccagtgctgccttattggactccttgtgcctctccttggctggggaaatcagaatacacagtggtatcccacttctaagatgcctgatctgaaggacagtaaaacaactgacctttgccagcatgtaaaacacatggtttaactagtcctccaggaacaacactgagcaatcctgacctgggactactttactcggccatctcctacttgagatgctccttgtctctctgttcaaggacaccttttctgagcctttcttgaacaagagtggaggaccgatagggcgattaaactgtccttgacacaactttagagcttcaactgagaatctagaagagagtagatggaaaaatatttttccctcccctccaaatgcaaggataatcttacacgagtccaggaggaaggctcattccacactaagtgttctga

SEQ ID NO: 3916 - DNA, 3715 bp, Homo sapiens
aaagactgaggccaggcacagtggctcacgcctgtcatcccagccttttgggaggccaagacaggatcacttgaggtcaggagttcaagaccagcctggccagcatggtgaaaccctatctctactaaaaatacaaaaattagccaggcgtggtggcgtatgcctgtaatctcagctactcgggaaacaggcaggagagtcacttgaacccggaaggcagacgttgcagtgacctgagatcgtgccactgcactccagcctgggcaacagagcaagacaccatctcgcaaaaaaaaaaaaaaaaaaaaaaaaaaagtgagcatctgatacacatgcaagaatttcacaacattgcattcactcctccagaaacaaagatatattttaaaatgctttcttagcatatgtgctctggttttctagcagatactctgtcaaacttttgataagtgaaaaatttaccgaagaatttaaaaccaaaaacagttttttaactttcccacctgaaaatattgaccattttctaatttattttcattataaagaatattggttatcatggttgctcatgcctgtaattctagcactttggtaggccaaggcaggcaaatcactcctgagcccaggagttcgagaccagcctggacaacataatgagacctccctacaaaatatttaaaagttagccaagtgtgacagtatgtgcctatagtcccaggctgaggtggatcacctcattagtgagccgtgattgtgtcactgcactccagcctgagtgacacagaccctgcctcaaaaaatatatatataaatactaaaacatctggaaggaaagaggagaaaagggagtatcagcttttaatacttgttacaaggtcagtctagaaaatacagtgagatttgctgggtaaataggttttgaaccatgaaaaaattgatggcatgcaagatcttcctcaatagacctaagagtctcatttctattaaaaaatacaaacaactgcttcattttattcataaataattttttgaggtgctacaaaaaattaaaactaagcaggagtttaaagtttttgaaaagccaagtaacattttatctctaacatttattgaatcctctccagtatttacacaacgtaaatgagatactacacacaaaacccttgtgtctgaaggtaaatttatttattctcaaagacaacaagaagagaaagcacatcatgtattttaaactttagaagcaactgagtcattagtgtctggtggacaggagctagggatcctatcccttcccaacaaggccaagagttcacctgaggtaatgcatttgccttgggggcgaggccttgaattgcagcaaataacctgtgtgtatttgcatatttaaccagtactcttaagaaggattatacaaaaacctgttccagacagctgcttactcattgcctttaaaattgcgtggtgctgggattggcaggtgccaactgtttgctcattctctttgacccactagccttgcagtttgctgtgtgggtgttgatactcctaaattaaagcagggaaggggtggttttagatggcttttaacacctgctctccacccaagcaccctggattcatttgatatctggattctaattctgtagtcaggagactggcccaaactgtggcccagagagaagtgagtcagttgcaagtggctagctgactctatgggaacagaaataaaatgcagcttagagagtttgtcagccaaatccacaaatgtgtggctttttgaaacattggacatctgttcctcttaatttaaaataaactttttttttttttttttttaagcacaaagttgcttggctccttgtttctttgtgtcagcagcagttgctgctctaatttaggaaccctaggatctgatttaggacatttggaatctttaaggcacattcgatctagaaagtggaactgaattgctttgggaaggcaagaggatgattttacagtatagggtttgtgtggaaatccccttcagcagtaatcaacccaggtgtccaacctgtttgttaaccatttccaaatgactcagaggacctagagggagggcttgaacacactccagcactgtttctacaatttagcctttatttgcattggaaaccacattcctgaattcttgagggggcaggctctggcttattctgggcaactgacttcaagtgggacccctgagctacctatgtaagcaaagagtcagccatctctggagagttaccagggaggaggatctttctgtgaacttgctttgatgacctccacccaaagccctttgaggaacagttttgtttattcaaggagcccttggcaggtcactcctcccctaccacaaatctaatccaaatgcgacattttcctttgaggccatctatcccttttgggggacaaaacacatcagcttttcccttcagaccacttttgactgaagcagtgatcaacattgcttaattgtgttccagtctgtttccagcggggaaaaaatgctttaggggagtgaggcagttagggatttgaaaacagggatggtgccgcctgaaggtggggaatgacttagatcactgtcttcctttggctcctcaccatgttgtgtggaggaaacgaaaagcagctcaagttcactcctcttggcagtagtgcagaagcctggcttgccacggccctggagaaccatgtttttcccaacttttttttttttcttttgagacggagtttcactcttgttgccgaggctggagtgcagtggcgcaatctcggctcactgcagcctccgccttccaggttcaaagcgattctcctgcctcagcctctcaagtagctgggattacaggtgcatgccaccacactcggctaattttttgtatttttttcagtagatacggggtttcatcatgttggccaggctggtctcgaactcctaacctcaggtgatccacccgcctcggcctcccaaagtgctgggattacaagcatgaaccaccatgcccagccttttttttttttttttttttttttaatacagaacacaaatttgagtgtcattcttgtgcaggggccatgctaatcttctgtatattgttccaattttggtgtatgtgctgccaaagcaagcacccagcttcttttcattagttaagaagatgaaggccaagactaaggcagggaggcctttctctgcctttcactctttagtgcacctcacagtcagttgcacttgagtaaggactgctaaacctctctgagagctgccagatgttcctgcctagcctcaggttgttggttcttcagacacctcttcattctgcccattgcaccagccctttcccatctccatgttccctccatggtaatttctttgtacacaacaaccacacggagcaccagcaatcaagattagctcccgggaactctggcgtgccctgtaccaggaagcacagtggattactacaacttttgataatgattgtttgctttgtaccaggcattattttcagggctgtttcacatgtgttgtacttaacaaccccatgaggaaattaaggcagggtggttcagtaatttgtcaagggaaacaaggaagtagagcaggcagcagaggcgttctggctctgaactactctgttctgtagaaatcagtgcaaaagtccaagcttcagcatacttgttt

SEQ ID NO: 3917 - DNA, 2331 bp, Homo sapiens
tcctgagaacgttccttctcaggaaaagagaaatgagtggggagggttttgaatgaatacttgtgttgcgcttaagtatgttgtctcttctatgcctcacggcagcccagcgggataaagctatcattcctatcttacaggagagaagagagaggcttggggaggtgaggtggcctgccctaggctataccacagcaaggaggggctgggttttgaaccccaattgtacaaggccagaggaaccctgagaattctagggcatatgtatggggctgggacagctggattctaatccacctgcttccgcaagtgaccgtacaagcctggacaggtcaccaaactcgccgaggcatctgcttcttgcagttgtaaaacacgggcagtttcaatgactccctcgcctgatgggagctgtgagaatcaaggtcgatgacaatttgtggaaaagttctaggacattaagtaccacagggaggtaaggaagagtttcattcctgggagtttggctcaggtaccagctttttccctatgatcgactttaagctttctttctcccctgtgtgatttgtgcaccgagggtcatgctgaagccatttccaccccaaaattctgtgacagtaagattcggatgacaggagaagaggagatggcccagagtagaacttcagatctcggagatttctttcaattgagtcttactctaaaaacccgtatctctctctctatctctgagtgttccctagttgagaacattctgtatgtgaagctgggcggtaacacaatggtggctgagccggccttgtttttagtaattcacccatcatcgagtgggttgctgcccctgtgtggcatgcgctgtgaatagacacatgagaacaagggttgaagaaatgcacttgcttctcctaaggagctcagtgtggtcagatagtgaaaagtcacagcacagtgagatatggccaggagggtggcgagcagccagacgtggggacgtgactaacacctgcattgtggggtgagctgaagcatggggcacccagggctctggtctcaaaccctttctcatttgtctgcactcacttttctgatctgttctttctttccttttttttttttatttaatcatctgtttttaagaccttctctgccctgaggacccctaactatatccttctgccagagctttcccctgcttctccatatctccatgtggatgtctaatccaacgtcaggatgtctgaaattgagggtcaggtatccaccccaaagcctgctgtgctgtctcgcccatctcagcacacaacagctctgacttccgctggctcaggccccaaactgcgaaccaccccttgttcttctctttctctcacatcctaggttcctacagttgacagatcttggtggctgggccttcccccccactcccctctctgcccggatgcagtcaccactggtgctgcagcagcctggcttcactggcctccttgccccacccttgacccagccctgcaccatccatgggctgttctcagcacatccatcaaggtaaccctgttgatgtaagtcacatcatgtgatttgtctgctcaaagccctctcatggttctccacctttcttcaagtaaaagatgggatccttatggattgcctggaaggcccaacatgacctgcaccccgccagctcccagccccttctcctctcactcccctctgctctcttactctgccccagccatactggccttttttctgggccccagctgtgtcctctgcctggcatatcttccctcacaggcctcatggctcactccagtgcctctttcagtcccctgctgcgggcttcactgaccccgctcacccagccccccccacagcacacaccccacctaacaagccgtgtgtactcaggtatcagtgtattgtctgtttcccctatgcaagctccttgaggacaggggctgctgtatctccagcccctaggagagcccctggtacatagaaggtgtgcactaattatctgttaaatgaatgacctggacaaagtattgtccaggagaaaggggggcactgagggaggggtacatacacagggctatgaaggtatgagagaatggccatcttgcagtgctggggctcaggagaggaggggagctgagagcacaggtacttggtgtcaggttttggggagtctgggaagaatttttggccagggagtgactgaatccgatttgcatgatacacatttgcctctgccaggagcctggagaaggattagcgcaggcggggccagggtgcagctgggagagcaggctagcatggaggaaggccgag

SEQ ID NO: 3918 - DNA, 1265 bp, Homo sapiens
gagccactgcacccagcccaagtgcccatttttgtgtggcccatgagctaagaatgatttttccatttttaaatggggaaaaaattaaaacagtattttgtgataggtaggaattacatgaaattccagtttcagcatccataaatagttttgttggaacagccatgctcacccatttacatgttttctgtggctggttttgtgctacaacagcagagtttaagtataatcctgctataacccttgttatttgctttcgaaattgcgcatttgttccaacccatttaatatatttgggaacagtttgatcataacgcagacttcatgtttgcttgtgtgtgatttcatcctcgagaaatagtaggtgaatatgggaaactgtatctagctgaaccaagcctaagtagtacacaaaactcacacctaaacatgtaccagctacctcactcatctccccacctgtgttgagcaacccttccgacgtccacttccaaaagcaaagtgcatgtcttcaagataaaaggccatatttattgtgatataatttctcaaccatttgacatatgtaaaaaccaagctatcctttttttttaaatgtgtcactcatttgagtgttgtgcttcaagccccatttttcccatgagacctgtggtctttattgtgcaattttgcatggcatagtgatttttaggaacgcataggtcacattataaagcagaactgactatatttgggtcagagaccatgtaccccacaaagcctaaatatccagccctttacagaaaaggctcaatgatccctgctttagaccattgacttccacctccttacctcatacagtgcagaaatagacttacccacacaccaatccaagaagccaaagccagttttatttcacaatcatctttattacagtaggatgatggtcctgggccaccagcctaaaccttgcagccttaggaaagacctgtgtcaacagggcttgcctccctctctagacaggggctcagccacctccagggcatccctgctgcattttccctgctggaggatggggcagagggacaatgggagaggagggcatgaccccaccccaggctatagcagctccttggccacaaagatccttttgccagtagcagaagggaggaaaacagcaaccaccagggttaccaccacttgtgggatggccaggaccccattatgtcctcttaaagttgtgctcaaagcaattaataaattaaaatgagccttcagcagcaaag

SEQ ID NO: 3919 - DNA, 2704 bp, Homo sapiens
ctgattccaagaagtagaaaagaatgcttatttaacagttactgccatcttcgctcacatacagagtacatgggggagtcaagacatttcctgaaaatccctcagaggtgagtgaggtagtgacttggggtagcaagactgtcctcctaagtcagttgaggagtgacatcgggatgaagctccacccacaagccctgcccacagaggtcttctccctgagtgtgtcctcctttagtacaagatgaggtttaacttattgctaatgtgtttcacattttccctccccacccatgtaaagcttgtcccaaaaaagctgttctttgatgaggactttttcctaagtccttgtccattctccccacacatgcagaatttctattcaatatactctggggcttactgcggggtgactcatggctgaagccttatctacactccttatatacctaacatgtcttagaatcaattatctggacagacaacgagacagaaaattgaggattcactggggagtgagggcaggactgggcagaggaagaagctgacctgcaatgtgtctgcaacccagtgatccttcagttcgatggggatctctggatctggaatgaccttctggagttgtccccgttgagtcaagggttggggccagaaggtacccctgcaaaggtgcattgcccctgtggtgcatgcagctccctgtggctgagagtgagttccagagcggagtgcatctctggaatgcatctctgccagcagcaacactgttctctcaagcagctggggtgttacccctgaaaaggtcatctgggcagagctccacagtgtccccacatgcagattctccctgtggtgtgtgatcacaaaagctttgcccatacatcctacaaacaaagacctccttcctgagggccactctgtgcctgagtgtccattcttttactgatgctccccaacactccccagacaagggtgctttcccctgaggctgtcattggatgtctggtaaatgttgattattgctaaagccttcccacagtccctacacataaacttctctcctaagtgtgtccttttgtgcatgctcaaggctgactgatggctacagttgcccgtactctatactcataaggctcctctcctgaacgtgtccctcccatgcctgataagggctgacacatctctggaacttcactcacaatctgtgtacacagggtctactccccatgtgtctctctggggtaacatgaggcttgactggtcactcaggtcttgttcatgacccctgcatacacaggtttctcccgtcagtgtgtcctctggtgtctgatgagatttgacttatgactaaagcctcgcccacactccctacaaacataatgcttctcccctgagtgtgtcctctggtggacaaggaggagtgatttccggctaaagcctcggccacactcactgcacacgtaaggcttctctcctgagtgtgtcctctcatgtacaatgagggttgacttgtcacaaaagcctcgcccacattccctgcaaatataaggcttctcatttgagtgcgtcctctggtgtctgatgagatttgacttctggctaaaacctcgcctacactccctgcagacataatgcttctcccctgagtgtgtcctctggtggacaaggaggagtgatttccgactaaagcctcggccacactcaccacacacataaggcttctctccagagtgcgtccgctcgtgtatgatgagggttgacttgtcacaaaagcctcgcccacactccctgcaaacataaggcttctcatccaagtgtgtcctctggtgtttgatgagatctgagttctggctaaagcctcgcccacactccctgcaaacatagggtttctcaccggagtgtgtcctctggtgtctgatgaaggatgacttctcgctaaagcctcgcccacactcgctgcaaacatagggcttctcctctgagtgagtccactgatgtctattgaggatggacttacttctaaagctttgcccacactccctgcacaaataaggcttctcttctgaatgtgttctctggtgtctgctgaggttggacttctggctaaaacctcgcccgcactcactgcacacataaggcttctccatcgagtgtatacgatggtgtctgatgagggttgatctatctttaaagcttcgcccacaatcactgcaaatgtagggcttcttccctaagagggtcctcgggtttgtaataaagtttgattccaggttatggtccggttcatactctctacagttgattgctccaaatctcaaggtttctaattccttcaagcctttgtctagctgcacagggtttggtctttgggctgagctgggctctgtttctaccaccatgttgccttttctaggacttgctgactgtctttggagtgggctggggaatgcccttgaggtttctctctcctctgtccttgcagaccagggtttggagccacctcctctctcctgaccttctgcattttcaaaccaacagcttacatgggaatactgctgcccctgctgtttccaatgccctgggctagaattccctggatggaagtgattttctgcacataagcccaggaagatctgaagtacatgttgactgaggaactgctgacaggagaaggccagaaggcaggaggaacaagtgtagatttctg

SEQ ID NO: 3920 - DNA, 2168 bp, Homo sapiens
tttccaggaaggtgtggttaagtgtaagtggtgaaagaagggaaaccattgcttaatgtcgcaaaggagacagactgtcctatgttgtgcagaaagctcccacaccaggtgaaatgcacatctgaacagagacaggcatgggaaggaggcccaaaagcgacatggcaaaccaccgggcaggggactcgctctttgttgcttcccaaacacttagacgccagcagcatgggttggtgtgctgggctggttaaggccgatggtggagcagagccaacctgcaaaatccacttcctcagcatcagatctcttgataaaagcatgaacctgcatgtaaggaaacgagaggacgtggtgttaaaaagaaacaaaaaaacaaaacccaccaggaaggaaaatccaagagtttcaggtctagagcttgtgctgcacttggaaagagcacctggcacctgcccctgagcaacagtggggccagctgcaggcccaaagacctgctccaccagtcacagcagctgtgaggccttgggcaagtcacctcttggagcctactcgtgcagtatggagacagtaactctgccttaaatgcctcacaggcttgttagaagggacaaagaaaatgatggacttagtgcatattatatactatatacaccgtctatggctgtccagatatttacagtattacttagctatttccactgccaccaaacgagacagcaggcggagagtgactctggaaggaggctgaatgtaagatgaggcagtcagtattagggaaaggccgcatccccatgaagggggtgggctggccttttctttcccatggccccctcaggcatttcctctggcatatgcttactcaggctgcgggggtcaccccagctttcccttaaactgatgggagagcaaaggagactggtgtttggtattctgcagccccaggctcagctggaccacagtgggcagggaatgaatgggctctggaagtactgcacagatgactgacagagaagaacaaatgaataaacaggtactgtaagaatccggaataaatagactcaccatgagttgcttcaaatctgctctctctgcggggttttttattaagcttaaaggaagaaagacaaggtaagagctgttgcctggcactggttctagctcaaataacatgtttgcatgcctgtcttctctgcacactagaggccgaggattgcctgggcttgattcatcctcctgttctaagcacagtatcatgcccacagtaagttaatacattcttgctgagttaaactaaggtcaaaaagcaacgtgccaatccctggagagcaagtaccaaaaggagcagctactacatccatgatgtagttagacatgccacataagtcttggcactctaaaaaagggcttatggcagcagccaagaatcatcagacgggagggtaaagggcaaaactctgcctgcagaagcaatgctggtgcttccagaaatggggtggggagcctgacaaatccagagtatacgcttccagagaacaaggagccaacttaccatttattcacaaaatcttgaaattccagactgaacactccactgggcagttttggaggaggctgcaaacacatgttgagataagaaaaatgcctggctccttgctccagccatctcctctccccatcccacccctcccaccagccagtgctacttttttttaaagtcttctctgcagtccaaaggcagtactactctcatccagtcaaggaaaggcacaggtagaaggccagtgctgcctgttgggtaaccatgttggaaccactgatctcaaatagcacatttagaattgggaccaagtcaagtccactcacttgtcgggtgattttgaactaatcactattcctctatgagcctcagtttactcttctatgacatgaagaggttgggcctaatgatctcagggaccctttcaagctctgacactctacaatggtaaatcttggagtgcggcatgggaacgtaaccagcaatttactggcagcaacagctaggggcacgtgcaaaccaccaggcatagcccaggtctgacagcacctgcagaagcaaaccggtttttaaaaatcccttttctgagccctagagaagcagtgaaaagttaataaaacattaactgaca

SEQ ID NO: 3921 - DNA, 1104 bp, Homo sapiens
ccttcacttcgccctccagctgctgcagctgcagcccgaccgcgagcgtgccaagcggcttcagcagctagcggagcggtggcggcggccccgctcaggagaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccctggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagacgggaagagcattaatgctggaggccacaaggttgggctcgccctggagttggaggcttaatccagctgaaagaaacctttgggaatggatatcagaagatttggccttaatatatttccattgtgaccagcagcaggcttttttcccc

SEQ ID NO: 3922 - DNA, 5734 bp, Homo sapiens
cttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagggcccgcctggcaggacgactgagcaagtccttggaaaaccagagatattagagcggtgaatcgcgctggtcacgttggacacctgcgcgttaggagattctggagccagagggagagaccccagaaactccccggtcggcgacccagcccgagacgcctggggtcccaagggaagctgaacgcccggtgggctcccgggatggttcttccggttctttgtgccgccttcacccagtgaaggagcctgtatccaccctgcccagtcgctgttgggctgctgcggagcttccgctgccatcttcggatcctgtgttccgcccggggctccaccagggcagggatggtggtgagggtcgctcgtgggtcccctggcagggagcagggtctggcactcacaagggcgcacgactaggacttgtcgaatgaatcctttgtcgcctttagcttttagtcctttgaagagaggctctgattgtactttctccacaagcttcagcatggcagtatctctcaccacttgttttggtccaagggcagaaatgagcatcctggaaaccaatcagtacttccgctctgaactggaaaagtgcaaacagaacttccaagacctcacagagaaattcctgacatccaaagctactgcctactccctggccaatcacctgcagaaatatagatacatgatcccttaattcaggctcaggctgaagaactgacccacttacgacagaagatacaggaagggagaggtgtctgctaccttttcacccagcatgtgaagaacacagtcaagtcttttgagggccttctcaggaacactgacattgcctactaccagagacagagattctgtgagcaaatggtacaaggaagccagctgacagagatccttgtcagaaaacttgccacagagtcttgctctcttacccaagctggagtgcagtgacatgatcttggctgactgcaatctgtgcctcctgggctcaagcaatcttcccacctcagcctcccaagtagctgggactacagaatcaaccccaatgctcactaacaaactgagaagaaaaaaaaagaattacccccaacaacatctgaggaagcacaacagggacagacttgaaggcacctgggcagtcctctggttttggagtagagaaaatcacaatggtaagaaaaatgaagacaggcaaaagccactggctcccaggatgcacctctaacctctacaggcaaatcatagattccattgtccagctgtataatgaaaacagagttctcagagaagaataccggagactcccccgacttgcctgaatcaaatttccagaggctgaggaggaggaaatacaggaagtattggtcctgctgttcagagtggcagaggagaaagaaaatcccagccgtgttggaaattcacagagagaatatgaaaatcaggttgtcctgtacagtatctgcaatcagttacgatacagaaataacttaaacatgtcaagaaagatgaacgcggatactatgaggaactgctaaactacagccgagatcatctcatgctgtacccttaccgtctattggatattatggtgaagggcttcagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagaccgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaagaatgctgtttcaatgtattgctgattgggctttgcccataagaagggacaagtaataaatttggatcaacttcattcatcatggaagaatgttccatccataaacagattaaagagtaccttagatccatagaagatgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaatgatgggaaatctttcaccagttcagagcactggtgaaagagaagcacagagatattttgagcatgcgcttactctgagaaacacaacactgtttctgcgtcataacaaagatctagttgtgcaaactgcacagccagaccaacccaattatggttttcctctggatctcttacgctgtgaaagccttcttggtctggaccctgcaactggcagcagagttctaaacaaaaattacacactgcttgtttccatggctcccctcaccaatgaaatccggcctgtcagcagctgcacccctcagcatattggaccagctatcccagaagtcagctctgtctggtttaaacagtacatttacgtttatcatatcactggacaaggaccaccatcccttttattatccaaaggtacaagacctcgaaaactgccagatatatttcagagttacgatcgattgctaataacatcttggggtcatgatcctggagtagttcctacctcaaatgtgctcacgatgttgaatgatgctttaacacattctgcagttttaattcaggagcatggtctgcatgggataggagaaactgtccatgtcccatttccatttgatgaaacagaactacaagaagactcgtgtcaatatgggtgttcataaagcattgcagatactaaggaacagagtggacttacaacatctctgcggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccactgttcagttccgaattaaaccggaaagtatatagaaaaattgctacacatggcctttgcagaaaagagagccttcaaaaacctcttacattccagtagaaaactctctctgcaagtccttaactttgttcactcattccaggaaggtgcttcaacattggatattcacacagagcccagtttttcaagtttgctttcacagtcatcgtttgctgacatgggtgttccacttcctgcaaaaaatttaacatttaaagatagtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgcggagcaattcttgctttactaatattaaaagtttggggaacatattcatgttttctgaagttttgctccttattgcacatcttattgcaacaaagtgctttttagcatccagcactgtatttttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcagttggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcaccctgatttatttttttgtttcttacctttgatgttttcaaaccaaggattgtgattttaggttagaattacatattagaagcattaagactatgtctttggatcagaatgctttagtgattaacctactttgaagacatactcttaagcaatctggatcttaaatttatgtgaatacatttttagaaaatgataaagaaaaatggaattacttcaaagtgtttcttgagtcattgattcttttagcatctcaaatgttaattagaataattggaatcactttttagacttttcaagttacctttcttgggaagtttgtgtagtgttaacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtatgtatgtaacttttacagtttttcagctgaaagttgtatttttttttaatcagggctctttaatctcattttaatttcctttgtttgaatgaactgtagttattttctgtattcctatattaaccatctaaaccaactgtaatgacacgtacactaataaagaattgaacatttgtatttgt

SEQ ID NO: 3923 - DNA, 10090 bp, Homo sapiens
atccgcccgaggcgctctgtgggggcggcctcgacctccccgccgttcctccccgcggagcaccagacccggggccgacggccgcggggcggacagcttctctctcggggccgggatgcgctgagcacctcggtccaacctgtttttccggggtggtgacctcgacgcgaaggaccgggcgagctgctgcctcccgggggataccagcccccggcgctcgttcaaggagggaggaaggaagggctcccatcgtgtttgcgcaggagtgagttttatttgctgcatctgcgggcgggcggggccggcggccccaaggtcagccgaggccggagtgcgcggctcgcggcgaggccggtcccgccgccgccgccgactcccagcccgggccagtcacggccggcgccggctcgcgggcagcccagtagcgcggcctggctgaagaagacatccctggccgcgcaggccccgcgcccctcacacccgcccggcccgctcccagataccttcttcagctcgttctcgctggcgccgggcgggacgcccaggatgtcgtacagcttcgtgtcagccacgttagccatggcggccggccgggcagtgctcggggagaaggtggcgaagcagacagagcggagtcgggcccacaagcggcgtcggcggcggcacaggccgagggagacagcgagggggaagcgggggcggggctgaactttgacccagcgcacggtgcgccgtgacgtcgctgtgcagagcccgcccccgagcgcccgaggcgcggccactggggtcgaagtattgaagagtgggccaggttctctgttttcctccaggtccaggcggctgggcagggccaacgtaggaaatgaagaactgtgcacggcgcaccccaggaattcagcttcctctcaaaagccatggttgcgaggtcgcgtgtttaacctcgcactggctgctgagggaattaacaggcctgcgcagcagcttcgttagcttcgaaagaaaatgggccccggctcccgcaggaggcccgcctggcgcgcagatgtcgttattagaatccgggacgtcggtggaccctctgggtctggctccctcggggcttacgatgaaaaaaactggggggcgcgtgtgtgtgtatgttgtgttttatattatgagaattctgaaacatttagcagaagcagtatattactccccatagtgcagttagctaccttttacctgtttcattggctccaccatacatttctagtgttttaagggaaaccgtttcattcataaataccctaagtgtatatatttaatatctaagagacaacttttaaaggcataacgatgtaatctcatctaatgaaattaacaattccttaatctaattcccagtccatatttaggtttttcagatgatctcatgtccttttacaattggtttgtggcatccgggtccaaaccaaggtccacatgttgcatctggaccacgtgtttaagcctcttacttgatagctttaaaattagctaacaccagaggtttagatggtgtaaggcaagtctggccaccaggtgacttgatttacattcgttttagtttcgctcagaaagtatgctgtgcatctaccaagtgctatgatgtacagaggcctggtccggggagaggagtgttacaaaagtgcctgccttcaacccatttacggtttatggagacagaaaagtaaggttttctgatcccttggaacctgaactgatagcaaagacttcagcataagcatctcactcaggataatgtttcttccttggcgttccctttgacctagttgtggagggcctgaattccatgacaaggactctgaaatttagcttgaaaaccctaagagtaatcagtgataagtcattaatagtccttaaacccttttcctcaaatcccatctgaaatcctgctccctctgtgaagtcttcctttactgggcactggtgaacactgctatctcattcgagttcccaccacccttcgtttgtaccttttgtggtaggatctcgaactcttttgtttttttttttttttttttttttttacttgaaacagcgtctcgttatgtcgctcaggctggagtgcagtggcgccatctcagctcgctgcaacctccacctcccggcttcaagtgattctcccacctcagcctctcgagtagctgggattacaggcgcccaccaccatgcccggctaatttttgtatttttagtagaggtggagcttcaccatgttgaccaggctggtctcgaactcctgatctcaaatcatccacccaccttggcctcccaaagtgctgggattgcaggcctgagccactgcctctgccaaccgccattgccgtgtaaatgctgacgtcatcctcatgcacggctgtaaaatccaattctctacttttcacattttgagatgttcgtaagagacggtgtaaagttatggcgaggttagactgtgtaggttggtagtctgactctgccatttaggaacaatgtgaccttcagcaagttacttaacttttctgaggtttcctcaggtgtaagatggggcttgttattttttatatcattggtttaaaagagttatacatttctattacttagggctgggcgcagtggcctgtaatcccagaactttgggaggctgaggcgggatcactcctgcctcaagtcctgatcacttgaggtcaggagttcgagaccagcctggtcaacatggcaagaccccgtctctattaaaaacacaaaaattagctgggggtggttgcgcacgcctgtagtcccagctactcgggaggctgaggtgggagaatcccttgagcccaggaggtgggggttgcagtgagccaagatcacaccactgcactccagcctgggtgacagagtgagaccctgtctcaaaataataataaataattaaaatttaaaaaattactaagaagctaaaagaaattaagtataaactattgttcttggcccatatgcttacgttgtctttgctcatttaaatttctggcttttctactgggattccctgacttcttccattacctatggggaatgcccctccgtcccttttcatgacctcatcttcccaaatctccttgcttgtcagttatcattttctctcgtctcatttctctgttagttcctgctccacgtaagaatatgaactgaaaatctgtctttgttgcaaccttcatattaatttatcttatttgtttcatattgttttatcttattttccttctgcccatgaacagtttaaaagggctggagtttcctatttgtttcagttttactcagtttttttttttgcaagaggaaaaaattctctcttgatgccattttagcttctgatattgtaatgaagagtagctgggtaaattccctcttttgttcttgttattttattttagttttttacctgactagaccagtaaccacagtaactatttttgaatttcattttcatttctttgcaatattttctccatttctgggtattaattgtagtcagcataatttgctaattttatagctcgagttatttcagaagaactttgtgtgcttaaactgacacagggtctcctcccaaggatcacagactgagataaacctgtgtcagtgtgagcactgtaatgttccagccactaactgttttgaggtagcatatttattttggcttcatgtttagccaatgctgtgaagggaaaaggacctttatctcatttcatgtctcaggcactgtaaaatgctgagtcacagtacacctgagcgctgcagtgatctaaagtttgaggcggcagtgatttcagatttctgccaggcttatattggtgttcaattcctttgctttgatttagtatgcttgtgtaactgtgaagggttgggatggagaggaggtggatatggactgggacggggggtataggaactgtagtatttttgaagaccattgatactgttcacaagtaattgggaactgtgtaatccattacttagacaactccagatatatcattgaggcagtcagaaaatagttttgctttctgctttaactaggtttgaatgtatagagtaagtgatgcaggttaaaatattttggggggatacagaagaaggtactgatggttcttgttatgagggtgtcaggaccacataatttgatgattgttggtactctggaaagaaaaaattgtgggacttggatcactgaataatctctgaatttctttcagtgcttaaagtagattattcagtgatggggcagcacagttgtatgtggtaggtatttctagccccactgctggcctttcaaacccagtcgtgtcaaaccctgccttattaattagcattttccaaaggttcagtttgcttatataattgcagtggtatagtaagcagagaaattgacccaataaatttagccatctaacaattagtgtgggaaaaatagtggagaagatatgtctattgtgataatatgagatatgaatatgaatatatatgttttccacatatatgtgtatatatatacacacacctcattaccactgtaatatatatataatatatacataatatacataaaggccaggcgtggtggcttatgcgcgtaatcccagcactttgggaggccaaggtgggtggatcacgaggtcaggagatcgagaccatcctggctaacacggtgaaaccccgtctctactagaaatacaaaaaattagccgggcgtggtggtgggcacctgtagtcccagctacttgggaggctggggcaggagaatggcgtgaacccgggaggccaagcttgcagtgagcggagatcgcaccactgcactccagcttgggcaacagagcgagactccatctcaaaaaaaaaattcgattagcctggacaacatagcaagacccgtctctacaaaaattttttaaaattagctggggctggggagtggtggctcatacctgtaatcccagcacttcaagaggccgaggtggtaggataatttgagaccagcctgggcaacatagcgagttgttttttttttttttttttgagacggaatctcactctgtcacccaggctggagtgcagtggcacgatcttggctcactgcaatctctgcctcccaggttcaagtgattatcctgcctcagcctcccgagtagctggaactacaggtgtttgccaccatgctgggcaaattttttgtatttctagtagagatggggtttcaccatgttggccaggctggtctcgaactcctgacctcaagtgatctgcctgcctcggcctcccaaagtgctaagattacaggtgtgagccactatgcccggcccgcaagatcttatctctaaaaaaaagaagaaagaaaaaattagctgggtgttgtgcacctgtcatcctagctatttgagaggctcaggtgggagaatcacttgagcccgagagttgaaagttacagtgaactatgattgtgccactgccctccatcctgggtgacagagtgagaccctatctttaaaaaaatatatttttaattatgagaagagaaggaattatctgacctatcttgtctgattgtaggtcatgagacttccatttctgaaggggtcctgttccatatcctcaagaagggagtgctgcacagagaggccatgaggaatctaagcagacaggccttgctgggtttccccactcagtctgttaatattagatcatacctttttgtccagtcacatttttacatggttgtcaattatgcctgtccagtaaagtctccataaaaggcccaagaagacagagttggagttcctggatagctgaacatgtggaggttcctggagggtggggcacctgggcataaaagctctgagccccttccctcataccttgctctgtgcatccctccatctgtatcctttgtaacattccttataataaattggtaaatgtgtttcccagagtcctgtgagccactgtagcaaaattaatcaaacccaaggaagggttcatgggaaccctaatttctattcagctggtcagagacacaggtgaaacaacctggggcttgctattggtatcagaagtgaggcgactgagccctcaacctgtgggatctgatgctaccaagtagatagtgtcagaattgagttggaggtcacctacctggtgtctactgtataattgattgcttgcttgttggtggggagaaatccccacatatttggtcacagaagtcttctgtgttaattgagtgcgagaatctgaatctgagtttttttcacttatctatagattcattcattcaacaaatatgtgttgtggaccctcctatgtggcaggcactgtttggtaggataggggacagccataaacgaaacaaaatcgctgcctttacagaatgtacatctagtggggaaggcaggcagtaaataagtaaatacatagcatatcagatggtattatgtgctgtagagaaaacgagagtattggggttgggaacaatttttatttaaggtgtttgaggaaggtgacatttgaacagtgatctagaggaagcagggccttgaggatatgtgagaaaacaattgctgaggcagtgggcctgcaaaggccctaaggcagagcatgcctggtttgttagaggaaggaggccagtatgactgggtagcagcaaggtagggagatcttggaaagagctcacatcagagaggttgtcggggactcaatcaggtccactataaagactttgatgtttactctgagtgagctgggaagctgttaaagggttttggtttttttgttttttgtttttttttttttgagatagagtcttgctctgtcacccagactgaagtgcaatggcgccatctccactcattgcaccctccacttcctgggctcaagtgattctccagcctcagcctcttgagtagctgggactataggcatgtaccaccaatgcctggctaatttttatattttttgtagagacagggttttgccgtgttgcccaggctggtctcgaaactcctaagctcaaagtgatccgcctgcttcagccccacaaaatgctgggattacatgtgttagccaccactcctggctatgctattaaaggattttgattagaggagagacataagtgcattttaaacacatcattctgttagctgtgttgagaacctattgtaataaaacctaggtgagaggtgacttgggccaagatagaagatgttgagttggtgaggaatcggcttctggatatattttcacctttgaactgatagaattagatgttgggcagaaatgagggcagggtgaaaataaaagttcatgttaatttattaacattcaaggaaatattttttaaattaaatttatttttgagacaaggtctcactgtatcactcaggctggagtacagtggcaagatcaaagctcactgcagcctcaaactccttagctcaagcagtcctcccacctcaacctcctgagttgtgtgccaactcacacttggctaatatttttattttttgtagagacagggtcttgctctgttgcccaggctggtctcaaactcgtacggttttttgttttgttttttttttttttatgagacagagtttcgctcttgtcgcccatgctggagtggaatggtgtggtctcggctcactgcaacctccacctcccgggctcaagcgattctcctgcctcagcctcccaagtagtggggattacaggcacctgccaccatgcctggctgatttttgtaattttttagtagagatggggtttcaccatgttggccaggctggtcttgaactccagacctcaggtgatttgcccacttcggcctcccaaagtgctgggatacaggtgtgagccactgtgcccggtccaatgttttaatgtatgtataatatacattgtggaatgattataccaaactgacatatccatcaccttacatacttattttttttgtagtgagaacatttaaaatctgttcttttagcaattttaaaatatacaatacattattgttgactacggttaccatgttgtgcaacagatcttaaaacattatcttcctgtcaaactgaaagtgtacactttggtcaacatctcctcattcctcctctcctcacagcctctgataaccacaactatacttccataagatttttagatcccatatgtaagcaagatcatgtggtatttgtctttctgtgcctggcttatttcacttagcataatgttctccaggttcaattcttttgttacaaatgaccaaatttccctcttttttgtccgggtgtggtggctcacgcctgtaatcccagcactttgggaggccaaggaggctgatcacctgaggtcaggagttcaagaccagcctggccaacacagtgaaaccccatctctactaaaaataaaaaaattaggccgggtgtagtggctcaggcttctaaacccagcactttgggaggccgaggcatgtggatcacctgaagtcaggagtttgtgtccagcctggccaacacggtgaaaccttgtctctactaaaaatacaaaaattagctgggcatggtggcacacttctgtaatcccagctactcggggggctgaggcaggagaatcgcttgaacctggcagaggttgcagtgagccgagattgcgccactgcactccagtctgggtgacagagcaagactccatctcaggaaaaacaaaacaaaacaaaaaaattatccggttgtggtggcatgtgcctgtaaacccagctacttggtaggctgaggcaggagaatcgcttgaccctgggagacagaggttgcagtgagctgtgattgcatcactgcgctccagcctgggcaacagagcaagactccatctcaaaaacaaggcagaatttccctcttattaataactgaatagtattccagtgtgtgtgtgtgtgtgtgtgtgtgtgtgtgtgtgtgtgtatcacattttcttttccattcatccattgatggacacttaggttggttccatgtcttggctattctgaataatgcttcagtgaacataggagtgcagacatctcattgacatactgatttcagttcttttggatatacacccagaagtgggattactgggtcttatggtagttctgtttttagttttttgaggaacatccatgctgttctccatagtggctgtactaatttacattcctaccaacagtgtgcaagggtttgcttttgtccacatccttgccaactcgttattggataaatattaagcagtttgattttttttttccattgccctggctggagtacaatggtgcaatcatagctcaccgcagcctcaaactcctgggctcaagcagtcctcctacctcggcctcccaaagtgttgggattacagccactgcactcagccaagcagctgggcttgtaagaatagagttgaaaggggcaggtgttcaaactggagatgtaaatttgggaatcccctcaacatattgccagtgtataaagaagtaagacctaggacagttcactgactgctcatcagaacccctaggggaacttttaaaaatgctattttctgggtctgtcctcccagaaatcgtgaccgaattgatctgaggtaaggtgagggcattgtatttttttaaatagtctaaggttatcctatatttgaacatttttgaaaaaaaattttgcacatgaagaacacatgatgttgttctgacatacagtctttaaaatatttattttttttttgagacggagtttcgctcttgctcaggctggagtgcaatggtacgatctcggctcactgcaacctctgcctcccaggttcaagcagttctcctgcctcagtctcccgagtagctgggattacaggcatgtgccaccacgccctactaattttgtgtttttagtagagatggggtttctccatgttggtcatgctggtctcaaactcctgacctcaggtgatccacccgcctcggcctcccaaagtgctgggattacaggtgtgagccaccgtgccctgc

SEQ ID NO: 3924 - DNA, 2701 bp, Homo sapiens
tctatcttccaaaaccaagagatccatattcacagagggaaatctatgaagaccaagtagataaagaaacagtaagtgacttacagaggaaaagagcaaacctgaagacttgctggaaggggctagaggacacctatggggagccagttctctccacagagcaacatgagggcccaagaaatggatgcaccagctattgaggaagacagatggataataggcaggtaaaaaggaaggaattactagatagtctcagtagaagcccttcacccccatatacctgctcctgctttgaaaatgcaggtgctaattcaccaaacaccaacaggaaatgaaaagtgtattttctggataaactaaaccaggcatatgtgtaaagacagcagcagtggacaaatgccaggctgagaatgaaatgactctacattagaagcagaaagaaaaaaattaggaaacaactaaagatttctaagtaggagtataatgacctcttcctaaggagtgtcataatatcttcctgacatttaaaaacatggtctctattaggcagcaccctgcaaagtaattcacttacccatgttgaggattgtgggccacaaacagcactttgacaggcacttctgtctggcgattctgtgttcagtttgctcaagaactcagcggttttgctaccagaaacacaaacaggtgttagtgccttcacaaaaatatgaacataattctttatttttcctttggatactaacctagacttatttgggtgatgattaaaattatcttcagcagaacagaaagttacgttgagaacaaggtgtagcagaaatcaaaacaaaatgctattgcaagattgcattcttcaagaacaatattacaaaattataaaactagctttatgaaatgtgagcttatgacctcattttttccactttatattactgacataaatacaagtcctctcccagagcacattccacagcatgcagccctaatttcctatctgaacatttaatgcttaacactcagacttcagggtggagctgtggaacattcacgccctacaacatcctgcttcacaccagttttacattaagccctttaccctctcatctgcctcatggctttgaccactgttaggacacagagaccctctaatccagtagctcttttccatttatggatcatggagcccttttggactctgaaagcaaaagtgaaccctctgttaacagacacacacacacacacacacacacacacacacacacacagtcctttgcattttgtttcagagagaggataaaccctccatagggtttatctatagaggttaaaaagtgctgctgattctagactgcatttctaatatctctttttagctctgaaaaattgacctagaaatgtcctcagtttaaataagaagttctctgtttttaccttaaaaatccaaaccaccaccccaatttcccctctcacttatgccaagcatagaacactggaattgtttcctagtccttacctcagtgcctggcccattctgcctacccttgattaatttctacgcctttgtccttttctcatgtaatttgtgtgatttttatctcttcattgcacattcacagccacatacctcattgagcactgacttactttgcaccagacttgcgcagcctgttcccatctccctccctcctcctgctagccctctgcttccccctaatattttaagcccaatgctaagatctgattcatcaagtacttaggacatgggcatcaaaggaaacacaaagtatctggtagaacaaatggcatccagtgtaggagcaaaacaaggaattagaaactaaacaggtgccagcatcacttcaaatattacttaggtagaacatggcatttgaaaaaggtcagaagcttgatctggggaaggaagaaataaaagtgaagcaacatacagaaccctgagaaacattcagcagttgagacgagcagcctttccatttgtcttagattacttatcttgcccagaatagacaaggagactaatgaagtcacagagtgtggaagctgccccattgtctggggctttatgaagtcatcagtcaaaagtataaaaagaagagtgatgccagaagtttggatgagatctctgaatatcctaagccaagtgcaggccataggagaaagcagtgaaaaagaaacactgtgacaagcaaggaagaaacttcagaccaagttgacaggcagcccttcagtttactgactgccgcttcttacctgccaacgccaagcacaaagctgcctgcagagccagcctctatctgtggtccttgtgccaattatcactgccccactcatgccgcaggatataaagcagagtgacagggtcacaggactgccagaggaatacaggtaggggcctgcagagtatgcggattactgccaagtgatcaactatacaaaggaagtcccatgttacgacactaactcatatttttctactattagcattagtccctggtatataaaatttccatatattggctgaactgaagtgggatccctgtaggtaactctggttatatttaacaaaaataagatgtagaacctgtttgaggggcaaacgaaggaaaacatcctcgtgggaagtccaactggactaagaaccctggactctagcactgttttcaccttgcccttgggggtt

SEQ ID NO: 3925 - DNA, 5008 bp, Homo sapiens
agtgcagagctggaggaaagagctgaaaggcaagagtccaaactttcccgcggcgacctaactgcacctccagtgtcttcccccagagggcacagaagcagcaagaagggcgggaacacttgactggggtccatgcagctctaggctgagtcttgcagggctgagccccccaggcctgctctcctgtgtcctggccgctccgtcagtgcctgccagtggggtccagagggaccgtttttttaacgcctcttttgcaggtaatgagaaacatccccactcttaatgtcttgcctcctccggcctaagtcgcccagcacacagcccaacttccctggcaaacttgcttttcaaactctcttctctcagtcacgggctcaggttctgtagtgctgccatgctttactcctctgtccctccccttatctagtctcccgcattgacttcataaccaagttctgggtccctgcctctggagtgcctgatgagacaaaacggctcctcgtcctgcatccccgctgctacttccagaattcaggcctcgtggtctggagcctgcactgttccatgagcctcctgagcaacctggagtcctctgtctttcttccctcagtgagatgcgcctacttctccctggagaagcttgaggaagcagaaatgctggagatgagacggagttttgctcttgttgcccaggctggtgcaatctcggctcaccactacctctgccttctgggctcaagcgattctccttcctcagcctcctgagtgctgggattacaggtatgcgccaccatgcctggctaagtttgtatttttagtagagatggggtttctccttgttggttggactggtctcgaacttcgacctcaggtgatccacccgcctcggcctcccaaagtgctggggttacaggcgtaagccaccgtgcctggcttgcccatttttctattgagtcatttgccttgttggtatggagttgtaggagctctttctgaattctgcctctaaccccatgttggctttttgtatttcagagacctcgtccgcacaggggcttgttcttctgtgtctttgcagggctgttttggactcagtattcacctaagcactccaaattacccagcacaccctgcctgcatggcgctgcgctgcaccttcactctggtcacgggtctggcagtcagctcaccaattcctcctgcttccctgggacttgccggcttttagcactgcaattcactcagcaaactgggactgttggtcaccctacctggcagccagtgataaggcatccgccctgcctggatctcctcacctgccaggaacttcctctccacaagccggccatcccagcaaaagttctaacaccaaaggtctggcaactagcctgccatcttgtgcctggagccgcctgcgtgccacctactcccgaagatgggaaccttgttgccagttgggcagatgcggggcaatcctgtaccaagaccccattttaccacctgctttctcagaccactctggaacccactgtctcagattgtgtcctccaggaagcagaccatgagagggagttggcagggccaaagatttactggggctaactaacactcaggaaagggataggaaggaaacagggctggagagcaggttgagcccgacctgacagtctcgagcagcccaacagggaggtgtggagcaagggttgcccactagaggggcctgcattgggtacgggtgatggggtccacatggtacctggcatatagcaggctgtgcaatccatattaactgactggataaattaatgcccagaaaaggtgccctggagaatgggtgtgtgctgaacacaatagggaagggcccagcatctgccttggcataggcagaactgtgctgtgccctgcaacaggccacctgagagctgctttgatcttgtgtgtacattagatgactgccaggggcatgaaggggatgtgcttccagggcatttgctggcagggcgtctcgtgatctcttggtattggtgtgagcacagcctggcaggagagggcagatctccatgcaaagtatgtcagaaagcagatggaagccaggccccctcctgaaagaggctccttgaaggctcctgggaccacattatcattctcttcactcgagagatgaggacactgaaattcagagaggggaagtgatttgcctcagcttgtactacacagtctcactctgtcacccaggctggagtgcagtgatgcaatcttggctcactgcaacctctgtctcccaggttcaagcgattctcatgcctcagcctcccaagtagctggaatcacaggcatgcactagcatgcccagctaatttttgtatttttagtggagacagggtttctccgtgttggccaggctggtcttgatctcctgacctcaagcaatctgcccgccttggcctcccagagtgctgggattacagacgtgagccaccacgcccagctcctgagaatatacttttaatgatttcagttcttttaaatttgttgagtttttttatggcccacagcatggttgatctctatgaacattccatgtgctgctgaaaaacgtgcattggatgtagttttaaaaatacgtatcagttaagtcaaggtgaatagtagtgctgtttaagtaatttatgtcatcactaattttctgcctacattttcctgcagttactaagagagaagtgttaaagtttcccattataattgtgtatttgtcattttattttttcagtagtgtcacagtttgtctaatatattttaagctctgttaagtacatgcacatttatactttttatatctaattggagaattgacctctttattattgtgtaatatctcaatttctgacaacattctttgttctgaagtttactttgtctgatattactatagctacttctgcacaatattttacttctagtaatattttagatcagataatttatttctttttagcactcttgatttgtttgtgaagatttatgtttccatctaatatattccttcggtataaaaaaacctcttaaagatttcttgtagtgtaggaatactggctaggatttccatcattatttttgttttcctgagaaagtccttatttctccctcattttaaaaatcagccttatggtgataaaatttacataccataaattcacccttttaagtgtacaattcagtaacttttagtgaatttacagttatgtaaccactaacataatctactcttaaaacattgccatcacctctgaagatccttcatgccagtttgtagtcagtcaccttcctatccccaaccctggcaaccactaatttactttttgttattgtagatttcctgtctttggaatttcctataaatagaatcacacaatatctagtcttttgtatctggcttctttcacttagcataatgtttttgaggctcgtcaatgttgtagcatatatcagtattttgttcctttgttttgctggctagtatttcattgtatggatgtatcatattttgtttatctgtttaatagttgataaacatttggattgttttcactttttggctattgcgaataattcagtcatgagcatacttacaagtctttgtgtgaacataggttttcattttatttattgcctaggtgttgaattgctggttcacatggtaaatttatatttagcatttgaaagaattaatggccaaactgttttccagagtggctccatcagttaatattcacaccagcaatgtcatcttctttattttttaatttattattatttcaattgttttttggggaacaggtggtatttggttacatggaaaagttctttcgtggtgatttctgagattttggtgcacccatcatacaagcagtatacactgtacccaatgtgtagtcttttatccctcacacccctcccacccttacccatgagtcctgagtccattatatcattcttatgcctttatgtcctcataacttagctcccacttataagtgagaacatataatgtttggcttttcattcctgagttactcacttagaataatggtctccaactccatggaggttggtgcaaatgccattatttcattcctttttatggccaaatcgtattccatggtgtatgtgggagatatatatatatatagatatagatatatatctcacattttctttattcactcattagttgatgggcatttaggctggttctatatttttgcaattgcaaattgtgctgctatgaacatgcatgtacaagtgtctttttcatataatgacttctttacctctgggtagatacccagtagtgattgctggatcaaacggtagatctacttttagtgctttaaggagtctccatactgttttctgtagtggttatagtagtttacattcccaccagcactgtaaaagtgttcccttttcaccacatccacaccaacatctattattttttaatttttaaattatggccattcttgcaggaattgtgtgtggttttgcctggcttatgatctgggaaacttgcatcctcctgttagtatgtctagttagctctgagaagtggcttggtttaatctagacctccttttctaaacacgtagaaattcctagggaaaatgaaatgttgttctatcactccaaggtttctttggggtcttttaagggataggttcctcttctgaaagctcaaagtcacccgtgattctgggtaagagcaggagtaggttaacctaagcagttgctcaataggttcatgcctgtaatcccagcactttgggaggccaaggcaggcagatcacttgaggtcaggggttcgagaccagcctggccaacatgatgaaacccccatctctactaaaaatataaaagttagccgggcgtggtggcaggtgcctgtaatcccagctactcgggaggctgaggcaggagaatcgcttgaactcgggaggtggaggttata

SEQ ID NO: 3926 - DNA, 6070 bp, Homo sapiens
gttttgaaaacggtgttgatacagtggaaggcttgtggtgttgctggcccttgatcgctggaaggattccgaggaaaaggacaacaacctgtgtgggttccctcccgacaactgaaattgcaccataactcccaagaagaaacactcccagaaacaaaaggcaaagacccctctgaaaccaaagagcaagtatcaccgcctgacacataaacttcatgacctcgacattgagacaaaatctcgccgtgtgacctacaacaccactcatttaactccaccaacttggggtcaaataaaggtcttatcccatcaacagaaaaatcattaagagaaaaatgaatccccaaaacgacaggtaatataattctggctgcctttatggtagtcagtgcagtggtgagtataccaccagtttgggcaactcaaaattatacctactgggcatgtgttcttttccccctttaattcagtctgtctcctggatggactcctcagtagaagtttacactaataatagtgcattcatgccggtccctaatgatgataggtttccagctcaaccagaataagaaggtatgcactttaatctgtcaattggctataaatatccaccactatgcactgggatgtcgcctggctgtttagtttattcttaccagaattggatgtggacagtaccgtcctttacaaatgattcttatcaagtacataatgtgttcagtagcaattcttttcaacttctgttaaacttaatccacaagaggaatggtgggttctggtcactactaacagcaataaaacaaaaggactgccagactgcccaaaggaatctacaaagggaccttttctggtgaattcaattttatggaataattgtaatgccattattggcgggattgctccagccagaatacgacatgctcagagttcaattatttgttacaatattagaggacggatggcagtcctacaggttgagagaatgggtgtctccttacccattcaaatggatgaacacaggcattgttccttctagaccaaaaatgattcatcccattgttaccccagaacatcctgaattatggaaattagctgcagctatgacaggaataaggatatggagtgctacctatcaactctctcccactaatatcaaaacacccacattcaacatcaccttgatgtctgaacaggtgatacgtatcaggagctgtgtcaaacccccttacatgctgttggttggaaatataattatcattcccaatacacaaaatatagaatgtgataattgtaagctgttcatgtgcattgatgctacttttaatcccacaacaagtattctattcgtaagggctagggagggggtatggataccagtttctttacatcatccatgggagtcttccccctctatacacatagtcaatgaagttcttaaaggtatcctgaaaagaacaaagtgatttatttttactgttattgtagtcattgcaggtctaattgcggtttctgcaacagtggcaaccgctggagttgagatccacagttctgttcaaaccactcaatatgttgaagcatggcaaaaaaactcctccagactttggaattctcagactcaaattgatcaaaagttagctaatcaaattaattatctccaccaaagtgtaatatggctgggagatacagttatgaatttggaacaccgtatgcaattacaatgtgattggaatacttctgattactgtataacaccttatgcttataataaagatcagcatagctgggaatcggtctcaagacatttaaaaacctgggatgataacttaaccttggatatttcaaaacttaaagaacaaatttttgaggcttcacaggctcatttatccactgttctgggctcagacatttttgaaggaatagctaaagaattatctgatcttaatccctttaaatggatcaaacccctcagaggatcattgttgtcactggcattattaatattggtatgcttatgttgtctacttttagtctgcagatcccgcaaggaatccgaagacaagtccaaagtcaacgacaagcaatgatggcaatggtgatcctagttaataaaaagcggggagatgtgggtggcaagccacccaggtgccgaggcaagagaccgagagcacgagctgttccagtgtaataaaatatataaaataacaagagttatactgatatagctcatagatatgattatatataaataccattaatcattagtttgtagtaattactctttattcaaatattataataatcctcactctacaatcataacctagaaaaaggcaggccatgcagagataggagctgaggggacatggtgagaagtgacaagaagacaagagtgtgagccttttgttatgcccaggcagggccaccagagggctccttggtctagcagtaatgccagcgtctgggaagatgcccgtaccaagcggaccatggtctagtggtagcgtcagtgccaaggaaaagcacctgctactgagcagaccaggaaagggagtctccctttccccaggggagtttagagaagactctactccaccatctcttatggagggcctgacataagtcaggcctgcctgcagttatccagaggcctgaccgtctccctgtgatgctgtgcttcagtagtcatgctcctggtctgctttcatgttccatcctgtacacctggctctgccttctagatagcaatagcagaattactgaaagtattaaaagtctctgaaatgcagaaataatggtgtaagctgtctctcctctctctccgcctcggctgccaaacagggaaaggctccctttccagtggatgcatgacccacgtgaccttacctatcattggagatggctaacactccttaccctgcccccttgtcttgtatccaataaataacagcgcagcctggaatttggggccactactggtctccacgtcttggtggtagtggtcccccagccccagctgtcttttcttttatctctttgtcttttgtctttgtttctatgatctcttgtctccgcacacggggagaaaaacccacagaccctgtagggctggcccctacaggctctcaactgtgtctctgttcagccctgctgtagggctctcaaccttctgcctgtttggcctggcaatgaggccctcaaccctatccctccacagcctggttatccatctctcacttctgcttctcctttggtgcatcaggctccctcgaagcctgtcctgcagttactgcagcagccttgatttctcaaccctaaaagacctgcccagcaggtaatcgcacctcatcctggcttacaggttcttgattcttcctctattcaaaactcgaatctctttttggcttctggtccggttaccactgctgttgccaccaccatggctgctcataagcaacaggttacatacattcctgaaaatgacactcctcttatgagagccatttctcaagccagggagtatgggcatcctgaggcctagcaacttcctcttattctacatccccatatacctgccgctcctgttgctgtggcacaggatcagccacagcccgctgatcctgctcagcaggtggctgatcacacggctccccaaggtccgcagcctgaaaatcaggctcctcaggcaaataatcaggctcctcaacctataccataaatgcttgctgctgtagcgcagccagctccaggtatacctgcagtccaggcagtagtccaaccagatccttttcatccaggccaggtccagttactccctgctacacgggaaagtttttcttttaaattcctcaaagatttcaaagaatcagtgaaacaatacagcaccatctccccttttgtgcattccacattaaaagctctagcagaggataaacgtttggtgccttatgactggggaattctagcaaaatcagtattatctgaatcccaatatttataattcaggacttggtgggttgatgctgtccacgatcgagttcagcttaatcaaggctctaatcctcctgttaatattacagctgaccagttattgggaatgggacaatggcctgcaattacaaatcaaactatactaaatgatgaggtcattcaacagcttcgcaaatgctgcctatatactaatagtagtgcatttataccagtccctaacgatgacaggtttcctgctcaaccagaggaagaaggtatgcagtttaatttgtcaattggatataaatacccgccattgtgcataggaatgtcacctggctgcttagctttctctaatcaaaattggatatggactgtaccgtcctctaataatgattcttatcaagtacataatgagtttagtagtaattcttttcagatcatgactgttaaacttaatcctcatgaggaatggagagttcccgtcactaccaaacataatacaacaaaaggactgctagactgttcaagtgaacctaccagggaaccttttacagttgaaactattgtatggaatgattgtaatgctccaaaagcagtagtgttacagggcctgattacaggtggttattgactgggctccaagaggatattattggctaaatttttccagcctaaatgccaaatattctgagttcaactatttgatagattatgtagaggagggatggcagtcctacaggctgagggaatgggtgtctccttacccattcaaatggatggacaaagtgatcattcctcctagaccaaaagtgattcatcctattgttaccccagaacatcctgaattgtggaaattggctgctgccatgactggaattaggatatggaatgtaacctatcagatcattcccactaataccaagacagacgtatacaaagtcaccttgatgtctgaacaggtgatacctagcaggagctgtgtaaaatccccttatatgctattagtcggaaatataattatcaccccccaacagccaaaccatagaatttgatgattgcaaattgtttacatgtattcgtgttacatttcatcccataacaagtattctcctggtaagggctagggagggggtaaggataccgtttctttacaccacccttgggagtcttctccctctattcatatagtcaatgaaatccttaaaggaatccttaagagaacgaagagattcatctttactcttattgcagtcattgcaggattaattgctgtcactgccacagcaatggcagctggagttgctatccacaactctgttcagaccactcaatatgtggaagtgtggcaaaaaaacaaacaaacaaacaaaaactccaccagactctggaattctcaggctcaagttgatcaaatttggctaatcaaattaatgatctccaccagagtgtgatatggctgggagatagagttatgaatttgcaacaccgtatgcaattacaatgtgattggaataattctgattattgcataatgccttatgcttataaaaaagatcagcatagctgggaaaaagtcatgagacattcaaagcctgggatgataatctaacttaagatatttcaaaactgaaagagcaaattttgggggcctcacaggctcacttaactaccgttcctggctctcatatttttgaggaaatcaccaaagtattatccgatcttaatctttttaaacggatcaaaccccttagaggttcactattgtcactagcattactgatattggtgtgtttatgttgtctgcttttagtatgcagatgtcttcagggagtccgatgaaaagcccaaagtcaacaagcaatgatggcaatgatgatcctagtcaataaaaagaggggagatttgggcagctgtggacgaaggattacccaggtgccaagacaggagactgaaggcacaaactgtagcagtataataaagaaaatagttagaataaagaatacttacaatacaaattagatatagagatgatcatggacaattatcaatcaataatgtataaacattattaatcattagcttttaatattagtctttgttg

SEQ ID NO: 3927 - DNA, 5952 bp, Homo sapiens
ccgggcgtgggcagcgctggaggacaggctctcccagtgtgctgcgggggagggcagcccctgcagtgtgcgtgttgagtgctgggaaacccccaagtaacacttcccccctcatttaacacacttcctaaaacctctcctccccaaaagccactttgcaaaagcagcgattaccaccaaccacgagaaacacaggagcctgccttccactgtttaccactgggcaggaagtcgtttatggaccagtctcttgcccaggctaaactcagaagtggacactgagggccggttgtgggtgccaccaggcaagctagggcatcggagttcagcagagctgggtgggaattctgcttctccctccactacctgggtaaccctgggcaagtcacttagcctctccgagcataaactggtttgcttgtaatatgcaaataataaggggtgggggaaatttttttttttttttttgagacagagtctcgctctgtcacccaggctggagtgcagtggcgtgatctcggctcattgcaacctccgcctcctgggttcaagcaattctcctgcctcagcctcctgagtagctgggattacaggcgcccgccaccactcccagctaatttttgtatttttagtagggacgaggtttcaccatgttggtcaggctggtctcaaactcctgacctcgtgatctgccctccttggccttccaaagtgctgggattacaggcgtgatggagatgatactccctaaatcacaagggtgtggtgtgaagatgaaatggctgcacgtgacagaggagttggagaacaggaagcaagtggattacttggatgaactgtgatgggcccaagaagaactaagccaatcactccagggggcgttttcccaggatccaggcagagagctgattccagcatccacgttgtatccccctcccgctgtggccggggtctccaagagccgggcacccactgcagagcttccaagcccaggcccatttgaacacaggaggacttttgaggttcatttaaccccaaaatcagtgattctacatctcaagctcatattttgaagtgtttacggaccagggatttgccaattattctggatgggcacagggaaggggccctcagatcctgcagagggagcatctgaaagacaatgagaccctgtacacaaccaagctgagcctcctgtaagcacatcctctgggtgtcactatgcgaaaagactctttgtctgtttacattgcacaacgaattgtccctctgattgtcctagcgttggtgcatgcatggatccaggaagagcaggtatttggacccaacgagacaggttcatcttggcagtttgtctcctgtggttgctttgtgcctgccccgtatctatccacccaacttctggcagcaatccctccaggacccacctctgtcttcatggtttgtgtgttctgatcctgctccttggccccagaatacaccctccacatctaagctatgcagtgcctcatccccacagctgcagcgattggtttaggaatgggaaaataatccaatcaaagtaagattgtctaatatctgatcccgcttaccccggagccagaagtcccacctttccaggctcctccatgttcctttctggagcaatgaggaggaaggttcattcccttctcagggaacttgctgcggtgtcccagtcctgactgtcccctctctacccctgcctgtggctctcccgtctcctggcattctaacctgccactgaattcttcccacgccaaacgcaggttaggaacctaagctcggatgaaatgctggcttagacctcattgctactgagaagcagaaaccacactttttagttggtagaggtggatgtggattggggccataaagtttcctcaatcattgaataaggatttcattatttggactaactaaatacattagattatttatactaactaaataaattagatttatttttcgaagtttaaaatcattttcaatagtgacgaaaaaggctgtagatgagatgggagaatctttcgacgccaaattcttcccatctcctgcctagtatgtatcactacaccttgcccagagagactgtaggggtgctcagcaaaaaccatggctggttgattccctggaaaaaggggtgctgtcccagggagctctgtgcccttcctgccaacactggggtctagaggaggcaagttcccctctgaaggtgagtatgattcactcattaaaactaagaaatttacattggtatgttactgttaactaacctacagactttttttagatttcaccgttctttacactctcgtcctttccaatttccgggatccaatgcaggataccaggttgcatttttggatgtgtccagtctgtgatcatttctcaatctttcctcattttctcatgacttttgacatttatttatttatttattgtgtgagactgagtctcactctgttgcctaggctggagtgcagtggccccatcctggctcactacaatctccacctcccgggttcaaatgattctcctgcctcagcctcccaagcagctgggattacaggcgcacaccaccacgcctggctaatttgtatttttagtagagatggggtttcaccatgttagccaggctggtctcaaactcctgacttcaggtgatctgcctgcctcggcctcccaaagtgctaggattacaggcgcaggccaccacgcccagcctgacttctgacattagagtacagggagggattctgtagaatgtccctcaatttgggtgtgtctggtgttttgccatgagactggggttatgcttctgggtgccacacagaggtgaaatgtccttctcatcacattattcgagaggtacatggtaccaatgggacttatcgctgctgatgttaaccttgatctcttggttcaggtggtgcctgccagctgtctccactgtggagttactatttttccttttccccattttattcatcagaagccagtcactaagcgaggtcaaactccaggacaggggaattaagtgccaccttctggagagggagcattcacatttattacttgggatccttctgtaaggaagagctgtttctcctctaaaaaactctttaatccttttaagcctcaatttcttaattgtgaaatggggctaatacctgtatccaaccaagggagtagttagaaggtaacatgataggtggaaagcacttaacataggcaaaatgttattatcaggaatgatcgagagacccatccaactatctgaaggagtcacttaactctactgtactgcagcgctgtaaagtctgcatctttcactgggggtaaaggcccccagtccctgagacgggccagtttggagacaggctggttttttctctgttctcctgagagcccttcagatgagaagggaggtctggagacagaatgccaaaagcccattaaaggcacggccttgcatttcagagagggagcaggtctagagaagaaccagaggagctcagctgagatatggtgtatggattggattttggtagaagatgggaagaaccaaacacctgagaaaccactttgaagatcggggtcagagtaaggcctaacacatagttggctcccagtaattattggttgattgaacagctcaaagagcaactcgaccaagaacactggactgggagtccagttacttggatcttgcattcctgatttatttttattttatatgtattttttctatttttttgagacgaagtctcactcactctgtcgcccaggctggactacaatggcacgatctcggctcactgcaaactctgcctcccaggttcaagcgattctcctgcctcagcctctcgagtagctaggattacaggcatgcaccaccacgctggctaatttttgtatttttagtagagacggggttttgccatgttggccatgctggtgtccacctcctgacctcagttgatcttcctgcctcagccttccaaaatgttgggattacaggcgtgagccaccgtgcctggccgtgatttattttttttgtgtatgtttgtttttgtcaacttgctgtgtgaccttaagcaagttacttaacttctctgggcttcactttccatggatgaacattgtaaagaggctggagagagatgaggactaggtacaggctttagaggagagccaccgccccggacttctccctctgtcaccccgctttccatgaccctccttgcctgactttgtgactccttgcctcgctatcaaaacaagtgctgcaatctcagtgctttccaagagccctgcattgttagaaacttcccagcacgcagcaaaggctgctgcaatactcgctctgcctgcctttgccctgcgcttcctacttaccctccttttgtttctcccaaacatctgtccctgactatgctcatctcatgtttgtcctcagctgctgaaagggccacgtttgttttcattacaaataagaccaccgagtgggctcctggcgtgggggcgggaccagccgcgcgcagtcttcagaggcagccccccaggctgtctctggagggtgtgtctctgcttccctttccccgtgtttattttcagacgaagccaagtggcccggggggaccctccggactcccagccttcagagaggagggcagctcgggctttcgccgcagtgcttcctgcccgtcacgtgtgtgctcctagccggggtcgggggagctggtatcttggcccttctgggaggacgcgcacagcccgaggaggcagagccccagacgggaatgggcttttcagaggtggggtgcgggcgaggggacgatgcattatttttaatatttgatttatttttccaactggacttcttcccggggctctttctgggcccagctgcctttgtgatcccgcgccccggtcctcggcctctcacctccagcgccggggcgccccctgctgtcggaagcggctgtgaccgggcagaggtgctatctgggactctgggttctcagcccggggacagcgaaccgaggggcagatgatccatcagaaaagagccggcactgcccagccccgcgcccctgcccctgcctttttccgggagcgcgccgcgccgcacccgctacggccgcttgaccccatctttgagcccggccccaagctctgggaccgtcgtgcccctcatcaaggaagagccaaggaccccaaggagaaggtcaggagcggcggtgtggatgtcccttggctgcaggccccgccgcgcactcccttcagtccttcccttctctagggaccaggtagcatcagtgcctggatctcggccttgtgtgccctgctccctgccccacctactaagaaccaagtctggttcaccggctcccaagagctggaacccattctcagctagctgggggcccaggccaccccttccctccagacctgtgtgccttctgccctggctccagggccccccacaccgtgaccagggcgggatccctatggggctggccaggcggcaccgtgccaggcccacagtgccctgggcgtccatggaagtcgttctgtgtctttaaaatcagaaggaagacattaacctttaggctgaagaaaatgttttagtacacagcaataacttatttgtctttatccaacagccataaaatataactttaaatattctattgatagagaaaggagttcatgaaggcagaaatgcctggggcccacgaacatcccagtgtggccctggacgggacatcatgctgggcaacacagctaaaatgcgggtgaagaccagatttcttgcacatggcggtgacgggatgctccctagagagcttcaagtggattctttgctttttattttctctcttaataaaaatgtatgatgtttacattgtcagagaacaaacagaa

SEQ ID NO: 3928 - DNA, 8943 bp, Homo sapiens
agatgctcccaggctctcccgcagtttaaagacttaactcagcggctttcagggcctgtggttgagggactccgaaagaactgttgctggtggaccggttcagggtcttgacttcgccacacaaaagaacttgagagcacgtccaaagtaaagctaagacctctagtacagtgttcaatggaactggtgagaaaagacgtccttgctgtgttcctgatatgaagaggaaagcagtccttctccattaaatgctgacaacatgagcctcccgtggtcggaacgggcttgtgaaggcggtgctggggtgcaccagggcagcagctacagcatttactgtctgggtcaaagaggatgtgtcctaaaaggagaatgagaaataaaacccagaaggagaaagaaaacgtggagaatattgctgattgcagccaagggaagagaatgtttccagaaggaggttaccactgcgaggtcaagtaagggactggagaatgcttctgtatcttggcaggagtaacgcgaataaaaagcaatgggacagacactttggaagacagtttggcagtttcttacaaaagaagaaattggcccaatgtgacagtcatgtcctactacttggcacttgtattccttggtatttgcacaattgatttgaaagcttatatccacacagaaacgtgcacacaaatgattataacaactttattaataattgccaaaaacagaaagaaagcaagttgttcttcagtaggtgaatgaacaaaaaattgtactacattcgtacaatggagtcttattcatccttaagatgaaatgagctatcaagctataaaaaacattggggggggggatcatagatgcatattgctaggtgaaataagtcagtctaaaaagcctacatactatatgattccaaccatatgacattctaaaataggaagaacaatggagatagtaaaaaggatagtagatgctgggggccagggggcagtatgaagagagaagatgagtaagtggaacgtaggggatttttagggaagtaaaattattttgtataatactgtgatggtgaatacctgatattatgcatctgacatcatgcagtgggcatatagaagcccatcaacaatacaatacaaatggtaaaccttagtgtaaactatagactttaggcaacactaataatgtataaatattggttcaccaattgtaacaaaactaccacagtgatgcaataagtttatatttgtggaaactatgtgagaagagggaggaggagtatatgggaactctctgtacttttatgttctattttcatataaactgaaaactgctctaaaaaataaatcctactaagtaaaaacataaaaaggaaacatggagcaatgagaaatccatagaggttttgaaaagctctgaaagtattcctggaaaaatagaggaccatgcacatacatagagcatgaacatgttcaggaaagacctaaaaagaccctaaggtctcacttctggctgatcttgagaatatgtgtgacagcaagtgaaggctaaggcagagttgttaattacctggctgagtgttgaaggcatacccctacaagtaaacagtggctctcagcaacacttagagatatattgactccatctatttaaatatgtctatgtccagtagttagctaaccactaaagacttcggtgatcaaacacaacaatgaatacagactgttcagaattagttcagaaaagtcactaaactaaacaaacaaaaaaaacaaacccagcaactacaataagcagcaattgcagaccctggggacagaagagggcaaagagagaatctgatatctactattgctacattatattatttaaacatcaagttttaaaaaaataagagaaaaaagaatgtatgacccatacacaagaaggaaaaaagcaatcaatagaaactatccctgaaagaatgtagatgttgaatttactaaagagagactttaaattagttatttaaaataaattgaaaataatatagaaaatagcaaaatggaagatgcaaaatggcagaggtaaatccaatagtattagtaattacactaattggaaatggattaaattctctaatcaaaaggcagagattgacttaatggataaaaaacataatccaactatatgctttctacaagaaacataatttagattcaaagacaaaagtatgtttcaaatcaaaagatgaaaaaagatctatagtgcaaacagtaacaaaaggagatctggaaaagcatatactatgcaaacgtaagcaaaagagagctggaaaaagatacttcatgcaaactgtaaccaaaatagaattgaggtggatatactaatattaaaatagattttaggacaaatatttgtagtaaatacagagaaaaatacttgataatgataaaagaatggattcaaaaagaagatataataattataaatgtatgaaccaagtaacaaactcttaaaatacatgaaggaggaattgattaaattgaagggagaaatataaaattcaacaatagtcagaaacctcaataccccactttcaatgatggacataacaactagacaaaagatcatctaggaaataaaagagttgaacagtactataaacaattaggcataagacatagctatagaatagtccacccaacaatagcataatacacattatttccaagtgtacgtggaaaattctcaaggatagattacattttaggccataaaacaagtttcaatatatttaaaagaactgaaatcataacaaatctccttcaacaacgattgaaattagaaatgtaaacaacacactcctaaatagccaacaggttaaagaaatagtcacagtgaaattagaaaatactttaaaattaaaaccctacataccaaaatttatggaatgcagttgaagtagtgcttagagaaaaatttacagaaatcaatgcctacattggaaaagaataaaggtctgtcttaaatcaataacctagcttaaaaaacctaggaaaacaagagcaaactaatcagaaagcaagcaaaaaaggaaataatagaagagcaaaataaataaaatgggtcataggacattatgttaagtgaaattctcagacacagaaagacaaatagtacgtgatctcactcatactcatctagaaaaggtcaatattagttactgttacagaagtagtgtgtggaatggtggttatcagggggtgtggtgaagggtagtggtggggagatgtttgtcgaaggaaacaaaatttcaatttgttgggaggaataagtccaagagatgtagtgtacaacatgatgactatagtgaacagtatactgtattatcagaaaatgtaagagtggatttaaagtgttctcaccacaaaaatgacagctatgtgaggaatgtatgtcattccacagtgtttattatatgcacttcgagacattgttatacatgataaatatatacaaattttatttgttaatttaaaaatagagaataacaaaacaaaactttttttaatattaacaaatggataagtctctagctggactagcaagaaataaagagaaaaggctcaaacttacagatataaaaaggattataaagaagtattatgaacagttgtaagccaataaagtaggtaactcatataaaattaacaatttctggaaagacaccaactatcgaaactgactcaagaaaaaatagacaccgaaatagacctaaaacaagcaaagagattaaattagtaatcaagaaaccacacacaaagacaggtccagcagacggtttcacctcttaattctactagacatttaaataataattaatagtaatttttcacaaacattttcaaaaaatagaagagagaacagttcccattcattctctgaggctattactataccaatactacacaggaaaaggcatcataagaaaagaaaactataaagcaatatatcttataaataaaaatgtaaaaatccttaataaaatatttgtgtattgaatctgttaacatcaaaaatattccacaccatgaccaagtgggatttatcccaggatgcaaggtttggtttaatgtgtgaaaattaatctttgtaatgtactagtcgaataaaataaacaaaatccacatggtcatctcaataaatactgaaggcatttgacaaaatctagcattctttggtgatgaaaacactcaactaactagcgatagaagggaaccacctcaacttgatagagaatatctatgaaaaaaccacaactaacattatacttaatggtgaaagaccagaccttccccctaagaccaggaaaaatacaaggatggctgctttcactatttccattcaacaccatactggacattctagagaggaaaattaggcaagaaaatgaaataaaagacatctagattggaaaggaagaagtaaaagcatctctacttatagatgagttgattttatatgtagaaaatcctgagaaatccattaaaaatctcataaactagttaagcgaggtttcagaatacaagatcaatatatgaaaaacagttgtacttttctcagatttttattttaggttcagggtcacatgtgcaggtttgttatacaggtaaactcatgttatggagttttttgtacagattattttgtcatccaggtactaagcctagtacccaatagttattttttctgctgctgtctctcctcccgcccttcatcaagtaggccccagtgtctgctgttttcttctttgtatccatgagttctcatcgtttatctctcatttataagtgagaacatgcggtatttggttttctgttcctgtgttagtttgttaagcataatggccttcaactccatccgtgttcccacaaaagacacatatattttcatatacttgcaatgaacaatctaaaaatgaaattaagaaaacaattccatttgcaataccaccaaaaagaacaaaatatttaagaataataacaaaagaggtgtaaaactcatgctctgaaaacaacaaaactgtgttgaaggaaatttcagaagagccaaacaaatggaaaaaatgtatgttcatggacaggaagaagtggtattgttatgacggcaatacagcccaaattgatttataggttaaaagcaatcccaatcagtatgcataccttttaacaagctgtttctaaactttatatggaattgtgatgaaccataaatatcgaaaacagttttgaagaagaagaatcaaataggcagactcacttcttgacttcaaaacttactacaatgaaatggtcatcaagaaagtatggtcctggcataaggatagacgtatagataaatggagtaaaagtgagagtccagaaataaaaccttgtgtctatggtcaactgaattttgacaaggatgtcaaaactattcaatagagaaaaaagagtcttaccaacaaatggtttagggacagccatatgccaaagaatgaaatgggactcttccctctcaccgaacacaaataggaactcaaagtagtttaaaggcctaaatgtaagaactaaaattataaatcttttagaataagtcataggggaaaatcttcccaatctcagatatgataaaatactcttagatatgacaataaaagtatgaacagcaaaataaaaaaatcaataatttggacttatcaaaattctaaaagtttttgcatcaaaagatactatcaagaaagtgaaaagtcaataaacggtatgggagaaaatatttgcaaatactatatctcataaaggacttatatctagaatatataagaacacttataatcaagaacaagaatataaataacccaatttaaaaatgagcaaagtatgtaaatgcacgtttttgcaaagaagatataaaaatgtccaatacggacatgaaggatactcgacatcattagtaatcaaggaaacgctaatcaaatccacaatatgataccacttcacatccactaagatgactataatcaagaatcagaaaataacaagtgttactgaggatgtagaaaaaataaaaccattatatactgctagtgtggtgcagctccttggaaagtagtctggaaattcctcaaatacttaaacatagagttaccttatgattcagcaattccttcctaagtatatgctcaagaaacataaaaacatatatccatacaaaatcttgtacacaaatgtttagcattctgtcattcataatagcaaaaaggagtaaacaactcaaatgtccatcaactgacacatggataaataaaatgtggcatatccatacaacagaatattattcagcaatcaaaaggaatggagtactgatacattcttaatcatggatgaaacttgaaagcattatgctaagtgaaagaatctcgtcagaaaatgtcacatattatgagctattcatttgaagtatacagaacaggaaaatttatagggacataaagcagaatagtggttgcttagggtttgggagtgagaaggtatggtggtgataggtaaggtcgtggggtttcttttggacatgatgaaaatattctaaattgactatattgatggctgcatgtgtctgtaaatatgctgaaaatctgactggagcactttcagtgggtgaattctatgctaagtgaattatgttgcaataaaactgttgatataagaagtatagaatctgagtatacctataacaagtaaagagatttaattagcagtaataataataataataacttatcacaaacaaaagctcaggattagatggcttcacgggtaattctaccaaatatttaaagaagaattggcatcagtactacacaaacacttccaaatatagacgaggaaggcatacttcccatgtcattccatgagatctgtgttatgctgattctaaacccgacaaataaatcatgagaaaagaaaatgatataccaatatcccatatgaccatatacacaaaaatccaaaaaaacactagcatgctgaatctagcaccatagtaaaaatattatataccatgactaagtgagatttatcccaggatgcaaggttggtttgttacatgaaaattaatcaatgtaatacaccatttaatagaataaagaatgaaaacaacatggtcatctcaataaatgtgcaaaagcatttgacaaaagccaataccctttcatgataataacattcaagaaattaggaatagaaaaaacttcctcagcaagataaaaggcatttatcaaaaatccacagctgataaaatcctcagtggtgaaagactgaaactttctctctgagatcatatacaatacaaggataaccactctcatcatttgtatttaacattgaactagagtttttagagaggaaattcaggcaaaaaataaaattaaagacatccagacaagaaagaaagaagtcaaactatttccatttgtagatgaaacaatcttataaacaaaaaatcctaaggaacacacacacacacacacacacacacacacacacacacacacacacacaattagaactaatgaatgacttcaacaatgttgcaggatataagataaatattaaaaattagttgtatttctatacacttgcaatcaacgattagaaagtaacttcaagaaaattccatgtataatagcatcaagatgataaaaatatttagcaataaatttaacaaaagaactgaaaaccatgaaacagtgttgaaataatttaaagatgcaaataaatggataaatattccatgttcatgaactggtagaattagtattgttaagacaaaaatactccctgaattaatctttagagctgatgtaatccctgtacaaatttcaactgtcattttttcagaaattgagaagctgatcttaaaattcacatagaaattcaaaagacctacaataaacaaaacaatcttgaaaaagaaggaagtaggagaactcacatttctcaattccaaaacttaatacaaagctacagtaatcaagacagtgtggcataagcatagacatatacatcagtagactagaattgagaatctagaagtaaaccgatacgtctatgttcatttgtttttgacaagaataatctttaaaacacatgatgttgggataattgaatagttgcatgccaaagaatgaagttgggcctttacctctcaaatcatgtacaaaaattatttcaagatggcttaattatctttattatttctttccttctagtgattttggttttggtttgttcttttctaattccttgaagttcatctttgggttgttttttgaaatctttctagatttttgatgtaggcatttgttgctataaatatgtctcttaacactgcttttgctgtgtcccatacgttttggtatgctgtgcttctatttttatttgtttcaagaaatgtttaaatttcattcttaatttcttccttcatccataggttgtttgggagcctgttgtttaattgcatgttcgtactcacatgtggaagctaaacaaaagttgatctcatagaaataaaatgaatataggatactagagactgggaagggggaagggaagggacatggttaggaagagatttgttacaggacacaaagttacagctagagaggaaggatcagttccagtgttccataacactgtaagatgactgttgttaacaataaaatattacatagtttcaaatagctacaaggaggatattgaatgttcctaacacaaacgaatgacaaatgtttcagatgatggctatgctaattaccctggtctgattactgtgcattatatgaattgaaacatcactatgtaccctgtgaatatattcaattattatttgtacattaaaaattaaattaaaaaataaagtactagc

SEQ ID NO: 3929 - DNA, 2437 bp, Homo sapiens
tttcacacagctgaagtctaacttcctcttatttattcaaaatgctctagaatctggatccattatcttgaatattctaccatgagaatcctccattccaagcacacagatccaaatccttagaacacagcatacactacacttgcttcaggcccaaatctttgttcatattgatcacccactcatcataatccacccacctctgcctatctaaaccctgactatagtcttaaactcttttttttccttttaaaaattcatacttccatgccaggctcaatggctcatacctgtaatcccggcactttggtaggccaaagcgagaggatcccttgagcccaggagtttgagatcagcctgggcaacaaactgagatctctaaaaaaaaaaaaaaaattaaaaaattagccaggcatagcggagtgtgtctgtggtcccagttacacaagaggctccgaggccagcctggcctattatggtgaaaccccatctctactaaaaatacaaaaattgccccaatgtggtggcgtgcacctgtaatccccagctactcgggaggctgaggcatgagaattgcttgaacctaggaggcagaagttgcagtgagctgagatggagatcgcaccactgtactccagcttgggtgacagagcaagactgtctcaaaaaaataaataaataaaataaataaatgaattaagggttttttttgtttgttttggggggttttttgagccgagactgcgccactgcactccagcctgggcgacagagactctgtctcaaaaaaaagtacaaaacaattattagttaataaagatcatggtagagcatagtagctaacacccgtaatcccagcacttggggaggtcaaggtggatggatcatttgaagtcaggagttcaagagcagcctggccaacatggcaaaatccatctctactaaaaatacaaaaattagctaggtgtggtggtacacacctgtaatcccagctacttgggaggctgaggcatgagaatcacttgaacccaggaagcagaggttgcagtgagccaagatcacactccagcctgggtgacagagcaagtccctgtctaaaaaaataaattaaaaaaaaaaaaagtcgtaaaaaccaacaaatttcaaatgcacttaaaatagtttaactttctcaaatttcagctgagctacaggagattgaaaaattcctttggttggcagcaagccaaagaactggaagccatttgagaattcagaagtcgcttgggatcctgcaatatctcatccgtgtaagtctcagctgcagtttatccattgcttaaagtcatatgcgtggctaataatcaggaactagttactttcctattatattagctcaaagtattattccttaggtaaaaatagattgtgtctcaccacagcaccacgggagtttattccagaacttactttccctcatatctcataatgaactaactgtatcatcacccagaacaagccagcaaatgaccatggcaaccttattttatggtctcccactatctcacaactaactatacagtcttcaccactgaagttagagaggtgcttctgtctctgtggctgaatctaacattaacaagccaaaaaccagaagtagcttatatgagcaaactgctgctttgcctctgcctctgccccatgttagtatcttctaatatcaataagccaccacagaacatgtcacttaccatcagacaaagaaaacattaactggtttctgtaaatccctcctctccacttgcaagaataacacaaatctcaaaagacaatcataagcaattataattcaagaaggtcactgaataaatgagtctagaccctacatttcagagaagggataaccaatgcctgaagcagttgcatggttagtctaagataagatatctactacaatgaaagagccaaactcaaaaccagattttttgcctccaaatcaggtacacttctcaatacaccaaggtaaatctacttctattttaagactagcaagtactgtttctaagccaaagtctagtattaaaagggcaaggatattacgagatgcactgggaaggagaccaggaaaagacccaccacagatcagatcaggtatgtatctccttctcatacactaattccttagattatgatacagaaaatactttgaatttttagcttgtgtttgactgtcactttctctggtacctcctctagcaaaaaaaaaaaaaaaaaaaagcctgaaacgtgactgaaatccatttattaaaattctatggagcagcaatggaattggaaaaagcaggccggcagaagagaaagctatgtaaacctgggttaattcttactcattcttctaatttagctgagatgtcaacttcttttagaaagccttaattcctccttccccagactactc

SEQ ID NO: 3930 - DNA, 5339 bp, Homo sapiens
cttccgcaagtgtaggcagagcccccggagccatggccagcccttcccgcagctccgaagccactggcaagccccgaggcagggatggccggcccaggagggaggaggacgacgtccctcccgaagagaagaggctgcggctcttgctggaggggggaagcgcacagccccaggacggcgaggacggggaggacgcgccgcggccgggcagggtggagaccggcacccagacaggtggcgacggcagaggagtaagtgacgcgggcgcgggggtccgggggtgccgggtgcgcggggatgcggggaacgaggggtaggggcggcgagaggctccgtggcctgccccgggttgaagttgggagggcggccttcattctgaacccatttaggcagcacgggcagccctcctcgccgtgggctgcatcagagccccccctgcccagtcttggggttgctcccggatgctgtctgggaggcttggtcatggtgacatcctcatctccccgtgcacgttaccgcattcagagcttgggtcacctggacactgaactcaggcgaattttctctgagatcccgggagaaggaggacagttctttggaaggttttccagggccgatcacggaaaggatgagaagggagaggtcctggtcggggacacaattacaatggcagtgtaacgccgggaaacttcattgcatgaagtccttctcactccctctacctacctcttttacgtggactctgccaaagaccaggataccacaatgcagtggagtgaccaagtgtagtgggaccttgggaacccgagtctggagccaggcggctggggtttgcatcctggttctgcccctccttagctggctgacatggcacaagccacttaccctctctgagccttactgtcttcagtggcaaatggatttgccaacaggccccattgcctggggttgttactgctgagattaagggatgctcgtccatagaagcacttagcgttgtgcctggcacatagtgtatggtggataaatgggacttaggactaaaactcatgccttggtgtgtttttgcagtgatgttttgttctggggtgcatcacaagagacaaggttcctggccgggcatggtggctcaagccaataattccaacactttgagaggccgaaaggggaggatcgcttgagcccaggagtttaagaccagctgggcaacatggcgaagcctcatatctaccaaaaaaaaaaaaaaaaaaaaaaaaaaaaaaaaaaaaagccaggtatggtggtgtgtgcctgtagtcccaagtacttgggaggctgaggtgggaggattactagagcctggaaggtcgggctgcagtgagctgtgatcatgccactgcactccagcctgggtgacaaagtgagactctgtttcaaggaaaagagagagagacagacagacccacaagagtcttaagccagaatcttcatgttaaaatgccttctggaggctaaaaggatgatatgttgataatgaaatatttaaaaggcagaaaccccactgaattgtttggtccacagagggaaatgggaatcgcatgacctgaaggatgatggaggaactgaacagaaaccatccttgtttcctgaatctgaacatggcaccctcttttcacggtgtctgtatctgctcagtccggcggcccctcgaaaagagggaatcttgattttcaaacttaaaatttggcccaaagcccactgctgcccacaatgcccgtcagacacattcctcttcctttttagtttctatgggaatactctctttgaagaacccatgaagcagtgtcaggctggtacgaggatcagcagtgatttctttgaggaggagatccgtttcttcactcacaggtcatgtctgagtggatcaagaagaacagagggcccttttatgagattttgtctgcgtagaccattagcttggtaaaaatgtcaaaaccatcctcattctttaatagcagattattttggacttttctctgcaagaagcagcatgggcattcagatgcgtttaaggataaaatgttctttctcatcaccaggcctggtgctctggatggctgaggttttaatgtgacttggtgttccttggagtggctcccaggctgtgatcttgtggtcgggtggcaaggggttgctttattcggtgatggctagaggatgttttagcaggtaaatcgggatctcaggagcccctgagtgccaagtcctgctgcagggcatgtgtttatggtggggatgtgggggcgtggagggtggggggtattgatttcctgccaatatcagaagtttcacaggcttcttgtgtatccacaaacacccaccccattgagaaggcctagaaaacctggccctccccaagcctttattgaccacttgtgaatgatcccagggtgtgtctgacccacagctcctcctggagggagagaaaagtgtctcctaggtacttggttatcaacctcaaccacttgctgagccttccccaagaccaggcatcttggcagagatttctgggttgtcaggcagaaccgagcattcgagggtaataactcactggagtccctgaaatccctgatggacacaccaggtaaaagcatccagggttgaaaccagatcaggaaggttgttgtcagcctggggctcctgtagaggtgcatccacgttgcagggattttccttcttgctgaggagaaacctggtttctcagctttgccacagtcacaacacttggggtgagaccattcatggtggtggtgggggcatcctgtgtattgtaggatggctagcaccatccctggtctccatcctctaggtgccattctatcctcccagctgtggctaccccagatgtctccagatggtctcaaatgctgtggggcaagggagtggtacgtgagcaaaaccaccccagttgagagccattggtctacacttgtggaaatgtttgaggctggactacacaggctgaagctctctctgccgagatatagatatttccctggtgacgatctttcaagctgacatgaagacatggccacccactggaacgtcgtgtgtctgccgtggcgctcttgtaatttgtgaggcaggctcctgaggaatgcagtgcgtaagtgggaaatggtgggaagttctcgcatccccccccgggccgaaagtgctgcctgcacaggttggtggatggtcctttgagcaggaagaagacatgaagcacattcctgttagctacgacagagaggggcagggcacacactggacatttcaagcccctccagaaaagcaagtcttactgtgctgggagtacttgtggagtgcgggctgtgttgccctgggctttaattatttcaggaacatttaaccacagggttggcaggccggatcttgatacgtgtttcttagttggaaagactttggaccatagggaaatgtcttctcaattcttttaatttcattaaggttatcatttttcttcttgtggcctctggaatgtgacacagaactcaagagacaggaaggaaatgagttgaaggctgggacaggggtccctgccagggatgctggtgactcacatgacggtgttgatgtgtggagtccggtgcctggtttggggagtgttcatgggatatgttccaaaggactgacggacctatcaggcacagtggctcacacctgtaatcccagcactttggcaggtcgaggctggtggatcacctaaggtcaggagttcgagaccagcctggccaacatggcggaactgtctctactgaaaatacagaaattagccaggtgtgatggcacacacctgtaatcacagctgcttgggaggctgaggcaggagaatcatttgaacctgggagacagaggttgcagtcagccgagatcgcaccaatgcacttcagccagcctgggtgacagagtgagaccctgtttcaaaaataaataaataaataaaatagaattctgaattttatttttaataattattttctaaaaagaatgtcttgttttctggagctgttgaatttattgaattgacaaaaattatgtacaagagggtacaacatgatgagattgaagtatgtatacattacaaaatggctagatcaagctaaataacatatcacctcccagacttatttttttatggtgagaacacttaaaaaatctactctcttagtgatttccaagtgtatgatatgttgttattaactataggtaccatgttgtcccatggatatcctgaacttattcttcttctctaaaaatgacattctgtgtcctttggcatctgcccacttccccaccctggcaaccatcattctactctgcttctgtgaactcaacttttttcttttctttttcattctttttttttttgagacaatctcattctattgcccaggctgtagtgcaggggtgtgatcttggctcactgcagccttgaattcccaagctcaatcaatcctcccacctcggcctcctgagtatctgggagtacaggcatgcaccaccatgctccactaatttttgcatttttttgtagagatggggtcttgctatgttatgcaggctggtctcgaactcctgggctcaagcaatctgccggcctcagcctctcaaagtgctgggattacaggcatgagccaccatgcctggccgagttcaacttttttagatttcacatataagtgagatcatgtggtatttgtcgttttgtgcctggcttatttcacttaacataatatcctccaggctcatccatgttttctcaaatggcaggatttacttctttttgaaggctgaatagtattccattgtgtacgtacactacattgttgctggaagtgtaatggaggccagttgggggaggagggggaaaagattcactctaagtatagatgctccagcacccacccaggttgtgtgcaaggaagtgcaggatgctcctggtcttgcaaactgtggtttgtgggactccaaagcccctatccttccacagtgctttctgtcttgttatcacatttccttggaggagagcccagccttggtggagagccctgctctggctttgtccctcggcatgagatggcagaggatggtgctgctgggagaccctcacgtctgcacactgggggctgcttgccttctccattcctccttcaagtatctgagcagctcctgtgtgccagctgctggtctacaagatggatgggtccttggagatcacgctgtagcagaggaggcaggctgtagcccacacgccacaaccagccccctgcctgttcacacaaataaagttttat

SEQ ID NO: 3931 - DNA, 11704 bp, Homo sapiens
agactaggggtgaggctgctgcgaggaagacccggtcagctgtcccttcccccatcggtcctcttaggggaagtggagatgtgggcctcggagctgcgtggcccgggctgtgcggattccctaaacgccgcacttgcgcacagccccttacgtaaccgtcagtgccggggattccctggagggggtcattctattcaaccattatacacaccccgggctcctgccgccgcgccgccgccgcctcacaaaatggcggcgcccatagaggagaccgcggccgcctccccggccccattttgtgggaggcgagagatctgtcaacatggaaaacctctgctgaggatgcatccgagtttggaaaccccacttaagggatggagcctgggggatcacattaaacggaaaatgccaacgacttctaccacctctacgcgtttttagtttttcattttctcgaaggaagcgccagaagcctgtggagtaattgtaactagagggagaacggaaagctgaggtgactgctccggggacttggcgcggcgccttggtggctttggttgctcttccacgctcccggcagctgaccagaatctcttggagggtctcctgggccacctcggccgcgccagtcgtgcagtgagacttctgtagttttaaaatgccacagtccacggcccggtcggcaccgctcgcctgaatcgtgggctttgggaaccttggaggctgctgctccaggaactcgcggtcggccgggagccggggagcttcgttgctgggagcgggcggtattcgcggactccggcggccctggcgggtcgcggccgggatccgagccggggatgacgatgctgatggagctgatggggcaagagtgggaacggaggcacgtacactgaaatttaagtcatccaagttgggacttaagatagcaggttaatattgtctcaggcgagacttagaacgtcttttctggtatcccagtctgcagtgggcaaatctattgtctttatttctcatttaagggcagaatggagggatgacatatttttacttttcaagaggcggttgccacttttaagtcactgttgtgtgtgtgtgtgtacatacacaaacatacgatagtgtgttttcagagcaagtatcaaaggctaaagacttggagtgatactagtgtttaaaagcctttttaaaaaaattaagatgtgatgagaaactggagaattgacttttaaaaatttcttttctgtagaagaggctatcttcaaaatggagtcctaaagtatatctgatggatagaatttaaattcttaacactgtatataccctgtggtcaaaagcatcaacgtaaaacttgatgtttatcagattacttatgtttcaattttcctgtggttagaaaaattaagacagaagtaagctattaacggtatttgcttgtaagagtaacgttaaaggtttaaggaaaggtttgttgaaatcgatatgcatcacacgaatcatttattttcaatgttgttttccagttgcagcaatcatttgtgtttacatgactttgaaaaagggtttagtttatgttgattttgaccctcttatttaatctctagtgcagaagtgcagctttctgcaggctgcgcctcaatcgctaagttccactctccatcctctgccgcgctactcctggcatgtggatcaccaagatacaatttctggtcctgtctgttcttattgatgtcctttacagttaataaatttgattgccactaatcagtctgtatctcttgcaaaaacaccacatttagcatccaagtagagtcagagtatgttttttatgagattgtactaaagtaaccttctattacatttcttattaccatattgcatttcctatagtgggcagcatagagcaggtggatcctgacaaagtaatgttagagatgtgctgacagctttacaatagatattctccaactaatttgacaagatataaaataaaatgtagttcgtagttttcaagcattaatggaaagtgttcctattaaaaaattaccaataacagtggaaattgttgcaatccaatttgtatagtttactgttttgatgacaaagcgcttatgatgggaaaaatgtagtgttgcttttgtaactgcaaacgctgcacgccgtaattagaggtttatgttattttatttgaatttttcattcttaccatcagttttcatattagtcaggaaattgtgataaattaaaaattccctcattcaactaaaccttaaaaaactgtacccagtttcaaatcaagcattatcaggtgtatgattacaacagctgaaataaattgaggaattggtatgccaactcagtggagaaattttgggattttaggtcactctaagatttaaaaaaatagtttgattcgttaaacaaggctattgaagttaaattgatatttccttaaagatgattttagagaaaaattccttggcgagcttcgagaatgcgttcatggcttctgttgcctgtacctactgctatacttttttatgtggactaatttgtcttatttgaaaatttgattacaatatcaaatcctagatgaagcccttccattcttagggtgattctaaggagtactgataactaagctcttaaaaggcgaggaaatagtttattctactgcagattagggtaatcttaatacagacactctgatggtaattctaagcagtgttgataactaagcttttaaaagataaggaaatagtttattctacttcagagtagggtaattttaatgccctgaatatactctgaatcttttatagatagatttctggatgatttggcccaaaaaatctgataagctttggggaattttttaatttttttttctcttaaagagaaatcagaaatgtgggatttttttaaaaatttattttcagtagatattggagattatgctttgtacattaaatccagtttgatttttaagtgataattttcaattaaagactttttaataagacaactaaaaaattaaattttagtcaattacaataatattttttggagaagcattcccagatgtgcttttgacggggagttgatttcattagttgtttgggttgtttaatccagaatttttaaaactgttatgggtttaatttgctacatttgtccattcttattcatttcatctgttttgatcactgaaaagttgtctaaaaactgtgctcattatacacagtttatagtattttaatactttgtttatagtatttaatagcttctgaaaactttaagagaacatactaaaccaaggaactatttattaatggtaatctatatttagtaataaatatatttgtaacttactaaatgtaagtttactaaatgtagattactaaatcactgagtaaatatttcttgaatatttggacaagagatggggggagggagaatgacttgaccctcaagaaacttaactgctacctttaaaaggttataatgaagctgggcacagtggtacacacctgtagtcccagctactcaggaggctgaggcaggaggaccccttgagccgaggagttcgaggctctgtctcttaaaacaaaaaaagttataaaaatattcagactggagggttcctaacttttaatacttaagcagggtctttaccacagagttaaatttaaaattctgtttagaatggtaacaaatttaattatgtacaaaacagcatcactttagtgttaggatcagtgttactcaaagtgttgtaatgttaataacaagcatttaaatcacattgtttgaaaactgggatctacaaaaaatatgattccaataattaactttttaattatgggaaaggcaagggaatgttcagtgaatgtaaaaaaaatatactactgagcaaacaaattgttttaatgaattttgattttctgttttaattttttggtacattgactcttcttgacatggcactttgctattaattaaaaaaaattaaaccccaaagacaaattaattctgtatttaatgcagatttaattcttgactagctgtaatgcttaaggagttggcagtcttgttggcaaaacaataaaataggaattaagctgaaatgtaaaattgtgtaataattaggtttcattaaagtatatatagtttccttaataactacatgagtcagtagtgttgacttaataataagttatttagcttttgcttttctctgaaaacatatcaaactcttcatatatagcatcgaaatagatattcaacctgagccactgtaaattgttgaagcttattgctatacattaagggaaattctatccaacagttcagtgtaaacaattttttaaaggtgctatgattctttaacatgatttgtagtatgtagaactcaagtattctagaataatctttgcatgataatgtatgagaaacatttataaacagtccttcaggtgtacaaaataactgacataatattttgcatttaactacactgcctccaagtattttaaacaaagatgaaatttttagagtattgtgctatatttttataactgaatttccctcttattaacaatactcataacatttagccattaatgattactgatagcttaaataagagtgtagtttctgtttctaatgtctattaattttaaccccatttaaagatatttcctacttatcatactcaaagttaatcagaagttaaataaatgatggtccttctggttctctggaaactgaaaagaagcttctgtttctttagggtatgcaggaattttttttcttcccagtgagctgaatccatcctttacgctgctatttgctaacctcagttgtttttctgctccattaaagttgaggccaccaaaaatagtagtaatatcacaactacaaaaccctgggtggatttgtacccattgcacatacacttcttgctgccaattcctaagagacttttgaaataatagtatattcccagctggacaatatattctacttgtggcctatgtatagtgttcaacaagtccaggagccctatgaaacggaatgtgtttactgcatttttctagggagaagttctcagcaggcacgggcatcttaaagaccctgtgatgcccaaaaggttaaagctctatttgctaatgacagatagtaagtttggaggattgcttcaggtgcagcattttattttgtgggttgttggcctgtagggaaaaacattttgaaattgtagttaaggaataccacttcagttcatcaaattaaaaaaattatggcaaataagcaaaaatctatttctaaagaactacatacaatatattcttacagaaaattttagattaaatgcatgtaactgtttttttggtttgccatgtattgaaaatggatggatgggggattacattagttgatgtatttatttatttatttttgaggcggagtctcactctgttgcccaggctggggtgcagtagcgcagtctcggctcgcaacctctgcaccctaggctcaagcaacactcgcacctccacctcctgaatagctaggactacaggtgcacgcaccataccacacctggctaatttttgtatttttttatagagacaggggtcttgctatgctgcccaggctggtcttaaactcctgagctcaagcaatctgcatgcccaagccattggcccatcttggccttctaaagtgctgggattacaggcgtgagtcaccatggtcagcccatattaatttaaagtaggcttcaaatataattattcactaattgggaatgcctggggatgtatatgaatgtattaccgttttgtgagtagtagtgtgtgcttgtgttcatggatggcattcatcagaatgtttgcaatggtgtagccaggttacactgccatcttcctgttctcctttgtgcttacttgctctgcctgtatttgctgcagtttctagcgagtgtatgtaggtgttggcccagaacttgcttttgtagagatcatacattgtgctaatttatcccaaatcagtttttgtgtattatctgtgggcccaatgtgtaatttgaactttaaggatactacttcagactgcagtgtagcataacctttaaaaaaaaaaatgctagttttgccctaatctgtgcatattccagttgttcaatgggtattagtaatacatgaattacttctgtgccctttttggtgtagagtctcatatgaataattactgttatttaaaacccacgactccatgcattgttttggtgggagagggtagtttcccatcatgttttacatatatgttagcattcagattttcctttttagcccactccctactgaactgaagggaaagggcgtatttgagagaaaacatatgctttactcaggttccaataattaagccaatgcacttgatttaagttatacatttagctcattcttaaagtgtaataaagactttaagcctcctggctcccaaatcagtgctttttctactaaacattctttctgtcttgctaaaaaaatccaattttcagaatcaagttagttgctaagcaaatatgcataaaaccatacatttatctgaattgtttctaatttaaggagtagtatataaaagtttcaacagaaatcattgattagtaaaagtgatggaaaatcagcaaaataaaaatagaattagagtaggctaaaaggcccttctttagggtaatcggaaaactgagttcaaatatagggtctgggacttctcaggtgatattttatcttaaattagaatctgcatgaggtagggtggggccactcatgcctataatctcagcactttgagaggccgaggcaggagcgtcccttgagaccaggagttcgagaccagcctgagcaacatagcaagaccttctctctatttttaaaaaactaaaattggatttaaataaagaatctgcatgaactttcttgtcacttattcttacatattatttgccagtgtgcgatacttaataaccaagtaagacacttgaaatgagtcttttaaggctacaacttaggtaacattttataaatattactgctacatacataatacagtaactttttttagcctcacaataataccttgtacaatttataactgctaaagggcctatagaaggctacccacctatgtaaaaaaaaaaaaaaaaaaaaaaaggtcctagctctgtctggtgtagcttggcaaattatttttgatatgaattgccaggaatataggggtatcattccttgctgataagagcacatacccttcctttgctggctaagctatgtgattctgtaggaccttagtgtcatggccatcctttcagtagtaagcagatttagagaagttgtcccattgttaccttatttcaatagtttttggtctttctatattgtgcataacctcacttaatcagattgttatgactgtttccccccaggaagtataggaagataaaaaaaaaaaaaagccaggccagatatatatgactgaacgtgagctcagcaaatgatataggtgtcttaaacatactttcttttttttttttttaaagggaggggttctggctctgtcacccaggctggagtccagtggctcaatcatggctcactgcagccttgaccttcccaggctcaagcgatcctcctgcctcagccttctgagtagctgagactacaggcatgcagccccacacccagttaatttttttatttttatttttgtggagacaccgtcttgctgtgttgcctaggctggtcttgaactcctgagctcaaccagtcctctcaccttggcctcccaaaatgctgggattacaagcatgagccagggcacttggtccatattttgtttcttaaagtcacaagttaaagctggaggtttcacccagaatcaaagtgccaggtagcattttagtccagcctaggataagcagctgagtttccatgaacacagtacaagaattcagggatatcacttgctaaatgtaaaccagttacctccgtaatttcccaaaaattttattgtgacaaacgagtgccatactctgaacattaaaggcttttacctccagctgtccaaacattgtgcatgttattcgggtagaggcactggtatggtaggagtttctcctttagtgtcttgtaattgacaacagatccagcatttatggaatgtattgttattgtaacttttgagtttccatagccaagaacgtaagagtaataactaggtatagtccattatttttagtaaagttagttttagttagcctttgatggtagacacttctcaggttataattcagactcaataacaaagccagaaagttcaggaagggtagggtagtgctgtggtctgaatgttgaaatcctaactatcaaggcattaggaaatggaacctctaaaaggtgattagatcatgagggcagaaccctaatgaattagtacccttataaaagagaccccagagaactggtttgccccttctgccttgtgaggttacagcaaaaagaccatcatataggaagcaggacctcaccagacaccaaatctgccaacgccttaatcttcgacttcccagactccagaactgagagatataaatttattaagtttataagctacccagtctttggtattttgttataacagcccaaactaaggtaacaagaagcaatcctcacagtgcttgcttaatgtctcaggtaaggatttattttccagaaagaaagtgactaaatagattccctccagaaagattttcagatcagtagatctgccttaaactaatgtagtctttggacccagttcagaagtggccaaggccaatcctcaatgcatgaaagtaaaagttagactgtatttaagggagacaaattactagttaggaaccatcgaatgaggtcagaggcaagaccttactaacagatgggcaagttaaatgctatcttctgaaaattttagttgcttcatgatggactcatttggagcatatctggaaagttttttggacatgtctaaaacacggggttgaattttccttacaagccagggttaggacaggaggtcgacctgctgtctagatagtctcagcactaccagaagctatttgtaagctgtactactagtctggtgactcaagtaggaagtgtccaggaacctttcttctagacactgcgagaaaccaaagattagtaataagaaattgtttgatagacaagatgaacatcttaaagcatagattcaagacagaggacctttgtacctgacaagtactcaggaagacttgaaaagggcccccgcaggtgagtttcaggctctgtcttccactcatgaacctgcaaaatccaatccttgctgctgaagatttcttaagaaaaatgaacagtgtacctggccacttcagtgtctttagaatcccatcttggtgttatactttgcctattgattctagatggagaggtatcaaatgctttacaaaatctcaaggagttataaactacttttacaatctgtgttataaagtgtattccctggttattataaataggcaaaatgctattccaaatctaacaataaagacttttgccaatactcattgtttcagctttcaaatatgttaagtatgttttctacccatcctacaaaagtatacataatcactaaaacttatgaacaacacatatatgatattaacctgaatatttacagagagctccccggagggatgattttatttattatgttaattctctatttgtttagtttgtgacctgatcttaatagtaacaagtgaatgagttagcagaggaaatcagttaataaatataagagcaacaatgcctgtgaagaagtcaccacatgggccaggcacagtggctcatgcctacgtctgtataatcctagcactttggtaggctcaggtgggaagatcccttgaacccaggagtttgagaccagcctgagcaacatagcaagaccttatctctactaagaataaaattaaaaataaaaacatgaagaaatcaccacagccttagtttagtaacgataacagtattttgtaatatccacagcagaggagactaaggactagatattttagctcctccagaagcgaggaatgtttattgtttttacaattgtctacaatcaagaactacccaaaagcttgaggagcatcagtcatttatgacttttcagaagttaaagtatcatctcaggtgaggacagcactttctgccacctaggaagaatatggagaaagcaaaattttttactactttgtcttaagaacagactgcatgtctagaagccaatttggtttttttctccaagctgccagttccctcttcaatattatacagtgttttgttttggtcatagcaccaattactaatttaaatgagatttaacgaaactctttcaataataaataatacataacaaaatacgtgtgtgaccatatatttgcaagaaaggggttgtgccatgaatctttttttctcagtttaacaaataaatttgcaaaggcaactttcaggaatcagaatgttattttaaatattattaacaagacaacaaattattcagacaactaatcagaattatagactttaaacttacgttatttttcacagaatatagcaacactgaaatccaggcgtccaggaagactattttacttgaaataatatttttaaacccagttttatgatatagaatagaattctatttgcttttctgcagctttagggaagaggggacattttccccttttgatattgctggttttttttttttattttaagaaaacagcaattagaagtgtctaaatatcagatttccattagctagcatcaagagagaagagtaggtacaaacttaaaattcagaaaaggacagaaagggccaggcatactggctcatccctgtaatcccaaacttggggaggctgaggtaggaggattgcttgaggccaggagttcaagaccagcctgagtgacgaagcaagatcccgatctctacggaaagatcagccattcctggtggctcgcagctgtagtcccagctactcagtagactgaggcgggaggattgcttgagcccaggagttcagggctacagtgagctgtgatggcaccactgcactccagcttggatgacacagcaaggccctgtatcagaaaataaagagaaaaaggacagaaagataatgctaacaaatggaatatggagcatataatgtcttgcctctacatgtaattaagaatagaagtaaaatttatctcagattaagattttttttgaaacaatctcaacagtctatattcagataagacagattttaataaaattatatatgtcagtcatctgtttcaaaaatttcagggctatttttagtctttatcaagcataacttacagttatagatagttgtggttttagaagctattctatttgttattccctctgtatcccttaatcccatgcctcaaattatttcagaatactttcccaataaatgtactaacttgttcttttgtattccaaaaatgtgaaaggtgttaaaagtttgtgttttcagtgcctttggaaacacttaaaaacgcatctttgaaattgtgtgtccaaaccagtatttcccaaa

SEQ ID NO: 3932 - DNA, 566 bp, Homo sapiens
ccctcccctttactccacttgatctttttctttttcttcttgtaatctccaagtagacaccacaaaggcagtgatcactttgcagcctccatgggtcagcgtgttccaagaggaaaccgtaaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggctggccactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcaagggaaagcatcactacacatcagcaggaatatcacaatacactgtgaaag

SEQ ID NO: 3933 - DNA, 2569 bp, Homo sapiens
gtttgatttttgtgggccttacttttcccatttgctcatgtatgtctatattcctatatctaatgtttcttaaaagacaaatctgactgtgtaggtgcatttgtttaaaaaatataactccccattgcctctgggataaagtcttatctcagtttacatatattcttgataacctctccaactttatgtctcaccacccccactcacttcgtaattcgtgccttatcagaatggacctgttatactggcagttcaccatatataccattacattttgtttctcccatctctcaggtagacttacactttcggcccagcacatcagtcatcgcccttgcttgctttcctattcactcctgttctggaaggtgcaccaccttttcttggaaggcttcccttgctctcccaggctagatgagatgtccttccatcagttcccacagcaccctgtgcatgtatctgttgtgcacttaccaatagtatacaagggatctatgacccaagtctctccccactagcttgtaagctcctcacagacaggaaccatgttttgtctttgtactccagtgcctagtatataagagatactcaataaataaatatttgtcaaatcaactaattgattccttgtgacctaattctagagaatgggaagaaggcctgttattttgttgtcctttatggttctttaggaaagctctccaagcttggcatttgtcagggtgggaggaaaactgttgaagtattaagactggacacatggctgctaattcatcagcttatcattgaaaaagtccatagccaaaacctgactgtgcacttactataggaccctgacctgcctgggtctccctgtctctccagccagtatatttaaaggtaatgagataatgatgagtgttttgaaaaatgtttagtgttcaaatagaaaccattcgtgtcccttcactctctgaacatagtctgcaaatctctccctctctggtatgtttctgttttgtggattagactgctaaataagcgaagagttaattttgaagttcaggtcaacaaattcctgtttggagacgggctgttcctgaataccaggttgttatctgtctattacagccccttcacttctgggctcctggccctttgcgaagtacttcagaaagcctagagagaagagagggccctcaaatcccattccagcccctaaatgaaagtggcatcacaaggagaaaagtggaggtagaaatgtaccatgggggacgttgccccattgcctttcttcccctgactactgggcttcctctatcagcttttaacgcctggaagtagctgagtctccagtcactggtggccttccccaagtgagctcagcagcatgtgctaataggtgccaatactgtgctggctccagtgggattcctctctgcaaagctgctggcttagcttgactgtttccctattcctctccttagaactttcatagccagtcaagcatagaattgcatccattcttctgaaataggtactgtgcctaatttttcattggcttggccaagattctgttacctgtaattatgtcatatgggctgactggtgtaggtttggtaggcctcactgctctccagaggctagtgttcctatcccaggatggctgttgggattaggagtggaatgaggaatagtttaggaccacaagagatttggcctccttggaacatgtaggaaggcctcaaggatgtaattctagcccagggaagaaaatccttttcagcagacgcttcccttcccttcccctagggaatgtgtccctactatagtaaactcttccttaagagagttttatgttttctctgtcagatcaatttgtttttcttaatgttgttcctatcaaaaaaaaaaaaaaggaagaaatacagtcctcagacctgacagtttcatttttccccccaagtagaagcaatagaaaccttagcagttccaagactcctggcactcacttttcctctccatctttaggtctaacccagctcagcccagagtaaagacataaaagcctcacatgtgatttcctcttgcattttttctgctagaagggtccacagtacttactttatgcctcatctcaattgaagctggatgatgaggatagtgggcagtgattgcaattggggaatgcatgtactggatcacataaggtcatgaaagtccttgaaacagagccttgccaagcagaacccttgccactcatggtattcgatacagtctacccatctgacatgaaatgatattcttaatgagccattcctatggaagatagctattgccaggcacattcagtctcctggtctccctctcatagctatgtagggcctatgacctagaataaatggaaaaatgttatcaggaggaagagactgctggactcccctgagaggtagggtttgtgctaggagagctgggtgccatttatttcattttgatatatcaggtgctcctagtaacaattcctagtttctcttacctctgtaatcatcctgaatagtcactgcttcttgagctttggtgagtgttctct

SEQ ID NO: 3934 - DNA, 2065 bp, Homo sapiens
gagacgactctcgctctgtcgcccagactggggtgcagtggtgtgatctcggctcactgcaagctccgcctcctgggttcacaccactctcctgcctcagcctcccgagtagctgggactacaggcacctggctaattttctgtatttttagtagagatggggtttcactgtgttagccaggatggtctcgatctcctgacctcgagatccgcccaccttggcctcccaaagtgctgggattacaggcatgagctactatgcctggccacatttttttaagttttgaatcatgcaaaccttttttagaatttcagaataagaatataaaaaatcacatcctaacactgaatatcaacagaaacaaatgtatctaactatatatataactctaactagatacccttaatggactatagtctaagtgcaaaaacaatgtccaaaaaaaaaaaacagttgtactaagtagtttgctgttggtagcagtattagtattgttatgctgaaactattttgtacgtattgttggataaagtgaataagcaagtattgctgagaacctgggttttcactgtgagagaggggagatgcatatatagaatgtgagaagtgatgaagaaccttgtagtggtggacttgaattggagctatgagactaaattcgtgattttgaaaaaatatgatttcctaacactatccttagaaaagtcctaaaaataacgatgctccgttaaaagtgagcatgtccaacacccatatttggtttctaaatgctattccccacttaaaagaaccagaacttctcagagagatggctgattacaggtctggggcaggcaagataacaagatgaccctggaaattttggtgtgcataaagcaagggagtcttcaaacaccaatgacattatatcaaaaggacataggaagtagcttgaaagggaaccactgataagcttgggacaatttgagcatgaaaaaaagacagtggcagaaactgattagaactcattaattaaaacataatgggttattttccattaatgccatgtgttagattaatttaaaaaacatgaaatccacagaaatattaaaaagtgggaaagggaaatcactagacgaaaagttaagaagataatattggccaggagcggtggctcacacctgtaatcccagcactttgggaggccgaggtgggtggatcacgaggtcaggagatcaagacatattggccaacatggtgaaaccccatctctagtaacatacaaaaaattgctgggcatggtggcacgtgcctgtaatcccagctactcaggaggctgaggcagggcaatcgcttgaacccaggaggcagaggttgcagtaagctgagatcgcgccactgcactcgagcctggtgacagagcaagactccaacaacaacaacaacaacaacaacaacaacaacaaaagataataatcacatggtctgtaaatatcactacacagattaattaaaaagggaaaatgttcctttacaatgaggagagctagaagactacaccttaagcatgttcaaatttagcaaaaccagtaataaaacctgactttattgccacctgatgtgatacaataaatacacatcatcacccacaccaaatacttcagcacaaaaaggaatatcataatacctacaactttcaaatggttcagtaaatgtggcaaaatgccaacaactggtgagtaaaagtgaagagtataaggatgttaattgtactagtttttcaacttttctatagatttggaattttgtaaaataagagttggggaagaaaaagtgtgtaggatgatttgaggacagaattgactgggtgatagttattaaagattccaccgttttaatttcaccatataaaaattatgccacactactaaaacaactaaacctgattaaatttttaccttcaactgagactactaaatgtgacaatgccaccccaaaagcggaaggcatagtaattaagccgaagttctagcaataaattttagtgggtcttagtcactctggtaagaaatgtaatacattaat

SEQ ID NO: 3935 - DNA, 4987 bp, Homo sapiens
ctggttcttgtgtataagctggccggccacctccagggttgcagagcaggagaagctgcgcccgttgtcctctggggtggccttcagcaggagctgggccctcgggcccagtggctgggctggaaccccattcagcgtcaccttggctctagggtgggcctcacacttcactgtcacctcggtcccttctgagacctctggcttcgtcagaatcacgttgggcgccggaaagcctggaataggcacacagtgagccccgccccgggttcaggtcacacccccaagaagccccactccgcccctgccccttcttactgtagatggtcactgtctgcagtgtctcctggctctggttccccagtattactgcacacgtcagccgctgggtgccctcgtcctctgcggtcacactgactgaggccttggccgagaaggagtcgttgccataggtgactgtggggttcaacctctggtcccccagtgccaggtggacctgggcctccgagactgggaacagcccgtccagggaacagaccacggtcccctgcgtgtccacctctaggacccgggggctgacaagttgtgggggagtcgctggcaggactagggagagaagaaaggtctggagctggtagggggccgaggtgttctcaaacagctccagcccttggggccgcaggtccagttcagtgcggcacgagaaattggctccatggtgatctctcctcaccagcaccgtggtcgtgacctcagcgggctcccccacagctggctcccgtttcagctccttctccccacggagcagcaccacggtgaggttggcccggggtgccccaccctccacctggcagcgtagggtaaggttcttgcccactggctgccaagaggggaggggtgccagttccacccgttctggagtccctgcaggaaaacagaggtgggggtgtctggtgaagtggaccttgctgcctgcctaacagacgaactgcacctgcctgggagccctacctcttcagtatctcccccaaacacgcccagacacctaagcagataggaatgtcaagatcttcagtgaaaactggtaagagggccccgagtgtttgtgaaggggatcaaaatattccttattcatgacagcagcatcttagagtgaaaagtggaaaagaacttcaaagtctattgctaggtgtctggtcaaataaattcagcagcccagtgcactagactgggcaaacagtggctcgatcttggctcactgcaacctctgcctctgggattcaggggattctcctgcctcagcctcctgagtagcttagattacaggcacacaccaccacaccaggttaatttttgtatttttatttttaattaattaattaattaagtttttagactgagtctccttctgtcgcccaggctggagggtgatggcatgatcttggctcactgcaacctctgcctcctgggttcaagcaattctcctgcctcaacctcctgagtagctgggattacaggcacgtgtcaccacacccagctaatttttgtatttttagtagaaacggggtttcagcatgttgcccaggctggtctcgaattcctgacctcaagtgatctgcccaccccggcctcccaaagtgctgggattacaggtgaaagtaaatgagcctggcctagacattctttaaaaaacaaaacaaaacaaaaaaaaaaacctgttggccaggtgtgatggctcaggctgtaatcctagcactttgtgaggccaaggcaagagggtcacttgaggccaggagttcaagacaagcctgggcaacatagggagacccccatctctaagaaaaattaaaaaaaggttggcagggcgcggtggctcacgcctttaatcccagcactttgggaggccaaggagggtggatccacgaagtcaggagttcgagataagcctgaccaacagagtgaaaccccgtctctattaaaaatacaaaaattagtctggcatggtggtgcacgcctgtagtctcagctactcgggaggctgaggcaggagaatctcttgaacctgggaggtggaggttgcagtgagctgagatcgtgccactgcactccagcctaggtgacagagcgagactccatctcaaaataaatgaatgaatgaatgaatgaatggttaactgggtgtggtggtgcacacctgtagtccctgctacttgggaggctgaggcaggaggatcacttgagcccaggagtttaaggctatagtgaactgtgatcatgccactgtactttagcctgggaaagaaagaccctgtttctattaaaaaaaaaaaaaagtcagtaatgacagagtctaataacaaaaaggctgcgtgtggtggctcacgcctgtaatcccaacactttggggggccgaggcaggcggatcacctgaggtcaggagttcaagaccagcctggccaatatagtgaaaccccgtctctacctaaaaatacaaaaattagccaggcgtggtgttgtgtgcctgtagtcccagctacttgagaggctgaggtttacttgtgaggaaaggattacttcagcccaggaggcagagattgcagtgaactgagatcgcgccactgtactctagactgagtgacagagtgagagtctctctcagaggaaaaaaaaaaaaaaaaaaaaagcatcaggaccgggggggtcctgcatttgatacccagccttgcttctttgctgtgggtaagtgactttgtctctctgaacctcagtttcctgaactgtaaaatagggctattaaaggtaggagaattcacttaagaggtagacagagtcgctgtacataagcaggaggtttcttttttagagtgattgaaatattttaaaattagattgtagtcatggttgtttgtacagaagtcattgaattatgtgcttaaaagggatgaatcttatggtattctaaatcgtatctcaagaaagcaaggctggggcatggtggctcacatctgtaatcccagtactttgggatgccaaggcggggtcatttgaggccaggagttcaaggctagcttgggcaacattgcaagacctcatttctccaaaaaaaaaaaaaaaaattaaaaacaagctgggcttcggcatggcgtggtggcttatgcctgtaatcccagcactttgggaggccagaacagatggatcaccggaagtcaggagttcaagaccagcctggccaggccagacatggtggctcacgcctgtaatcccagcactttgggaggccaaggcgggcggatcacgaggtcaggagatcaagaccatcctggctaacacggtgaaaccccgtctctactaaaaatacaaaaaattagccaggcgtggtggtgggcgcctgtagtcccagctactcaggaggctaaggcaggaggatggagtgaacccgggaggcggagcttgcagtgagcccagatcgaaccactgcactcctgcctgggcgacagagtgagactctgtctcaaaaaaaaaaaaaaaaaaaaaaaggccgggcacggtggctcatgcctgtaatctcagcactttgggaggccgaggcaggtggatcatctgaggttgggagttcgagaccagcctgaccaacatggagaaaccctgtctttactaaaaatacaaaattagccttgtgtggtgtcgcatgcctgtaatcccagctactcaggtggctgaggcaagagaatagcttgatcctgggggtcggaggttgtggtgagctaagatcctgccattgcacttcagcctgggcaataagagcgaaactccggtctcaaacaaacaaacaaaaaacaccaaagaaaaaaaaaaaaccagctgggcttcctgctggctcacacctgtagtccctgctactcaggaggctaagggtgggaggaggatttcttgagcctgggagtttgaggctgcagtcagctacgattgtaccactgcactccagcctgggtgacaaagtgagaccctgagaccctgtctctaaaaataaaacagaaagctgttaagctgttaaaaacaaaaacaaaaaaatatatatatatatagtcaagaaaactctgacctccagctcttctctcttaccacctcctatagactcttgcagaacttgaggtaccctcaaacctcagcccctagaggaaacccagctcagctgcctggtgcagcggggaggaagtctgtcctgctctcacctcttcttgaccctgacctgcagtcctttaccaaatcctggtcactgaagtattcaaatacttgtctgtccttcccttcttgaatacggtcactgcccacaacatgggccgcgtggacaaggaccatagccaactgctcattggcttccagtaaatccagccttcagctatctaatccctggcctgctcagaaaccctccatgactccctatcaccccaagaaggaaagtcccagctcctccacctggcattcaaggctctgccaacctcacccttcctcccatcaatcaattttttttttttttttaggggcagtgtctctctctgtcacctgggctggaatgcagtggtgcaatcatagctgactgtaacctcaaattcctgggcttgaccaggctcagtggctcacacctataatcccagcactttgggaaactgaggcaggaggatctcttgcggtcaggcgttcaagaccagcctggctaacatggtaaaccctatctctactaaaaatacaaaaaaattagctgggcatgatggtgggcaccttaatcccagcaactcgggaggctcaggcagcagaatcggttgaacccaggaggtggaggaggctgcagtgagccaagatggcaccactgcactccagcctgggccacagagtgagactccatctcaaaaaaacaaaaacaaaaacaaaaaaattcctgggttcaagtgatcctcccacttgagcctccagagtagttgagaatacaagc

SEQ ID NO: 3936 - DNA, 1264 bp, Homo sapiens
aagaaaagggtgggggaagaatgaggaaaaagttgtcacaaagcgttttttgacttagtctcaaaatcatgcacttcattctattttctagaagcaaggcactaaatctagcccgcacccaagggtaagggcatgaattaaattctacctgttgaaggggggagtaacaaagaatccatggacatgattttaagccatcacaatctgttgggagtcctaactgcaagtaacagaaaatccatctcaaaatggattaaacagcaatggggactcattggctcccataatgaaaaagccctgcaggtaggtaaacttggtgaatacttgttcagagctctgttttctctgtcctcttgtctgtgtcaagtcatccgtggccaggttcctagcaaaaatgactgcaaccactctaaggcctcctccatgcacatagcacattccagaataggctagcttggctctgactccgcaccccagcagagttctgagattcactctaattggatgggcttaggtcacgtgcttaccatccccaagccggggcctcaaatgccttgactggatccacagtagatcccaatcacatgattttcatcacagtatttatgtgtacattctgaaatgtacataataactagtcaatcaacttaaaacaatgctcctggaattagatgcaatactcgtactagactgcatcataacatttagccaaataacataaatttagttttagttaaaactgaacatttctgatcagtacaccatgtctgtcaatagaataagtttaccctttttttgtgaaaaatactgtgagaacaaaacccaaaagttgagtatgttgtgaatttccacattaagaaccattaaaattattttttatcatctttactcttcccagaaatggcagtgtgttctgtccatgtttacttttgttaataaaagtgttgaaaaaaagactgtaaaattcaccattagccctacacatagcatgctcttgttcaaaggatgtggattcgagtgtgagaaagacacggacagacacaattttcaggcaccactcagcaatatgcttcataggataagatgtcgctacaccagctggtacccagatcctgatatttggtcatattctattgtatactgcctggtccagtccacgataacaggacgaaagaggccacagcatcgaaattcaaagaagtctataatatttcttacacatccatggctaaaaacagcaccccaaaaagaaaacacgtcagtc

SEQ ID NO: 3937 - DNA, 9976 bp, Homo sapiens
aaccgtttttctttattctacttagtggggcacccagaaacttccctgggggaaatgcttgttcaaatagagaacacgcagaagatgcacttcaccggcctcctctggctgctgagcccgtactctctctttggctcaggctaggcctcttcttctccttggacttaacgtggcttaggtccctgagtcggccaagacctcccagaggagacctgcccagctgccaccaccaccattattgattggcttcccggtactggtgcagcaggtcactgacatctgtactttctactttcacccaaccatcttccttcatgtggtacactgtggacaaatgagaaaagaacatggagtcacctttcacctcagcaagttcctgtcactgatgttatgttgaaggcagcaacaagacacatgcgcaagcttaaaaccatatgactgggcctttaatgcccttcttctgactctgaaaatttcctccctactactctccctcctttgagtctctcaatcattttcttttttttcttttgagaaggagtctcactctgtggcccagactggaatgcagtggcgccatcttggctcactgcaagctccacctcccaggttcaagtgattctcctgcctcagcctcccaagtagctgggactacaggcacccgtcaccacgtccggctaatttttgtagttttagtagagacggggtttcgccatgttggccaggctggtttctcaatcttaaatcaccccccccaccacccgccgactcctcccaggcatggtggtgggagcattggtctcttactattgacaacgcctccagaatagctgtctctgtgagtggcataagcaatagccctgcggccaaggtcataggcctcttcagggctaagattaggccgatagccactgtccatgaccccgtaggcataagtgttcccactacccgtggagaacatatttcctgagagccgagtcccatgttcatccacgtagtagagtccaggaccctataagatgaaagatttcaggctgaaattggagaggaagatgttggtaacatgggggttcaaatatgagacataaaaagtgaacaaaagaattaatattaccacaagaacattggaattaggaaaccactttggtaaagtcatcgaactttagaaatgaaaaaggaaaaacaaacttgaaatcaactgtttaacaaaagggacaagcttacaaaacacatgcaatgattcatatctgggccaataaatagtccatggatatactgaaacagttctataaccaagcactctatatgccatgcatcttgtcagggagggagtaggagtatatgatgggaaacagatctgtcatccatagggaacatggtgggggaacatgaagaatggagagcacccaccttcttatcccagccacagatcatactgcccatagagaggcccatgccccggtactggcacatcatgttggacagcagcttggaggctgccgacactgaaatacgttctccatttcgcagatagtacagcctgggtgaggacaaggtggagtgaggaaagagaggttagctctttccaacttgatggggcaggaaatgattaaagagataagcattggaaaggaattattttgtaggatctaaagatcagagaaagatttggaatttaaagtatctgaaacatacaaaggcagcctagtaaatgatactgtcccgccagggtggatgtgtcagtgctaaatacctgacgtactatctggcttatgagtggagcacaggctgagatttgggagaagggtcttatcaccaaaaagctgttttgtgaaatatactattagcactaagatggaccacataggacaagagtaaggagcaatgatctgagagatccagggattaaccactaggctaagaaaggaagatgagaggcctcgcttacctgcattccttggccagcaggcgctcccagtactgacagtctgctgcacagccagacatggtgccaagcaggtaagggttaatctcaatcaccttgttcacccgtaaggcacctggaagaagatggagctttgggagagaagggatgaccccatagatcccccagtgtgtcctaaatcaatatccacttccactttgttgcagagttggcctcctgtggaaaggagagcccagctccccagattctgcctgctggagcgtatacactcactaatgtaggacccagctgaggcccgagaatccactgctgcaatcactccatgctggaacttgaaggcgagcgtggtggtgccatgggccatctcaatctgaacgttcctttctccgtccccacccagggactggaagaattctgtgggctgataagagaaaagaggttgagaaaggcaatgaaaaattctgtagtaagaggctccaggaaaaggttttagggagtatgagggtgaggagatatgcagaaatgatctaaccatcaataaatgaaacagttaataaccaatctctagaaggaaatggcttgggagaaggaaaagaagaggcatgccagtatcaaccttttccattttccagcacaacagaaatgaaagcaagcacatgttaccattactaaaaaattttgagagtgacttaaagggtttcttccatgcataaagcattcaaccctcacaaaacacgtttagtaacagtatcctcactttacagaagaggggcttgggacctagactaagtgacttgttctaagtcgcgcaacagtgagttgctgagaggaggccagcaggcaaatttcataggtttcccaagacaccacacacctcctatatcatgtgataaccccatgaaaaaggctccaccatttgtgtgtggacaagggcaggaaagttctcttgtcttcctttgggagcccccacctcacctgtaactctttgtcctaacttgcacttcctcctctcaggccccatccccatgtggcctcttctttgggtctggcgctctccgggactgaaggctacccccgaccctgtaccccgcgctcccgctctcgcctcctcctctcaggcgaccctccactcctcagcgcccgcctccctgcatccctaggggcttccctactgccccgacctgcattccccggggtaaagcgagctctggagatcgcatagagaaactgtagtgtcctgggtccgagcgacgcccgcttcccgcaaccgggagagccgattccggccgctgccctcggggggctccgcatacatctagtagcgccatgaccgcccagcacccagagatctgtccgctctcggaggaggaagtgaaagcgaaagccacagatcgaaggggagggaacaagactcttttccacatccccctgccttttccgagaaaaggacagttagtgcctggaccaggaccatcacactggggaccggcttctctgctctcccgttatgggggtcgggggaatgatgggtcaagggtcttccgaagaaagcgagaaaggaacaggcgccttcaaaagcccacttggcgatgggttacagtaagaggaagtctgcattatcacgaggagcttggaaaggaggtaacacactcaaggcaaatttcaagtaactcatcctggaggcagctgcctactctgcagctgtggttctccaccacagagagaagaaaagggagggagatggagtgcgcaggtctgagaaggctttcattctggagcatctgcaggagcctgcaccatggcccagtagcacccctttttctccatgagctgctggtgggttcccccctcccggatagcgcctccttccagaaagaggatgtggtcagcctgctccaccaggctgaggtgctgggtgatgagaagcactgagcgggagtaccgctcagggctttcgtacaggagctgctccacctgaggaaagacatcggaccgtcagagccggggactaccctcagcccagggagacacctgtgtttccagggctgggactgacctcacaggatcactgctggctctgctaacaaccccaaggacaccaacgtttcccattctgagtacttctccgcaaaccctttgtttcattaaggactgttttacatgaagggtgcaaaagtaggataaaaatgagaaccctagggtgaaacacgtgacagaagaataaagactattgaatagtcctcttctctacccatggacttggcatttttatattcgattttaaggaaatataacttagtagtaaagagatgagcattcaagtcaggcagacctgaatttgggtcaaggctgcgccactcaaaagctatatgacctctatatgagcagcttattcaacctcttttaacctccattttgtcatctgtagaatgatgataaatgcctagctcagaaggattcctaatgaataaatgagtgacagtgcatgtaaacagactagcttaattaatattaatatgattaggatgggctgggcccggtggctcatgcctataatcctagcactttgggaggtcaaggagggaggatcacttgggcccaggagttcaaggccagcctgggcaacatagcgggacgctgtctgtacaaaaaataatttttttaaataaacgatattatgaggatggtcttttccttatgtttcgctttagaaattcagtctataggactgggcgcagtggctcacacctataaccccagccctttgggaggctgaggggggcagattacctgagctcaggaattcaaggccagcctgggcaacatggtgaaacccatctctactaaaaatataaaagtcaaccaggcatagtggtgtacacctgtagtcccagctactcgggaggctgaggggagaatcgcttgagcccagcaggttgaagctgcagtgagccaagattgtgccactgcgctccagcctgggcaactgagtgagacactgtcttaaaaaaaaaaaaggaaagaaagaaagaaattcagtctgtagtttgtagatagtctcttttaactgattctaggtgtctttgcctcgtcttctatctctactccttggggaggcatccaatggaactggatttgggaactgagaactgcaaggactggtttgtataattatgatgttagtaaaactaacagaagatgtataaaagaagcaagattgggtgggatatagccattaagaagatgactgcctcacctgtaactggctgtttgcatccagggcactggtggcatcatccaggataagtacacacggtttccggatcaatgctcgggccaacgccactgcctgtcgctgaccccctgacagctggctcccagcctcgtctacctctgcagagcaaagggccaagatgagaacggtatagccacatgtgtgcacgcatgtacatgcacacagacacactcatgcattcacgcactcacacacaccaagatctgacggttgtagctggataggggagattctgggaagatgaacagaatcctgaggatgtcaggatgaagaagccataggagcatgatcttacaacttcaaattgatgtccatgagtaaggaggaactgaaggataaaggcaagactactggggtttcagcaaaggtaaagatggctgggtggtgagatgagtggagagagtacctgtgtcatagccctgagggagtccagagatgaaactatgggccccagactttactgcagcagctgtgatttcctccatagttggcttctgggtcaggccataggcaatattttcttgaagacttcttccaaatacctgtggctcttgtcccactgcagccacctgagatgaaatatgatgaagagtcatagaacaaggcacatgggagtatggttatctagagatcgaagactcaaaatctttattgagaacatgtcacaaaatcatactacctccctcctgactacaccaccatctccacccaaggtctcttatcattccctaacccctctttcagagtgctcagtaagaatgctcttcgtatttgatgctccctgccctccttcaagccacctgcttccatacctgcctgtgcaggtagcggtgctcatattggggaaggggcttcccatccaacagcagctgtcccccggtgggctggtacagattctgcagcagggcagccactgtgctcttcccagacccattgggtcccaccagcgccgtcacctcgccagggcgtagggtgaatgtcagcccctagaggccagagaagcacacgataagaggctaccaaggcctctaaccttgagagtgtcattgccttgttacatagcatgatgtcttaccccagaagaaaaacagggaaatatagaaactcctaccctcccacatgcacagatttctgggtgatgcctccccaaggagtagagatagaagaagcggcaaagacaagggcagagacccagcaccactatgccacacacttgatgtcagataccaccaggaaagggaaaaatcacattccaaattacaaaggaaaaggaaagatggaagaccgaagacacagattttgctgcagcaattccttggaacgtgagagcactctcttcgaaacctcttctctcattctctttggaagcccaaactgggttcttgagtttggggaagatttatggaacagatgatgcctaccattgcctttaaagggttagggaggatatatgcttggcagtaagcaggctgaaggcaggaagaaaatttaggatggcagaattgcagttggggccagtggaatacagggagtggtaggttgtacctgtagcactaagacatctgggcggtttgggtaggcaaaggagacatcttggaactggacaaggccctccaagtgtaagggagtcaacagaccactgggtgggcagcgaggggtgcggtccaggtactcaaatattttctctgaggagcccacagccttctgtactctggggtagatggagagcagtacctagagggaggtaagaatagtgaaagtgaggtagtctgcttgccagcattatgtgaagcaagaagggtaaagaatggaaggacatcacacagatggtgctgggccagaggaaggaatcacactggggagtgaaggtggagggacctcacctccacagcctgggtgaactgcatctggtagagaacaaatgtgacaaggttcccactgcttacagccccactggtcaccagctgcccaccaatgtagaggattcccactttcagcagcatacctgaaatctataaagagaccacaaaaaaagggactgaggtagagaaatctggaggggacacaaagaaccgcagtcattaacctgaaggaaatatcaagtccctgtctcctaagtgacatcggcaggctcaataggcagacaggagaatgaaccagagaccccatggagtctgactcaatgcacatcatgcaagtcacagttatcttcaccaccatcaccactatcaccttgtctggggagcattttactcttcacaaaaggctttcattcatgtgatgtcagctaatacatgaagagccttataaagaaggttatatcactccatttttgaaaaatgaggaaacaaccagtcgggcgcagtggctcatgcctgcaattccagcactttgggaggccgaagtgggcggatcacaaggtcaggagattgagaccatcctggctaacacggagaaacctcgtctctactaaaaatacaaaaaaaaaaaaaaaattagccgggcgtggtggcgggtgcctgtagtcccagctactcaggaggctgaggcgggagaacggcgtgaacccgggaggcggagcttgcagtgagcccagatcgcgccactgcactccagcctgggcgacaaagcgagactccagctcaaaaataataataataagtaaaaataaacaaacaaacaaacaaataaataaataaagaggaaacagtctcagagaaggtaaatttgttgtcatgatcacaagacaagtaaattgcatcatcaagccaggatcttcggatcactggcgtagctctctttccagtgcatcacagatgtccctcatccctggcttccactattcccatcactctcactaacaaatctacaaggtaccagcatgaagcagtcccaggtgcaagaatttatggcgccctgcacttcccctgagaggcaaaggaaggccctaggactggaagacacgcatctctccaatccacatggttgggtggattttatgtaccatactgaaaggaagccacctagcatctttaaagagagggagggggctagggacactgagtagagtcattgagcctcaggttgctaggacgaaaatactgaaccaaccatttcccagtaaaggaggagtgggagcagggtcataggaatgggaatggagtcacggcatcttaaggacaagggaatgggtattcatcttcaggtgctcacactagtggtccaggagttgactgcataggccacagcctccttctggttgagtgtctttatttcttgcagcttttccctaaacttctgggcttcgccctcctcgttggcaaagcttcgaactgtaggcatggccgacagagcctcaatggccacctggctggactttgccagagattcccgcacctgcacttccagcaactgtggatacatggacaagagatgtcacacgggttggcaaaccatcagggacactaatacctgagttacctatttggaaattaaaggtgagaagagacagaggaaaaggagaaaagagaaagagacacagctatgccccttggatgctaaagaaatacgaggaagaggaaaatgactcagaacgggttggggatcaaattcttaaagacagattgtggggagaagctagaaaagaagacccagagagtatggaggttaatgttgagcaacctgggaacatggaccacagggacagggtgttccatgaagatggagaatcagtaagggtgccaggaaagctggactgaaagcaatgtgagaggaactgagtctgccaagtctgggagatgagggtctgtgtagagcgggccaactccatgaacatacctggtaccattttcccaccttcttgggcagaaggaaaagcagaggcagggtgatcagggtgaccatggtgagggacactgatccccagagcatgatccccaagagacataggcctcgcaccaggtaccacagaaataagctcagattctcactcagagaatcactcagggtggacgtgtcctctgttacccgagacatgatgttacctgcagggttggggagaagagagtgaggtgaatcagacaggttccaagtgatgagacgaactaacaatgagccaggatgccagggtcaggggtgtcaacatggggttctaaggaggctgcaggaaacaaggttagggttctccagaggtctgcaaatctcagtgcagggaagatgagtgttaaagaggaaaggcctgaccttcattttaattataaagtcattaatgcacatgtgaatttccattttcctgaaagctttctgttccctagagaacctgtatgtcccatgctatacacacaggcaggaagagcttaaactggtcacataacagagatggaggaggagggtgctgctaggaagcatgccaaagtctgtggagcactcactgggactagggttctaaccccaggtctatctctagccatatgtaactgtacagcttctagtgctgctagaaagcatgccgaagtctgtggagcactcaagagaccagggttctaaccccaagtgtgtctctagccatatgtaactgtgcagtttcagcatttagggtcttggcctcagtttccttctctgtcagatgaggcagttggtctctatgagctcaaaatttccaggtttgaaattctatggtttctatctaaggatacataggaatagatttataagaaaatgctagatgaaaactctag

SEQ ID NO: 3938 - DNA, 2080 bp, Homo sapiens
ggaaattattacaaagttcagctggaagtctccttctccctgtggaccttccccaattccactggctgccctcctcaaggacccctgtgagataaattcagaaatggctatccttggcttccctggggaacaagagtgcctgcagttcttttcccacttcttttacttttctatttcactgggctctctaaattcatttcagctctagggatttggaaaggattccgtgatggttaatattgagtgtcaacttgattggattgaaggatgcaaagtattgttcctgggtgtgtctgtgagggtgtcaccaaaggagatgaacatttgaatcagtgagctgggagacacaaacccatactcaatcttgggggacaccatctaatcagctgccagtgcaactaggataaaatcaggcagagaaatttggaaagactagactggctgagtcttctggccttcatctttctcccatgctagatgcttcctgacctcgaatatcagactccaagttctttagcttttggactcttggacctttggccacagacggaaggctgcacttttgaagttttgggacttggactggcttccttgctcctcagcttacagatggcctattgtgggacttcaccttgtgattgtgatttcaaaccttctgggtttcttcccagcgctaaatcctgtcgactggattcactaggatgaatagagaaagaagtgttacattttaagataatttcttttctaaacacacagaaagttttgaaaccaatggagagatcaacacaagctttggagaggagatcaaaatatctgcttcactggaaggagttttggattgctcaacaaggttcagatctgtggcataatcaggcttcctaatcctgaaccaaagttgttgttgtatctcgtagttgtcacctgagagctgactgacctgtttcaagcatatgtgagatgccttctggaaatgcccggaagcatatagctaatgggatgaggcatttcaaggttgaacttcagcaagagcaagtgggataaagggcaaaaagcagcacattcctttcaaaatgtccccattttaaactgcaggctagagtagacaatggaaatatatgacatataaagaaactggtgagattattaagcagagggccttctggggagcattaaagagtgagcaagaaaaatttctcagacatggtgattctagaattgaaaaatcatagactctttctcttctctctcctttgagagtttccagatgaattcttggatctggctactgagcaaatatatgaataataacctaggatcagctgggtataagaggtttccaccagaagtccatgaaaaccaatgtttttaagcatctattgggcaactaccataaacaatcagcaagatgtttaaacagttgattctgccggcggcccaaccagtttttaactgtatcacgaaaactggcctgggggtacagtctgagattattccagccctgcttttacaccgccagaaattccctttctgttacaaatttctaccccagagaggtttgcatattcttggcattttcactgtgcatcagtgaatcagctagcctacgggccaaggagaggggaaaaaaatcccaaataaaactcaacccagttaggatgtcttcatctatttttcagtgggaaaaaatacagctggactcagtgacttcagtcaaaagcaaacattactagttgcttcatttttctaatttttatttttgactctcaagttttggagggcataataaagacatagcctcagcaaagtcacttagaagattgagttcgttattttgcaaagcttgggtagtgacacttctgcaaaatgcacaagcacatgagcagagagatgtgtgaattcaggaaagcagccaaatgcacatcagagctgaggaatgtcacagcgaaatgaagaaaacttgtaaacacctatctgtatttttaggtagagaatgttctaacatattgccaatgggtgctgcctgtgtgttccttcccctaagctttaaactcaactgatattaaaggtgatttgaaaacaa

SEQ ID NO: 3939 - DNA, 1610 bp, Homo sapiens
acagaaggaagagcaggtttctcacggcatgtcagcccagggctcccacatgtggcctcccaccctcatcttcacacattctcacaccttccggagtacagaggcgagtggggtgcagatggtcctccctacatcgggccactcctcgacttttcagctcccgcacgattccttggggcaggcgaccagtgactgacaccgcatatacacctggcttaaagttactgactcgctgccacttggagacccagctgtcctctggactcatcatcgcaatgattccatcaaaggaagagctagtgcagtcatataccatctctcggttacccttcatttgtagatatgcatcacaattgtcacaaccatcatattcaaactggtctatagtaccttgaccagcgaacacagcaaacaggcccgcagatgccgcaggtccttcggcaccgtctccagggccatcttcgccgatgggaagaacaacagggagatagacgaccacagcctgtgcacccgcaggaagtaaatagctcgttacccagaatgcccaccacttccggcgcttagacttcctcttccggtgtgggcggacgccagctccgcccctacccccgccagaggagatggtttctcccgccagcaggcggggaggctgggcggccggccgccacctgggccggagcgcgtcgcagccacctgagcccgccgagggcgcggcggaggctgtgtggggtagtcagcgggcccccggggcgggggggcggctgcgcttgcgcgggagtgtgtcgggctgagccgcagcgccgagacgcgggctgtttgatctgggctggtggccctgggcgtcggtcctgttccccgatggtaacccgaagtttgtttttttttgttttgtctccccgttttagaagcattgggggcagtgaatccactgtctccctctggattgtctctgcagagaccgagaagaaatccagggacagccccacccctccttcctaactgcgagagcgctatagggtttccacttgcttcccacaggaatgctggcctgggagctacggcggaaaaaaatgcgtatttatcttttaaaactccgtctgtttgctcgttccggctgataatttatactttgcgcagttcttagcgcttagacacggttcctttactaaagaccatttgtaggagattaggtgtcctttttttccctttcatttcaccgtctaggaagcgaaatgccttgttctataggcactaaaccaccacccctaccaaacctttctcggggaagcagaaggggaacttgtgccttgtgaggaagcgacaaaggccccttctggccctggagacttcacgccaatggagcaccagctctctgtcctcgcaatagcccgagtgcaggcagaacgcagtcatttgtgtttatctgagaggagctttgggatataaatagtttcaggccccgctgcgctgtcattccagcccagcctcctgattgagctgcttccgggcgggctttcttcttgttggcggtcccatgctgtgttcagatgggctctgtgacaggtttggatgttttctatcactgaataaaactttccactttggaacat

SEQ ID NO: 3940 - DNA, 525 bp, Homo sapiens
ctgttcccgcgctgagctacaggactcccgagtgtgagccgcggttcctctgttgcagcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaa

SEQ ID NO: 3941 - DNA, 730 bp, Homo sapiens
acaggtgcaaactggagaggcctagagagctagagaagcaagtaagggccagggccagagtcggcttcaatggaacaacagcccagtgccctaaggcccctaactcttgctggctgtttcttgaccccaagccagggttgggagtcctctgggcatccattttttctaaaggaactggacagagtacacacaggaaaggaagctgtcaccctcttgccatctggctccaggggcctccagtccagcattcctccttcttcccttgattgggtggggccacatgatgggcagccaggctctgggctgtcccactagagcaggctgcaaacacagccatgtttcagtgaggcgttgatcttcttccctggtgtcccaacctaccagtgccacgttacagcccagagtgagttctacaagcgttgctggcctaatggatgggctgggggaagggggtgggacaggggctggaggaggggctctggggtccatcacggcacaggaacaacacgcatggtgttggtgaagccggagccagggcgccatccggtcagcacaatgaccacatctcccttcttgaagaagcctcgggccttgcctggaggaagagaagggaggttggtgagtaaaagccaagccaggcaggtttgcacctgggcagctgccccatagcctgagtactgaactaggctggctgaccactacttcctcacaccacaaggtggcaccaaac

SEQ ID NO: 3942 - DNA, 20290 bp, Homo sapiens
ctcactccccaggcccacacactagcccactgttcagggtccggggtggcagcatggcctgggggtcctggcaccgctgctcctctgcccaccctaacttcccggcatggcggctgccccctctgagcgtccccaaccaaactgcaggggatatgaagcaagctggacttggggagacatctctgctcgagtgcacgttggcctgatgacgactgctcttgggttcacgggttccaggctctgcccgggagcctcatgcaaactggtcccgttctacagacgaggaaactgaggcacagagtgattacggctgtccctgagctcctgcagccagtaaggtgatacaccaggatgtgttcccaggttgtccgctgggctcagtaacacagtctcaactgccctgtgacactgcgtgtctgtgcttgtggggaaggtgaccagaggccccctttcctccacgcggtgagcctaccagcaaggagacagtcctcaggtgtgaggatgagcctcgtagtaggcacagagaaacaggaggaaccttctggaaggtgaagcctcccacggctgggactcttggagaagggcggatctctgtccactcctgcccactccccagcacagacagagcaagcaggacagagggcccaacgtcccaggatactgcagagctcaaaggagggcagagagcatcgccccacatgggcgccgggagaaaggtgggcggggtgctcaggggcccctggccgtcctgaagtttgcctcagagaggtgtgggcttctcctccctcccatacacagtgtctctgaggatgaactgccatgtgcccggcggggatgccgtccctggcccttgctgagtgcctctgggacgaggtcagctgagcctgccatcctaactcagacaccatctcactctccaagtcccttctcggtgagacggggggccttgcacccacctcccagcccccacacacctgagggggtccccgttcccctaccccgtggctccaccacgccccacgcatcctacctgagggacagaggggactgtgagatgccccccacaggctggttttcctctttcacccataacaggcccagcaaattctcacctccagaggccaggtctgccccgcaggtcttaggaaatacagccctacttccatccagcacaccaacccaaggaagtgcctcggagccctggggcccgaggggggcctggccttggtctcacggcggcagctccacctggagaggagtgaactcaagccaggacgccccgtctccacagcggaaaccgtgttgccggctgctccctcctggggactctgggcctgaggttcctgtgggagttggggggatagctgagtcctatggaggtgcccctctcctccccgcccagtggagcttggggtggggacaggcgaagacagggtgagaagcacggggcattccccctccacacagcgctgagaaagtaagggagcatccagaaaacggtgcccacttccgcgtcaggcggatatcacgggcaccagctccaggtgaccctagcccagccagagaacaaggaccaggttgtgccgcaaagcccgtgtccgctccctcccgcctgggaccactgtggcgaggggaagggagcgtggtggccctctcctgactcctgaggcctgaagtccaagctcccggccctcaggcaggccagggtctagacaccgctgccccaaacacaccccccagtccccgcccgcaggcttcctgcaggatcccccagtgcacctgggggctgaggagagtgagcagggcgcaaagaagcttcgtcgggagggcggtccccacccgccttggacccccggggatagtgtcctggggcctgggctcagatgcaccctgggaggaatggtgcggaggctgttttttgctccaagaggacattgcctcagcagagggctgccgagctgggaggacccacagtgcaaggccgcagaaccccctaggaagcctcagagccttcaggttccgggctgaggctgtgggcgtggacccttgtgcaaaccccactggaagaaaaaccttacagctcaggaggaggaggggccccacccgctcccagagcccgtaaacgaggggtggtgcccacatgaggcctggggaagggctggggctgggacaccccctcaccacccccagataccccaggcagcccctccctccacagagagacccactgggcctgaccctgccctgggcacagggtcgagccagggacggcccgtgggagaaagacggcttcatgggccgctggccgggccaggtgcgtccttccccagttctaggtggcaaatggggtggggccagagccttctggctagggaagacactggcctggttggtgtggcaggggcagcgaaggagggtcaaaggccactctggcctggaagagtccccagccacctggacgggggtagccaggcctggtccctgcccccactctccaaggggtcggggcagccgggcagagccagtaagtgtttgttttcagatgacatttgtaaagaaaaacagcctcccacactgcttgaccctgtgtctggaatgtggggaggcaaacagctgtgcccttcccagaccctgcacagcccctggtgggggcagggccctggtgggagcagggcccagaggtacagcctggggaggcaccggccattgtggttggagcgcggcagccaggctctgggctctgttccgggcctcactgtgtccccagtggggtgccgccaccacccccccagcctgggccccgccggtcagacacccgcagggacagcttgtcttggctagctggctacagcacctcgctggagtccagcagacacgcgctcccgtgcgcacgctgcgccccaggccagccctaacgccgctgctcgggtcaggccccccgcctgccgtgggctgctggctgccttggcccgccccagctctctccgcgcccctgcctccagggagccctcctcgaggactccagccacccaagctcagcagggccagcccgagcccctgccccacacagcctgtgtggagggtcctcagccccctgatcccccagaccctcccggcagaggctgggtccctggggcttggggaaagccggctccatggcccctggcctggatgatttcccagaggccggtcccctgccaagtgcctggtgacccttgttcctacctggctgcccatggtcctttgtgcgacccccgcccacagcccaggagctgggcaggagactctgattgggtggcagcagagccatcctagggctgcccctgaccctggccctgaccctgccctggagcctcgtttccaaatcttgcctcatgctttcgccagacccctgtggccccttcccgaccctggagtgcccctggggcttcctggaaagggcctctcctttgctcacagttgggtgccgaacttcaccagcattgaccacccgaaggcgcagggacacccccgcagtccctctcctgggggtcccatcaccaactccccatgggcgggatatcagaagaattctctgcgcaggtgctccgccccttcaggcccagcacttccagggctgcccgagctgaggacctgtgcagagaactcttctacaccccacagaggaggctgaggggtcgaggcggctgcgggagccccagggggccaccacacagccatgcctgcccctctcctcggtgggtgtagaaagctcttaaatggtggaaaaacaagggcatggccacattgcacaggcacagaaggttccagaaggagtgaaacaatggcatggagggagcagagcctgggccggtgggggcacagggatgaggccagtgaaggccacgggttggggggtgccctgaagccaacgaccccatccttatcgcctgtgtctctctgcacacagcgtctcgtctgcaaagttagctgagcaaacgccaggagccaagggtcgaggcaacgatatccgtggggccactccacaccccctctgcctgccccatcaagacctgctttcctggttgaaatccaactcacgatttgcccccgggggcccagcagccctacccaatggagcagctgcacccacattgcccagcttcccaggcggacaggggcttggtgagccttcctgtccccactggagcatggccggagtgattttctgcttctgctgcagatcaccctggtgggagcagctgtaatcgcattatccccagttatgcctccactgggcactggggtagggacaggactgccaggacacgattccatttacctaacgccagtggagccctgggggctctcctaggtccacggggaggggtggccatctctctaggcccagggaccccaggacaggggtagaaaaccacgggagagttaaggagttaaggccagaaggggccagtccggccaagtggggcaaagctgtccaccgttgggcagggcatgactgaggggcggtgtggggaacagctgctcatctcccccaggcccatgcccgtgatgaactgtgtgactacccccaggatcagtcaggaagcttggcccaggagcctgtgcagacctaacagccagctccagccccgaggcagggcagctgtgctccagagggctcccggggccgcactgtccctcccaggtggacaccctcgtggcacgtacgcccctgctctcagccctctccttcactggatggagagactcgggacccgcagaggtgggtggcgggcagaggaggtggagctggtctgagacgcaagacgtggcctgtggattctaggagcaactggtggcttccaaggtcccccacccactccacacatgttcccaaaccccgttttgcagatgaggatggcaggctcagcacaggggcccatgtctctgtcaccaggcaaggtgggggggctctagggccagaatcgctcccacctccagccggggatcagaggtctctggttagcagccgaggcgagcgggacacaggctgagggatggggacagctgctcgcccggcacagacaaggctcccctccccatgctggagaccccggctgccccatcagtcacggcccacccaggaccatgcaatcatcctccacttctcctaatcctcctgccagcttcttcccaagagtccaagcagttggatgcattttctaaattctcaggccactgctgtttcctcctcaaattccttgtcccccacccgtggccccctcccagccatgggaaaggactgctgcggcctccccacaggcctgtgcacgggtggggctgcgtccaggcagctgtgaggtaccggggacccaggggtaagagccccgattacaggggcgtcatgggaaagtggcgaggggaggccacccagggcccccaccacagccccgctccacatcctcccctgatctctggccctggaaagaatcagatgggacccccagcagcagtcacttgagtcccactgccaccggctgtgctgaggatgcccactgggccgtgctgtggccacctggcttgcagtgtgggcaccaaggtatcggcccagattcctacccatcagagcaccagcacagggccgagccagtgccacagagcccctgggctgcagcacgtcctgcacgtcccacagaccggcctgccgggagggaggggtgctgcccagggctcggtgccctcccggaaggggcttcagtggggctgtttgccaggtggtggctctgacgcaggagaggacagatgggcagagcccgagggcagccctggccaggtgcgtacagtggtggctgtgacgccctctcccacgcctgtctctgggtccaggaggagtgatgatctccaggctccagaggactaggaacagcaggcaggctcgctgctgataacggggacttctccacctggtggggagtgatgaggcaagaccggatggcaggccccaggcctctcctctccagggacagccatcatctcctcgcctgtgcaggtctcaatcagtcagtgattacgcaaccagcaaccagcactttattgccggttgtgaagatctggaggacatgcgggtccccggggccacagccttcccgcatgggtcacctggggtgtctacagtcaaggccagtctgacaggtgggatggtgcttcccagcaaccccaccctgaggagaaccctgctgcctctccctgctctccacccccagcacaggccccgggaagcctccagctgatgacgacaccaggacggtgctgagtggaccctggggccagcatcacaaggcacccaggaccccagaccacccagccacaccccaggctacgaggagggggcgctccggcgaggctggggtgccttcaaggtgcatcctagcaacatcctccacctgcaggagggacactcggtcacagcttggggaggatgtgctcagacggcataggaaggatttgctcagaccccatggggaggatttgctcagaccccgtggggaggacttgctcagaccccatggggaggacttgctcagaacccatggggaggacatgctcagaccccgtggggaggacatagaccccgtggggaggacttgctcagaccccgtggggaggacatgctcagaccccatggggaggacttgctcagaccccgtggagaggacatgctcagaccccgtggggaggacatgatcagaccccgtggggaggacttgctcagaccccgtggggaggacatgctcagaccccgtggggaggacttgctcagaccccgtggggaggacttgctcagaccctgtggggaggacatgctcagaacccatggggaggacttgctcagacggcataggaaggatttgctcagaccccatggggaggatttgctcagaccccgtggggaggatttgctcagaccccgtggggaggacatgctcagaccccgtggggaggatttgctcaggccccatggggaggacttgctcagaccccgtggggaggatttgctcagaccccgtggggaggacatgctcagaccccgtggggaggatttgctcagaccccgtggggaggacttgctcagaccccgtggggaggatttgctcagaccccaggcaggcatcatgaatgcgcccagcccggaccccagactggtagctcctaccacacgcggagcagcagaggctggcaagagggactcaggacttgggctggggacagagggccctgcacagctctggggtcctgacccaatcctgcatttccatagagagctgcctgggcacccatgctgagggtccctgcaccccctggtgtatcggagacccttcccccaccccctatcccccgccactgagacacaggaatgtacaggatggctgtgagggcagaggcaggcccagggcgcagcaggcagggctgggcggggctggggatctgcaggaggttggccctggagatgggacatgtctggaccctcggtgtcatcacctctatgttttgaccactgagcaaaattacactaaatgaagcacaaattagccaaggggacagtcgactctgtcctttcttcttaatccctctggctcagggtttcccagcctggacagcctgtccgaggggaaggctgcccaagggcacacgggcatcggtccggggacattcaggcagtgaccaatccctggccaccctggtgtgtgcccggcaatgtgggccttttcccagacagccagtgggggagcggctgctgtgggtccctgagtcttagccagatggtcaaggataggacaatgatggagacccgcatgcggccgcatccatgggtaaaggaggcggaacggaggacagctctgccatcccctcagccagccatgaaaagcaaccctttcccctaaggccccagcaccaccttggaggccaccatgggctggagcccagcacagccaccatcgcatcttggctgtccagctcaggacggccagttccaaggcgtccaggctggagctctgggggcggaagagcacaagctcctgaagagcctctggtccagccctggcagcggagggccaggtgagagcctgttgagggctctgaggactccaggagggactggctgaggacaccggtgggggtaatacctccccctccaatggccgctcgcaggaggcaattcccagagccccgctccatgggccaccaggtacccagagcctcatttagaaatggccatgcctccccacaggcccccgctgggatcctggtgcttcaaatgtcctgctgtggtcccagggaggagcaaaaccccctcccagtcaggaagcatcctcaaccgcatctaattccagatgctacctcccaccttggctttccaggagacggagaacggagccggcccctctccaaggccccgaggcccggcagggcacccctcggagcagataagctcacccctgctcccaggacaagcaagctcctgctgaggctctgctactgctaattggcccttgggataagcagacctgtccaggaaagaaccctctccctgatctcctggccccagccccatccggccgggagttctgacttaagcaaataatcagtccagggaattggaggctcaacagaatcgtcctccaggaatctggtcttcgttcctccaccctcctcctcccgtctccgcccggggtcttgagatcaacagcaaggttttgcactcgtaggggcttcccggagacaccctccagcctcaacccagaggagatgggtgcctgggccgtgacccctcacacaagaggaccaagcccagagaggagacgggaagccatgcgcccggccagctggggtctgcgatggactcagtggggtccagccctcctcactccaaggggagctgggagccgacccggtgagggagggcatcctgggaaagtgacaggaatcagggaatggccctggggctccggacctcctctgatggagtcattcaaggcccttggcagagctgggcatcctctgggccccagggaataaggtcccctcactccaccacagaacagcatctgggcacctacctgttggccatgggcagagcaaaactctctcctggaccccagtgcccagagccctggccttgggagggagctgtgcatcctcaggagcccccccgggctgccccccaccaccctgcaggcagctcaccctcccaccccaccagctgcaggtgcggacacgtgtcttctccttccccaaatgctcgttctgcacctgcttcgggagggcagtcctgcctgctcacagcccagccctgcccgaactcctggccatgtgtggaaacacacgggcgttagaacatggcatcccggttcccttctatgttcaggaagacgacacccatctggctgaggggatggcagagcccctctccccacagccccctctgcagtgcagctctcctttcctctccccgcatgcctcttcccgagggcagccccttctctccatcaggatcgcatgcctcttctcgagggcggccccttctctccatcaggatcacccttcctgggcctccggggtgcaacgggcgggcgctgtttcccccaagccctcccttcctccctcggggtggggccctttcctccaggctcttctccgtctcctggtctctgccatctcccaaaacccattctatttctccacatgtctacctcgtcccccatccgtctccattctcctagtctcccgcctgccagcccggccctggcaccagccacttggcagcctcctcctcctcctcccagaaccttctctttccttcctggtcccatctcaaactgcagcaagctggtcgaaaggtgagaccaggctgggaggagctgtgggccacggagatggtggccgggggaggtatgggaggtgggagggcaggcgggccaggtggggagcagggcatcttgccatgggaagggctggaggaaacaccgcatccagggatggccagagctcgcctggagcccctgaaggtcttgcttttagagccgggtggggctgctgtgtggccaagccgggcgagtggccccatccccgggtcctgggctcctggcgtctgccctggagcccaccatgttgcagtactgtgtggccgtccattgctgctctcttcactgtatgaccgggggttccctctgtgcccctcaaagccccaacttgcctggactttgggtctgcagctggcgcatgggaatcttcccacatggcagcgtagggtgactatggagccgaccaaggctgccaaggtcttacttgagtagaagacgtccatcctgagcgatcctgttggccggtcctccggatccagccttcctgggaatgcggccacccacaggactccaagcgggtctggggtccctggtcccccaggttgaccaccccttgctgcagctgctccggaaacagagggtgctgccctggccattttgctccttgctgggtgtctgggagggctgcgaggggaggaagaagggcagggagaggtgagagacccgagagaagggggaaggagtctcaaaggaggggagggacggccggccagcactgtggcgcagtgtgcaggaggggaacatggcggtgcccggcacgaggtggggtgcggggcagccctggagccctggctgcctctcccagcagtgggtccggcactagctagccagctgagcttgctgtgtttggagtctgcagaaagtgctgccccgccaagccccacaggccaagccaggcccgagggacaggaaggagcatggggccttcactcactgcccagcccggggcacggccggcccatctcccatttccagggcatccggggacgggcacgccccggatacttactgccctgtcactggaggttagcatcctccctcgtccggtgccctgcccaggtggctgttacctcccctacctcctccaagaccctgagcagggggagaaagaaagtggacagaggcacccgacctcctgacctgagtgtggtccccgctttgttcccccttcctctgcccccagttctcactgcgaaggaggagagggctcacctggggtggccccacgtgcctgccagccttggtccaagactgcagagaagggtccctgaggaggtggggaggaacccagaggcagatcctgagggtcttccctgaaagaggagggctggtgggcagcaggaagatccgggattgtgccctcagctgccctctctgtcctgacgtgtcacccgctaagggtcatgggccaaggagggaacgggcaatgtctgggagccatagagttgggatggcccggccaggctgggtgtggggtctgttggggatcccaggtgaggggaaggaattgggagtggacctgggcccgaggcaggttgggtggctggtgcaaggcagagggctggccccgggggcattctgtcctggttcctctgtcccctcacccagttcgtgagcatccctcgtggagcaggccccagggagatcacgggcggcgggtgggcagatggagtgcaatatcccccaaggaaagtgtgttgtgaggtggtggagggcagggccggagaggccccagctgtggagcaggacgctggagggctcagggcagccgagccagggcccggggcagccgcaaagtggcactgtgttcttttgggccggaccagagcccaggcagtgtcaggaggtggatggtgtggaagagagaggagttccaggggcgcactggggggccctctgtgtggctggaaggtggaggggcgctgggtggaagggctggcttcgggctggcggcttgggctaaggcaggcttgcaggggctggctcctgaacccacgcatggcgagaagtatgggctggagcggccacagcattggggaaagacagatgggagggctggacaggaagcagggctgtggccaggccggggccccgggaggacagggacgagtggtggacgtgagggtgcagaggagcaaagtccaggacttggcccggatcgggatgctcaggaggctggggatgctcggaggaaagcaatgggggagcccggctgcctgccccacccctgccaccctcagctccttctgcccgccaggactcccaggctccatcaggtgccgcagcaccctggctgcgacataacgaggtgggacagggtcagcaaggtgacttctcgtgccccagtgtttgcaaatccccaaaatgacccaacagacaagctcgaggctggattttccaagagggccccttcaagtaccaaaggacacaaagagcaggcccttctgagtctgcggcccacagatggcaacacgggccccggaccccaggaccaccttgggcacagagcggctgggcccaggaggctggcctctcccggggatcccacggctggcctgcggggctgcagcaaacacgtgcagggctttccagagccccgcacagaacaaagaacaaaatggggagagcagggcctgggctgaacggaccacgggcgggtgggcggaggggcacagcggcatggcacccactgccaggccgagggcagctgcagggggctgggctggagcagacccggggtgggggtgggggctggaggaggctctcacggccggaatcaataactcacactgggggagggcgggagacgcttgtggcggagcggggagggggtgccggacagggtgtccctccacccccaagttcaaagttttatggcgagcaggcttgacttcctcccgcgtccctcctctccaggtgttatttgaaaaaaatacttttcaaactacatgctgaaaacttcagcatgaaaatttaatgtcagaaactctgtaatctctttcccagagataagacccagcccctcgaggaggggcgaactcgatccctctaacacagaaagcagacgccaggccgggaaggcaggggcctggcggcctcactgggggaggctcaggctcacgctccctccctccctcccacccgcggctgggagggggtgactgagagaggccctgcagggctggagctgcagggctggggcgaggggtccggcaggaggggccgtcctagtgcagcctgcaggcttcgggccttcgggaagcacatcctgccgctctcccgcgtgcaccccgctccccggaacttggagtgggtgccgctgctgccaaggctcgggtttccatgacggctgaggcccctggccctctcactcagaccctaacttaggcctcgctgagggctcaggttgtggacagctaagctggggaaggacaacgtggccaccaccgcccacggcctttctgaccggcagcgccgccctgggttgggtggcgggggcgtcctgcacacacgactcctgaggtcaagcctgggtgtgggggtcttggactctgagctgccaggcccgccgggtcctggcctcagggagaggggaacggagctgccacacacccggctcttgactcgatttctctgtgggggacagacataacttctccaagctgtttccaacagcccccaccctgaagacggcctccacctcagacatcagacaacgccccgagccccccctgcccagggccgggagggcaggctgcccggaaggagggtggggctgcccgggggctgggtgtgcgctccagacctgtgttctgggactgcattccgggggagggggtggtgggaaggcgccatgtggagcaaaccggctgggctgggggcaggaggccccccaagcggggagagggaggcgtccgaccgaccgcactgctctgctgcccccaccaggcaggccgaggccggcatccccggagaccgggacctggtggcccagcccagcactcctgaatgagcctgaggcccccgtgtcctgagaggcagggggctccctcctttgtagcggaaggagacagaggcctcctaaaggggccggacgcctgcccaaggcgctagtcgcctggaagctcccagaatgtgggtgtgggagaggccaaactgctttctccccaaaccccaaaatcctgggtgaccctgaacccgggcctgggcacttggccctgtctgcccaagccccctaccggcccccccatgtgctttgcgtggtccgagcccagcgggtggggcagggctggcttgaggctgccgagagggtttctccccaaccgtcctgccccctccaggggacatgcagagccagactggtctgttgtcctgtgtttgcctgcctctcccggtgttgccgtggtgatgacacaccaggcatggctgggaggggtcatacctcaggcagaccaagagtcctgcgtgtccaccacagacggcaccccctcaggatgcccacgccctggcccccggctcccaggccttgtcgagaatgttccatgagcctgacggacaggcacgaggtccagcgtgtgaggcccaggccgctgctccggcgcctgcccttgcatccccacagcaccccgcccagccaccctatctgtcctcggggtccccccagccgtctcaggtccaggctgctgggtgtgagaagcgccctgggtttctgctgtgtccctgccccctgacgaggagcgcttctcttcctgcacccacagccccacacagcccctccacgccccagggtcccccagccaacccagcgtcctatctgctgcttgcagctgagcctgcggcgggggaccccaggcaaatatgaggaagcctgggcagaaggtggcccctgcagaagctgctgcccacgtgcccccgccccatgctgccaggagaggctcggacctcaacaacttgggagtggcagaaatggtctctgcatgaccagtgcggccccttcttagccccttcctggggcttccggagggcctagcagcttccctggctgggggctgaggggcctccgggcggcgactcttggaaaagcctgaggtcagaagagttcagaaacggccgtgctggctgggtcctcttgactgatgtggacaactgtgtcccatctccctgagctatttctgttttcgcaggagtcaggggagggctggaactccggcttcccggcatcccggcgggcaaccagataccctcagataaagggcattcctgcaggccttcatcacgctccccgggcagctgctggcccctcaccctgcacaagtgggcacgtcctccctgagccccgagggaggctcggaacacatagtttccctgttatgtaccagctgaggggcccggtggatttagctggggtgaggcccaggggcccaggcgagcaggggatgttctcgtagggaggacagggctgagatgggaagagcagctggtcctaagccccacagggcccccccacagggtcccctcagggccccgagcctgggttttattttgggaggcaccttctagagtgtaagctgcctcatcccgcgggcacgcgtggggtcgcccaggacctaggggatccttcagccggctgtccagctccgggactctgggttcccgggaacccttgggggctgatgttctgagcatgtttgctccgcagtgttctcagccacacctgcaccctagcaggatgccagagggcttttcccagacttcagagctgaggcccgggcctggcgggcgccccctcctccagcaggacgggaaccaaccattcactcaagccacgagcaccccacgggctgccctgaagagctgttgggaggagagggtccatgatcccaggctctgaagacctctgtgcccagcagcggggcctctggagggtgaggagggatgcgtatcaggagcagtccattgccggctggtggggtttgttttgttaaaccgaaagaaaaacagcagcagcagcacagagccccggggcagctgacctcctgaagccaggcagggtgcctgggcagggccccaaaaccacagaggagccccagccagccctctggggagcagggtcaggcaccccgacagagggtgaccaggacacacgacccggcggccctgcagccccccagcacctcctcactggggaccagcctgtcggcaggaggcagccctgggggtcggggacacagtcccaaggaaggctaggacctggaacgctccttaaggggtgagacacccctggggggcagagctaggccctgaccagggtggggactgcggaggagctgagctggctccaatcggtgcatggctggctgtctaggggcagcacagagggaggtcccatcccaggccagcagtggcaatgccatctctgaaaaacggtccgtgccatgaggcctgagcctccggtgcccttgcctggcatgctctgccacaccgtggccgcgtgagggacagacagcgcgggacagaatcccacctggcagggaggtggcaggcttgccatgtgccagcaggcaccgggggaggaggggctgggtatcgggggcggggaccctcagggcgaagctcgatgttaggcgggcttcttctggagggccgtgtctcctgggcaagcattatcatctccacgttttattttattatattattatttatgtatttattgaaacagagtcttgctctgtcacccagggtggagtgcagtggtgcaacctccaccttccaggttcaagtgattctcctacctcagcctcccgagtagctgggattacaggcgcccaccaccacacctggctaatttttgtatttttagtagagacagggtttctccatgttggccaggctggtctcgaactcttggactcaagtgatccacccacctcagcctcccaaagtgctgggattacaggcatgagccactgcatctggcctcgtctccacattttagacaaatcaagacaaagtgacagccaggggcctcaggcttgcaaggcagcagctcaaagtggaaacccggactcctggcccctcacccaggccgcacacccacagccaggcctccctcccagaagccgccaccaggcctgctccggggccccagcttcctgtgctcccggtccaggcggtggccattgtctgccagccattaggaaccagctgggggaagtgccatgccccagcccctgggcagcccatgtgtccctcctacacccgcgggcagggccctcgagtcccaggtcccagtggccagccatcggtcctctcactaaccgcaggatggccactgaaggccagaagggtgggggccttgggggctacccgaaaatctctcccaccatggcccaggcccatgggcgttctgtggctccagcctgtggctcggggtgggcggttggggggctgggttttctgaccccggtggtggtgaatgaacagcagagccccatctacgcccccggcctgccggctcgctggccttcctaatgagcgtgtgtttccagagccctttgatctggggctttaatgaccatcccctaccgaggagccaccaatcaatgggtccgccccctccccagtgtgtgcacaaccaaagccgggcttatccaggccccctgaccggcagccctgaggctgagggctcccactcccgcccggggtcaccaggatgttctcaggtggcattccaggtgggacgagcccagctcctcctcaatgcctcgatgcccacggccaggcccagctgccctggggtcatctgggcacctcctggcccatgatgggggagggagtggccgagctgtgctggctcccaccttcgggcaccggggggtctgctcggaacatggaaagaagacaagacatggcctcagctctgactcagggcatgggagcagcctgcgcttcacacggtcggtcccccactctgcttggggggccctcctcccgagctccatcctgggtgggccagggccctctccccgtggggtctccaagccccaacactcggcccgcagtgttcggcgggtgtgccatccatactgtcctgctggcagaagccgtgccctccgctggccctgaggagaccgctgctgctgttcccgccactggggacaccctgactaccaagcgtagttaacaaagtggggggcgcaacaggctgtgtctccaatgtggcgatggggggacccacgctgtccctgccgacggggaggcgagggccgcagggcaaggcgggagccccagcggggactgcaggggtccagctctttggggccacccttcccccagggcacccctcactcgcgcccacgcacgcgcagacgggaaatgagacctgcgaggccgggctcggccctccccctctctggcagcaggcatggggttttatgagtgctacaaatcagatatcacacagtttggggctgacatggtttttgcaagaattatttaaggccctggccgccggtaaagtcccagggagaacggggcagggcgcacccagctgctggggccgtcggaattccaaacacttcgtaaagctaaggtatgagccgcgagcaccttgttctgtttaacaggctgcttcacccctgccctgggccgcgcgagggctgccgggaacacctcccccaggccaggaggagggggccgcctgcagctgggaaagctggggcctgcctgggcggccctggctccaggctgagaagctgagagggagtgagttgaagggttggccccgctagcatctcctcccaaccccgaagcactgcccagggtcctgctgtcaaccccacacacggggcctgagccgctcctggtggtctcctgtgctccatcctgggcccggctcgctcctcctggggtctgtggcaaactctcgcaggccgggaccatgcccagtgcccacgcgccgggagcacggcggtgtcctcgcctggaatgggcctcactcggcatctgtgactggtcagttctgccggccgagcctgctgctaactgggccgtgtcacgggctcaggctgtcctctggctacttccctgctacttcccttcagtgggcccaggccaaggcggggagcgcagatgtgcccaatgtcaccactgccggaggagggacggccatgtgggtggcccggggcaccccaggtacaccccaggaagctgctcatgggtacccattggtgaggagggtgcagggggaggcacacgccaattcatcaacctcagggatgcgttcaggtttctatcctgggatatttgagcacttccataattatccaaataccagtggcgtctcgtactgacagacaatggcacccttccttctgcgatcagtgctaaaacccacgacactgtcatcacgcagagtgctgagcaaccgcgctgagaatacgggacgcacggacacgaagccctcccagtgaacctgtgggaaggaggcgagcagcatcgcgtgaccgggactggcccggctaagggggctctgcagagcagggccatgggctccccaatctggaggggaggctgctcactcattacctggcctctccacccactgagtgccctgaaccaggcctctgcctcaggggtgccctcaggggaactcagaggactgtgcaaaggtgggcttcgagtccctgacgctgcgtggagggcctctgccgtgcggatgccaggcaggaaggagtggagaagcaggaaggggcgttactgtcggacccaacgggcccatccctttccagcccccaacttccctggggtgacggggcctggacctgtggacccctgtctctgcgggaaatgtttgctgcaggtcccacggctgcaccctcctgggacaggctgcggaccctgcacatctgagcttctatgaattccatgtagaattccatgggatttctggaatcttctgtctcatgtctctcagtgagggaggatggcaaagaacgtcagagggaaggatggggtagcggctctgtcctgggcctgagggacgtctctgaaggccagcgcccccagcctcccaccatgggcgccccagagcaggggtcactctagccatggggtgagccccctagggtctcagctttgcagagctgggcccaggccaaggcaaggagtgcagatgtgagggggagaacggtggggggtctcccaccctctcgcagagctggctttgtgcagggagaatgcaggcctggccggccctccccattggacacagcgtcagggccccagcgtccacggaggccagggccaatcaaagccagatgtcggagaaacaagaaaagctgactattttgactagaaaaagccctatttacaaagaaataatgaag

SEQ ID NO: 3943 - DNA, 828 bp, Homo sapiens
attaagcctcagctccagctctctgtattgcactcactagtcatcaggttggaaggtcctgggttcctgtgtcctgttgggcaaccgcatgatagaactttaatgctacttcctggcatagcaggagatgaaagagcagggggaagaaacatcaatctaaccacgaattttatttccttgtgtttctgatgctaaaaatggagaggaagtcaaactagacaagagggaagtctccatgaagtgtggaaaacaagctccttgattgtggatgtgcagagctgcctgttgagtctgaggagtctggcatgtgacacactgcagacctgagacaagaagccttgttgctatgggtgacttttagtgacctataaattttgcaggcgcgccacggcactctattattgctttctttctctgagtcactaattagatcctgatgatttccatgtgaaaccatgaggactgggagatgcaaaatggttttgctgtgtagattcatgaatgctggactgttggaggatatctgagtgtgctttgcatacttggcttaatttgtttttttttaactaaaagtagttgtaggtgaaatgattacttaggtaattgttttggtaaatggcttgaagttgaaccacagcagttttgctatttggaaaaaaaatgaaaaaaataccattctaatttcagtttatttggtttactgacccagttttggctaggggttattgaatctagtgagaattattttaagcaccccccaaagaaggaaagatatgaagtcaagagaaggataattatattgtaaaaataaaaatttaatgatgttta

SEQ ID NO: 3944 - DNA, 3372 bp, Homo sapiens
gcagtcctctgcaagcacacttaatgtataaaaaagcagccgggcgctgtgactcacgcctgtaatcccaacactttgggaggccgaggtgggcggatcacttgaggtcaggagttctacatcagcctggccaacatggtgaaaccccttctctactaaaaatacaaagatcagctgagggtggtggcgcgtgcctgtaatcccagctactcaggaggctgaggcaggaggatcgcttgaacccaggaggtggaggttgcagtgagcccagatctcgccacttcactccagcctgggcaacagagactccgtccaaaaaaaagcctgcatataatctgggcttacaagcaccaaggacattcctgcagattaccctcagacactggagggagccggaagtacctcggagttttatgtttcacctcgttccacaaccctggatagccaaagacaggctgatgaagagcaccaaagcccagctcctttgtgttgaggcaggaaaaactctgaggtgtgttctttgttctaaagcttcccgtgtgatcaggctgagtgtaggacttcggaaatcatgctctcgcttggcttcttcccattccctgtccttcatcccccactcctttactgttcttttcctaggagccccccacttttttttttttgaaacagagtttcactcttcttgcccgggctggagtgcaatggcacggtctcgaagagccctttcttaacaagtcatttgcatccaaatctttggctcagggcctgcttttgcaagactccacctaagacactcgctgactcttcagatgatgaaaatggcatgcacacttgcagacagctaaggattctgtcttcgtctttctgttgctatagcagaatacctgagatcaggtaatatacaaaaaaaagaggccaggtgaggtggctcatgcctgtaatcccatctttttgggaggccgaagactggaggatctcttgaggccaggagtttgagaccagccttggcaacatagtaagaatctgtctctacaaaaagtttttaaaaactagcgatgcggccgggcgcagtggttcatgcctgtaatcccagcactttgggaggccaagatgggtggatcatgaggtcaggagatcgagaccatcctggctaacacggtgaaaccctgtctctactaaaaatacaaaaaattaacctggcgtggtggcaggcacctgtagtcccagctacttgggaggctgaggcaggagaatggtgtgaacccaggaggcagaggttgcagtgagccgagatcgcaccactgcactccagcctgggtgacctagcaagactccatctcaaaaaaaaaaaaaaaaattagtgatgcatgggggtgtgcatctgtaagccccgctactcaggatgctgaagcagcaggatcacttgagcccaagagtttgaggctgcaatggcacaatggcagagcaagatcctatctcaaaaaaaagaaaggaagaaaaatgtatggaagaggctgagaagttcaacattgaggggctgtatctggtttgctttgggtgagggctttgttccgcatcataacatgggtaaagatatcagagaggcatcataacatggctaaagataaagatttagaggggcacaagagaaagagcgaaactggcttttataacagacccattctcaggataacccattaatccattaatccattcatgaaggagccctcatgacccagtcacctcttaaatgccctacttcttaatactgttatattgaggattaactttcttttctttgcctcattattttttattttttaatttaatttattttagatagatagatagatagatagatacatagatacatagatacatagatacatagatagacagatatgaggtctcactatattgcccagactgctcttaaactcctcctgggttcaaacaatcctcctgcctccgccttccaagtagctgggaccacaggtgtgtgctaccacacccagctaatttttgtttgtttgattttgtagagaggaggactcactatgttgcccaggctggtctcaaactcctgggctcatgcgatcctccagtctcagcctcccaaaatgctgggattagaagtgtgagccactgtgcccagccaggattaagtttcaacatgaatttcagaagggacaaacattcgagccataataaatgacgagaaaaccacttcaactatgctgtgtcattcagtggcagcaaaagtcctctcagtttttctaagtgaaaacagtaaaaagaggaagtgcctgtaatcccagcactttgggaggccaaggcgagcagatcacgaggtcaggagtttgagaccagcctggccagcatggtgaaaccccatctctaccaaaaacacacacataaaaaaattagtcaggcatggtggtgcatgcctgtattcccagctactcgggaggctgaggcaggagaatcacttgaacccaggaagcagaggttgcagtgagccgagattgcgccactgcactccagcctaggcgatacagtgagactctgtctaaagaaaaaaaaaaaaaaaaaaaaagaggaagtggtccatgtggtccgtgggggaggggaagcctgcacatcattgcaggcttcacttgggcctgtgtgtcttaccaaagacatagataacgcttcagtttcttaggctttttaatcacctatgttgtggaggaccaaagatgtctaataattgcatccaactaatgacaggagatatatagagtttagtgcatagtaagtgctttaatatatgctcgactgttattttaattgtatttatcagtttttttttctgttaggccttcttgtagctctccaaagtaccagaataatttctatgcacaaacttttcaatcaaggtaatcacagatgttttattatttattttgcgttatctagaacccaaatattagccttcaatttttttcctataggtctagactccagggaaagacaatgccaatttttccccctaaaactttgatggctacatcacagacaaaatatttttttattataggaaatggctgagtgtggtggctctgtaatcccagcactttgagaggcgagactggaggatcgcttgaacccaagagttcaagaccagccagggaaacatagtgagacccccatctctacaaaaaaatacacaaaaaaaattagccaggaatgggtggtgcacacctgtggtctcagctacttgggaggctgagatgggaggattgcttgagtccaagaggctgaggctgcagtgagccaagattgtgcctctgcacacaagcctgggtgacagggtaataccctgtctca

SEQ ID NO: 3945 - DNA, 736 bp, Homo sapiens
aggaggtgagcggtgtcgagtgagggagtgagggaagcttcgtctgtatttacagccactcccctttgctcacattcccgcctgagctccaccttctcagatgagcagcagcattagatgctcataggagaacgcaccctgttgtgaactgtgcatgtgagggatctgggttgcgctgtccttatgagagtctaatacctattgatctgtcactttctcccatcacgctcaggtgggaacatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacaccca

SEQ ID NO: 3946 - DNA, 887 bp, Homo sapiens
atattttcttcctgtcaagagttatttacatatgtacagtatttcagttaaaaatataacaccataaactatattttataggaaatcataagggaaggaaatatgcaggtctattaaagacttaagagcttctaataaactactttacttggagagggttggggggacttcagatcatacagtctgccatggagaaaagaacttgctggcagacagcctgatggttcagaggctccagtgcccagttagccacctggtctgcaatctttccacagacttactgatcaggcttgatcaggatggcccagccatccagaaaaagcccccatcaggttcagtcccttcggggtacagatggaaaaggcgtcaatcactgagtgcacagtatgaaaggttccaaaatctcccccagctggtataatacaatcagttccccttcaagttatggtaagccatatgtgccaagcatgaaataatcagattgcaactcatcacggaagtagttaattctgtttttctagtacagcagtgtctatgatattccgccgctttggttctagggctgcaaaaaaggaaacatcttggtcccggtctgactgcaatgctaagatggtctcttcaatgacttcaagatgagggttaccagcatttctaaaatacgctaaagagagaaaccatgagtctgaatcagcatctgccttagggccttggctagcagaaccctcacgttgggcacaggatctgatgcgaggctcaggaggctgggaagcaggtgctccatgaactggtccacggggacacactccttgctcaccactgcctgctccaagaaagtcacagccaaagaaatgatgttttccgcagtcttctagaaacatacacttctt

SEQ ID NO: 3947 - DNA, 297 bp, Homo sapiens
gccaggcacagttgtacgtacctatagtcccagatattctggaggctaaggcagaagaatcacttgagccccggagttcagggctatagtgtgctacgttgatctggtgttcacgctaagttctgcatcaatatggtgacttcctgggagtgggggaccatcaggttgcccaagtaggggtgaacctgcctaggttggaaatagagctggttaaaactcctgtgctcctcagtagtagaattgcacctgtgaatagccactgctctccagcatgggcaacataacaagaccctgcct

SEQ ID NO: 3948 - DNA, 716 bp, Homo sapiens
gtaagcagggctcgagctcgccccttgggcgcggcggcagcgctgcctccctcccatggggtcctggctcttccgcgtcgtccccggggtaacggccccggcccgccctgttgtggggactgcgagcctcaggagccgccgggaagcctgaggaagctgaggcagggggctgggcgggtgagggtccggggagtccggggcgatggccctggccctgccggcccggctgatacctctcggcctaatgcacctgacaccccgggggacgtctctgcaccttgctgggcccgggggcacccctgggagggagacaccccagtaccctgcaaagggcgtagggtgttgcccggcctcgggtccacaacctacccctgctaacacccctactgtgtacacctaatgctgagtctgcgacatcgcccgtgacattctgccagacgatggcccctgtgcttaggcccgatttaagggttagccacaatgataatattgccagtaacagggcatgtttttctctgtgtcaagcgctttaagttctctctgaattgccgcaactctgggagccaggtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccac

SEQ ID NO: 3949 - DNA, 2523 bp, Homo sapiens
tttctctccctctgagatctttccttaccaaccccagcctcccaacccgggtgtcctaggtgggaccagggacgatccttcggagttggtcaaggaggcgtcggaacagcaggcatttgcccttctagttggcagcagcgatgagccgcgtgctccatgctcagggcaggggcagccgcccggggaaggggcgcccgatacaccgctcaccgctcagccccgcgtctccctccggggtcctttacctccatgtccttcaggaaaccactatctatccatctatccatctatcttctgtatacgagtagaaggaggaggaggaggaggaaaatcaggaatccacgcaaagttttccaagctccctgaagtggtaaatcttttcttcaaaccttgctttgactgatgcattcggttttgtgggaattttggctcccacaagctgcttgctaaagggcctcgtctccattcctgttaaatatagcaaagggcaagatgctcaacatctgattcccatagggcccagcatagcaaccttcctttagggccatcccggctgggcagcagagaccgcatgggagggattcggggactggaatctgcaccagggtcactccctgctacccggatcccggcccccttcagacccttcggcagagagaaacaggaaaatgccttgagagacctgtgagtgccagggtattggctgggtatatgacgcctctgggttatcccacagcattctcacccgcccaaccccagctcaaccaggggaggggagccccatcagaggtgggcaatgggacaggtgatggtgagcactgtgaagagacatgtggagaaacagtagagaaaaaaggctgagagtctgctcctgctacaaagactaccctgattctggttatcccggcaccatctttgcactttcaggcacttagattgctgctttgggtaccagtcttagaaatatggcctccttcctgtcctagaactttctaaggcccaactttctaaaacactggcagccctaatgccagagtggcttctagttctttagcttagctaagcatagaggaagacgcctggttttaggaacagacagattgagggctgaattccagctctgctactttctagttgtattttttagacaagtcacttaactgctctgattctcattttcctcacctatacaatgtagtaggcactctgcaaaaagtggctgtttttatcatgcttagccccatgtacaagcttcagatgaataagagcctgatatttcttttatttagagacaggcactcggggacccagtgaaaagagccctcactcccaggaattaatagtgaggcccctcccagtccagccacatggctgctcaggtgaagactcgagagcagagtcggcagtaaggaagggtatttactggtaacctgcaaggcacacttttgctcgtgcttctttcctttctttttaaaggtgcaggacgtagtgatgactgcatagtctactatcaggtcttctaactctgctccacagggccttttcctttctccctctacctagtcctcctttgtgctcagaatggggctgccccagcacaggtttctggcttcacaaacaggagggcggaagtgcttacccagaggaaaccgttaggcctagataacatcagtcacccaaggtgacttgcagctgctccccacgccctgcttaggcctctcttggctgagaacagatgaccacaaagcaaacaagcttggcctccaccatgctcctgggtccccagtgcagagtttaatgctgctccagagctatttgggccccagactgggacttctcctgagggagggggtggaaaacggggagggagggaccaagaggtagccccgagctgtgtttaggcagccatgagtaggtgtggtgtgtgtactccccttatcttcttcttctgtccctacagaagatctccaggagccagaatagcagtaactctgctgataaacacccaggtttgctgggttatctgggattgtaactggctgctctgggggctgggaggaaacaacagcccaaggggaagggaaagtgactttccgaggagttggttcccctctctctctggaggtctggctggctaacacggaaccacttccttcagtctaccctgggccttccccttcatatatcctgatagccagaaccagccacgcaataagtagaggtcatcaggtaactaacaataaaaacaccaggctgggctcatgcctgtaatcccagaactttgggaggtgaggcaggtggatcacaaggtcaggagttagggaccagcctggccaacatagtgaaaccccatctctactaaaaaaatacaaaaattagctgggcatggtggcgtgtgcctgtaatctcagctacgcgggaggctgaggcagaagaattgcttgaacctggggggcagaggttgcagtgagccaaattcttgccactgcactccagcctgggtgacagagccaagactccgac

SEQ ID NO: 3950 - DNA, 351 bp, Homo sapiens
ggcggcggctgctgctagggagtcgacttctctccggtggcgactccgctttttctctccggtcgcggcctcttctcgcttccctcaggcgacggcggcagcggcgggctcgacctcgggccccagaatgcaccgcgcggaaagagcggctcctccggtcggggagaagaggaaagtgtaggaaaaggggcgcgaggacggagaatgaacgtgcgtgcgtgcaaacgaggggtggtgaggccgggcggcggctggtgacgcagcaaaatgcccgggccttgccgccgcgcgtgcgcagtccttgtttttgggctccggcgcggctttctagagatatctacggaaagggcg

SEQ ID NO: 3951 - DNA, 1220 bp, Homo sapiens
gccacacagagacgtctaggtcatgcaggaggcgcccggccccggcccgctcccgccgccccagacccctcctctcatccgacagaaagacagacaagaagggttcccgacctgtcgtgccctgcatgttcagagtctgtcatgtttggtcaagaacggggcggggctggagggcaggtctgcgaggccggcggcggcggggcgcggggaagaccccccgcgccgcctgcgggaacctgctcccggccgccgccgacaggtgacgaagtggtaaaaactcacggttactagtgagcgacacagacacagactttccagtctattaacaaccacgccagagagatggggctctaactgcaaacactgggcaacggccccgcgctgccggcgctgccgctctagtctctattcgccgccggtggctgtggcgtgggagcgggcgggcggcgtgcagcgacgcggggatttggacagtggccgtaacggtgatttctcctcaccaacatggcggcacccgaaacaggcggctcgagaaaatggcgccggccgcaacaccttgcccgggactaaagggcaagagagattcctccgcgagccgcggcccttgcccagcccgccggggccgagcgcgttgaccattggaggagagtgcccgtcaatcacctgcaggggcgggtcttcgcccttctctgtgcagcggcggaggcggcagcctagtggcggggccgggcggcgagagacgcggccggatggctcctcgagtgtctgcaggagggggaggcagcccacgggacctacgagggccaccagcgcttctgctcccggcgcagtacgggccgcggtttttcctgcgagacgcccgccgcccgaggagttccagacgcaccaagcaaacgggccccaaaaccgttagccgaggcgggcaggggtgggataacaaagaacaaggcggctgtagagtccttaaatttttttgtgaaaacctttgttcttgtaataatagggaaatgcagtttctccttcacagttgtagcaagtatctgtttttgtaacgtttagtgttcagaatcatgttttaaggaaaatagcttgccatgcagttttttcttgtatttgctgttaaatttacccaattattacttaaataggaatagctattgaaataattatataaacgttactttatttcgtaataatattaacatgtaaaatgtatgcga

SEQ ID NO: 3952 - DNA, 565 bp, Homo sapiens
agtgccaacgaggaccaggagatggaactagaagcattacgctctatttatgaaggagatgaaagtttccgggaattaagttcagtttcttttcaatataggataggtgaaaatggtgatcccaaagccttcttaatagagatttcctggacagaaacatatccccaaacacctccaattctatctatgaacgctttttttttaacaacaccgtatcatcagctgtaaagcagagtatattagccaagttacaggaagcagtagaagctaatcttggaaccgctatgacctgtacattgtttgaatatgccaaagacaataagagcagttcatggagaatcacaatcccattaattccacaacatcgataagcaatatcatctcaattgaaactcctaatacagccccatcaagtaagaaaaaagacaaaaaagaataactttcaaaagcccagaagcgtaagctggcagacaaaacagatcacaaaggagaacttcctcgaggctggaactgggttgatgttgtgaagcatttaagcaaaactggctctaaggatgatgagtag

SEQ ID NO: 3953 - DNA, 2692 bp, Homo sapiens
ccgggccgggccggggcggggtctcgggcaggggcggggagcttaccgacctcccgcccccgctgcgcgcgtttctggccctgccagtgtctccgccggttgaaagcgcgtgtctgcgtcgggttctgttggagtgcgttcggtgcgccgtgggtccgcgctgcttccacccaacttcctgttagtttctctcctgtcacaatggcatgatctcggctcactgcgacctctgcttcctgggttcaaggattctcctgcctcagcctcccaagtagctgggattacaggaatctcaccagtgacacgcgtttgtgaaaagctgtgaatattcagtgccacagggttaaacctcggtacagaagcgagaccctgctgggcagagaaagggtgacctggaaggtgtgtgagggccccgcccatgggcccctgtgatggtcatggcctcaagaatcacagtccaggtgaggccctgaatatccacagccaggaccagttccctctgctcttgggtgccaaggccaccgtcagccaggagaggcctgcagaatcagcctgtgcacctctctgacgataagcagagatgctggtttagagacttgctactcacggggaagtccttgggcctcctgtactcacattacctggaacttcttggaaattcagaatctcaggccccaacccagacggactgaatcaaaatcttcattgtggtaagaccctcggtgacacacaggcctgggaagcacaggttagcgtgtcaccttgggcaaagctctcagcattgtgagcctctgttttctactctgtaaaggaggcatgaatatctacaacatcagtttgccatgagtattgaaaaataatgtcttagaagcacagggcagagcctggcatgtagtttgtgctcagtgcacagcagacaagaaaccacatgcaccagacctgggcggccgtcggcagcccaccctgagcaaccatgggtggccctcttgtctctcgggacaagaaatgcttctttagaaatgcttctttcctttctaaaatgaaagttttggacagtatttcctttcatttaaaaatttcatctgtgtatttgatggcctctgttgtttctttcctgaaactcctgctaacatactgggagctgaagaagggctccgtgaaggcgagtaggggtgcctgtccctcccagggaggagcttccctcctctcacctgctgcacgagccctagtgcttcaccaactccagcctcagtgccctgacactgggggagggaaaggaagcgcacgcaccagccgttccacccaccgaagttgtttggtcccaatctgcaaaatcagttaaacgtcttcctgcctggcagcagatcaaagggtgaggggtctgggacagacagagacggctagagaatggatggtgaagtgctcagaggccctgtgggctatcccacactcggcggaagacagcaacaccatcaaatctccaccctttgttatccatgacttaaagaaaagtgaacagggaggtggacaactgtgcaaagactggctggagtcaaatcctgggcataggtgaagcatcgagaatgcttgtcacacgtttgaatgtgcagggggactctgactggaagctcctagcagaggctgaagacactggttaggtcctggtgcgtgccttgggatgcatcccaggcaacgggcccaggagcttgaggtcatgtccacctggctcaccagggagtcctgcaccattcttcaaacctaactggaagagacactgatccttcctcccacctaagggctcccagagccacaggtctccgactctcctgcaacacctcctgctgcctgttcccaccgcccatgattcactcagtcaccatcctcagcagcacccgacagcctctgtgtgtctgtgtcactcaccattaccagccccctgggtgcccaatgcatgtatgttagacagaacaaatgcacggcggccttcagcagcaccgaccgcgtcaacccctctgtgctcacaccaggagtgatcagcgcacacgccctcccacaggatgggagaaggtgataacagctgagctgggtgtccagaagccagccccaccccacagccactactgagaggttatgagatcatggccttatcccgagtaatgctgctgcagtgaactgggacttttttcctctgaattcaaaggtggggcagtctaggcacctggatgcaccatctgctctgtcccggcctggtggctgctcactgtgggatgctgtgcaattagacagttactatctttccctggttgacggattagagtttcccttttctgagcatcttgttttgaagtgatccgaagtgtttagggttaaagagcgtgattttcccaaactgtccaaagaaatagaagcaggtctgcaagaggggggtgcccagagccttgagatggaagcgagatggggtgagacctggggagctctccaggccgccgggaagctgcacgtcatcctctggacctctttgctgactgtgtgctgtcaccacagcagccgccttctctcatctgtaaacaggattttacgtaaatttccatacacttggttgttgacaattaagtagattgtttttaaagatacttgaaatgatatcagaatttcctaaatatatcattaaaacaggaaacttagttaccta

SEQ ID NO: 3954 - DNA, 13817 bp, Homo sapiens
ctctccaggcccgctgcttctgccagctggatgttgcgtcgtccctcgctattcgccctcctataatcactgcttccatgttgaatcaaaacaattatgctttcgttctcccttcttcaattgccctatcttcacacctgaacactattgctccggtatcctgccattttggatcagggcggttgacggtggattcacttcccatcagcccttgaggctgcagggaccagccctttgtggagaagcccaggcggcctagaatccagtgtcgtccgtgagtgcttggctggtgttcaagtgcatcttccagcctgagaccgcgtggactcgctcatcgtgagggcgagaggaggataagcccattgggctgtcggctgagagtgaggtgcgggaccatccacaatattgtttgaacatctgaagacatggggaacttgccatctgatatctgataacagacttcctgtaaagcaggactggtagtttcctgataacaaattcttcaatatgaagattgctgatgaaatccttggcatcgtcggagatctcatcgaatgcctcgtcgtcgaagtcccaggtggctgaggtaacgttggccaaggtttcgttatcgttgtctcccatgaagggggaaaggccactgactctggagagacaagagcaggacagcaggtgtggctaggagagggcgcgacgaccaggtgagtggtaactgaggtcaaaggcgagggtcggccagcctccccacccccaaactcatgctctgtgggccttgcacctgcctttcttccacttgtggaaagaaaagagggtgtggttcacagccctgtcttttcttggtcacctgcctcttgacaccacctacctgtgaggctgaggtgcagcaggttggctttagattacgggcttctgcagggtacgcggcagggctgataagtccctctgtcctggttttctattattccccaaagcccaggctagagccttctccaagccccttcctcccgtgctcctgccccctctctgtggactgggcacatggtagtgatcaccactgcacccttctgtcccctccttcccacctctctccacacaccttcagctccaagaagagggcccggcaaataagagaggctcagcaagtgaagtgtgtgcccaatggatagatggactttgaatcagcaatgtaggttcggggaacttgaggcatttatgccaaactagaaaacttccctatgaggtgccatggcagaggacagagtgcagcctctccgcttgctgtatggccttggacaattccctgatctgtgtcagttttctcctctaaaatggagaagctgccatttaactatagggtggtcacttcttcatcctcatcatcatcatgatggcagcagacattcattgaggtttttctatgtgccaggcactgggtcaagtgcctaaaacaagtgaactcacttaatcttaacactgccctatgatgcaagtaattcttataactttgttttacagatgagggaattgaggcacagcccaggctcaagtcacctgcccaaagattcacagccagtgagattggaagccaggtatctgcctctagagcctgtcctcttaaatgctatactatcctaacatttctgtaaagatgaagtaaattgcagtgttcagcactggcaccaggcctggtccacagtaaggaggcggtccatgcccggagatctcatgcagttctgctgggttccctccactgccttaccaagctgtgagtgcaggaatgactttgtgaccagcagcttaagccaaataaactttataaggtaaagaatttcaaaacaaaatagagcagatttgtggcttactgaccttacctctcacctctgtgcacctcaccttcatagcaacaactcaccccactgttcatgagggccttgtgagtcagcctcatgggtgttagaccagcacagttgcccacagtcccacccttagacaggccctgtgcttggtttaatgctctgctgctgtcgtctcaagattctcaataaggtttgaacaagtggccccacctttcatgttgcaaattgtgtagctgttcctgccctgatctcagctgagccccatgagatgggtctgggggccaggcgtggtggctcatgcctgtaatcccagcactttgggaggccaaaatggatggatcacctgaggtcaggagtttgaggctagcctggccaacacggtgaagtcctgtctctactaaaaatacaaaaattagctgggcatggtggcaagcacctgtaatcccagctactcgggaggctgaggcaggagaattgcttgaaccctggaggtggaggttgcagtgagccaatatcgcaccattgcactccaacctgggcaacaagcgaaactcaatctcaaaaaaaaaaaaaaaaagagagatgggtctggggccctcctgccatcaacctgtcaagttagggctttaccaatgtcccttctcccaaatgcttatgaatccatcatcataagccaagcactgacagcttcaggagtaaggctttggttgagtttgacagaacaaaccccacttgaaatattgggagaaaaagcttgccatgggaggaaccctctggtgaaaccttttgtaaagagaagaaagcttttacaatgtgaattgtctcatcctaatcaacatatttgtgtttctgaataatagatctttgtggatgggatttttttttaaagcaagaccctgatttatgttttaagaaggcaaagagaatcattctcggtcatgtccccatgagggaagggtgggcatttacctgtccccgagtctgcactgttatctgctgctcctttcccctctctgggcctcagtttctcctttttcttttttttttttttgagacagagtgttgctctgttgcccaggctggagtgcagtggtgcgatctctgctcactgcaagctctgccccctgggttcatgccattctcctgcctcagcctcccgagtagctgggactacaggtgcccaccaccacacccagctattttttttgtatttttagtagagacggggtttcacagtgttcgtcaggatggtctcgatctcctgacctcgtgtcgtgatctgcctgcctcggcctcccaaagtgctgggattacaggcatgagccaccgcgcctagccagcttctccttttatacatcaaggggactaggctagatttcctaggggcctcccagctctctctgtctctgtgaccccgacccccacgtggcccatgcaagccccatcaggaagcagcctgtctcttgcctgtcagccacctgctgcttctttacattttccactggaaacagagaggggggaagtccggcagtactccaaaagatggcaggaaaagcaaacaaccctgctgtggaatgcagaaagttccccttctgcaaacctcccttccttattaggaactataatcctgcaaagataggtcttaatctctgcaactctgggcacagtcagggagagcctcctcgcctctggcctctggcactcctccttcctggcagcctatccatctgaaatactctcctcaccctgcctggctccttgcctgcccaagttcccccagcattcttcctattaaagagcatgtgtctggaataaaaaatataatacatacacagcatgttgacaaagagggtgtttgaattttcagtaatgctgttgctgggtggtggggttttacaggatttttaaaaacctttttggggaactttttctttgtggcagaatttgcataagggatcatgtcttttaatttttttttttttttttgagatgcggtcttgttctattgcccaggttggagtgcagtagtgcgatctcagctcactgaacctctggctcaagcgatccttccacctcagtctcctgagtagctggaaccacaggtgcgcgccaacacacctggctaattttttgtattttggtagagatggggtttcaccatgttgcccaggctagtctcaaattcctgagcttaagcaatcctcccacctctgcctcccaaagtgcattacaggcatgagccactgtgcccagccttgtctttttatttataaaatagtcattattattatttctttttatttttttgagacagagtctcgctctgtcacccaggctggaatacagtggcgtgatcatggctcattgcagcctcaacctccccaggcttaggtgaccctcccacctaagccacccaagtagcagggaccacaggcgcacgccaccatgcccagctaccttatgtatttcttgcagagatggggttttgccatgttgcccaggctggtctcaaactcctgggctcaggccatccactcaccttggcctcccaaagggctgggagtataagcatgagccactgcgcccagctagataacagtcattatttgttaaaaaaatcaaccggtcaacaaataatgttagcattaaaacacctctttatctccctggtcttatctagtttttaactaatggattgatctgtttttcacaaaactataatcagtctgggcaagtccttggatgctttactttttcttcactggatgtatcaagtacagccagactctacatgttgatttttagtggtcaaatattagtctttgtgctgatgaaacacaatggtcatgaatgcagggcattctaatttcttaattctcagctcattgccaaagaaattcccccagggaatctgatgtggaagcctgtttggctgtgggggcagaaggttaggagagcagagggtgcagaaatgcctcttggactacactttctgtgtgtgtgtgtgcgtgtatgtgtgtgggttttaagaaatgggggtctcgctatatcagccaggctggtcttgaactcctgatctcaagtgatcctcccatcatagcctcctgagtagctgggaccacaggtgcacactactgcacctggcttctgtgttgtgtttcaagcagcagacagatgccccgactgtaccagtggccagctaaggggaccacacatctgctgatggaactactgactgctaggaaggggttagtcttttatccatattagccatctgatactctggtgggagagctgagagggctgagtaggtccacaggaagagctgtgcatcattttgtggactggccgaggaagcagcgacctggggtttagttgtgttagtaaaagttgaaggtggtggccgggcttggagagggaacagggatcctagggctggaatcagagcgtatttccaggctcagcagcagagagggcagcggcagccccaggtggggaaggcagaggttactggatctggctgaggagccctgcagtcagaccctggtctgaggaggcccccgatgccccggcactgtgacccctcctcagctgactgggcagctgtcaccagaagagctgacctgcctccccaccatacacacctctcctccctcctggcatctcccgaccacacaccagggtggggagggacagctgacagctgtctgcaccacggtgggtgttggacaaacaaacaagcatgaatgggaaggctgtgctgctgggcctggtcaggaagaggcaggaggaggaagcagagcagccattgctggttcgctctggcttgagggaggctgggagagaaggcattgtggagtagggtgagggaagggctcggagaagagctgttgtggcctccccacaggcagcaaggaagtaccaagtccaggaagtaggggagggagacagcagggggaggagggctcttaaacggaggtggacttaggatttctcccgtatggaagtgtggcctccagctctctggtattctcacttcctgccagaaaccacatgggtattgctaacttcagaaggtctctaggtactcacacaacctactatctcctttcaggatccggggtaagagtgtgggggctccacgaccccattctgctccttccctatagggccagaaactgccctgatggctgggctgggtgggagagagtaaagtcacatcgtcctatggtgacacggtctgttgccttcccttccaactccctggcctctccatctctcactggccccagaaaggagaacaggaggggctctgtggtacaaaggtggaagtcgccctgacagggactgcccgacagatgactaggctccaaagagagggatagagtgggccagaggatgccatgagggccaccagagagcctcttttgggtgctcccagcagtggctccagagttctgcatagcaggcgcttaaaggaaaccatctccttggcgccaatgtttgttttcagcaccgctctctgttgagagccctggcttgccgggggaactccctgacttccatccatgctgagagagccaggctggaaaagccccagagggcagtggctcacagtgggggtccaggagctaagatgtggcacaggattgatccagcctgagtcagtgccacctggcctgggtccttgccacacacacacccctcctccctcctgacaaccctctgcccaagcactggcagcatcaaaactatcttctccccatttccaaaactctgccctagttcttggtctttgctttaaaagtaatctggtaaacaaggtaacatagtgcccaaattactatgttcctccaccgaaaagaactctcatttgacaataaagtgccctatgacccaattattctagttctagattatatatccaacagaaatgtacaaatatattcactgaaacacgtgaaccagaatgcttccaatggccaaactggaacccactcaaaagcctatcaaagcagaacggataaattaactggattatattcacacaatgggatactacataacactgagaataaacagtctacaatgacacatagtactatgaatgagtctcacaaacgatgtcaagcaaaaaaagccagacacttctttctgtatgatttcattgacattagccttgagggtaatggtgacctctgggggttggtaacagggaggggtgccagagggctgtgggggcctggcagtgcttggtttcttgatccgggtagaggttacacaggtgaaaacttagtgagcagtctagtcactgctctgtcactgaccagtagagagaccaattgtcctggtttgcctgggactgttcccatgttagcaccaaaagtcctgtatcctggcagactgggacgactggtcccctggcccgactgtgggaagtgggcagccacgtgggcttccttggcccctgtcacctcaacgccacatgaagatggaatccctgccatgatccactcttgggtttgttgtgagcatcaaacaaggtcctatgtgaaaatctgtagctgcagaagatcctgatgccacggcagtgggaaaacccactgaagaataaacagtaaggcaagtctccatgacggctggagggggaccctgggaccaagcgagaccacagcgcagctggggctgaacagtgagagctgaccaaggactgcttctcaagggtctggtgtttttcccagggccagaggttagcactgcccaggcctggggccgccctgaaaggggcaggctggccccgccccctaccctgctgttccttacttatctagggagccagggagtcaagctccagtccagctgctgtcttcacttgtcagcgccccttctccaagagggggcggggcagggaaacaggcagggaaatgcacacctggcccggggtttttctgctgatctggggaaggctgtggtggtggggctaatcccaggcaggaaagaggataactgtctggactacaatgcctgtggtgcaggttccactgaggggactgtcctaacaggctatagtgagtaaagttcctgagcatgtgaaaaagtcacattgcacaaaattcacaccacttctgctaaagcttttataacactggtttctaaacctggctatgcatcagaatcgcccagaaccttctctcacactggagtctgaaggccccaggggtctaagaaagtattcatagaggtcttcctcattttctatgaaaatgttaaatttttccttttgttctgacagtaaaaacattattgaatgaaagcatacacatctgcatctttggggacaccatcccataactgcatgtggccacacaggttcaggggctaatgaccgtccgcaccctggggcttcagggactaaagcagccagaccccaccgacagagtgttctcaagccttgttactcagagcgcagtcgttgaaccagcacattcacaaacctagagcctgttagaaatgtggcattccaggtcacccagacctgaacaaaaaccctgcaatgtaaggagccgcctaggtgagtcaggcatgctaatgtttgtgaagtgccggcctagatggctggcctcccctctcctgcattattgttcattgaaatggctttggatttcccacctgatttttcagttctaattactgtgttactttcttttatctgttagtcccattgaaggctcgatcatcaatagtgtttattaattcatccatatactagactcaaagatgaggctagtagttggggtccccgtgccttggggatggagtgctatgccctgaagacaatgaggatgcccagagattcgcccctggcctcctgccctccttctttgtggacccacacaagtgaggttttattacttggtgccagccacatttcccaccctcctgaccaaaggccccaggctggccagccttggggacagtgagcacccagaatggggatcttagcatgtgtagctacatgatgctatagaatatgcatgctactgactccctgggagcccaggagcagggtgggctgccagggataggaggggagcctgccaccctcctgactctggggggggctccccatcatgacaatggcagggcagcctggggaccctcctgtggaaccctcagcccccacccactggtccaccaagtggtccaccagtccaccaagtgccccaggactcacaggatgtagcagatgaccccgatgctccacatgtctgtggcgtagccgatgggctcatagttgatcacttcaggagccacaaattctggggtgccaaagaggaccttcagagaccccgcattctctgaaaccaggatggagagggataaattgccagcacatcacggagccagcttgagaccagcagctgcccgaatctgtgtgttgaccccaacctgggaggggccagacacaggctttggcacagagaacaggcacagagacatctgacctccttgttaaacaggtgcgtcaacacaccagtgaaaccaacaaacctcacactcacctcaaatgtcctgtgcagggtgggcagggggagaagaggccgctaaatcacccgcccctgaatggtctttttgtgagtctgtctcatgagttagttcccctaggcagggactgtgacttatgcttaataataatctctagcattcactatgtcctatgtaccccaccggcagctttacaagggttctcacccaccccaaggggtaggtataatgcccgtgctactgagaacatgagtgaggcccagggaagtgcagtgatttccccacccggttaacaagtggtggtcgggactcaagcccaggtagtccaactcctgagccatgcttaccaccgttcctccctcctgcctctcctactcctcacacagcttcatggctgtccttcaggagctactggtagggtagtcgggagaggcttcaaccccagggtggtacctcttggccataaaggaccagagatgtctgttaatatgtgcaaaaggcaggtacctgtgggctatgcctggtcttgcttaacttcgcagagctcacagcaaatgttctaaaacaaagcatttaacagccctcagatgtgaaagctctgctccaattcctgcctctcagccctttctgctacattttagccacttctcagttatctggtccttggtggacacggttgttcccacagtatccctcaccagtggaagctggacattgtgttccctgggctctgacactgccgactcctgaggacagtggcctatttgtttaatttattggtggtcactgttcaaaggcaggccctgtatgccagccactgcccctaccctgtcctcttagcaggagtgagcagagcagagcaggcacatgcgcccagcgccgaggcatgtttctcacctgactgcgctgaccaccagaccggtcatagtctatcggaacctcgcccctgcttacccctttcctctttatgaccaacacagcctcagccagcactgaacatcgtgggagacatttattgggtggcattcatttggcccctcctttctactacctgcagggtggtgaaataaagccagctcaccccagccctcgggctccttgctagcagggcagtggctaagaagggaggatgaagctgtttcctcaatcaccgggacatcaaagggctgcagaggcaggctggatgcaggcagaatgtgagccaggcaggcatctaccaaagtgctttcagggcggccttgagaccctgaccgcctacccctgtgacctctctcctggctagcataagaatcagaggtgctgcagagcaccctgagcaaggtctggggtccttgttccaatcccagcacatcccctggctcacagtgggacctcctgggcaaagctattgtgaacctttgtttcctagtctacaagttggggctcataaaatctaccctgctcacctcatggtgagaatcatagggtttattttttatgtgaaagtgctctagaaactgtacagtatgatgcagatgtgcagagccaccatcaccaaaatgacttttgctgctaatggcaccagagtgaaaaacaaaaggggataatcatcatcatatatacagctaacacctaagcagtcttactatgtgcaaagcactcttcccatccctttacctatattaacacatttgatcctcctaacaaatctgtgagttaggtcctactatgatcccacttttctgatggggaatttgaggcttactgtcacgtctagtatgtggtaggggcaggattcaaacctgggaagtcttcatggtctcggatttaaccccaatactgtatgtttcctctcacactcagtgtgagaggaaacggccagtgcaatacacactggtgtccatgggagaggcagatgagccttacccagcctcctggccagaccaaagtcgatgagcttgatcctggtgcccgtcttgttgacacacatgatgttctccggcttgaggtccaggtgcacgatgccctgcttgtggatgtactccactccctccgagatctgccgcatgtacttgatgcactcacgctccgtcagctcaaagtcctcgtcaatgatgcgctcaaacagctcccctcctgacacgctgcgggaacacgtgcacggggtggtcaggccacaggctcatggaggccaggctggcagggagtctggccagggtaggctgggggtaggagaaattggcaggaaagcccagggaatgggggtgatgggcaattcctgaatccccaccctccgacatgggagaagggtcagggcctcctggtttcccatcagggaaccctgccctgcaccttctaagctgctggggactcagggaagcatctacactaggcagtttcagaggtgggtgtgaacacagagatccagacatgatcttcttagcaaaaagagtgacctctaaacagtctctttccctcaaatgaccacacatgcctaagggaacattcttgtactctagccgtgtcttttagtcacagggaactcaagttcaaaatactcacagttcccacaagcatttgttctgcatagccaggaacggaaaaatatcttcaatcatcaataatgagcctcagcaaattttctaaaattagttggctgtaactcattatacctacagctgtgacagatttgcttactctggccaggcctatagtattggtttactccctgcagtcataattaactggtctcccttggaccccttccttaccccagctgtgtaatcctttctaactggataggctttggatcctggctatttctagtgaactttgcttctgcagccacaggcatgcatcctctgctagggactgccccggggtctcagccatcagcatattgcccttcagtgcaaatgcatggccccaccgcctgagttgcatgagtcctctctgttcccctgtcctagccctctgacccacctttcttggtctctgcttagcaagtttaaagcatctctctggtaacttatgcagcacccagatatcagtaagcttgcttttctttttttcttcttcaattttttttttttggtagagacaaggagttcaaagttatgttgagctatgatcacacaactgcactcaagcctgggtgacagagcaagaccctgtctcaaaagtgaaagaaaggaaaggaaggaggaggggaggggagcccaagctggtctggaactcctggtctccagcgattatcccacctcagcctcccaaagtgctgggattacaggcataagccatcatgcctggcctataaccaaccaacctacctatcttccttccttccttccttccgtccttccttctgtcctgcctgccttcctccctccgtccctctcttccctccctccctctcttccctccctcccttcctcccttccctcccttgcctccctcctttcctccttctcccctcccctcccctcctccttcctttcctttctttcgcttttgagacagggtcttgctctgtcttccaggcttgaatgcagttctgtgatcatagttcaacataactttgaactcctgggctcaagcgatcctcttgcctcagcctcccaagtagctaggactacaggtatgtgccaccgcacctggctaatttttttaatgttttgtagagacagggtctctctctgtcacccagtcataagctcatgtttctgcagtggcctgtaggtccaccagttgaacaaggccgggtgggttctgggcctgtcctcttgcaagggtatttcctctcctacagagagtcctcacgaagaggaaaggagctgagtttgaatcctgcttctgccttttatgagctgtgtgacattgggcaagttgcttaacctttctgagtcccagtttccttatctatccctgcctcatagagtttttaggaatgtaggaggctttgtaaagtatcatgcctaacacacagaaggtgctcaacacttattacttatcgtttgataagctgtggtgggctaggtggatcttgtcactgacccctgcaggagagagacagggatgcactgtggggcccagcataccacagcctctgccacgtgacacacacactcacttctggaagggctgaactggagaaggtcagtctgtgccagtgacagctggagggagctagaactcatactttaaaacccatctgagaagaaggtccccaaatggcctgcaggtggcgctcttgtccttatgccctccatttctattgctctctgccaaggctccaagacaaactctcatctacaagtattcttaggtctcagccagttattaacatctctgtgcttcattttcctcatctgtaagatgcagattaaaaacagcctcacctcacagggtggcttcaaagactaaatgagtcaacacagg

SEQ ID NO: 3955 - DNA, 2910 bp, Homo sapiens
agggccaaaccggcccacggagatgacgtcacacgaagaagcggaagtcccgcctccgccgccctggcccgcagaaaactctcctgtcctgggtcgtcaatggcccagagtccgcggccgacgcaaggggcagtgccttctgggtaatgcagtttttcccttacatctaccgggtgtgggaactcacccagcgcatccgactgcacgtaagtgcgcaccagaacccccgcgtcgtcttagggccaccgccttagtataggcacaagtcggagggtcgaaaggtcccttctagctcaggaaaatcgaggtcaggaggcggggatattcgccccgattcagaccccgaacaaaggtgcttaccctgctgtgggctgggcccgcgacttctcgcttgctttgcctcttttctggatcttttcatagaagaaaaggataaatgagcagttaaaatagccacccaaaggaggacgcctgacagtgtgcccagcctgctgggaaaggacagaccgccctctattgggcctcctttggccgggcccagccttcgtaggatgcagggacttccgggtgatgtaataggcttcgcgttcgccacgtgtggacttcccgtaccctgaggtggggaggctgctagtggagcaggcttgccgggaagcccagtactcccatttcaagcatgatcagtttgaaacgtcagtaagaccacaaagcgtagtgccatatactcaacctatgattcaacattggcagagggttcgagcgtggatatataaatttgggagttattactgtaaactgttacttcaagtcatgatattgggtgaggctatgaaaagaatgagcgtagatggataagtgacgggaaagaggggaaccctggcccaacccagcattaactggttgcagacaggagagtttataaagtcttgttaggaattttaacaatcctagactatgcaaagattatattatgcgaagtcttaggagtccccatcagtaactttttttttttcttttcatgactatgaaagtgagagaataaagtccagctttcaatggtttgacgatatatatggttaaggaaatagaaaggtgtgcagaaagtactctccaagagatttaattttgagattgaaaatagtcaaggaatggagatggagtcaatttcctacacgatgcggtacttttggagaaatatttttggctaaattagtgtgcaaggaacactgttattcatcactggcaatagtaatttttgaaaattgataaagacatcattctctttttcacatatttgtgactcttaaattttttttttttttttttttttttgagatggagtttcactcttgttgcccaggctggagagcagtggcacagtctccactcactgcaacctccgcctcccgggttcaagcgattctcctgcctcagcctcctgagtagctgggattacaggtgtgcgccaccacgcctggctaattttatatttttagtagagacagggttcttccatgttgttcaggctggtctcaaactcccgacctcaggtgatccacccacctcggcctcccaaagtgctaggattacagacgtgagccaccccctctggccagactcttataattaaatttaaatggttttttcagaggcatatgaaccagagcaactctatcttaaataggagctgggtaaaatgaagctaaaacctactaggctgcattcccagacagttaaggcattctgagtcacaggatgagataggaggtcagcacaaaatacggatcataaagaccttgctgataaaacaggttgcagtaaaggagctggccaaaaccaccaaaaccaaaatggtgacaagagtgacctctggtcttcctcactgctacactcccatcagtgccacgacagtttacaaatgccatggcaatgtcagggagttaccctatgtggtctgaaaaggggaggcatgaacaatccaccccttgtttagcaagtcactaagaaataaccataaacatgggcacccagcaacccttggggctgctctgtctatggagtagccattctttattcctttactttcttaataaacttgctttcacttgcactgtggactcgccctgaattatttcttgtgcgagatccaagaaccctctcttgggatatggattgggacccctttcctgtaacacattcctggccactacagaagagactatactgcaggaacccgtgacccaaaggctaactttgggtaagtggtggggtcgggtaacacttttctcgcaaaccacaaaagggacaatgctgaggagacccccctgactcaaaggaaatagactgcagcactgattggatgactttgggtaagtggtggggtacccaggtaaagaatgggattgggatagacgctcaagttaggggagttagagtctctcctaaggcagagtggattagaggcccctcttaataaaaggcaaggacgcttgactgaccttgggttagaggcccaacttaggaggattagagtcccttctaagatttagggggttagagacccctctcagtaaagtccctcttggctaagaagaggtttggcaccgtgggatgttaactgctattgtctttggattaatctgccttgcactctttgctgatggctccgggcgacagggttaggcgtgtacaggatcgtgggacatggggagctttttcctcccccaaaaggggaaacttgagagctgacgggactgctggaaaaaaatcccttcacgacagcagccgtagccgcctgaacttttcagtgtcactgcaatgggtgggtctttctctggcctccctgatcattttgccttccctgggaaagtattgcttgtggaaaatatttcctgggaaagtattgcctgc

SEQ ID NO: 3956 - DNA, 587 bp, Homo sapiens
gggtagtgtggtcaaagatgacttctgcagataaaaacatcatcttgtatgcaagggcgtggtgaaaacctctgctaccatactggatacaaggtctttaacttctcagcaccagttttatggagcccccaccgctaagcaagtatgcaaaatgcagtgctgcttcgcattgggaaatccccaatctggtgccaagaggttcataaatacagtaatggaccctcttatgtcaaaagtgagtactgtttaacagcgtaagttggaacagccttcaggatgctttgcagctgcagttgttccactgcaagacatcacaaacttcatgatgatggttgtcacaccaggtcctggaaaggcaacctacttcagtctgcaaagtgaactaaaagggaatggttgttcatacatggccctgatgccactgacataagaaacgcaatgacaagagcgatgaagtaggaatttggtggcagatggtcaggtctgcaggaagtgtccacccagctttgtttggcccatattctgaaacaactagaataaacacttagtgtcataatttataagcatatcagtaccaataaatcaga

SEQ ID NO: 3957 - DNA, 1247 bp, Homo sapiens
acacacacacttggacactacacacacagctgaggagtaactttcctcttctcgcggagcaccctatcccctattatcggcatctgatcttcctagttcggatccccggaacacacgccttctccagcctgcaatctacacacgtggggaagcgcgtccaagtggtgccaggaggcaggagggaagcgcaaaggtggggaaggccggggacgaggaaggagggagctctgagtcggatctgggatctcagatccccggggcagcgtagatgcagggtaagcttctgggatgcggagagggaaaggcaggggggaaggaacctagagaaggttaaagggcgggggtgggacggaggatgcggggtaggggtcgctcacctagggttttgacagcgatctgtctggtgaggggcggcggcaggttaatgcacaccaagtccacgtcctgatgcagcagcacctcatcaatgcggctagtgtagaaggggacactcatctccttggccagctcctccgcttcttcctgcgtgcggccccacagcgccttcaccgcgaagccctcgtctttcagcagcgggatgatgacacgggccgtgaggctggtgccgaacacgcccaccccgggaagcatggctgctcagagccgcctggttctgcttctgctcggatctccagtccaacgcgcgcacacacccacctctagccagtcctgcaccccgctcctgtagccaatctagccgcggtgcgccagccgccgtgcaccgggcaaggcgcccgggtgcccagagcgcaccgagctgcaggcggagcaagctcggggcgcctcagaacggtgactgcggcagtgtccgccacgcggggctcgcgtccttcccggagtcggcggcagggacccccccagggcgccggaggcttcgaagccccctggagccccggctcaggctgcgctcccgcggcagcgccagtccgctgcgtgcgccccgccaaggccgctccatggccggctcatccccgcggccgcgccgccgcagcccgggaccggctctctcccgcgtcgtttgcgcagccggcgaatcgcacagacaaacgtctacaccctgccagagcacggaaccgctccgcgggggagtctcctttcttcctagctctccgttgggaatgaaataatcccgcggccgccaggaggccggctaaggatgcggcccggagcgcgccggactgggatcccgagctgcagcgcggcagcgg

SEQ ID NO: 3958 - DNA, 17866 bp, Homo sapiens
agtgctaggaacctgcgcccggctgagctgagcgaggcgagaggagaaagcgaggcccggggacgggactgagagctctgaaaggagggaggcggctcccgagtactccgcgcggggcaggccccggcctcgcctcttcgcccatttttaaggctcgagttagaggccacctcctccgagaagccttcggtgacaccacctctcccagacggttcccctttctgattcccacagcattttccaaccattcacggtcagaaccactcaccaggacgtgttgtcaccattttaccgctttgcctcgtctcttaactagacgaaatgggttccttttggctctttggaaagggaggctgtcttctatttatttccgtggtaatcccacctcccacaacaagttccattctacagcaatgtcttttctcttgctgagaaccattcaagtctaagttttctggtgggtaggggtagggggtgtgttgcaagacttttgtcttctcaacttatttttctagttctcactttccttaagtgctaatttttttgaattagtggtctgctctcaactgtacgtatttttccgtccactccctccttcccccagccgtcttccttcctcattgtggtttggaccttctcgagaaagaatctggcctcagtctccctcttccacactcagggaccgccaccatcacaggcactcggtagatgtctgctgaatgaggataacttctacccaacaccgtgaagcctggcccagggtctggcatacagatgccgtgtttgtaaggtgactaaaacccagtggcctctgtaaattcctattttccttggactctgagccctctgaccaccttctggaagccgtgtccctgtcttttttccttgtgccccaggcttctccacccccctgtctggctgtgctgcccctggatcccttcgtgccccgttccccgcactatgtctcctcagtcctcctcccttttctctaggctgcctttccttggagaggtcctatgcatgtagcctgtcttgatgtttactgttttacagtggcttttctcatctgcatagtctgtcctcctgtctttccatcctgctcctgttcccaccggctctgtcctctccctcagatgtccagccaccacctcaatgtcagccgaagcccagtgtctctccaaagctcttgatctccatttctgtcagcgataccatcatttcccagtcactccgtccagaaagtcctggttgctcatctcgcccacttgcacagcccacctgtgtggccgactcaggattgacccacctgctctcttcaggccatattcccacgcagaagtgggtcccactcctcaggcctctgtgctggccccgtctgtggggttagcaagcagccctgctctccatttccagctcagaagcaactggatcgttacctcattggtgacaacttgactgtgctgcccagagctgataagaaacatcacccggggaagaccagctgcctcttccttgcttcctaatcagggtggaaatactgctaaatatatcacaactctttgcaagcatcgttgggtaatgatcgggacatctttgtgggttccctatcattttctcacaaagttgagcctttcaaggtcagttctaggccagccagtctgggagtcattctttagaatcagaagagaatttaagaagaggagaagataagattgtctctaaaacctgctaatgagaactacaggaaggtggggatgctagctacttttaatatttctggtttgaaccccttcctccaccccagaatgaactgagagtaggtacagaaatagataatgcaaagacggttagggttgagggtaagcagaaaactacccatctagaccgaaggaaggcttgctaacatatcagtaagcaaacagctttctaatctgcaggtaacaagttttacatccctgaggacactttttgagataggactttgtttgtttgtttgtttgttgttttttgtttttttgagacagagtctcgctctgtctcccaggctggagtgcagtggcatggtctcggctcactgcaaccttcacctcccaggatcaaacgattctcctgcctcagcctcctgaatagctgggattacaggtgcatgccaccatgtccagctatttttgtgtgtgtgtgtgtgtgtgtgtgtgtgtgtgtatttttagtagagatggggtttcatcatgttggtcaggctggtctgaaactcctgacctcgtgatctgccctcctcagcctcccaaagtgctgggattataggcgtgagccaccgggcccagcctggggctttttgagaccctattgaaggctgaggaagaatctggaagctaaagagtaacccattccaccacctgctctgaagatagaagaagcaaaaaaagattaaattgtacaaaaagcacttaaattagacaacagaagaatttcctgatacaaagtgggtgtctaagatgtgttaaacaagatgcctgctccagccaggactcagacactcctggatggagagcatcttcacagtttgggataaaagtgactatacagagtggtggagtgaaggctgcaggcccctccccaaggtggcatctaaccccggaggtatcaggacctcagaggctacccacatgatttccagctgatgagcagaaatagctgtggcaggtgcaggcttcacttgctgccaccaacatgggagctcaccaaacacccagtggccaaaagaaccagggtctctctaagccctgggctcaccgccaggcaagcttgggtgcttgggagggccgtcgttcttcacagtgcagcccctggatttcttctcaatttactcaactctctctcttgaatcccatctgtgcagcttagaagtcacaaattagaaccccccaaggcaaagctgaccatagatacaaatggttttgtctgtatagtgtttaagcacttaaaaaattcattgtgaacatttaataattagaaagtgtcaaaatgaaaatatctatagtttctctctaaaaaccagaagatctgttaacactgatcccacacttctatttggcaatgactggcccctaagacagggggtatgtcctctagctcaccacagtctccacctttacctactgcatccctgctgagacaaagtggtacatgccatttattaaggatgaatgctgttttttttaattatacttaatcctcatttgcattacctgccttcattctggaggtatttgagtttgcatctcctgataaagaataaatctcaaaattgtcatctctaacttcacctttattacagagcttccaattcatttttttccaactgagagctggacatctttggagcatttttctggtgtttcagtctcaacatgtaacagatcaaagatacttctctcccatcttccttgtttcttagttctttctctctctccttagtattacccttctttttctgctttaaaaaccttcaatagcttcccattgcctgtagtactaattaaaaatctctcatctgacattcaaatggctgcataccaagggaccttaggatacccattcaaatcacccaggaagtttgataaaaattcagatcacacagcctctccctgagattctggacccacccacctcaaactactgaatcagttattaagtatatacatacatatcatatatatatatgtgtgtgtgtgtgtgtgtgtatatatatatatatatttttttttagatgaagtctcactctgtcacccaggctggagtgcaatggcgagatctcggctcactgcagcctctgccccccaccgagttcaagtgattctcctgcctcaggctcctgagtaactgggattacaggtgcctgccaccacgcctggctaatttttgtattttaagtagagacggggtttcaccatcttggccaggctggtcttgaactcctgacctcgtgatctgcctgcctcagcctcccaaagtgctgagattacaagcgtgagccacctcacctggcctttagttattaggtatatgagaggtaatttataggaagcacctagcatactacctaagtattatagatgctcagcaaaccatatctcataattgccaactgtcagaagcagggttttcagaaataatctacacaaaaattttaattcttcagatggagaaaagaaagccatgagatgaaaaaaagatgtccaaagttacacagctacttagtggcagggctaggactagaacctagatctcccacccagcctagggccctttccattaggccagattcccatcatgtgaccctggctttattcatgtattcacttactcaaggaatatgtattgggttcccctgggagccagcggtggaccatggtgggtttgggagttggtatcagcattccaagtgtctatctgggggtgagggctggaggctgagtgcgtgagatggccacttggagacacagaggagcccaggagcagaatgagttcagctactcacatagaagttgatgtttcatcaggtggtagcaggaatttagagtacagagaaaggccctaaccctcgcagggcaagatctttagtcaatgagaaagagcggccgggagggcccatgttgatgagacagtgggataaatgaacttcggagaaaggcatgaggaatgatggcagggaaaggctaacatagagcaagacacattggtccccactgcctcattctgaggagtgttgggtgaggcagaaaaacaggcttctcttgacacagcctgtttgagggaatgccaggagatggagaaaatgcttggaggggtgaggatataggggacttttctgggcccaaagggggctcaatgaaagggtttggaaaggagggtggtgagagttagactaccacagagcacacccacagtggaatggggatgagaacatgtgtccttcggacagtgaccagcatccatagagggagtgaggattttagtcttgtctgggccttggaggtggcaaccaaacacagggttctaggagagaggcctggcaactgagacatgagacccagagtgctgcacagggcagagaaagacaacctccagggaacttccatttctgctgtcaggggccagccactgccttgacgactgcagagtggtcttcgtgtctcggagggacagggcctccagggtcctggatgcaggctgtgtgctcccctaactcacctcttcatcctctccatgttactctgcatcgcgttggcccacacaggcccactctcctgctgctgggagggaggggctggaaagtgttaggaattcatcaagcttgtaactaaagctgactctatgccaggccccatctggggaaggaatctgctccccccaaaggcatgtattcccctgagggttgcttctcagctgctgtgctctactaacccagtagtgtctgtgggaagatgaatgatctgggcttctcaccctcctttgccaccctggctgtgtggtcagggaagggtgaaggcaagaaggatggcggagggtacaggagagacagtgaagacgggatgaggtgggagctggggaaggggaagagacgtggacagatggccagaccaatatggctggaaaggtccctagtgatgtgtttttgtttctgcgactccctcggtgtatcaggagcaaaaggatgggaacgatctgctaaaagtctgttatcctggaggccccccaagaatgtgacctcccacaccttctccctctaggccttctcctatggtacgagaaggtgtgactgaaagtgccagaaactcacaggggaacacatggacttgggacagaagcagatctgaagctgaatttattgcctctttcccaaatttagaagacagacatgttgtaaaccctcctcatcctcactcccaggggcccaggataaaccccctttatctccagacaaaaaacaagagaagaggccctgaacctattggagcttccccagatgttgttttggcagagccgtaatggggctgggcctcctggggctgagtgtctggggcaagcaggaagctggcatcacagctgtgacagccagagaccacctgggggatgggggctgaagggaagaggaagacagattcagaaaggaggacacaagaaaaagtctaaagaagaggtactgcagcttctcacctgtggcctcctggctctgggcctgaggtacttctctactgcaccatgggttcaggtccagggatccgtgtggtttggaggaaggagctaggagaaagggagagatggttggagttccctgagccttagtttgcttatatgtaacaaaagagtattgggctaggagacccaccctgcctcttaatctgtcatctatggttcacattgatgactccttgggtcctagtggaatacgtgatcacctgccagcaagagaggattttcctgatgaggtgacaagatatcctggagccctacttcctgagcggatcccatatccaattactggcccagtcctgtcagttatcctcttgaaataccttctactcagcatcactgaagccaccaactgttagatcgttcttggatagtttcaacagttccctaagtggtctctttgcctgaagtgcttcccttcctgccctttcctcagtccatactctgctgtcagagctcctaaactacaggtctgtcttgtctctttcatgtttaaaagctctgaaggctccctacagttgaaagtttaattcttggtttggccttcaaggcctttacaatctggcccaacctcaaagctcaattaacccattctcagtgtttctcaaatacatactttgcactttcataccattgtgcctttgtagtttcaacagtgaggtcttgccatgttgcccaggctctggagtgctgtgcttactcacaggcatgaacatagctccctacagcatcaaactcctcacctcgagtgatcatcctccctcagcctcctgagtagctgagtgcccagcttattgtacctttactcatattatttgctctgcctgaaattctctctgttcagctctttgtccatcaaaaagctgactaattatctccgtgcaagtgatacagaaggagtgaaaacattatttttcccacattattgaagaaaaaagtaaggaacatatagggcaatggacatgtcaggaaagtctctaaaaagggggctggggtagtggggtgagagtgggctagggaagggtgggaaaggattctaaatcctacttcctccatcccttccactaagaataaggttggggaggagtggaaaggaatctttatttagattaagaatgggtggcctgagctgcttgttatgatatattagtctttttttttgagacaggatctcactctgttgcttaggctggagtatagtggcatggtctcggctcacagcaacctccatctcccgtgttcaagctattctcctgcctcagcttcctgggtagctgggattacagctgtgcgccaccacacctggctaatttttgttatttttagtagagacggggtttctccatgttggccaggctcgtctcaaactcctgacctcaagggatctgcccacctcggcgtcccaaagtgttgggattataggcacctggccttatatcagtcttgttttgatgatgactggctccgatggcatataattatgcttttttacattggtgtccctggatgggctaattaagtttttgaactgacggatttgttctagtgcgatgggcagagcacatcccttaaagccacactgcttaggttcaaatcctagctgtgctaccttaggcaagttattgaagctttctgtgccttaatttctttatctataaaatgagattaatagtaattcttacctcttagagttgttgggagaatcaaatgagtttacaatacttagaatagtgtctggcacataatagtggtcagtacatgttaactattattacttataatttatactttgcttacttccaagaagaatttgagacagcttaaaatattaaaccacatagaggatgattttatgtgtgtgtttatattatattaaagatcagaaacgaattggtagtaggaggaagaaagagaaagatagatatttacaaacttgtttgaatcagatacttctttgacacctaaatttatctttgaacttccaggaagccaaggtaaaaagggaaatacctgcattatatagttttcattgtgaaatataaaaaagcattcaagttagcctgttaaaacccacccccaccagcccgctacatccacacattcctcaagaagaaatttatgatatgaatccctatgttggaatactggagccaaagagtctgaagttgttctcagttggcatttagtatcttcctcaattgggtttacctttcataagagcccataacgacaacagaagtaatcaggataatggctgggatagtaacaatcaatatcatctctacatttctttctatccttatttcagggtttccttccttccctcttggctcaggaactctctgaggtcaggggttgagcctcgctcggtcaaatagtcaggtggccccaggtggtttcagctgcctccctgaagcattagagttgtgtagaagcaaggtggaacccatggcaaaaactcatgaggtgaatggagacaggaaggttatgaggtatgtctaagagggctttgagacgattgagctcccaaacatgtaacagaatgattatcttagtgggaatgggtaagctcctagaaagagaacaactctgtgtcccctattttttgaattcagcagaatctattgtaagtcaatatccttatgtaaaaacattgcataagtccaggaagaccaccaccacgatcttccagcctgacctgccaggcttaaaaaaagcggctcggccaggcgcagtggctcacacctgtaatcccagcactttgggaggctgaggcgggcagatcacctgaggtcgggagttcaagaccagcctgaccaacatggagaaaccctgtctctactaaaaatacaaaattagcagggcgtagtggcgcttgcctgtaatcctagctactcgggaggctgaggcagaagaatcgcttgaacctgggaggcagagattccagtgagccgagattgtgccattgcattccagcctgggcaacaagagcgaaactccgtctcaaaaaaaaaaagaaaaaaaaagtggctctttgcctacgaacttacacactcagaagctttggacctatctcgttgaattcttagacaggttcagaggtgtggctggaggttagagctgaattactccacagaagaaaacaagaggaatctatatttttgttcctgagagagagcagcaaaaaaagggggcttgagtaaccttaaaatggtgttgggagggcctagagccaatgtgagagaggaagccgagggaagtttaagaacagaaatgcccaacactccctttttaagctctttacatttttgcaaaattaaccccctcaggagaccccaaccttcactaaagcccatgatgtatatacagaccttgtaaggaattcatatgaagaaacaagagacaggcctgacacggctcacaacagtgagagcgctcagggtcagcaggatgattcccaaaaggaactgacttgagatcccaaagccagaggcactgatgagaaggaatgtcttctccaccctccatccccacttccaggggaatctggaatattttgaggaaaactattggatcactcatcgatcttcgaataaaacattgaaccaatcttgcccagcacctaaagagcagttgggcacagctgacgaacagtttacccactgggagcatggaattaggtgtcaccttcaaatacctgatgtttaatgaggacaaccatctccaaagggaggatacctgcctgcccactgtgcagtctacttcttggctacctagcacagtcctccctgagagagggttccgtgggggctcgttgaagccaatgagtggggaggagaaatgctgcagaaatttaccatgtctggctggccctatggctcactgccatttatgtatgggtcacatgggtcacaaatcaatcacttgacctcgtgatctggataccttttgtcgtctttgtcctagagtgataagaggaaggagatttagtccccaccctcagaggtagagagtgtgggttcttcattctgactggggagaaacggttcctgcccacaggacgctgcaagttcccaaggagggagaagcatccacatcgaggacacagacgcaaagctgccaggagacaggcaaatatgggcagagccacactgcacaaacacgattcacaattaaccaaggagttggagtgaaggtgtcagcaggaaatagcttgttgggcctgggagttttgagctgagctggatttggaaggaaagagttcttactagcagcaacagaagacagtcatgtgctgcacagtgtccagtactgtgcgaggcgtttgcacgatgaccgctcacccgcggttcccctccctgctggaaggatcatctccagcatgctcaccacttgcttactaacagaggccccagacaaacagctcgccacagtacacacaagaggcaaactccagatgactttatttacacagcttaagcttttcaacagggtcaaagggcattctcacagcacatgggtgtggcccgggaaaggcaggttctggagggggctcctgaacaggttcctcctccctggcaccaagtgaccacctgtaagtctgaatagcactttacagcttgcaaagctgttttacaccaagcagaacactcatctagtccttacaaggctcgagggcagtatcctccatattttatggagaaggaagctggggcctgaagaattatgagacaaatttaaggccccaaggcagaggcaaggatgtcctttctaccacccaacagtggcctagcatcacagccttccggccgtagactttgggatgcagagcattcagggactatcagagtgcatcagtgaaaggccacctggtcatctgcatttcaatctagctctgcacatttcatgagaaacccaaagagggaggatgcagagcgacagcgtctgggaaggctgcccgcctgggctctggctcttgagaggagacagggaggctggcctcccttttccaaatgcgggtcacctttgccccggcctgggcattgtttgggagaggagagcctggcccttgatggctggcagctgttgccctccccaagagcgcccctgccctgccggcccctccggagtctgtgcccatataagggaagcacttcccggcagctgaggtagaggctgtgacgcccccagtccacgtcagcggccggcgggaggcgggaaagcccagcagaaaaacaagtgacgcggcgcgggagggaggcggtgggtggcaggtggcgggagggagtggccgcgcctgcctcgttaacccctgcccaggcagctggagccaaggactgagcgcagccagccaaggttgtgggctgtctttgcccttctgtgtgaatgggggtgtggagtggggaaagtcgggggccaggggctgcgctggtgacacctgcctgagcacttctgtcctggggtgggtgcaggtgtttgtgctctggaggacctgctctttgggcgtccaaatgtgtttcacagcctgtgcattttgcctggtggtgtcaaggacgcatatgacatggacagccatggtgtgtatttttactgcagagcccagggattttcccataggtgtttaaagacaatcacatctcctattgaaactcaatctcttctgtcctgaaacaagcaaataaaaagaaaaactggcatctgtgtttccagagaatcccagaaagtctcagaagaggcactgctgtaaggcgactggcttctcattagccaagtggcctccccatgtcttccccagaccagtcaaataaaaaggtctggcctaggggctgacggagaagcagcctgaaaaacgagggtttccagaggcctcctgccaggcagaggccaagaaaaaaacagaaaaggaagagaaactgcgatgagaactcagggctcatcatggagccttcactgtcctggggcaggttgggggaggcgctctgatttctgagtccagctgagcactcagataaagcctgttggagtgctgttctcagaggcctgcctcgtctcgcctgaaattatgggtgtgcgtgcctgcctgtggtgggttggggagtaaattgggtagctcagcctccggggaaagtccccagggcctcccaaccatcccttcacacccacagtgcttagccacccacattcgctcctctatctaaggtctacttcctctctctacttcccctggcccagtctctccacggtagagagttgtctggggggacaactcaccccatccccaagctctgggtgctgtgatagagtgggagtttgaggcatgaaaaatagctagtggccctccttggcagggcattggccgaggatgtggcaagtttgctttggctgtgggcacggtccctgtctctgaggcttaccctcacggtggctggtgaacatggttttatgcctgggaattttaaaggatgtgggaggggccttccttcctcaggagccagtgtcctgggactggatgataccaaaggtgttgaagaataaaaacaatggggtaatgtttgtgtttctgcctggacagtactgcatagcggttatgggtgggctttggggtcagatgggaccttagctctgccacttgctggtaggtcttctggcaagttcctaacctctctgagcctcaatttccttgtctgaaaaatagaagtaaaagtattaatcgtattgattcttttttttttaggcagggtctcactctgtcaccccaggctggagtgcagtggcaggatcacagctcactgcagccttgaccttctgggctcacgcgattctcccacctcaacctctggagtagctgggaccacaggcaggcaacatcacacctggctaattttttgggtatttttttgtagagatggggttttgccatgttgcccaggctggtctgaaacttcttgagctcaagcaatccatctgcctcggcctcccaaagtgctggaattataggcatgagccaccgcacctggcctgtattgttcttttgaagataaaaggagatcacgtttattaagcattctgcacatatgttcactctttccacaatatttgcacacccagcgcatagtaaacacattaaatagtggcttttattactattagcagtggtagcagtatcataaaagtcctcaaggacaccacatggagagttagtcggagtcaccaggtgttccaagtttgcctttggcggtctcctgcctctcagctttcttcgaggttgctctggtacctcatcacctccaccacctcctccaccatcccgacctcagcctggcctggaagaaagtgcaatgagtgtggaagcacaagaccgatgcttccaccccagctttgccctgccctgggccattccacccttctgagcctccatttccttatcactgaaatggggagaatactttctggctggcttcgtttattgtgagagtcaagagaataaacgtttgtgaaaatactttgaaaacagcccccacctatcagttctccaccaggtgaattctcccctctcatcctcggcaccagctcctaccccattcctccccttcgagtctctctctgtagattttcatggctttgggcattttgttcacagctctgttgacattcccttgacctcagaattctggaggtgccttaattccgacttcccctatagacgcctcctcagggcaggaaatatgccttattcattcatcctgtgattccagtgccaggcccaggaagggcacatagtaggagctcagtcagcgctgattccctttcttctaccagcaaatcccagggatggaggcctgaaaaagaacccagtagaatttaggggagcagactctgtcctccaagagagaggggttggggaagaagggagacaggaggaaaggaggggagtggccctttgctatgcaggccaaaggatgcccgctgtcaccacacacaggcgcaaggtaataccagtctccatagggtgacatggtgctgactggttttactcagcgatcccaaggctgggagaacctctgagagcctcagcagagggccaagccactcttcctggtaggaaagcagacattctgcctaaaagggaagtccttgggtaacaagttccacttcatcacagccagggcactaacctaaaaccctaccctctcctcctcccccaccgcacaggcaaaccatttcctcttctgctgagctcatggaaacaaagaacagctgtcctctcattgattggtttaaaaataagagactcttgctttacctccccaaccccccacccagacctctgatgaccaaacatctcagcacagtccccctcaggcctccacccactcccctggggacagaggggcagcccctgggccgcccacaggctccctcctcctccctgtggggaccagcctctgcctgccactgagccacacccgtctaccttcggtggggtgactgcagctgcccagccactggctcttaccagtgtggccttggcattcacactttggccaccataattttgtctctgcagtgggccttgcacaaggctgggaggaaacagcctctgtagaaatcaaggtttcctgctctgtgagggctgatgcggtgccatggagatacttcctgtgactttgccaggcaaactggaggccaggggaaagatcgggagtgtgaagtcctgacttctcagctactcagaaacccctctaagcctcgatgttttcatctgaaaaatgacagtggcaaactgcttatagagggactgtcaggatcaaacgagatatggttatgaaggcgcattgaaaacggtgccaccatggacacacgagttgctatttctgcctgccacctccacagaccccagttcaccaccagctgcaatctctacaagtggccctgccttcctgaaaaccccaaaccaagacttgcctccctgggcatctgagtccaccccatcctctctcctcgggcttacttactcaacctacaccacagggaaatgcaccagttgcttaagaggtgtggaaagtttcctccagttttttccatggtttgtgtgcttgtcttacctgtcccgcctccttcctagcaccgtgggagtataagctggctcctctgcaatggatccgtggccagtacctctgttccctcacagcacaggataacaataagtgtgccaaatggaagtgtgcgtgtgggagagggcacacagccagatggctccttggggcaaagccttatttctaccacataggactttgtagacaatcactctctggctatagaggggttttgtgctcattttctgttgtgaatcaagctaattttggattcactgggatacaatagtgaactgaaaggcagctgcctgcaggaggagctcagagaaccaagcagagccaagccctgggaagccttttagaggaagatttgcagagaaggagtgtgacagtcataagtgtcccacgctctcagtcctcagcaggctgtccctcccagtcccaggttcaccttgcagaggtgtggtggagaacaagcgtgcccagcagcttcccgtctgaaagccaactggcacagcccacctccagtgggccacccatgtttctggggccaatgagcctctgagctgggaggtcctggccaaagaaatgccctcctgcctcagagaacagaaagttccagaagatccagggtagctttattcctgacttagcaagcagacctagaagtgggatggagaagggcttttgaatctccctccaaaggtccagagaaatctccttggaaatttgattgattattgattattgtaacaagagtttctcctcccccaggaagctcaccagagtggtcttcttctaatagaggcggaactgtgtgatgggtggtcggaggttccggctgctgtgccagaccgcttgggttcaaatcttatctttaacagttacctaatattcgctgtgcttcagttgcctcatccataaagtagaaattacaatgatatctatcacattggattgtttttgattaatgagttactatgtgcaaaacacttagggctcagtattgttattataagaaagaactttacttaagaggcttcctagtttaatttctctaccattatgaaaagaaattctctccctgattccgacacctttgtttctttctttttctttttttttcttttttctttttttttttaagagaaggggtctcaccttgttgcccatgctagtctcaaactcctgggctcaagccatccactcacctcagcctcccaaagtgctggggtaataggcatgatcaatatataatatatatgacattatatataatatattatgtttctcctggcctctgagctccaggttcagcaagaggagaatgctcagttccttcctgtggactaaaagccacaggagacattcatcaacagcaatggggtgatgagagccatttgggagtattaggaagtggaaggtctgagaaccttttcaaactaagaaacccacctggccaaggtgtccctgacttgactcattcagtccctatcctgccatatatttattataactatattatatcccagaactttcacatttattgtgttatttaatcttcatgatgatcccacagaataggctataaagatcttatcagagaaggcaactgggaccttgggacgggtctcccacttcctgtcctactgagaaggatcctatccatctttgccccaggccattccactgaggaagctgcaaggtggttccatggaggaccagttcagagtccataataacaggatgacttaatgacaggttgaatcagtttgttatttggagcaggcactgcagggaaagggctggccatgttagacgtggctcatcctcttccctcttcaaaaacactcccacttaatgcttgacctcccagaatcaaggaagtacgtggccttattgctagagccaaaatttgcagagtcaagtgcacatccagcctgctaacaagaaattccaggtgccctgaggacagtggtgctggcctcaaagtcacaagagctttctgggtttagggtcaccctgcactgattctgaggaattgggagtaagacacagaccctctccatacacttggcctgggaggatcatcctgccctgctcacgggggagagggacagagcccgtcagtcccagccccagctctccggcatgatgccagaagtcaggagcctggtgaactctctggctcagccaccgactctctgggtctcagacttcttcattataaagtgaggatgtcggactaaccgtacctaagatagccgtgagcttggacagccgggatgaccttctctgtgccaaattaccctaattccttccatcttgtgtcatttgccttccacttactggtcttatatacatctttttaaaggattttatcagtttagttaaattcaacattctccaagcagctggtatacacccgacattgacccgatactggaaaatcaatggtgctgagatatctgttttcagagtgcttccagtctagcagaggaaggcaggcaagagaa

SEQ ID NO: 3959 - DNA, 2635 bp, Homo sapiens
tgggacagctgggatttgaacataggtattcagactccagagtctagactttcaactgccagactctcctacctctctacacagaacactaacaagtccacaacgtaaaaacaagctgtgaatagtaggtctccctccctcccaagactatcaatcttcattcccagaggaaaccactggcaacagtttccttccagaaaaatgcaagtatgcacatgcaagcatatatctagattcataagttataaatctatatcttttttataaccaaaatggaagcatttaataccaatgctgtaccttcttatttcacttaacattatatccttgaagatttttccatatcaaaacatatagatctactttatcttaagggctgcaaagtaattcattgtaaagaggtaatataatttaattcactagcctccaacatttatgtggtttctagacattttcttatataaataatgctaccataagtatttttatatttatggctttcttcatctacacaagctaatctcagaataagtttggagaagaattgttggctgcatttaaaaatttgatacatattgccaaattgctttgcaaagtggttacatgaatttatatatagctgatatataaataatggttgattctgaaaatttatatttacgaagtgacacatatctgtataaaattccaaggcatgggtagaaaggaagttttgctttctaatgattaaagctagtcaaactgtcaagtttagctccttccttatgtcctttaacaatatcctcagcaaaaaagggctagtcaagaatttttatctgcagtttctgtaaaaggattgtgtaccacatgaaaaaattccctccagaatttagaactaggaacagtctggcagtttttctttactgaatagcaattatatacctttctctctttttgctttggcttccaggctgctcataattacatttggtgctcaatcacagcaccaatattagccaatgaagaagcatcactatttttatatttattcctatttctattttaaagacctaatagcatatatgcaccttacactgaacccctcaaatttattttggaagtaggtggtatatatgaatagataaaatttaaatgaccttaagattaataaaagagattatacaaaatggctaaggagggaacaatggtcacaactttcattcccttcctgtttgaaatatgtaagagacttaattatttttattgctcttcagaatcattcttagaagataataaattggggaaatttccctcatctgggaactggatggcaggaactagaatttcaaggtagaaaggggattcagcgatcatctaagcaaacccatcactttacaaatgaggaaactgaggcccagagaggtgaggtgacttacccgaggccacagctctaggaaatgacagaggcgggactagaacgtgggtagcttgaggtccggaccaacgtgctgtcccactgcatgacacgcaacacagacgacttggggtggcagaagagaggaagagaaggtgaccccacagcccctagcaacaaaaacaacaagaaggacttgaggcactcataaataattaagcaattagctgcagcagctactcccctcccctccagcatccagtcaccaaggcaacttgggcagggtgcctgctggttgcctagtaacagtgtggtctgctcccctgacaagctccctaggcatcaaaggatttgagagccgggaagaaccttagacagggatcacttttccaacaccttcattttccaaatgagaaaagaaaggcccagagaagctgggtaacctgcccaaggtcacacagctattcagacacacagccaggctccattcccagttgctttccattgcactagggctgcctcagggaggctgcagatggaggagagggggaaatcgctctacagttcctagaagaatgagaaagtcagagcgagcaagcaggcaagaaagagacagaaacctgagcactcatatgcaattagcaggagctggtaatcccatcagcccaactttcatcatcaccatggcaacatgggtgaggtgggtgctggttgcctagcaacaagtggtcctctctcttctactcacatctgctccctgggagtcacaggaacagcagaatgatgacgttggaagggaaggcaggggtcctaactcagtctcctcctttacccaatgaggaacctgaggttcagggacactggaagtcacacagccacagagttagctagtgacattccctccattgatggcctctgtctcaacactttgggaagggagccttccactcaataaaggcagaacatgggagggaattggccagtggctcccttgaaaggagggaacacatggtctctaatgtcagaaaacctgggtcaaagctagttctccctaaacctggcaagcttcctaccctctctgtgcctcagtctccacatatgaggactggacatgctaatggtctctatctctcgagttatcgttaggattaaatgagaaaatgtatatgtcaagtccctggtatatagtaaagatacagtaaatgtcaggcgttcattcattccacactcaataaatatttg

SEQ ID NO: 3960 - DNA, 4540 bp, Homo sapiens
agacgcccgctggacgtcaactcggccggacgcggggcacgggcgctaacaggctcctaggagcctccccgggcgccccccgcccagggcgcgctctgctcacctgcaggtttcggcggctccgcggtgactaacaacagcggcagcagcagcagcagcagcagaagcggtggcggctgtggcagccccgggcgcccgcccggaccgccgcgggtcatcgctccacggccgcgaccttcctctgcgggatcaggcggccgcggtggcccgcggtggcagaagttgcaagagaggctcctggcctactcaggggcgccgcctctccgaggtggggcgtcctcaactttcctctttcttgagcccggcctgctccgggctctgaggggcgaggacgcttcacgtggtggcctggggcccaccccgcctaggaaaggcggatcctttacgtctgaccctctagcaacccctgggccggtctgggaaagttccccagctgcacttctgggaaatgcagaggctgcctgccgctttctttcgcagttttgcggcccaaggcttgggcgaatcagttcacatcaacacccctactagcctctccctccggggtcgaccatttatctccagcagcggaccaggcgcccgggccagggtgacatgcgcgccctgcctacacgcagctcggatcctctgctgtttctggagaggcctccacaggtagaagctccctggaacaactgctggaataaggttccagagtggaaggtggaagctccctcttgggataaaggatccacagtggaaaaaaaaaaagttgccctctgctggaaaacagcatctttgtcctctgagaaaaacagtctcccttcttacggaggccagtggattccatcctagaggctgtgttgaccgtatctccaaatagacaataacgaggcatcttgattcccacaactccagcagcacagggacctgaaatgaaggacagaaagcaggaagtggaggcaatagaaattgcagagtagagtgaagacaggtggcatttctgggattggtgccatgacaatggaagacagaagacaagacaaaggcataactttccgtaagcatttcatggaccaggcgaatgcagctggatggggaagcctgtggcacaaggaggttccaacaagcagaacaaaagcccaggctagactatgcgctgtggcatattaggtaggaaataagggttattcagtcatgtatttgcatagaatgactgagtgcaaggtgttaacagtttcagaagttaaagattaactcaaaaactgcaaagctgagttttaagcaatgcctggctaaagattcatctagatgacttctgagttcctctcttacaggtgttttttctataacacctgtaactcatctcaaaccttgatgttcaaggctgttgaattaaactaagtttggcctgaggctgcctcttaggggtccctacaaaacaaactgcaacctagcttggtacataaacaaactaaaagcctaactagggtatacttacgttatagatagctgagtctcagccaatcgcagtagctgagcttcagccagtcacaggctgtcaactgatgggactttgaccaaatcaggggaacacagaggtttgaccaatcaagttgtttctgtccctcacttctgttttctgtctataaacattgcccgcccaccttgcccattgaagctctctgaacctcttctggttttaagggccatctgatttgaaaattattctttgctcaatcaaactgtgttaaatttaatatgcataagcttttcttttaacaaggctatgtaactttcatggtctttgaaagtgactcatgtactttctgtataactgcagtggcagggaagggagggggtataaatattatagaaatttcaccatctgttctttatttccccttgtagataatctaatccacttaagatactataatattttagtgggaaaatatattgaagttgggggtggggagaaagggaatggggaggaaataaatgaaatcataggtatggtgatttaaataggagtccaaagcttcttgttttcgtacatgtttggtgtttatcatgtcagcagtcagtggtgccctcaaaggtcttgttcttagagttctctaggaactgggtctaaatatctcaggatgcatagtgggacctcacatttggcaaaaagaattaagagtaaaaattatgtgaggtcgatcacacttgaagaccttttatcctttctgatttagttggtgcacagcagtacatatggttcccaatttgctaagatgctcaactccataccagagtgaactccaatgcgaatccatattgggaggccaggaagatgctccagctcaaaggtccccatgaagctgaggatttccaaggccatcttggcaatgtctattgcatgccgattgccatttctcttaggcaaaccactagccaccatgtacgcatcaccgatggtttccacctgtggaaacagtttctcatgagtgcctctgcccctttgaaaagtatagaaagtaaacagaagcagttaatcacatgtcaaacacaaaaagtgatttgggaacacagtatgagcatagccctttacactttttctggggccagttggatcagttctatgctgatttcttcagggtttttatagtccagttaatgggtgataaaatagctataaaggaatttagccatttaaaagtacttcataattatataaattgtccagatgtggtgacagttctagaaatgttcaaataaataatctgaatggttttatgtaatttgaggaacacccttagtttcctgaaaattaatcctttagcaaatgtcaacatactatttaacagaatattgtactttgtaatatgtaattgtatacattcttgtagtatgattttctatttattataaccccagtgtcttctctgcttcatttgcagtcagcctaaacactgcccattttttggaggtgatttaagagtatgccattttgtctaaatttaatacttcaaattaattcctgctgaacttcctgttgtatcttttttgctgcttcttaaagttgaatggtaattttgacttctcactcctctaatccttctacttctcttcacttttagctcagattcaaccaccaattcactaaatgtgaaactagagcggtcaagagtagtaacagaaacaaccaattcaggctctgatgaccttgagttgtacaattaatggtttcagcctgttaggtgatgtggttaccttgtagacatcatgatgatcaacaatgtggtcaaaactcttatagatgtcattaagcatgtccaccacttccatgggggtgctgtatttgcagatagtagtgaaacctacaatgtcactgaagtagattgtaacttcctcatatagttccggctccacaaagcctttctccttcagagactttaccactagcctagatgaacgaagggaaaaaaaatgccttcaacttcagcaaatttcttcttgtttcacataaatctttcaggtagtagtgattgtctaccaagaattctagaatttgagacttccagtgaattgagtgaatcggaaacagaggttgtgtatatcatatacatgaacatattacacaaatacacatataatgcatgttgtgaacacagatgaatacaagcaggttcaacattaacttagtgtttgattattaatcctaatacacataaatagataactttaatatcctcaaaactctcatacatatacatacttgtccactttttgcttctctattgataatcaacctcttacagatgtggctctacatgcagaagctgaggagagtgtggtattacttaaatcaccacaggtatcagatctgaatttctcaacaaagttgatagttttactttcctggcatatgtaatatggcattgcttaatattactatgaaataatgatgcatttaaatataaattttgatatattctgaaccagagttcatttgatattttgaaccagatttgggtcctttgtaaagcagaatcaatcatgtaaataaattaaatcatgctaaaactgtagaagtcaaattaaagcaacttttagaatatctttgctgaatgaggagcagcatatcagattcaagattgaaggaagagaaccagaagaagggactccatacttggtgtgccaagttacctcttcattgagaaaaggaagtgagggctgacatgaagtgggatggtccctgtctgtccttggcatcactttgtagtggccctcagtatggaaccactagaatcagaaactggaagctgggaggttccacggaagtcattgaaaagaaatctttatttttacagatgagaaagttgaggtctaaaaaagtatgacttccctaagttcccacagccgattagggacagagccagggctagaattcaggaagccttcagtcccacccatcagtctttttttgcattacactccctgcacaacccag

SEQ ID NO: 3961 - DNA, 1325 bp, Homo sapiens
aatactagagctctattcatagtgactcagaatggacctcagactcttgcccttattcaaaaatgacagattgccctccacatgaaactgcctttcctagtaaggtagactgctcggaaaagggtgggggagtttatcatgcaatctttctgaagaagccaaaggccatcatgctgactcattaatatctacagcctttcagccctttattaatccagaataagtaaatgaacaggtgctaactgaaaataaacacatatttaacctagtaaaaaaggatctagttatcctgtgtgactggaatgaaagtgttattatctttaccatttaactgaatagaacacatgaatctttttgttttgttttgttttgtttttggagacggagtctggctctatcacccacgatggagtgcagtggcgcaatctcggctcactgcaaccttcacctcccggcttcaagcgattctcctgcctcaaccccctgagtagctgggattacaggtaggcaccactacaccctgctagtttttgtatttttagtagagacagggtttcaccatgttggtcaggctggtctcaaactcctgaccttaagtgatccgcctgccttgacctcccaaaatgctgggattacaggcataagcctctgtgcctggctcagtatatgaatctttgaagctgatactataagaaaaaactggtaactgatgtattctacttgctttggatctgaaatgtggtagccccctaatcatgtttctttacatccaggatcttggaatggcaccccaacataaaataaattcaggatgaaaatcacacactatactagaaaatctagggctttctcatatatacaagtttggactgacagtccctggcaccttctaaaattcgttgtgatttgaccccaggatctgggattaaaacatcttgaatttcattcacatctgtgccctttcaaatgattaaaacttcttttgtacttaagttagtccattgtacgcagagtggtattatgaacacatgacaccatgggtttctttctggctgtgtagaaggaagaccatgctttctccaggtgtattttatcaggtacattgtttctactgccttacagcatattttatcacaaaataatctgcaattgccctagcttttggagatttagcattattttctgtaagaatcagattggaggttagacttccttatcattagcagctactctttgaaataagctaacattaaagagaagctctagagaacaaaacctcatttcagaaggcagacttgagcagcaggagaaaagcaggcatttgt

SEQ ID NO: 3962 - DNA, 2408 bp, Homo sapiens
ggttcctctcggagcggagacggcaaatggcggacttcgacacctacgacgatcaggcctacagcagcttcggcagcggcagagggtcccgcggcagtgctggtggccatggttcccgtagccagaaggagttgcccacagagcccccctacacagcatacgtaggaaatctacctttcaatacggttcggggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggcttcagggatgacttcttagggggcaggggaggtagtcgcccaggcgaccggcgaacaggcccccccatgggcagccgcttcggagatggccctcccctcggtggatccaacatggatttcagagaacccacagaagaggaaagcgcacagagaccacgactccagcttaaacctcgaacagtcgcgacgcccctcaatcaagtagccaatcccaactctgctatcttcgggggtgccaggcctagagaggaagttgttcaaaaggagcaaaaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacacggggttcctcggaggagcagaggtggccgccgtgggggggcgtttgggctgcggtgctgcgtcatttttcctttgctttctctttactttagacactggcccaactccaggagtttcctttcattccctcagtgcttctcttctgacctgcatgttgagttctgtattgctggggcttccaacaaaaaccagagtcactgacagagggaactgcagagaccttgttggtattcagctgtgatggatatagagaatcggaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggccatggaagagcggtagggagtccacggagaagatgcagtgaatgcttgcatgcattcacacgtgtgtgtgtcccagctagttcactcctttcgccgtgcgtggtggaggctcgcctctctggccgggtgcagtgaacggccagcgggtttcttttctgctgggccaaggcgctttgggggtggagggggtggtgctggcgctgcactgggctgactgcggcgctgacacagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactgtgcagagctgtcaggaaccttcagatagcagtagaggactgcagctgcctaggtctgcggccacatcttggggacacactggattgttcccatgtgcagggttcagcacttacgtgggagtgctaggggttaggcttttgagcttgaacgcctgcgtgtgaacagatgaaaaatccttcagtacccaacggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgaggctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaatatttaaaaaaaataaa

SEQ ID NO: 3963 - DNA, 2592 bp, Homo sapiens
gtgccaccaccagtctccaccactattctgaggcagaatgcacctattggctcacaatgctgtgaaagaaaacaagaaagtcgtgatgataacaatgcagtgtcttcattcataatggattgcagttccccactcaggaagaggacattttttttaaaactacatgatacaactgagagcttggaagctatccatgcataagttttaaaacccagcagcttcatggtttcctccttctgttggcctggccagtggacacagtggtcacgttcctggcatggagatgtcattcatggtctctcagacccaagtgttaccagtgaagggtgtccaggttcttggcgctttgaacaaagaattggacaaaactcacaaacaaagcaagaaaagaaagaagcaacaaaagcagagatgtattgaaaatgaaaacacactccacagggtgggagcaggccgagcaagcagctcaagggcccagttacagaactttctggggtttaaataccctttagaagtttccattggttacttggtgtacaccctatgtatatgaagtagtggcctgtgatcagtctgattggttggaagggaccaatcagaatgcaaacgtctgattagttgtggaaagtgaccaattagaggctgaagtgaagttacaaagtaatactcccacgcaaatgaagacttggcccacaaccaacctgattggttgtgagaggggaccaatcagagggactttcagtttttcacctgcaatgcagaaaaagggtggcaggtgaggggtgttgcaaagggagtagcctctggtccttttgttacttgggcacttgggcgtggaaagtgggggttttccttttgatttagttctaggaagtcagcgtgaattggccttacattccctgcctccagaccctattctcctgcctcacaagtgctcctaggagctgtacatgcctgtctttgtccccatgtagtcagctcgttacaggtgggtcctgctgggtctttcgttcttgcttctctgcttcaagatggctaataagtcctggtccagtgagtccccagtgcagacatagagcagaagggaagtgggtccagttgcatttcctgcagtttaataaagaaccctgtgctctctggcccattacctaaagctgatattgtgcttggaacgtgtagtgttatccaatccagctttaccactgctaaagctgataccacgctttgatcctctgcttgctcattttgccaagttcttaactgcgtggaactggaaggtgagggctggatgattgatttttcaccctgcccccaaactccaacaaccgaaaccaagggttcttgaagagagaggggcagggcagcaacagggagactgaaacttggggtggggggggggcggggggaggggggcggacggaatgtttttgaagtgtgtgtttgcctaaggtgtgtgtagaaaggtagctacttttcagtctctgcctgcctttaatccattacaatgtcctaattaaaaacatttaaaaagctacattggaaaatgatccctgaggctagaatgctgttggcacagtgaaaaagacgcaatcaataagtaaacaggcaatgtcagcccggagagctttcagaacaacatgcctactcgggggaaaaaaaattacaagtcgctttagcctatttaaatattttccaagatctttgttaaatttcaggtaataatatttcttcctttgaacaagcgttgtatgtttgcctttgactgagaatggcctaggctagagaccatttggtattcaacttgtgactattttagtatggggctggaccccaaaaattcatgctcaatgaaatgattttcacttactgagatgaatttactttttgcttccttcagcaattcatcaatctaatggaagaaagagtagctatcatcataatgagaatagacttctacgagtatgagtcaatgtcaatactttatttaataatgcaaattctattactatatatttggtctcaatccaaatttgctttaaattgagtttccttgccattgcacactcctatctttctgaacacacaccaccccacacacacaccatacacacttgtttcattgcgcttcattttattgcacttctcgaagaatgtgttttttacaaattgaagatttgtggcaacttttcatcgagtgagtctattggcatcatttttgcaagagcatatgctcacttcctgcctctgtgacagcattttttagcaataacatatttttaatgaaggtatgtacattgttttttagacataatgctattgcacacttgactaaaatgtagcctaagtataatttttatatgccatgggaaactaaaaaaagtgacttactttattgtaatatttgctttattactttggtctggaactgcctcacactatctctgaagtatgcatgtatagcttttcataacacagatatcacatttgaccagatcctattgttactgaacaatgttgatgctaacattgatgatatcaatcactattactggaatcattatcaacatatcaataaatatttttagaacattt

SEQ ID NO: 3964 - DNA, 1085 bp, Homo sapiens
tactggtcccatttaataccaatgacttttttttagactaaaactcaaactgttgccaccacaatcacacttcctctgtaactcaactctctcctcactctccatttgctctgcagttattcagaaaaatcatttacccaagtacccaattaagtctaccttttttttctatttcattaatttttgtctcccacggctccatcattcattgaatctaacaagatgctggacttaaaagaattagtcctttgtcctctctacttgactgcttcccttattcttgactacttccctcatttttacttgtagttaaaggttgagattaatcaactcaggattctctcaaccactaatacacagatcttcaaagaaaaatttctccttgctcataaacttttcacctacttcctacatttaacaatgtctaggccagctgcagtggctcacacctgtaatcccagcactttgggaggcaggggcagatcacttgagctcaggagttcaagaccagcctgggcaacatggcaaaacccagctctacaaaaaacatgaaaaactagccgggttgttaccatgctctgtgctgcaccaaatattatacttaatggaacggtgaatatcgtcctcagagtagctcttaatgatgaaaacccggccatgtttcagattccagtcaaaatctttggggttatagttattaatggaccgaagcttctccaacactgggtggggttctgaaggagtagatccagaaccagcctgagactgtcctactccattaccatccaccccattatgaccgaacccactgccacggttccgaggtgctacccagcgggttggctgagctgcctgttgctggactgaaagctgggcaggctgtggtggaggtggaggcaatggctgtgtctgttgccctactgatgcctgagccactggtgggctattgttagcctgctgacctacaggctgaggagacccctgggttggctgacctatattctgaaccaaagcctgtgagggggcttttgcaacgggacccttgttatcccaagttccaatatccatgttatgctttatcgggg

SEQ ID NO: 3965 - DNA, 4061 bp, Homo sapiens
aatcagagccagccagcgcaggcttgcaccgcgcagcaaagggggagcccagcatcaagtccacgcggaaagcatctgaatcccggctgctggctttactggcggagcacagaggaaaaccccaagctcctgcctacagccccggcctgtctggctccctcctccacgtccccactccacgccacgttctgtgcctggcagtccacgcgccctaatccaactcgcatttatttaagcacccgccgtctacaccgcatcatggttcctccaggcactgcaggaagaaatggccccatgccgggggaaagaaacaccaaaaggacagccgcgagggctgaagacgaccccgaatgacgggatgactgcctgcaacgggtggtcaggagaggagctcccaccctcaccccgcgggtcgtgacactcccagggaagggagggccccgaggggtgcaccaggcccggccttcctggagtccgccacagccgactggcggcgttaagaggtccgcatcccaggaccgcccgagcgctcctctgccccaaggaggcgaccccgactccggatcccgggaaaacggcgagcgcgggtaccgaacctcggtaagggccggagcgggctgtcaccggcccccgcatccctcccctgcggccgcggccggccgctccctccccagcttgacagtcgctgcagtcacggacggagcgtctctgccccagcgtcgccgctcgcccggacgcccgcacccccgtgccccacgcggaggggggcagtgccgggaagacctctccggaccctccccccgccctggcccccagactccggaaaagcggttacctggcgcgcgggttggggcgagagcacgactcggtggaggaggaagagaagacagtggcctccggcccagggagatttgggaaatttgggagacttgttccgcactaggtgacagctgttcgctgcgcacgcgcacaggaccccggccgcccgatcactgcgccgcgcctcaccctcccgtcgagggggtgggtgggaggcagcggcgaaggcgcgcgcaccgccggctctccctgcgcgagggcgcgcgcgccgtcacgtgaccgctggggcccgcacttggtgagtcacgtgggcttacaaacagcttaaaggtgcccggcacgctcttgctttgggctcaacttccgcgctgtggttaacttaggcttgctggcgcgcatcttcttgtcctttggacacaggcatatcccattctttccggaggggaaagatactcgcgtagaaggagaaaacaggtgcacagaaccttgcccggaagcgctggctggggtcccgcagggctggacctgatgtagtccacgcgccacacgtcctcctgggcgccgacgcgcacctatggcggcctccgacgcgcggacgtcagcgtggcgttaccggggtggagcctcggaatgtactggagagcctggcgagaaagtcggggctcgcagctctccggcgatgacagcgctgtgttcccgttctcccttcacccggtggccgggaccactgagcctccttcccacaatgggagatcccgaataggcgaagagtatcttcgtgtcccaaccctttaacaactaccgcgcaggagcgtgtcagcctctggaagcaaaactgtccggtgttgagtcacctacacccagcacgtcccgccccgacccgcccaagtgtgctcttaagatagggaggcacaaaggtgaccccaataggaatcctgggctggcggtccctcagaaactagagttgataacagtttggccagaactgaagtgactagaaatgcaggtgcctccagcgtctgagactagataagttaacttcctacaacttgttgcttttcctctgtaactccgccttccgaggtgtcagaaggaaccaaccagaccttaagcccctgtactgccaaagacagatggttgagcatcagatgttttgcaaagctgaatgattttttttttaaacttcctacagagctcccagctgggtcccttgtggcgttttctctaacgtcttagctaagaaagattgggcatatcttcacaccagtgagcaaagttgggctaatatgctgaattttctgttacattatactgataacagaattttaaaaatatatcgacaccgcttaccacgcgcttgaactcgtttctcactggggtgaacattgtgaggacagatggaatgtgattaattgagctaaggctaacgggattattgggtcaccatatttctttagttgttaaaaacaaagttccgctacacacacagacacactcttttttgagacggagtcttgctgtgtcgcccagtttggagtgcaatggcgctatctcggcttactgcaacctccgcctcacgggttcgagagattctcctgcctcagcctcccgagtagctgggattacagtcgcccgccaccacgcccagctaatttttgtattttcagtagagacagggtttcgccatgttggccaggctggtcacaaactcctgacctcaggtgatccgcccgcctcggcctcccaaagtgctgggattacaggcgtgagccacttcacccggccacacacaattctgaacttggctaacgtatactcaactgggaattttccaaatgtgtgcatgtaacgtcaggatcccaaccatccttacaagtaaattggatatgctaaaataataaatatgcaacctaacacttacttagaacagtaatgtgagctacacactgtcttcagagcttcacatgtattaataaatacttataataattcaatgaataggtactattaatacctcattgttacagatgtggaaactgaagcatagcggttaagaaatatgtccacaatcaagcagctagggtcttttggaagccatatgctatattagaaatcttgtgcaccagaataaaaaatctggaaacctgaaatccattttcttcagaatttgcagatgcacaaataacatttctttaccattgtgaattagagtatgacttttttttaacctgaagaactgaagtggatatacgaaccttgctaacttcactgagcactttttaattttaaggaagataatgtaaaatgtcaaaacacttcaaaagctgtaaagcactatgtgaatccattaagtgcttcacagtcttggaaagtgaagagagcctactagaaaatcaactggactcatggcactgagggcagtcttgtgtccctaatgtatcaaaatacctccatattatgaattatcgtgaaaacattttagccatatagtaaattttttatttagattcaattgtttaaatcccaattgcaatatattaatggaaggctgtatgaacaatacatagattccccttgaagtttatatgtaatgtgaactaacgaacagatcatcagatcacctcagagacaatacttgtttttattttattttatttatttgtttgttttttgagacagagtcttactctgttgcccaggctggagtgcagtggcgccatatcggctcactgcagccttgacctcccgggttcaagcaattctcgtgccttgtgcctcattctcctgagcagctggcattacaggcatgtgccataatgcccagctaatttttgcatttttttataattgagacagagtctcactctgttgcccaggctggagtgcagtggcgcgatctcagctcactgcaacctccgcctcctgggttcacggcattctgctgcctcagcctcccaagtagctgggactacaggcgcgtgctaccacacctagctaattttttgtattttaagtggagacggggtttcaccgtgttagccaggatagtcttgatctcctgaccttgtgatccactcaccttggcctcccaaagtgctgggattacaagcgtgagccaccatgcccggcctaatttttgtattttttgtagacagggtttcgccacattggccaggcgggtctcaaactcctgagctcaagtgatctgctggcctccgcctccaaaagtgctgagattacag

SEQ ID NO: 3966 - DNA, 2228 bp, Homo sapiens
taattcagaattgagtaaagaaatattttttctagtccttcatatattgaaaacttgccacatgacattgtatcgtcttcattttccagaagatgcgttggtgtgccataggtttctaacttccttgaaaatagttttttaagtcaattgtaaatatacgtattattgttaaaagtaactttaaactgcaacacatagcttcaaaacaatatagagattttgtaataccttataagtggagttggctaaaataccttatccatataaaacttattctattctttgcatgcttattttgtgtgttggttgctagcttaaagtttgatttgttgttactctttgtgtgccaaattcactaggcaagcggatttttcctcagacttcaaaaaataattcttttaagaaaaaatgtaaaaatgtttattctaaaaagctgcattaaagggacaacctataaaaagttttgctagctcatctttagaaggaagaaagaatattagcttgggtgatgtttaatttgggtggcgatagtttctgtaggctaaactttatgagaaaagtgtacctactctataaaggtaataaatgtaaaacctcttgctgttattgaggaagctcttcaactaccctaaatttcacaaatgtaacttataacactatgaaaagatttgaccaacaatttacgtttgctgtgtgctttagtttttgtttaagcatattcttttgcttgaatttctgtgttcatgagagttagggtgttttatgcttcttgaactaattttataacatatttaatatattaccagttaagatataaaatcatttgtacatagcgaattgtaaagcagctattaaagtaggtgaaataaagtatatatttgccggttatccatatcttttagaagtcctgacagaacaaccagtttatttgcacataggtagcttctgtttgaaggaaggtaaagttataaggaaactcaaatactataagatgtgtcaaggtatttctccagaattaattgcaaagctagtgctgaaggattttaatcagcttctaaaattttcttctcaataaggcatatgttttgattacttagggaagattcctcatttttatttgccctttatgcatttaatccacatgataggacattaaaaattaatataaagaaaaatcgtgctcatactgtacatctgtttctgtgcttggaactacttgttaatagtttttatcgaagctgtcagcaataagggacataaaactgctgtattatacattgtggaattgaataaacagcctaattttttttttctagtatagggtacttaagcatttccacttttggaagaaaagtgtattagtattttatattgcatttcatttaaaaggacagttttttttttttttttgtaaatccattcattgaaatggtttctaaactgtataatgtaatttggagcctatttagtaatagaattaaatgtcctatgtagtgctacaatttttgaattagaaagtgatcaaatgtaagaaaaaaatttaaaaattcagcccagaaaacaaaatagtgtattaaattagtttaatgtaaaaggaatttataagatttttttcctcaatatagatacctcacttgaaaagaaagcacagcatacttaaagtagttctagtaaacatgtcctagaaaacagttgctaaatgtaggacatcttttgaggaattagtttatgagaaataaaattttacttgtttttactatcctgttagaagtatttgtttatcctgataattttaagccaacatagtagtcttaaattacttttgaatttctaatctgtgaaggcagtaaatgaaatatctgttctgcaactgttgaaacaaataattggctacattgaccataattaaagttaaaattttgccaatgatgtacagttttatggttaaagttgctgtggttggttgcattacatgacacagaaaactgtcctctacctcacgtgaaataaatattttatatggttttactaaaaataagactcatgtatctggtcacctagtttacaaattttgaattatatttattgaaacatgacatactgtgctctgagcttatacctcaattgtattttgtgctgttttccattttcatgccttgtaaataacttgtatagattgtggatcaaatactaaataaaaacttttaatgccaaaaaaaaaaaaaaaa

SEQ ID NO: 3967 - DNA, 3593 bp, Homo sapiens
acagcctgtgggctacgggaacgcgatccgactcggcggccctccctgcctggatggccggtccccgaggctgaggaagtccattcctctttcggaaatggtccccaggaagcttctccgtgtccccctatggccggcgggtggtctgcggccgtggcccccgcccctcagcgcaggcgaccctcctggccctggcgggcacagcgcctctcccgtgacctgggccggcccgcaggatgagcccccggatcacgatcgctggcattttatttaccttcttccattacaaccccaggcgagtctcccgggccccgagaggagggggtgactggtcagggtcatcggtagcggcggcaggggcctgcatagggctgcctcggggcgactagcagaatggccgccagcctcggctgccccagcccccagcgcatggaatgtgccccgggccccaggagctccaggaaccgcgcttgtgagacggagcttcggctgcttggagctagtgagccaccggccacggcagggatttgagcagaacttgggggcagagggatgagatggtgcatcccttgaggtcacttcaggagatgacactcctgtggctaagtgtagcttcccaggtcatggctcccaggtcaggcctggtcaatggagaattaagtgggcgttgggtggtggatggatgtgatttggcagaggggacaaatgtgacaacagtgtaataagggccatgttggggagggtcaggggtcagggtccggcccaacctgagcagaagggaggctgctctcagggatatttgtcaggtaggaatgggtggagtggaactacagggccaccatgtttcccatgggtcacccatggtggccttgtcatgtttatccgtgatcctcagtgttctctgtggtcctcccgtcacccctttcagactgtcctttcagttctccactgtccctgcatcacctctgcccctgtcccgtttgtctgtgttcagtccatgttcccaggtcttgaggtggcccctggttctatgccccttacctaagaccctgtgcagggaatctgtgaaaacacagaggaaataaaaagtgaggaaaatagtactcttgcatcctcgaccaagatagtgtttgttgtgagtgctgagacggaccagcattctctttgttggtgaagaggagacagacccatccacaggagtcattggcttttttgaatactaagctctgactgccattcatcatctacacagggacagaaaacccggtctgggggacgtggcacgcagcagtgtgtgaggggaatgccaaggaatctggggagcgtcaaggaatctggggagcgggaagatggagcggggtagctgcctggaggcctcagtcccacagcagtgaggacaaggctggaggttagccaagccctgccctaggtgtggtcacgacctcaccagctcccttttccttttctctgaggccattgtctctcctgggcacagtccgtaaggttcagattccagactgtgactttaactggtcaccgtggctctggctggagcaggacatggtgacctggagtctccatccactcctccgatgtgcacttagccacctcctggggctctccccagcactggccgagcatcctggttagtggggaaacgtggagcaccaggctagaaatcaagacccttctgcctgcagactagcttggagacccatccacgtgtctctgctcctctgccccttaagggcaggtgcgccccagtgttcttagtctgtgctactccctgctgcgggcctcctctctgcagtctggttaaatgcaacttggctccctccaggcccctgcctgcctctccagcctccagctctttcctgcacagacacctttccccttgggtctcagctccaagactggaggctgcttgcttcttgagggaatgtgtgaagcagcctacagtgtgggttctatctaccagagtacgtggctcctccatgctcgtggccccaagggactcagacccagctcaatcaacatttctggctgggctatctgatgtctgccgtgtgattcaaagtgcagcctcggccccttcctgtggagagggacagggacaggactcggtgcaggtgtgcagtgagtggctggcatctctggaggtcagtatgtgagggtgggggtcccctccaggcagctgcgagggcttggctgctcccagaactgcctggaacctggggagactgtaaacaacctcttgcaaccccaagaataaagctgccatgtgtgagggcttgctctgagctaagcatgattctgagcaccggcagggagtacagcaagtggatgctgaggcctggagggcaggccccagagagctgagtgcccctccaggtttcatggctggcactgtggaccagtgtggcccactgcctgcttgccaccccacaacaaagcttcagaggtgcagaaccagtggcctgagctccagggacaggaagcatcttggcgtggggttctcatggtggcacttgcatgccctagtgcacaggggcggaaggggaagctctgttgcctgggccctttctctgtggcaacagatggggaagtctgccgtgaggatagagagtgcatggccatcccatcacagcacaggttgagtgctgagccaccccgagccctccccagcccagcggctctccccaaggaggcttcaaaaccccgtgctccctttgtacccccaagcccatgcttggctctcagatccacctcgggccctttgcaccccagactcctccccagctgcacattcccgggattccaggcatctggtgctgtgtgaggtcactaggacagggcagtctccccagggacgggacctgttcacatggagtttctggctggcaaaagcttgttctccagtctgagccaaacgcttgcatgactcttcccccacggaggcacttggacaggaagctggcttctctgcacagccaggggcactaagtgatcccatcctgcctgagcgtcctccacgtggctcataggctgtggaaagaggggcttggccccatggggacatgccagttcagagctctggcctccagccagagggacacctttctctgaggctcatggctgtggcatgaggtgcccagagagccctggtcaggcagccccacctcctgctgccccagggcagctgcctcccagcccaggtgaaggaacaagggagggcccctgcccagagcctttgggtagcagatgccagacacccacccccacctggagttcagaggcctcaacgtgcccccatctcctcctccccacgagcagcccatttcactcactgaggagctgggcataccccagaggggccctgggcaacccaacccttccctaagcttccctgtgggtgaggggcaggcagtcgtcctgggggctccatctcctgggcccagccccctgctctgaacactctgccaggccacccctaggccttgtcaacacacccttttacccatgccacgggatcttgcccagaggccacagggaaggccagggtgcacccagatccttcttggcctggcgctggg

SEQ ID NO: 3968 - DNA, 2814 bp, Homo sapiens
gaatagctgggctgttcactcctggtgacaccagcgcggccccctccgcgcccgccgtgccggccgccgcgccaaccgggaccgggggagggtaggacacctgccgggagcgagtcccgggctgactccccaaggccgcgcggggtgtggagaggagccggggtggggcctctcgcctccggcgtccgccgggtgggcggccccgaccgctctgctgtcccttacggcccgcacgccctttgccctccccggggacctggcatcttcacatctcctgccccgcctgggccgcagcttcgagaccgctgagccctcctcctcctttttctcctcctcctcttcctcctcctcggacttcacctccaccagggacttccgccctggggcccggccgcgcgctcttccccactgagtgcgtcttccgcccccgaggccccgcggctgcccccgccgattctcgcgccgacctcacgcggcgaggctgagtgttatttttattgtttttatttttgcgatggagtttcgcttttgttgcccaggctggagggaagtggcgcgatctcggctcactgcaacctctccctcccgagttcaagcgattctcttgcctcagcctgccgagtagctgggaattacaggcatgcgccaccacgcccggctaattttgtatttttagtagaaacggggtttctccatattggtcaggctggtctcgaactcctcacctcaggtgatctgcccacctcggcctcccaaagtgctgggattacaggcgtgagccaccgtgcctggccgaggctgggtgttatttatgtccccgtctgtgtctccgcagacagagctcggcctagaggaggccgcggcccagcggcacacagccggcgcgcaagtgcgaggccaaggcaggaagccgccggcccagccgcctgcttcccaggaccgaggaggcccctggtcgaggctggctcacctcacccttgggaaagcaacagaggacaggaggcagctgccacctaaggtcatggccacccacatcccaccacaccgcgtttgctctccctgtttccccaggttaggacatcatcgggcgcttccatgtcgccccgggaggctcccctaaagcaagggcatggccacggggaggctgctgagcaaagctaattccggagttccacaccaggcctcttgagagtggggcctgggcctctgcatttgaaatgtgctctaccttcaaggctttgagatgatttgagaacagggagggttttagggaagagagctagctgacagcaggcgatggcaggtgcaggtggggactgcggcagactggatttgatggggcaggctggaaagacagggcagacgaggatggactgggagccttggtcagagaatggccggatcatgaccttggagcaccatgcccacccgtacaggtatcccttactgcctgctaagggatacattggaccctgtcctccagcaaccctgcaaaatgggccttattgtccctattttaaaggctcagagagtgaggccgggcgcagtggctcacacctgtaatcccagcactctggaggccgaggcaggcagattgttttgagtccaggagctcaagaccagcctggccaacataacaaaaccccgcctctactaaaaatacaaaaaattagccgggcatggtggcacgtgcctgtagtcccagctactcgggaggctgaggcaggagaatcacctgaacccaggaggtggaggctgcagtaagccgagattgcaccactgcactccagcctggacaaccagagtgagaccctgcctcaaaataataataataaataaataaaaatcaaggctcagagaggggatgtgacttggacaaagtccctggtgaggagggtacagaagaatcaggactcagtttaattcctccatccaggccctagctagacactaggcatggaaagatgaataaagtacacttcctgccctaaaagagttgttggtacaggaagaggggcaggcagcaaacatatcacaatcgcaatcacaatcctcatggaggtctgatggagcagtgagggctcagagctgaattttgaaggatgaagaggagttaccccggaagattcgggaggggcatccccggcagagggaacagcttgttccgctgctcagaggcctgaaatagcaatcgcttgtagggatctgtgagctctttggtgagactgagcttagagtgtgttggtttggtgggagatgaggcttgatgtgcccagagagcgttggccaggcaaggaggctggattttgtccacagtgcagtaagagtgtgagccctgtggaggaggggtgagcagtaggagggacctgaaggagaagagcagaggcacagggctccctcctgccccttccctgtatctccatggcaacccctctttcccccaccctgactctaccttagctgtggacctggctctctatcagcagctaaactggggactgtcaggagagaccagaccccattctagctgggcatgatgtgcttgctgtgtggcctgcagcaggccactttgtccccttgggtcttggttttctcttctgtaaaatgggagcagcactaatccctgcccagtccctctgcggggtgagtgaggcgcagaggtgatggccaggtgggaggggcttgtctgctgcacagcccctgtcagcaccttgctaggcattggctcaattggtgcatcccccaacccccatccggtcaagccttctccccagtgatcctcccgaccatgcccaccagactttaggagaggct

SEQ ID NO: 3969 - DNA, 1616 bp, Homo sapiens
ttcctgctgtccacaagctttgccgaacgggggcatgtcccaacttgttcagtcccaccagcccacggctcctgggctggcctggcgccaccaccacttcccataacgtggggtggccgcctggtgccaggagagggcaggagggctacagcctttcacctgctgttcttttgcacccgctgttcggcaggtcccgagttcttgtcctgcgtccaagaagaatgaggttacactgacaattgcagagtaaccaaggcagagaggacgtttattcagcaacagaacagctcccagcagagaggggacccaaaggtggtagtcccactgtgtagctgagtccgggagtttttatgggctcagaatgggggagtgtgtgctgattggtccataggcagcctggaaaaagcaccatttgattggctaaaaggcattgcgggagttctcacttgggtcttagattctacccagaactggcaggtgagttttcaggcttccggcggtctttgactcgaaggttggttttcaccagggacccgcccgtatctacctaggaatttgtctgcttcccaccactatcagtatctgtccatttatactaagttctaaaataggcaaaattaatctataatttaaaaaaaagaaaaattcaaaagaccaggcttgatggctcatgcctgtaatctcagcacttcgggaggctgaggtggaaagattactcaaacccaggaattcaagaccagctcggggaaaataaggaaacctcatctctacaaaaaataaaaaaaaattatcctagcatggtagcacacagtggagtcgagactcgaagcttccacgcggcggaacagcgtccctctcaggcggcgaacgggctagggaagcgcccggaggagacctagcgtgagaactacaactcccgcggagcccgagggcgagctgcctgcgtaacttccgcttccgccacctgcccctctcaccctcttcactcgaaccctacccgggagcggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgtgagtgtgaggggcgtggaggaggaggcgggctgggttgcgctcacacttaagcgtctgtgacaggagccggaatcgcattctcccttgaccatggttctagccaaagatctggctgaggagccctaagggtagaatggaggcggaggca

SEQ ID NO: 3970 - DNA, 1981 bp, Homo sapiens
tgttgggattataggggtgagccaccctgcccagcctgctccagcaaatcttaaatatccatgcacactgaataaacatgcacctgaaacaggtgcacgtttcaggaagtgaatggaactctccaggagagtttgggtcccatcatgtgtaccttagaaacagaagtctcaaaagtctcaacaacatccacaaaaacatctgcatctgttttccagatacttgcaaccaaaaataaaacttcacaggaacactacacaagaagtggtagacagctaaatcttctccaaactgagacctggaccataaggtcttggttgtagcaggtctggcaggggttatctataaacctgcacgcagggcactgtgagcgggttgccagggtacatctgtggccaggtaagggccacagagacagtcgtgatccccagcagcttcaaagctgcaaaatgctgggcttttttttttttttttaagatgaagtcttgctctgttgcctaggctggagtgcagtggcgtgatctcggctcaccgcaacctccacctcccaggttcaagcaattctcctgcctcagcctcctgagtagctggactacaggcacccaccaccatgcctgactaatttttgtatttttagtagagacgggggtttcaccatgttggccaggctggtcttgaactcctgacctcaggtgatccatactcctcggcctcccaaagcgctgggattacaggcatcagccactgcgcctggcctagggctttcttttttaaaaaacaagtcctaacaaaagggggtttctaccagcccctgagccacaccttctgaaactcccttgcccaggatccccacagctgtccacctcgcaagtcccactctctgcccacagagactgcctaaaaggaggacacaacagatttcagataaaaagcacctgtgtatcgtaaatatttcaggaaaaagaattcagatcttttcaaaggcttgcttattgctgctaattgttcctgaggatctttctaagcagcaatatacttgagaatattagctgctactgtttgttttccctctaaggtcctgaggaaatcaaaagaaaaaaaaaaaaaccctcaagggtatagcttttgtatatagccctagtgagcaaactgcaaattgggacatgcagtagattctggagcaatctccaatccttaccaggtacttcctggcatcaaatccccaggacatttcttggcccctccttgcattttccgtttcaaaatgttgaggttaaaatacatcgaagcacagagggaagaaaatctcaggtcttctagaaatggcgatgtcttcatttaaaaataggactgatgggggcttggcaggggtctctaggatccaaaagaggttgagttgcatcctgcagcccaactgtccacatttagaagtgacaacattcatgaactaagtcaacatccaccaaaaataacatgaaataaagctcacagtttgggaacatgaaaataacgcacacagacctcacccaccaatccctaagctgtgaaaacaaacgctcgcatttaaacttttctcaaatgtcaaattagcatattcttcccctccatgtaaagttttaataaacttgactcaatctgcctttattaaaaaaccttacaaaagatgtatttaaatgcttgaaaaaattaactttatgctctatgcacagataaatttctcttactgtacaactaaatatggttatatcctttgtttaaaaaatattttttcccccactaattacacttcgtgtgtagttccacgtcaatgatctttccgctcttctgggaatgtgtcctaagagctgccgggtgggtggaaatagccctacacagcgccactttcttgctcagtcgtgtttattaagattgtttggggtttggggtttttttcctccgttttcgttttctgagacagcgtgctggtaactgtggacccgcccg

SEQ ID NO: 3971 - DNA, 1513 bp, Homo sapiens
taagaggagtcatatataaagagaatttaaacctttacaagaaaatacagaactaagaagagtgatacagtgaaatgttctaaagattagggatcagaaaatctgggttcctattaattactataaatgtaatattagacaaccatcactattttcactgttcagtgaggtcaataataataggcctattaacagcagagtgattttctcatttatcagatgagaacatagtaaagaaaagcacaaactgtaaaacaaaactcataatgagtgatgctaaaggacatcttgtttgagttcatcgtcataggtaaaacttaaaattggcactgcattttctaacagccatggctaaaaggaaagcctgttgactagagacacaaattattattgtctgatatgaataagaagatgaactttccccaaatttatcaaacatatgtaaagttgacactaaataactggataaaactgacactgaataatatgttacacaatgtgatataaaaaacaaagcaatatcactcagataggagtgtctacaaaatctgagtatgtaaaattagatataaatgtagtgaagatatatatgtcttcagaaaactaaggtaatatggtaaagatatattatttaatgataatctatattcctaaaagtagggatgatatttttcccaaagaaaaaggatggaggaattgactggctggtacaatgcattttataattcaatcgattttttattctccactggtagataatttacagaaagctttaaatcaccttcttgacctccttgaatgctaactcttttatgacaaaatagacttttctggaacagaaaaaaaatatcttatttttctacatgttcacaatgaatggccttaagactttatccttctactctcacagaggatatgtattcccttaactcaaacagcaaatagcaaacagctaagttcatgatagacagccaagtctagggcactagaatgatgtttttaaaattactactaaaacgaataaccacttatagtttaggaatagtaacattgcttatctaatatttgctacacacattttctccagtaattttgcttaataccttattcatgattttgatctatgaaattttataatttgtataaaactaattaaattgtgatttttgtttattgattttaaatgcaaaatttatgttatatgtagaaatatgatttatatgttgttctaattatgatgtttaaaatttaacttaaaactacacatgaaatatgaaatataagttgtgatgagaggtacagctctttatttctaattatgtcactcctcacacagaaattattttatctacaagtaaaaattttaaaaaatggaaatgatgacaatatctaaaattttaaatgttttaaatgttttcacccattttctgaaacaaagattgtaaacgatttttcatatatcagtctaacaaagatttttaaaatgtttactagtcagtaaaaagttacattg

SEQ ID NO: 3972 - DNA, 5338 bp, Homo sapiens
agacaaggtcttgctctattatcactggagtacaatggcgtgaatgtggctcactgcagtctcgaccttcctggctcaagggatgctcccacctcagcctcccaaatagctgggactatagacacatgtcaccacatctggctaattttttattttttgtagagatgagatttcaccatattacccaggctgttcttgaactcctaggctcaagtgatttgtctgcctcagcctcccaaagtgttaggattacaggtgtgagccactgcacccggctgccttttcactcctaattgtatcctctgttgcacagaaatttttaagtttgatgtagtcccatatgtctccttttttttccccatgctttttatgatttctagcatctttttgtgggcttattgtgcttgtatatcttctttggagaaatgtctgttcaattcctttgcccttttttgaatggggttgtttggtttttctgttgtggaatatttaaatttctctatgtatcctcaatgttaagccatactagagatatgcttttcaaatattttcccccattctgtgcatcaccttttttactctgctgaaagtgctgtttgatgcaaaaaagtgtttaattttcatgaggtccaatatatctattttttcttttgttgcctgtgccttgggtgttatattcaagaaatcattgacaaatccaatgatatgctcttctacactcttaaaaattatagacaaccccaaataacttttatttagtggttttaacaatatttaccatgtctgaaatatgataaacattaaaattagtattttggaaaaatgccatattagaaactgatgatttaaaagtaacaacaatgaatccattacatgtgaacatactgtttttttgtttgtttgtttgtttgttttgagacggagtttcactcttttgcccaggctggagtgcagtggtgcgattgcagctcactgtagtcttcgcctcccaggctcaagtgattctcatgcctcagcctcctgagtagctgggattacaggtgctcaccaccacacccggctaatttttgtagagatggggtttcaccgtattggccaggctggtcttgaactccagacttcaagtgatccacccaccttggcctcccaaagtgctgggattacgggcatgagccactgcaccaggccaacatactttttataaaaacagctgtcttctctaaaacaacaaaaaaatgtagataatagtagtatcattttatagttttgcaactctctttaatgtttggcttaatagaagatagttggattctcgtatctgtttttgtattcagtctgttgtgtatgttgttttgattgaagtagatgaaggaaatccagctacatacagatttggagttggaaaaaatagtattttaataacctttttagatcatggtggatactcttctttgttatgtcatcaaaattagacaaatggcagtttctgaaaaattagttgtaatgtgtgtaaaaaattagttgaatccatatcagtgaactcatacttttctatattaaacttcattgctctatcttgcactttgaatgggtcttttattcatgcctgattttgtaacatcatgcattcgtcattttgaaaatgatggttcagtgaattattcacatcttctaaatgtaggcacatttcagtctataatatcaaaaacatatttgtcagtgttaccactgatttcatcagaaaagtcttgaggtgttaagaagtctttaggtatctaccagcatggatacacattttccaaaattttaaatcttcacttgacagctcaaattttacagttggcaacaaatactgtcagttgttttctatgaggtgacaggttcacttaattcatttttgagaaaatgtttgccaaatacccaagtctgaataatcatagtttgttagtcatttttttcctaataaaaatgatgttctatgaaaaagcaagtagtcagcttgtaattcaaacaatcaggtaagtgcttccagtacttaggtattcagcagaagtgctttgtgtacagagtattaataagacatgtattcaagggataagttttaataaaattaataattattactctatcatggacatttttacattaagtttgcctttctgttgaactgcaagtacatgggggtgaagactgtgactcctggtgcagtttggtgcctcttcattgacttaaggctctagaaggcaccaaatactgttgcttttgcatcatcagtgcaaatgtccgcaaagtgaatgctgcagaaaaactcttggtattattataaaaatgatgttgaccttggccgggcgcggtggctcacgcctgtaatcccagcactttgggaggccgaggtgggcggatcatgaggttgggagattgagaccattctggcgaacacggtaaaaccctgtctctactaaaaatacaaaaaattagccgggcgtggtggcgggtgcctgtagtcccagctactcgggaggctgaggcaggagcatggcatgaacccgggaggcggagcttgcagtgagccgagattgcactactgcactccaccctgggccacagagcgagactcatctcaaaaaaaaaaaaaaatgatgttgatctcttggatcccccgggaagggtcttggggacccaggagtccagggatcataatttgagagccatggcctatacgaccatgggtactaatagcacatgcctccagcaccctccatcagcctccctcggcctcattttcctcagttgtaaagggaggcctgggcaggctctgtttcttcacactgttggaccctgtttgctagcccccgaagctgcttctcccttagcggtgatgctgctttcagctcctgcttttcctccctctctcatgcctccctttctctccgtggctcctcttcccctcactctttacaggttggcattcttcttgtttcgtctcctcctcctttccctggatgatcttatttcctccctggtctttaaccatcacctgcaggctgacagctcccaaatctctatcttcaatccagatgtctgtcccgggctccagttttgtggttccacctgagacctttccacctatatgctttacaggcaagtcaaagtcagcatgtctaaactggtttcttcgtcttcccctacacattgcttcctcttccagaatagacagtcttggttaatccatcatctgctcaaatgcttaagccagaatcccaggagtcctcctccccttatctggctccctcccttccctcatctgctcacctggcctatcagttctgcctcctaaacattttcccaatctctccctgctctccagccccaccaccactgcctcagctcaggcgctcatcccttctcacctaaacgattgcaagggtcttctccctggccccctgccccctgttttcaacctgtactctacagttctggttggaaaccacaagagttatcttctcacactttttttttttaacttttaatttaggttcaggggtacatgtgcaagtttgttatatagttaaactcgtgtcacaggggtttgttgtacagattatttcatcactcaggtactaagcctagtacccaagagttattttttttgctcctttcccttttcccacaccccccaccctccaccctcaaggaggtcccagtgtgtattgctcccctctgtgttcatgagttctcatcatttagctcccacttgtaagtgagaacatgtggtagttggttttctgttcctgcattagtttgctaaggataatgtgtttttcattaagtaaatacatatcgagtacttaccataccaggctctgtgcaggctgtgggaatacaacataggacataacagatactgtcctgacctccagcactcacagcatatgaaggaggagagaaaaggacagggcacaggtcattaggacccagtgcagtggggaaagatggcagaggtgcttgggaacccctagaagttttgactgagggctgagtctgagggtgttcagggagcacttcctggaggaagcagctctcatgttcagactgcagcctgggtgggagttaactaaaagagatgggagtgttgtggtgaaaaacgttactggaaagtttgatcatttaatttccctgttaaatacttctcttgtgagcttcaccactgcctgcaggatcaagtccaaattccttatcatgaaacacaacctttgtggcctcgttgtctgccactcccctgtattcattgtcatcagcttgaactgctttcagttccccccaacgctgcttgctcactctctcagctccaggcctttgcacatgcagttccttgtgccctccacccttgccacgcaaatccctactgcctatctatccaactgtgaatcaccccacgtcagctgttcaggagaccttcctggcccctcccctgtagactttgtggctccctctcttgtgcttcccacctgtacacacacctggactcttgtgcccttatcacgtccttagagcttttccacttgtgtatctcccgtgcccctacttgacagtgtgggaactagacccctgtctagttcacataccctcatcccatgagcattttgggcatccccagggtgtgtgactctcctgtgctagtggacaaggttagacaattaccattaccttttcgtcttttcccctcctccagctctgtgacttccctttgcccctaccacaccccatgtagctatcagttttgctggacacggccacacccatcaggcaccccatacctgctgggagtcacggacactcctatagcagcagtgctgtggggctgctggtccctgcattgccttatagagccgtggggcttcgccctacagatacatctaaattacaaataccagtccagcccagaatcagttcttgctgttgaacgcaactgtctctgggtcagcttgttgtgcctgttttccttcttcccttagaaagagttatttccttcagaacctttctacccctcatgaaaataggcttcccaaaggtctgcccaccagccaactagacagatgtggcctgcattgtccccctggaggcaaaggatgtgtgggtatttatttatttaagatagtaagttatggccaggtgtggtggctcacgcctgtaatcccagcactttgggaggccgaggcgggtggatcacctgaagccaggagtttgagaccagcctggccaacatggtaaaccctgcctccactaaaaaatacaaaaattagctgggcatggtggtgcatgcctgtaatcccagcta

SEQ ID NO: 3973 - DNA, 4401 bp, Homo sapiens
cccgcctgcccctcacactgggagccgcccgctcgccccgggacgcggggcgcccctgaacccgcccgcgcccctagccacgactcccgtcccgaaaactacggctgacggcagaacgagacccccgaggagctgcgacccgcgggccgtgcaggagccgggggtgcgcccgccccggctgctcagccccggcccctcagccctggcgcccaccgtcaggccggtgcccagcacgatcacgtcgtactcctcattcatggcggggcaggcgcggacgcaggacccgagcaaggaaaaggcgcaggggctccgtgaccaccctacgaggctgggaggcgctcttgggcgcgaaggaaaggggaagagaaagagaggaaaatggagctggcgacaaggcgagaccgaccgccacctcagacgggaagagaagaactgggcggggagaggaggggagggagcgaggaggggagggctgtgactgagcctccgcagccggggcggggcctgcaggcgccgggagggccgccaatcaggcgctcccggcactctaattggttacgtccccgtcgctcgcacaactttttttccttccccgcctctcgcgagaggaaaagggcggggcgtcgccattttggcttccggttccccttgcggcctctgccacggtggttcgggaggcggcgcgcgggccggggtggaggtgcacggagccgcgggcggggactgctggccaccaccgttctgactcccgccgtcggggcgggagctcgctcggtccaaggtcccagagccggatcgccgcccttggactttgagcgggcgcgtgcggcggccacgtgggcgaggagcgcgggccgggctgcctctcgggggtggcggccttggttcctcccgcggggctgggcttgccggggcccggagcccgccgggaagagttcggaaatcacacgtgtcctttttcccgctctgtgccctccttgtttagtgcgttgccggtgggcgctttaggaaattggtaggaggaaaagcggcttcttttgaaaaggtaacccttaacagagatgaaagtgaaagccaggtttcattgggaagccgatctgcacctaccgagggctgtaacttaaagccgctgtaaacgtggtagctgatccttgtatgcaaaggtttaggccctaagcttagaaactgttccttgcttgccttctaccccgctcctctttttctagaattctcttaggaatctctggcttcattgaggacacaggtgtaagcagaagctgtgttctcagctccaagaggccgaccccacgaaagcctaagcaggtgaatttcgtaaagacgttgacagttggaaaacctgtgctttcagcacgtgataaatctgcagagtcagcagacaatgaagatttggcattcaagaactcctcaaatacttctcgatagtagctattcagagcctgccttgatagaccgaacttgctcatatttaaatcattaagatagaggaaagaatgtaacaactttttaaaatgtttcttaccccataaatacttgaagaagatatgttatattggaccatggatctttctgggggggaggggagaagaaagcaaaagtaaagtttaaatttacattcaaccttaatttgattgtatatatttgtgaccaaatgaattagtgcacagttgaccatacaactgattatgcaacagtgagtgtaactgacttttcttttggctaagctaatgatgactaaagaaggtccttctgttgctctgtcttcaagtcatcagggggtcatactacctatatttttgaaccaatatgaaataaccctttttctttatttttctgagacaatctcaccctgtcgtccaggctggagtgcagcggtgtaatcatgcctcactgcagccttgatctcctgggctcaagccatcctcccacctcagtctccccagtagcagggacaagaggtacaggccaccacacctgactattggcccttttttttttattagcaataacaataaagagcttttttcacaattgccatcagcctctggctcttgaagagaaatttaagcatgtcaactgaattatgttaaccatgttttaggtgaagactattttatcgatactcaagagttgtgagaaacttgaagacactgagataagggaattgaatttaaggctaataaggatcccttccttacttaacactgaagttcattttagttcacagtacaggccctatggcccaacagaaggacaataacaatcaaacctggactaagccttaacggactgagtgcatctaaaatgttgtacctgagccaggcacagtgcttcacacctgtaatcctaacactttgggaggctgagatgggaggatcacttggggccaggagtgggagatgggagaatcacttgggaccagcctgtgctgtagagcctaggtaacagagacactgtccctataaaaaaaattagctggaggccgggcacggtgattgatgcctgtaatcccagcactttgggaggctgaggtaggcggatcacaaggtcaggagtttggagtttgagaccagcctggccaatatggtgaaaccccatctctactaaaaatacaaaaattagccgggcatggtggcacgtgcctgtagtcccagctacccgggaagctgaggcagagcaatcgcttgaacccgggagacggaggctgaagtgagccgagatcgcgccactccactcccgcctgggcaacagagtgagactccgtctcaaaaaaaaaaaaaaaaaaactgggcaggctgggtgcagtggctcacgcttgtaatcccagcactttgggaggccaaggcgggtgaatcacgaggtcaggagttcaagaccaacccgtcccaagatggtgaaaccccgtctctacgaaaactacaaaaattagttgggcgtggtgtcaggcgtctgtaatcccagctactcaggagtctgaggcagagaattgcttgaacccaggaggcagaggttgcagtgagccaagatcgtgccactgcactccagcttgggtgacaaagcgagactcagtctcaaaaaaaaaatcagctgggcatggtggcatgagcctgcagtcctggctactcaggaggctgagctgggaggatcacttgagcccaggaaggtcaagccatgatgatgccactgcactctagcctgggcaacagagcaaaaccctgtctcaaaaaaagaaaattctgtgcttttcttggatcttccaccccacccattccagttgcaagggaacttgtagatgacaaatactgcttaaggtgaagaggcttgaaagccactaattggttgagttgatctcatgccacagatggtagttcctgctacagtgaaaccttaggtttaggggaagtaggttggttggtgaagatgagtggtaaacatcaatctttatttttaattttattttttggtgccaaaacccaagatcaaaccaggacaccatcaatctttaaaatatttcaaatcttgaaatcagccaggtgtggtggcacatgcctgtagtcccagctactcgggagacaggcaggagaatcagtggaacccgagaggctgaggttgcagtcagccaagatcgcgccactacactccagcctgagtgacagagccagactccgtctcaaaaaaaaaataaaataaaatatttcaaacctttatgcaaagcaggaatccatggagtcttatttatacttgggtacatgggaataattgtttgctgatctgtttttactaagcatccatctgccctttgaaaaggagagatttaatctaaggaaagaaaatgagagcgaacctcagcccagaccatctttttctctcctgcatcactgtggcagtttctcaacaggcttttttccctctctttttcctcttctcctatctgttctgtccattatcttctaaaaacacgcatcagatcatgttcaggcttctgtatatcttttgtacttagaatacattgtagatcctagccaggcatggtggctaacgcctgtaatcccagtgctttgggaggctgaggcagatcacctgaggtcaggagttcgagaccagcctgaccaacatggtgaaaccccgtctctactaaaaatacaaaaattagcctggtgtggtggtgcacatctgtaattccagctactcaggaggctgaggcaggagaattgctggaacctgggaggcagaggttgcagtgagccaagatggcgccactgcactccagcccgggagacagagcaagactccatctcaaaaaaaaaaaaaaaaaaaaaagggatacattgtaaatccttaaatatgacctaataccttaatctagcctctgtatgtctctcc

SEQ ID NO: 3974 - DNA, 2002 bp, Homo sapiens
aactcttatggcctggaatccttgcgtttctgctgatgactgtcattttagagtacttactaaagacaatggttggggaaatagatattttaaaaataagggaaaaagtgggtagggtaaacccaggcttacttatgtaaactctgagtgctgaagttagaagacaacttttaagattaaaaaaaaaaaaaaaaaaaaagatttctggtagccgccagaagctaagaacagattctccctctgagcctccagaacccagatgacaccttgatttcagacttctggcctccaaaactgtgagagaagaaatgtgttgttttaaggcacccagctggtgacagttcatcacagtagccacaggaaactaatacccagccccatggcaggcataggtcaagcctggcacagtctggatctcagtccctgactcagaccctggatgctcgctgccttgtacagaaacaacctgctcaaccaaacagggtgaccctgctgaagccgcaaatgtccaacagtcctgccaaccgtggatgcttctgtagcttccctttagctctccctcctggcatgaaaccagacacagactacccagaagatgaactgagcactctgcaatgggcccagcacgctgctgcatctgagaccatcttctcggccctaacaaccctggcaggctcttctctctggtggggaaattgggcttagggaaaggacatctttaggacagtcatcccaccaagtagaatgactctatgcagcctgaatactgtttccctgggaggaaaaaaatccaaagcataaacttttataagctgttttaattaaaacactctttgtaaagtgatgtatttgaagcaagggaggagaaaggttttctggcaaaagtgtcttttgtggtgtttctttggtgagcaaaaggaactcaactgatgaaaacaccaaagcacaaacattctgtggccagtaaagtgggtggagggggcaatggagacaacctcaggtggggcccagcttgtaacgctggcagggctctgttaatgtgctccataaagggctttggagggcaggaggagcaccaccaacattttaaatgtgaggccaaccataaaacgattcatgattagtccactaaaatgtgtttattggcaaataggaaagagatccctgaaaataagcaggaacaggtgattttcaaggctgacttaggtctcctattcagctactcaacaattatatccgagctacgtgcagtggctcaccctgtaatcccagcactttggaggctgagacaagaggcgaaaagttcgagaccagcctgggcaacctagcgagacaccatctctatgaaaaatttaaaaattagcctagcatgtgtcttgtgcctgtggtcccagctactcaggaggctgaggtgagaggatcacttgagccccagaggttgaggttacagtgagctgtgatcacaccactgcactccagtctgggtgacagagtgagacactgtctcaagaaaaaacaaaaattaaaacaaacaataacaacaacaacaacaacaaaaaaaaacggcaaagttagaacacacaaaagatagtatagttccttacccatccaccacttggttttgaggagaaaagggaagtaagaagagttgaagagaagaaaaacagaacagaagagtgggaaaggaagatgaaagggtgctatggagtactatgcacctgtttagaagtggggaagtagcacaaacactagcaaaagaagaaccaccatggagttcctccttgcacatctctctcccctcctgaaggcctagggtgagcccacagcattgttccagcagtgagggagtcttcactgcctcctgagactctctcacggctcttaagatacctccctgaagtccctccaaagaattcaatgtgcccctagtctaaatcagtttcctccatcataaatactcatagatgacgcaacaataaagcgttaataacgataatggcaa

SEQ ID NO: 3975 - DNA, 212 bp, Homo sapiens
cgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaagtcattgctctctc

SEQ ID NO: 3976 - DNA, 602 bp, Homo sapiens
ttcttaggcgtcctcatcccttttcacctcggagctcagcgtcttcctcagcagcacttccatgtcatctgccccgtgaaatcagcctaacgccgtttctcaatgacgtggatcgccctaggccaccgcaaccttccggaagctctctcagctcagttcccattctcccaccatctcttggttctccttctacctcaccggttgctagtcctccgcttcgcagctgaaaatgtgcccggggcctactgtgggcctagccaggcctgcttacgcagtgcagtttcccatgaatgatgcccagtcattatcacataacctgtggcaagccagcaagatggccctggtgacagcaaaagaaactgcactaggacctgaatgtagatctcagtcatgttccttactaacagcacgttttgcaaccatgcgttaaagaaacatctgactcacaacaaaattttaaagggtttatttgagtgaaaagcaatttatgaattggggaacacctgactgaaagagcgttagtattccagagacaaaacatcaagtgcaagtttttattgggaaaatgtagaagcacaataaagaaattatttgattggtta

SEQ ID NO: 3977 - DNA, 2364 bp, Homo sapiens
ctcggctcactgcaagctccgcctcccgggttcacgccattctcctgcctcagcctcccgagtagctgggactacaggtgcccgccaccgcgcccggctaattttttgtcttttttagtagagatggggtttcaccgtggtctcaatctcctgacctcgtgatcggcccgcctcggcctcccaaagtgctgggattacaggcgtgagccaccgcgcccggcctcttccctcttctttaggtcctttcttctcctttgttttttgtccctttttgcaatgtctccctaaggctgtggcactaaaccttccatgtttcacacccaaactagtacaataaacctcctgtcaccaatttctccctcctccagcccacccagcacactgctacctgatttcctgaaaacctaattcaagaggaaacacactgatttcacccttgctcaagaattcatggcagggctatgcacggtggctcacgcctgtaatctcagcactttgggaggccgagatatgcagattgcttaagctcaggagttcaagaccagcctggacaacatggaaagaccctgtctccacaaaaagatgcaaaaaattagccaggtgtggtggtacacacctgcagtcccagctacttgggaggctaagctgggagactcacttgagcccaggaagttgaggcggcagtgagctgtgatcatgccactgcactctagcctgggtgatggagtaagactctgtctcaaaagaaaaaaaaaaagaattcacggtggctgtctcttgttgaccctatttaactcaagcgcatccaggccacagggttctgcagctctgagattctgcagaatctggcctcttaccacgcactcacacaaacactgtgctccatacttaggcagatatggccgtcattccagaaatatatccagcccagctggtcctctgattctgctgctcatggtcttcctatccttaaaagtctaactcaaatcttcacttctctttggccattccgttcctgtggtgggttgaatagtggcccccccaaaagatagatatatctaagtcctaccctctggaacctgtgaatgtgacctgatttcgaaaaagagtcttcgcagatttgcagagatcctaagagctcaagatgagttctccctggatttagggtgggctcgaaagctgtctggatggaggagacaaccttcaagaggccagcctttatttgatctccgtcccagctcctccttcccctcgctgagaagagggagaagaaaatcgtccctccttcactcgcacaggcccctccagcagcagctgtctggtgtgctcagatgcaacccccagcatgggggacgtcaggtccagggtggagaatgggcgcaggttctgtcactcggaggcagtactggacataggggtggaaccgctggccaaactggagagacagatacgggaggtggggagcaggcatggggagaaggccatgaatacaggctctagctgcaggacccaggaggtcaaagtccctggttgccatgcatggaccaaagagagatatatccctgagaggtcctaggcagagccatgtctgactggcaggcagcagcctcctggacctgtgttctcagctcccggagcttgctggtcatctgcggagccatcacaattggggccgtatgtgtggggatgggcggatcacaaggtcgggagatggagaccagcctggccaatatggtgaaaccccgactctactaaaaatacaaaaattagctgggcatggtgacgggcgcctgtagtcccagctacttgggaggctgaggcgggagaatcgcttgaacctgggaggtggaggttgcagtgagccaagacagcactactgcactccagcctgggcaacagagtgaaactccatctcaaaaaaaaaaaaaaaaaaaaagaaagaaaaagaaaaagatgctgtggaaggactgacacatgctgggcattgcatgaaaggaccatactttattttctttatttttaaaatttattttttaaaaagaaaatagagacaatatcttgctgtgtggcccaggatggactccaactcctgggttcaagcgatcctcctgcttcggtttccccaccttttcacttctccaaatcatggcacctcgtctgacagaagcactggatatttgagatagaagtgtcctgtggatgtgtggtcattataatctcacaaccatgaaacccaagaccctgtagttggcaggtggcaggtctgaggctcccagcccctcaccctgactgtggtctatttcctgccaatgaactcaacagtgattgatacggctccttacttcttcagagcatcctgaagtt

SEQ ID NO: 3978 - DNA, 2554 bp, Homo sapiens
gaagcagcagaagcaaagggctataggtgacacacacctgcaagcagcttaacaagactggagcagcgttgggggatgggaaagcagtttagcaacatgagccattccaagactggacttttctttattcaagtgttaggtcacttcctcagggaagccatccctgactagctagcttttatgcttccccccaattactgtccatcccatgaccctgtacgtttcagaatcggaaacacctaccaacccttactgacaatgccgccaccgccaccaccaccactattattagaaggtgccatgaaacagggttctttttcttcttattttactgatagatcaccagtgcccacaataatgccaggcacataacaggcaaatatttgttttattcattcatccaacaaatatttattgagcatatataatatgctaggcattgctctatatgctggggatataacaaaacatgacaaaatttgctgtcactgttaagtttactatgagcaaatacattaaatatgcttagcctagagaagaaaaggtgagaagaggaagacaaactagcagctttcaatgatgtatagggcaattaaatgcaggggtgattccaagagcctgaaggaggaacagtgagctaagattaccgagtagctgctttcagctcaacctaagagtcagaactgggggaggaccaaacaggagcaaccagaagtagaaagctttctgtcactgaagaaatctggccagtgggcagaggtgtcagagaaaaaaatctaagtagtcaatgaaaaagggagtctgggatccagaggtcccaaactgacagccacagatatgactggttacagttgaacagggttttgtaaaaactgagttgccaatgtttttaaacgccagaattacttgccaatttttaaaaaatggcatcagtcgccagtgtttaaaaatcaggaaactgcacgcacgtgcacacacacacggtttggcttgtacttctccaacatcatgtacgttagtactgtacttataaaattagaagtttgactctatttctgacaaatgttctaacacctatatttaccttaccggattgattcttattgtgcattagtttctaaccctgtaaccaaggaatcgagaatcttctttctcagaaagtaaacttatttaacctcctcacttaaacaaatggcggattatcattcccattttgcagatggaaaagcagcttagatggggaaggaacgtgccagagacagcaaatccagacacagccaggctgggaatccaaatgtcccatctcccgtgttccaacactgaagattctgagcactgcctaccaagaggacaggaggggctgacttaggaaatcagcacgagcttccaagtcagaagaccccggactgaaccagtctgaggggacgcggctacagacgaagggcgccagccggaatcagtgagtccctggaggaggaaggaccacccagaaactggcagaggaggatcctgagacttgctgtgaccctcgccctccctggcgagctcgccccttgactccaggcctccaaaaccggcccagcaagaccccactacaccctcgcccgccgcggctcacttaccgccgctcaacttccggcaaccacagctctctctgaggcgcgcgccccgatgacgcaacgcggtcctgcccgcgcttgccactgggaagcggcgcgcgtgcgcaaaggagcagaggcatgccggggaaatgcgcccctagcaccgagctaagtgggaggaacttgagtcgtgaggagggcggggcatcagggggcggtgacgcccccgggggaagcgatggagagcgtctcccttaccagatgtcggaatgtctacattcccttcaggcttttaagaaagtgcccacgttctctcttttgatttcagaggatgacaggaatgatcaccatggtcattctccaggagaggcggcatcaaacgcagcacaggggccatcagggtggcaggtgtggagagccaggagatgagaattttagtaggaaaaggccagtgaacgtcgacagtgaccaacctgccttttctaaaccagccatcattctcacagctcctcactgtcagtgagataaagttattccctctcaatacttggttagatactctgcgcgtgcaaagcactggacaggtgttgaagatacagcagtgattatgacaagtttctctgtctggcctgtaaggcctttcacaaattaactctgatataccactctagactcataacaacaagagcgatgactgctattaattaactagccaccatgttttcagggttttacatctctaatcctcacaagagtcctgaaacatatccccaagttatatatgaaagaacagaatctaagaaaagttaggtggcttgctgaaagttaaagggcttttgggccaggaacgtaatctgaagtttgtttgattctggcaaataagaaaacaaatccagactaataaggatacttattagaaaggattactgcaggcccggcgcggtggctcacgc

SEQ ID NO: 3979 - DNA, 653 bp, Homo sapiens
ctaactcctcggccttttccctccgcctctcctcagcagcccggcgcatctcatcttcctgtagccgctgtcgtgctgctgacaactcttgcccttgtctcctgcgctgccgttcccgttccaatgcctcccgttcctctctttcttcacgctcccgctgcttctgggccaccagctccaacatcctgtgttgccgagggaaaacagttcaagagaaatggacagagtgggaaggtgtaaagtttacaataaacaaaattaggcgacatatatcccaaagtagattaaaggaaaagaaaatgccaagaaagaggaaatgtggaaaggtcaaggttctttgaccagacgtgtactggggagagatggaagacgaccctcagacacgtgagattgttgttactgtacctcttagtttgttcctgtctttcctcttcactcaaagcgggtttgccttctccggcagcagaaccagatcctacaaacaaacaatcggtattattatcccttcagattctcctcggaccctcctgaataatcacaccgtggaccctcagtcaggaccttcaaggccgccttgctctgaggaagtgggctcccgtcccaggatatgtccaaggggagtctctaaaggctcgtccacatcggggtcgtct

SEQ ID NO: 3980 - DNA, 537 bp, Homo sapiens
ctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccgtc

SEQ ID NO: 3981 - DNA, 8079 bp, Homo sapiens
tcacgtgctctcttctgcaggatcttgggtacctttctgtctggggacacagtatctccttctggttccaggatgctcagctcaaggaccacatgtgggctgggccgctgttgaatcgcaggtcatccttttgaagtggaaacaggtctatctatacagctcgcagaggaacagacaacaatgaaaggaaagagttaggaacctgggctccaaatgggacagaatcttctctgtgctagcaagggtaccttagaaatcaggatctttgcttctcaaatgccagtgtggttcctgatttctctgagactactaggaagctcctccccaaattctccaatgaaaacgaatactgctttattagaatttgcccaaagtgtgagtccctccttgtctgcaggaagactggagcagagtgtgacaggattgtgacatcaagaacaatgacagtggagggaccaggccaggtgtttgagatccattgcgatttgattgctctgcctgagagagagagagagagagagagagtgtctttcagccatgggcctgaattagtactttcaccatgcttggttactggctgggagcagctcttgagaattacagctttggcacaaatatggtagtggatccagaggaacagaagctgagattgttgactatttatgctccttgcagcgggagatctgaatggtacagcttcccggctgccatattggatttactttgtaaaatatcatgctgacagctgcatggagagtagcatacagaaaccacggaaggagccgggacagtagttaaactacagcaactactaatgaaagagtactaacgagtgatagtgtcaaaattggcagaagagctcagatttgaagtatatttttaacatagggccaacagaattttctgaaggcatagcttttgcatatgggataaaagtcaagaacaacccagattttcagctggaacaactcagaaacagtcatatagtgataagcttcaggttatttcattcctctttgaagatgaaaacaattcaacaaccttcttctccatgcctttcagaatgaatttcttcttctcccggatttttctttcaattcttggctgaagtttcaagctgtgatcactccaggtaagagcagaatttgagttaactttgtgcatcagagagaccaaggcaggcaaggtgaaggaaaaagattgcagcatccccggtgcgttcccagccctacctcccctcgtattctagtttctgtgtctttgttcacactgatcctgtagctgggtggccactgtctctaacccatcggcttgtctacacctctaccttcagacaccctttgacacacctttccaaggaaggcagtcatccccacactcccttctctccactcccaaacccctgaatgcatttctatgaaattaatgtgctcaagcttctgacctctctgcaaggggccccaggggtctctcctctgtagttaacactcagcattttatcttctccaactcagaccccctaaatgtctctgccccagtctctgttgctattaatccagtgttggccgcaggcaaagctgttattcactcctaaatgcctcacagacggagcagacagatcaaatggaaaggctcccccatcctgtcctctacaccaccttgcagctgggcctcagcaactgggtatgtagaatgcggatgataacgctcgccatgtggacttgtcattgggataatgtttaatttaatctgataaaaatactgattgaccacagtgctcagtaacatgttggctctcgaggtgtggcagcttcttccttgcttttattcctcctgtagaaagttaattgaatttcacatgacttgcagccagtgggcaagggattgactcacagcaagatgcgtgctattctatgtaggagacaggccatgacggctatcgggaaacaatctgagccatggtattgtcattccctgcctaatggtttgttgggtaatgagggacattgagacttctaccttgtggcaaatcagctcaaggcctaccacctgtatccagaagatcattcactcagggatcagccaaggttaatcacaatggtcctgccaactggcccgtttatccgatcagaatagacaggagctgggaagcaaaaatgaacagcttttaatttcagtctaattcaagtcagcagcatagggcagctcctgggaaattggtttacacatgcggacaagcccagtagcccagagctaacccactcaccatccctgaccacagaggagcagataaggaagcaagatttgtcgggctgcactgcaccgagcttgcacagggcgaggcgggggcaggacctgggacccagccaccccggaggaaaccggagaggaaaccagcttggtcttgctctctgcctcgtcccaatccccggctcttaccaaatgcagatccgttggctgaatgccttttagtctgcatacatgcatctcataccgcacagcccaaatttctacaacttgtccaggtgcagtctcctcagaactacaaagcaagaaaagatcacctttgggctcaggaactcacagtcgttctccctctcccggaaggcacaatgaccaggacagtaccgagctttacagccatattgaactcaccatcaactcagcacattcaactcaatcagtcaaaatcgtcttttcctgctggtaaataacactgaaatatgagtctcactctgttgcactgcactccagccttggtgaaagagtcagactctgtctcaaaaaaaaaaaaaaaactcatacactgtcttgaaaataaagaaatccatctaaaaaaggatagatgagtcctgcttacaatggcctcccatagaaaaggaaaggtgtttcttttttcaagttccaaggtgtttctttttccaaggaccgcatccttgattcttcttggctctgaatgctgtatgtacgtctctaaaccaaaggttgcattcagagataatgactttgagatctagagacaggaggggcctggatttgtgatagaaggagctggtcttctgtcttaatgttcccttacttcctagctgtgtgctgggatgagtcactgagcctcgcaaaaactcctcttgctcatctatgcagtagcaggtgaaattatgtcccccaaagaaaccaggccaagtcctgatctccacgcttgtgaatgtgactttatttggaaatagggtctttgcagaagtaattgcggtcatctggatttaggatgggacccaaagcccaacaactggtgtccttgtaagagagaggaaaggaagattggacatacgcagacatagaagagacgacaaacaagaaggccatgtgaggatggaggcagaaatgggagtgtggcagccgcaagccaaggaataccaaggactgccggcagacacccaaagctaggagggaggcatgggtgggattctccttcacagcccccaaaggaagtaaccctgctgccgctttgatttcagagttctgccttcatactatgacagagcaggtttctattgttttaagccaccgtgctttggtactttgttatagcagccttaggaagctgttaataacacatatgggtaacaataatcggtgctgctgtgagatcatggatgcacaagtcagaagtctattgtgggaagatgggatggtaagaacaaagtctgtctctggaagcacgggcgctgtctctgaagacaaattgatcgtaacacaagcagacccggtggaacgacctccatgctgaaccctcagctccccctgcatttggaccatggcctgatggaaggtgcgagaaaccctgtgaccacgttacagcacaggggcagcttggccaggccaccccttgggcctaatttttctccctggccaaaggggtcagactattccagtgctgtctgctccctggcctccagagtaatcaaacacacatgtttggcgctccactaatcagggaatgaaataaagctagatgtttccatatgttgattcaatttacaagcaaaagtaagtgtcaggtagggggcacaacagtaaggggtgagcagtgaagaaatgattccacaatgacgtttcgtaaggagcaaaaagatgaggaagaaaaggggagacacatcattgaaggccaggctctgtgacaatttatatttgcctatatatctgtatctctctctgtcttatctaatgaaataccaacaacaacctgagaacagttctgtcttccgtcacagataaagagactgatctcagagtggtacagatctacaaccacgtgaagaattggatttatattcatctgactccagaaagttcctgagattcctctgcttcatcatctttcccatgccctttaaaacacgttatcaaatagcaacaggtggtgcaataactagacaaatgattctcagcctttttctttgccattagcactcccggaaggagacgtgttggacacttttccttgtcaccaccccatgaaccttccataccacaggtatactgtgtattcggttatgtatcatctgtacatctgtttctaaaacacagaaacagtaagagccccccatccaagaatccattttaatcctcttgggtgtgatgtcaccccccaaaaatgcatatgctctggagtcagtcacaaacacattacgaatgcatgatcacttaagaatgttaccaaagtttataaatttgagatgataattctatgttatttagttcattttagagataagtaagaaccagagattccagagaggtagaccaagctgacagagcaaggaaaggcagagccagacatgcagctgaagcatctgaattccagccaatgagggggcatcagggccacagccttgctaaaatccatcctctctgttcctttgctcttctgaggttctctgagttaccgcagcagattgatggcatccaattaactttctgtgggtggttcaattgggtgaccaccctggaggtcagcgtctatgcctgcttccttctggtccatgagtcgtgcctggaggtctgcagcccttagcacgctgcatggtaacacagcccagtgcaggaagcatttgcccagagcctgctctaccccattcaggccccctcccccagcacagcaggacctgcaagcatgggtctgaaaaacagatcggagacctccaatccatggccagattctagctgaggcacacgagggtctagggtttcgccaggttaactcccaggaaccagagcagggaggggtttctggcagtcagccacttggacaaaggctcccagaaagcactggagcctgagccccacccgcttgccaacccctctgcctggagcgccccggggccgagctgcctcgatgcgtgacttgcccaggcctcacacagctgagcagagctggaagcctcccgacacattcctggtctcaacttcactttccctgcctggttcctattaatgatgtgggtttccaagccctaatagcagagctctggcttcagaggagggctgcctggggctgccggccgccaaccaggtcgcacacaaacgggatcttttggagtcaccctttatggcccggacactggattatttataaacttcttgaaaacaaataaacaaaagcaaaactgaaaaccttggaagacaccaggctggacatatgctcctttcttcagggacagaagtcaggcagattggaagacgcgtttgttggtaaacgccggcctccctaactccatgctgttgatgttgcattcggtgaagccctttctttggaagcttcatcactggcatcgccactaggctgctggagatgccctgcaagtaatgagttttgcaaacccatgaaagacacagcccacctctcatgacaactcaatttgaatgagacagacactagttaaataggcaaacaatcacataaagtggcagttgctatggtacggcagtgtaggatgctaaagatatagggaaataagtcctaaccccctcttggcgattcaggaatggtttccaggaatggaatcagagctggttttgaagaataagtaggtgttttccaggtggaaaaatgacagcaggatatccctggtctagagaatagcatgtgccaaagtcatggagggtgggcaaaacaaacacaagcagaacttggctggggcatgtagtgtgaggtatgctcacggagaggaagctgggaaagaaagcaggggcttgaccatgaaagaccttcaaagtcatgctaaagagatggcccatggatcagatgttcaagttaggaattctctctctggcagcaatggggaacaggggatggaatggcaggaggcagggggcagtaagatcacagagaagctgctgtagaagcccaagtgctcagtgatggggtggccgaacctcaaaaattggagatctttaaaaaataacctcagtgattttttttttttgtggccaagcatttacagagatgtttatttgatttttcctaaaatatcagtctgcattgtgtgccacaactccctactacatggatgataccccaagatacgaacattcattatatcatgttcactagacaaatggtcattctaaaatgtagccatgactatatgattcccctactctaaaacctctcatggctgccttcaacctccaaaaaagatcagcctctcagcatggcaaaccagccctcatatgctggccccatcatggctccaggtctccccctgtccccctgttcacgtcataccttcctacttctagttattcaaccagattcttctgctgttttgtttttttcgcaagctagccatcactcttagaggaaaacttctgtttactcttcaaaacctgaacatctactaggttctagtggcaacggttaggtcatagatatatagattacttatcttgtgaaattctcaaaccaaccggaagttatatactgttattcccaaattaagctgagcaagattgtaggagaccatgcaggtagtgagtggataaagcagaactttaccccaggcttgtctgactataagttccatgagtgtttccttatcccatactgccttttgcaatccagtgctggcacgttaaacctgtggcataatagggataggtgttccctagacccaaccacaaagggtcagctcacgtctcttcccctggatggcctcttttcactgctcccttctggaaagtttctgtctaggtcaagggcattgtgggccacatcccatatggcagtaggtgaccacggctaatgtaggccttgtactgttttatgtgtgtgttggtttatgtgtgtgttggtttgtttgcaggataagcctcagaagaaatgtttgtatgagtcttctcttgtaataaattatcaccaactgggtggcttaaagcaatacaaatttattttctttcagctctgtaggacagacatcagacatgggtctcactggactcacatcaagatgccagcaggttgcattcctttctggaagctctaggtggaaaaatgtgtcccctttttaaggtcacagatgcctcccacatcccttggctcatggaccccttcctctttcttcaaagtcagcaacatcatttctctctgacccttcttcatggtcctctctccctctgactctgaactcagccaggaatggttcgtggatttcaaggacccttgtgactatatttagtgtcctcccaggtgtactaggatcatctacaaggaagctgagccttcacaaggtcgaacaacacatttgatgccatgcaactgagaagtggttcaagctggatttgaacaaatgtagtcagactctgcagcctatgcatgtacccactgtgctatgctgtcgcattgaataaaatgcagtgccctcaatacgaagtcaatgtgagcacataccaagaatcatattgggaaggagaagtcctcagtaggcaaaacactttccagcaatgttaacctggatgtggatagaaaggagacttgggaatttctctgacttaattcatctctgggtccatttgaagcac

SEQ ID NO: 3982 - DNA, 2313 bp, Homo sapiens
atccgcagcaggggcaggaagcgctcggtggtgaagtagcgcagggtcggcttcggggcgcgcaaagcggtgaggaagacctgcggcggcgggaggagagctgtggccaccgctgcgcgccggaggacgcaccgcccccactcctggagtccagcccggcgctcacctccgccacctcctcagggttctgcgccgcctcgcgaaagacttgcttgctgtgggcgaggtattggtagaagcggtggaaggtgtggatgtccgtgcggtccagcacctcctctgggctgcccaacaccttctccatgaaggcggtgtgcactgggccgcactcgatcaggctcaagctgctggccggagagcaacgagtgggagggggcggacgccagccaggccccagtcccagccccaaccccagtcccagccccaaccacgtcccggcccccgaccgcgagcagcaccgctgcgctgggaagtgaggcggaaagggcgctggggataaccagaacatttgaaacgcgggttcctgccggagcagccctcccaaatccatctgaggctacaagggagccctggtgtcaggattcgaatctagcggggtccctggccgctgtgtgaccttgggccagtcacctaacctctctgggctggagcttccccataacaataccaacacttcagcagctaggtcagcaggtggcacaatgcgtgccatgcgcccagcccaagtgcctggcacacagctaatgtgagccgggcagagagggccagggagatcgccccagagcggctcccgcaggacagggtgctcggcgtctctaggtcagagttaagagggttcggggaacgggggtgttgactcactggaccccaaagggcagcagcagaaccgccagactctcgcataagccttcgagcgcgaacttgctggcgcaataaacgtcattgaaaggcagcccttaggtggggagacgaggttcctgaggcgcagcggccagggggtcatccccgggcagacggtgcccctccaagctgacggcaccccactccaccccccccgcggaacctgccttcaaggctcagctccgcacacaaagaatctggagctgccgaggccactccctaccactcacccatcaatcctcccacgctcccggtcaccaacacgcgtcccgaaccgcgcctcttcatgtctggcaggaaggcctgcagcatccgcacagtccctactacattcacgtccagcacagaggccacggcgtcctcccccagcgcctccagcggccccagcaggcccaggcctgcgttacacactgcggagacaagaggcccgaccagcccgcctcagcatcaccctcagcacggcctgtcccctcgtgctccctgggcctgggaacatgttggtttcaacgcagggcggagaaggctcctaggagcccatatgcttccaggaggctcacccagcacgtccacgcggccctcagtcacgcgttcccgggcagcggccacggattttgagtcccttacgtccagctgcaacgtctccagggatcccggagggcatgccagggcccgggccgcctcccacagccggccctgtgttttcaggtccctcaacgtggcatacactggaggttttgggagaggaggaagatctgacttcccttctggcctccaagggctcctcccttctctccctccctgtccctgcctatctatacctttgaagctctgggatggatctgaagccagacgtacggccaagtgcaggccgatgcccgaggaacagccggtgatgagcaccacggtgcgggccatggtgagactgtggggagaggctggggctctgggcttgatatcacctgcttcgccccgccccgcctgcgggcccccaccccttgttgtgtctcccacgcaatctcaaggataagccttcctgcgggtccctggcccgctctccccaccctgttctgagccaaaacagacatgagcccactgcttggaacaacaaactgtcctggttgctggtcagagggaggggaggctttacaagcaggtgtgggttcccacgtgggcacagagtggccccctgggcagattcccctgggtatgcctctgtgccacaggagcgattatagtgaccgcagtttgctgcagaggctgtgaaagtaaaggcgttgggaggtgggagatgattgtatatgtgctggtttcgtccagggttcctagctcataactcacatgaccatggttacagtcttacgttgtcatgttggggtgcctcaggcctcaaaaaacagcctttcgtctctctga

SEQ ID NO: 3983 - DNA, 5353 bp, Homo sapiens
gttgaactttctcttaggggaaacagtttaatccccaagtactatgagataggcgttttaaggcaactttttaaaaaggaaaataaatctgctttttgccgtctaggaaagatacatttttccttgtggaaatctgcagtctgaaaagacagatatgaaaagcatgaactgttgaaaataacctaaatgttctttgaaaatttaaaggccagcttatcctgcaatggtgatagaatagtcggcttacaacacgcaaagccgagccgcgggtgggcaggcgccgcccgtggctcgcggagtggatgcactcgagggcgcggccgctgcgcttggggaactttcagggcgccaagtacgggtagcgcttctgatggattcccgggtctgggaggatccgattatcccggggccgggtgacacgcacaaagctgaggttagagttggccaggaagggaggacctggtgagccggtggaacaaaagcgggaaggcctttccttctaggagcaaaaccagcgacgcgtcccggacgcccggggacccctgtgggtctcggtttccttcgctgtgaccctgacatgtttccctccaccggcccgaggaaaccgtcgcttccagcctccaggtaccgtcacctctgcggggctgcgagcggaggaccgggacagagaaggagccggcggtcctggccagccgcgcggctcaaaacccgacggcgcggggactccgggcctggggcctccatggctgtggcctccttatctcccgggccggctgctccctacgctgcggggctgagggcactggggacccaggggcttctctggcactagcgaggacctaaccttgagtgaagaacgatgtcaagtgaaagtgaagaataacgggggtgggcgcgaagagaatggtcttggggcgcgcttgcgcctctacccgaggaccgaggtggggattcgacagacgccagcggtggggatccggggcgagaagccccgactttctgagtcgtgagccgcctccagtcgccccaggacgtaaccccgaggagctttcagacactggccgcgcctaatatcgctgagaaccgcgaaaaccggagttccggccgcctcccggactggcgtcccgaggccaggggacccgcttggggctcccggccgagccccgacctcggacgtttttccgggagccgcgagaggcctgggggcctgggccaggcgccgcggcgggcatcgatcgccggctcccagagagtggccccgcgcaggtggaggtgaccccgtcacctccaggagcgcccccaagccccggtacccgcagcgtgcgccctctcctcctccccgaaggttaagttcgtctttttcggttctcggttacgcatccccttggcacgcatgcccagccacaccgtgggcgaaactagagggcccgcgtcccctgggggctgccgcggggccccgagtgaggtgtcccctccgggccgggcccgagtcggaggccccctttgcagcctagaggagcgcggggctggcgctgcgcaggaaccgccaggccggggagggggccgcgcccgggcctgggccaagagcgcgcgtcccccgcccgggccctgcggccctccccaggtgtctgagcagagctgctgaagctgcagaaatgtgctggcgcctgtccaccgccgcacacaaaacccagccaaaagcggcgagaggaaaagcgaatatggcgctgctgaaaatggagactccgcatctagaaagtctttctttcctttcctcttttcgctcttacttcgtcgatcttttcccccttgccctctcacgagggcctcctgcgctttccttcgggtgttctctacccctcggcccctttcctgttcttatgaataacctcctttactcggttttccttcttcctttccactcccggttcctctttctccattttgtgtcacaggcgccttgcttcttgttccctttcagggcgcgcactcccccgcccggctcactttattttgtgtgtgggtggcggagcagggagggggtggcaaggatcgtgaggctaagtatcgagtttgtttgtttgtttttctttctttcttcttcttctttttaaaggtgttatcttaggagccaagcatctcctttggtcctgcgctccttcgcctagcgcctggtgccccccacccggctgcatccgaggcttgcgcggcccggtcccatcagccgagcgtcgcccgcccaggaggaggctcgggttctccgcagaagcgaatactttctctttttgttttaagttagaaccttgcttttgcagtgattcgttgctgtggcgtgattttaaacaggtcgaaaagcatcatgaagccaagtggttattgttttgcttattcagtgtgaactgagtgagccaggtttgtataccaagtgattctcgtggtggacaataccaatatgattatgccaaatgcattgcttctgaggcatcactctttgggcacatatagaccctgctgatttctgccaaagcactcttcttaaagttccaaaacattaccccaaaacctctatagccccctattgccaacaaaattaaagcctttctcttcattggcattagaagcccctgtaacccattgcttttccatttccagcctctttccaaaattaccaaacaaactctgtatcctgcagccaccaaactgtactagttgtaatatattcactaagaacagtggtctctcatttgtctctcttttctctcttcttatatcagttagaatgtaacagacaacccagctaacacagaggctcatttttcttatgtgacaagaagtctgtagataaagagttgctagtgttttcttgggggttcagtgatatcacctctgtgattcagttgaccttcatatcatagttgcaaaatggctgccgtaagtacaaaaaccacactgactgctgggtgggaaggcaacagaaaatttgttcttggtgagtcttactcacgtcaaggaagtataatattttccaaaatgccccaccaaaggatttcctcttacatcatattagccagaactgggacatattatcaccctttatctggggtagaggcccacatttccacatcaaagggaatttgctcaatgcctaaatcaaactggaattcagttaagcaaagaagaaacagaggaatggtttttgggtaggcagtaaacactgtcagctacatctccctgaaagccatcactcccttaaaatatctttgcgtaatgtcatcagttacttctgaactttttcatccaatggacagtgtttattttctaacttacttgaactttttgtggggcttagccacaccctttttgaaatttatgtattcatcaaatacccactcatcacttactgtgtattagtcactctgctgggcaaagagaatgaaaaaatgagtcatgcatggtcctgaaccttcacaagtttatagcctagtggggcagacaggtgaataaataagtgcaaaagaatgttatagatactgtgataaaattatgtttcgtgggccgggtgtggtggctcatgcctgtaatctcagcactttgggaggctgaggcgggtggatcacctgaggtcaggagtttgagactagcctggccaacatggtgaaaccccgtctctaataaaaaataacaaaaattagctgggcgtggtggcaggcacctgtaatcccagcgactgggaggctgaggcaggagaattgcttgaacccaagaggcagagattgcagtgagctgagatcacgccattgcactgcagcctgggcaacaagagaaaactttgtctcaaaataaataaataatatgttttgtgggtttttttttttttctttgacagggttcttactctgtcacccagcctggagtgcagtggcacgattatagctcactataacctcgggctccctggctcaagcaattctcctgcctcagcctcctgagtagttggaactatgcaggctaattattttatcttttgtagaaatggggtcttgctaagttagccaggcttgtcttgaactcctgagctcaagcggccttcccacattgacttcccaaagtgctgggattacaggcatgagccaccatgccgggcttagaatgatgaatgagataaaatggggtacaaagaaaggagcagccatttctggatctcaggtgtgatgtctcttttcagggaaggacaggggtgatacagccattaataaaagcaatctcactttcctggttggttgtctctttgcctcctcccctggaataatacagacctctgtagaaaatcacaggcagggtagggatgacggagctggcctcctcccttcccttggcctgacaaatatgcatggaattcccaggaatgttcaagctttttttttttttttttccaaacttcagattagaatccaactcatgtagaatccatgtagaatccgactcaaacagaatccatcaggcatgagaattctggaatgcccttcctggtttatctacttcatctgtgttccatgaagggcacctggtctcacacctagactccgggagctccaggtccctactctcttaggtttcagggcctaaccaatcaggatggcaagaaggatgtatttggggagatccaagcctgtctgcttggctgtagtgtaggactggggggaaaagaaaggcacagtaaggatcaaaacaaggctggagcagtaggtaaagatgagttcatgccaacgtaggaggcttgaagatgtttggtaagtcataggttcccaaactttccagctcactgcatctgtagcatcttcgtaatttgttcatggtgccctcagccagaagacatacttcacaattccattcgttaagtaggtaagtctaaacaacatattagtggtcatttgtgaggtgtttgataggtggggctgtatttctctcaaacatttaaaatatcccacagcaaccttgtgagtttgttccctgtggtgtcccagggtgacctgatgggaaatttgagaaccatggtataggtcgctaaagatttttcatctggtgaattaaatatttgattttgtatttgagaaagcgccatctttctgtagattggagtaaaggcgtggtgggaggtaaggagaccataagttagtggtagtcatttaggagagaagtgatggggatataaaatgagacatactaatgagcatgctgctggatctaaaatatgttatggaggtagaatggagaggaggatttccttatcaattggtttttggagagaaagaaagagagaggttgattcctagactgtgggcttgggttaaag

SEQ ID NO: 3984 - DNA, 383 bp, Homo sapiens
ttccattgtcatataaggagtcaaattgtttcttatcatttgttcattgaagaacagagacctgtctggaaaatcgatctctacaaattcaattaaataatgatccccaaatgctgaaaaagtgaaatacagcaattcaacagataatagagcaatgtttagtatattcagctgtatctgtagaaactctttgacgaacctcaatttaaccaatttgatgaatacccagttctcttcttttctagagaaagatagttgcaacctcacctccctcactcaacactttgaatacttattgtttggcaggtcatccacacacttctgcccccactgcattgaattttttgcttatgttgtttataataaaacttttcaattatctc

SEQ ID NO: 3985 - DNA, 1078 bp, Homo sapiens
ctgatagatactaagataagaaataactgcaaccataaatgtatacaggttatgtgtccatgagccatctcttcagtttgcccatagatttttgtctgtggaatattttcttgtttcatcacactgaatcgttggccaagaaatgcttgaaaatcaaaacattaatatcatctttcttcttttttttaaaggtgacttaagagattaaaattaatttggttgctgttggttctgaacaaataatgagttcttttatttgaggtatgccattttgaagactgagacgttggagttttatcctagaggataaaggaaatctttgggaaagtcagtattttatatagcaagtaagtaaatgtttttacccaacatctgcaattgaatagttaccaacatttaagtagaaaaataccattaaagtttgttaatgaaacaaactgtagactacttatcactgaaaggatgagaaaaccatcaaatttctttgcctgacattgaaaacacttctattactatcaagacagtcgatgcatgtaatttatattggagcaggaagacatttagtacttcttaataaaatggtgctttaggattgtggttaaatctgcagtaaagtcatcaagattatgtttttacaaatctggtatatacagtcttaagcctttttttttttttttttttgattgtacaaatcacattttaggaatggtctggaattttgcatttgctgatcgtaggattcttaacaacatttcaaaaactaaatagacactttcatatcttaggcatttaatagatttaaaatactcattttaattgttttcatgagttttcaaacaggtccaaaaatgtgttgttttctaggaaatgagagttaatgcatctaaagagtcctctaatttaattgcttagtaattgcttttaaagcatgaaagatagagataattttcacgcgcagtaggtattgggcccccagcataccatgtatatcacactttaaaatcttaaagctagatacgtgaatttaaaagaatgtccactgatgtttttaaggaaatatgccttttttgtaagttaa

SEQ ID NO: 3986 - DNA, 3162 bp, Homo sapiens
atccagttccgggagtttgcacgcagacgctctgcttcgtgaccttggctctgctctgtgggcgccgcccccagcctgggcgcgtccatcgtcgagtaccttctcctctgcctccccctccctctgcttctatctctctccaattgccctccctggcctgcggccgcccggtcctccttcccagcccagtgcagccaggcacccgggttcggcttgctcaggtctctgtccgggactgggaagccacggagggccgggaaagtggcacactcctggagctcaagcttcctactctctcatcgctgaataactaccgggcaggactgggtggaacagacagcatatttaggtcattgatgggctgctgggtggatggagctggaaagtgatgggcactgctttctggggctgcccaggttccttccgagggctcgcttttcctgggcagagcgggaaagaggaggggcaggccggtcgcgaaacgcaaatagtcgagaatagcgatccggggagaagcaggtgtctgtggggcccaagagaagtaccatctcgttaaaaattcagattgaactatcttacaaatggctcccagaagatccactccctgtgggaacacagcagttgtggaagtgaagacaggactggacccagaataagggttcaaatatgtggggaaatctgacctctaaattcttataagtcagagagtgactgaacaacagcagtgagacatcgaagagttttaatatctgctgtaaaccttggcacagatcatttacttctctaagactgaatccaaaaagcacaatggaatactataataagctgagacagcatggtgaattccagacaagcctgagcattccctatagccagagaaggaggcccaacacctaacatagccttggatgcagaactgatagaacttggggaaagtgatgaagtagttgacctcacctgtgaatctctagcacctgtagtgattgacctaactcaccgtgactctgtagtgattattgaacaaaggaggaggccaagagcaaacacaaggccactccaagaccacactggcagttgtgtggtgaacaatgatgaggagggagtgaaaagggacagagatgtatgtataaccaacagtgcccaccataattccctgcaaaaaaattttttttgtcatatactacctggttatattcagtgtcaagtttgcatggatggatgctcagagattgaacttagtatacaacacatctactctatagaatgtggccacatctgtagtcagtgcttctgcacttcctttacacatactaacactgcccagtttgtttgaaaaaaatcagcctccatcagtatcactgcagttatatatgatgtatgccttattgctcaagacagatcctgtggctggatttttccatgtctttgtgcaggaactatgggttgttggcatccaatgctctgagcttaaaaatactgatttttaaaattgctatctgcagtatataagaaactctttgatttctcatatgctctgagactgctttttgtttcctttggttttatgcttcagctctggacttcagttgccagagtgtgccagatactggggtcgtccttaaagcaactttccctttcttatagtcatcaatttttagttggccacatgtggacattctggaccacataaataaagacaacaccctagagatggtgaagtaagttgtaaactaaaatcctaagccccctaattgactgaatggaacccctcttgaccaaagtgaccccagaaaaaccttaaaactgagttcctggccatgacgggatgggaggtcagacacgcttcattatatctccgtctcttttatggtttagacacaacaactgaccagcattaatgtcaaaataaagatcataaggctgacagaatagaccctttgtggcaataacaaattattcgtaagatctaaggtcatgccaggcaagtgttatgtcatgcactcctacacttaaagaataaactatgttctaactgccacaagattttctatttatttatttatttatttattttttgagacggagttctgccctgtcagtttttctttttgtttagcagctaaacaagcaccagctgagataagcaatttttttttttttttttttttgagtcagagtcttgctctgtcgcccaggctgcagtgcagtggcccgatctcggctcactgtgagctctgtcttctgggttcatgccattctcctgcctcagcctcccaagtagctgggactacaggcacccaccaccacgccccgctaatttttttgtatttttagtagagatggggtttcaccgtgttagccatgatggtctccatctcctgaccttgtgacctgcctgcctcggccccccaaagggctgggattacaggcgtgagccaccgcacccagccactttctcttgataagaagaccactgactatgggctggttctggccagtttatagaggctaagcacccttgttccttcctgtcctgaacaggcattttgacttatagggtctaattgttatgcatttaagtgttaagtctccaccttaggcctggcgtggtggctcacgcctgtaatcccagcactttgggaggctgaggtgggtgaatcacttgaggtcaggagtttgagaccagcctggccaacatggcaaaaccccgtctctactaaaaatacaaaattagctgagtgtggtggtgcacgcctgtaatcccagctacttgggagactgaggaaggagaatcatttgaacctcagaggcagagattgcagtgagctgagatggcgccactgcactccagtctgggtgacagagtaagactccgtcgcgaaaaacaaaaaacaaacaataacaacaacaaaaagagttaagtctccacctcaaagtgaacatgggttgtatgttacatgcatgtttgttcaataagcatgagtcaggatgaccttcataattattcatagctcctcctgtaacctgttgaatatgtatgtttagccaacctattcagcatcaagttcctacccctgctcctcctttgaagtgcctgtctctggtctttgccagagattgtacttcctggcctgtgggatggccaccttgcaggcctttaac

SEQ ID NO: 3987 - DNA, 2683 bp, Homo sapiens
agctcctgccgccgccgcagccgctgccgccgcagcgaagaggccatgttgtgtggtgtgtggggcggggggaggaggaggagggagtaaagcctagagaggagacgggagagagacaccacacacacggcacaagatggccggagaggcagcagcaccccgagctgtcaggcgttccgccgcggccgcgaggcccgccggccggcggggagctacgcccggacggccagcaggcccgcgggagtggggctgccgcggctgaggcgaggcgggccgcgcgcgtcggcgtcacagcccgcggcagaggcgcccagggcggccgggcccacgacgccgaaagcgccgctgcggttgccgcctcggaggctcccccgggccccggcggctggacccggcgcgggcgggaggctcgggcgggcggtccggcccgggactcgggtttgggcgaccaggaggtgccggtggccgcgctcggacccggtgacttaagagattaaaattaatttggttgctgttggttctgaacaaataatgagttcttttatttgaggtatgccattttgaagactgagacgttggagttttatcctagaggataaaggaaatctttgggaaagtcagtattttatatagcaaaaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaatttctcagtttgggtttttttttttaagtggaagtttaattaaatgtttagttttattttagtaatactttggcctttgtagttgccgagtggtaaagtgtactgaatatgaataaagctggtaaattggaaatggtgtaatcgaaaacattttacttggtttatgaagatttacgtttttcacaaagttgtgctcttagatggtcatttggtttaaatactgttttgtttgtgctttcatgaaacacctttcaaaacaactcaatgggtaataatagaatctgattttaatctgccacaagattttaatgaacttgaaacaaactgcttgttgctcgaaaattcaggatgagtgatacacatatacttctgaattattttgtgttgattgaaatggtttcttaagctttttaatactataaatacatcttgctatagaatattcatctgaatatttaaattaatgtctcctattgtcttactattagaggaagaagtgttggatttatgggttagggtccttggagtattcacaattttttaaatttgaaattatgtgtgtaatccattttatataactttgaagtaggattaatatcttgtatcgtctttattttgtacaattggggatttagaataaatgaattgcaccctgccatagattacttacgtttgatttttaaatgccaggttttcatttattactaatcaactgataccagttttggtaactattacaaaggtggtaggcattattttggtagacaaaatgagttcttgattctgttttcccattttacatgagaagaataaatagttcaggttaaattgttttgtgttaatcatactgtttgtgattcatgtcaaatactgcagcatacacatccatggttaatacacgagcaccatttgttattgactgatgtgaggtggttggtctttgttaaattcaaaaatggaattttggatattgttcttgctacgaaatttatctttgtgtgtagagtatggaattgaaacagtttggattatggattttacctagattggacattgttgattttgtttggtgtaaatctaaagtggatttcttcagtgagggagagacatggttctggcagattatgttgaataaggaaagttgattggatttttttgggtgtgtgaatatgcttgtctgaatggagtgcttggtaggatattgtttctggaattagtaatttgtttctgtggatctcatggttttgatatttaggagaatttgctttgtgacattactttgataatttgcaatcacgtatgtcctattgttaataacattgttgaaatgggtgtatacttacttgatttgaaatataagggaagtgttgggatatgtgttttctgttggatttggacgtggagtttcttgggttactgatttaaaggtgatcgtgtttggaccatactcttgaatttttgcctgaatcagtatgggaagtaaatatattgtgattatgagaagtttctttggggggaggagtgtaatattttcaaggttatataatgggttaaagaattttgtgaaagaacaaagaaaaatggatattcttgaataaaaattggttgcatt

SEQ ID NO: 3988 - DNA, 2092 bp, Homo sapiens
atggcgtgaacctgggaggcggaggtggcagtgagccgagatcgtgccactgcactccagcgtgggcgacacagcaagactccatctcaaaaaaaaaaaaaaaaaaaaaatcaagtagcttgctcggggttccataacacctcttccttctgtttctctggctttccctcagtccacatataaggcttcatgagagaagacacgaatggatataaaccaatgggaataaaccaagacaagtcctggtttatgaattggtctgcacagtatgctggctccagctggaagtattacatagcctcacttagagatgaccctaagagacagtgataaagccaacctcatatcttgctaccagaagcacatgagaataattcttttaagaggctttaaaatcccagctactcaggagggtgaagtgggaggatcccttgagcatcggagcttgagaccagcctggacaacatagtaggacactgcctcaataaaaaattaagtaaataaatagatagcttttgagttatctatactgtgatataatacaccacaccctttacaagagcaaattctggggcatgattaaatgaaaagcaaaggtagtacttcatagcatctgcaaactggcatagtgcagacaggcaaaaagcaatggtaaataactactggaacatatgtagaaaatgtcctgtttggcatctactgcagagtaggctctcaatcagatgggtaagatagctagtcctatggatgtcagcctttttccccagccaccctggtgcttaataggcccatttataaagtgccatggcaacaagaaaggaggtctgcatggacttctcactgaggcttctctgcccatgcaccaagagtcaaggctatgctgggcccctgactgatcacaccattctccagggaaccaatgagcctcttggtggtagattgatacattggaccctttctacacagaaggagaagcaatttgtgcctttgggaatagaaacattccaaatatgaatttgcctgccagaaatggtcctgctggcactaagcagaaggcctattcattgctgtgatattccatacaaatcactaagcaacctgtctacagtgaaggacacgatgagagagaattacactgatacaatttactagcactaccacaagccccaaggacccagaagcatctgacttgacaaaatggcagaatgcctgctaacagcttagttactacattagctggagaaaattagctggaggattagaaggctgtcttacagaatgaatatatgacttaagccagtagctaatatttggtgacgtctcccgcatagccaaataccgcatgaaccgaataaccaaggggtggaggtttggaatggcccctttcactttttccctttttattttaatttatttatttgaggagttgctgtgttacccaggctggagtgcagtggtgtgagcacagctcactgcaacctcaacctcccaggctcaagtaatcctcccacctcagcctcccaagtagctgggactacaaacatgcgccaccacccccagcttatttttgtggttttagtagagaaggggtctcactatgttgcccaggctggtctcctactcctgggttcaagcaatcaacctgccttggcctcccaaagtgcttggattacaggtgtgtgccactgcacccagccaacattttccctttttaaagaaaagaaacataattcagacatacatataaagcatacaattcagtgatattttttagtatatttataaagttgtacaaccatcaacactatctaatttcagcagattttcatcatctccaaaagaaactccatatccattagcagttcactttccattcacaccaccctacccctagcacctgacaaccactaagctactttctgtctctatcaatttacatattctgtgcattttatattaataaaatcatgtaatatgtgaccttttgcatctggctcttttcatttagcataatgttttcaaggcttatctgtgttgtagtatgtatcaatatttcattccttttggccaggcatggcagctaacgcctgta

SEQ ID NO: 3989 - DNA, 2706 bp, Homo sapiens
gtagtttcaaaatagaactcagtgatcagtggtttttaccctggtggaagtcattaaaggtataatatgagccagttaaagaattaattaggtgttgcttaaaaaccccaatttgattaatgagttcaaatgaaaggcaattatgtaacacaaatgacagaatctttggcggcaatagatttatgtgttaattttaggacagcaatgcacagtacagggttcacggtgatttgtctgggaaatgccataggtcctgttttccaaaagaattcgtgcaattgaccttggggtgagggggataaaactgtctacgcagcaaaaaacttcgtgtccaagacatggagggagtgttcagattcggtcaccttaacctttctagggaaatcactcaattcaagggctgttgtttcaatattagtaacgagcagagctgagtacttacccgccaagggagataaaaggagactatgtaaatcagtcttctcgtgatttagtagcaattgaaaaggcacaggtttttttgagtatttagatttatggtgtactgaaaggattaactgcagaaccactgtaaaattgattctgcagtggataggagaaaaaaaagtatttctctctttttttttggtggcggcagggggtactgcaggttacttggtatttaagaaacataatttagaggtaaatgaagagcgtattctgacttctttggacaagcctcttttaggcaatattttgtttaccttatcccagttcgttcttgcaaatggtgcttgccaaggtggaattacaggactctctactgcccagctcgcctgctggggctttcttttattctctctttcactgggaggctgcaggtcattccccaagagcattcctggggctgggtgccctggaggacaagcctatgctctgagttacatcttgctttctgagagccctttattcaagccactgctcagcaaatgccaccattgtgagtgtgcctggaacccttagaatgagaaaagtgatctccctatgggaggaagagagtgtggaactcacttctacgtgcagtgccgatcccagggcaatgcgacgcttgctgactgactcactatggaaaaggaggacaaggcattggcgaggtgtggcactgtgccctgctggtgcccatagccgattcctcagggctgcggtgatgtctcctggaatgggcactggtcctcttcatcatctcagggatagacagcaaagctccctttggatgacatagatttattacttagtagtatattatgtattggctgtcccacattttgaaatttaatggactcgtggtgatcagaataaaagaagccttcgatgtgaggcccaggcattgagtaccatgtgtgcgattcacaagccttggcatctgaacaattttttggaaggatccatcaggacaacacgtcgggggtgtactagtgaagtgattttccaaatgtgctactcagacctgtagcatcagcatcaccggataatttgttagaaattccaactgttaggccccactttagaccaactgaatgtgaaactctgggagtacgtggggcccagcaatttgtgtttttacaagacttaccaggtgattctgagaaccactgtgctagtgaattgttcctgtctgtggccacgtagaataagaaaaccatagggttggaaaatggggaaactggtgagtgttcgcttatgaggaaatgaagaatagatagaaaagaattagttaacttttggaattcaaaagagaagcagtttgtaaaagccaggaatttgatttgaaggactaattgcttgcagaatctttgctttctcagagaggggcaatccagatcactaggttaccgtgaaatatgttggtatggctctaaaattctagaataatctctctagtgagaaaaggcatacctttccatattaggacaaaacttcaaatcaggtttgtaaaatcctataagattattgtatcccattgccatggccaacttgtttgtctctggagatcccagtttctacatctgaaaaccatatgcattcctgctcaccaggaattatctcgctgaatgaagcaagagattcaggatgtgtaagagaatttatgaagcatttggattaccaagaaatgtgaagtataaagatcaagaatgattattacaaacactgatggtaaagaggtgtttcgaagtcgatgcaaaaaatgagttgcttatttcagtctctctttgatatatctgcctttttagtgctgactctatcatgtattcactatttgattttcagtgaatcacattttttaaagcttttaatctgtttcctcaaaaaatatattttttaaaaatatttactcaggattgttgtgagaataaaattgattcgattgatatttcaaaaaagaaatatatttttaaaaaataaagcaataccatttttggatatgctagtgctctgactgttattttatgtctgggttgaggaatcctaaaggactgttgacataatgacatcatccaggggtttggaataagagtatacatcagcaagttttctgattacaaaaagtagctatgtttacttttctgttaattctccttcagtggaatgtttcaattttctcatgagatgggggagatccatttttttgagagctctgttttattaaagaaagcaagtctggtggct

SEQ ID NO: 3990 - DNA, 887 bp, Homo sapiens
cttaaagtgaaaaaagacacccccacctttaccctacttgatatccaggtccttttcctccaagaatatttctagctgcttctggttttgctagtttatttcaaaaattacaattgtttgagtcaaatctatacttgatattcattgttgggtttctttaggtcattctgctgttctctcagtttcccaggtgttttgtgtgtcttccttgtgctattaattttcctgtggccttgttggtcagatccacagaggtaaatgcaagtgtttttccttgcttcagaacatgtgctgtaatcactatatcttctcctaattttgcaggtgacatgtaccttgaaagaaaatgaatatagttaacagcagataatttttcaaagggaaagttgtgtgcatctcacaacagtgttcctatgtaacttattttactcctaaaaatagttttaacggtagtattggtaagctttctgtactatcaaatgtgaatggctggtcctaaccaggttctattttacccattccttacccacacaagtttcttttcccaaatatgtgagaagaggttttcttgcctccccttttttccctttacatttcccacttcacatttatttggggctggtgaaagatttcctccagctttcatttaatctccttaacttcttagatgaaatatcacttggtgtctgtatattgtcctatccatatttacaatttatttgactctaaaatgacaatataacaactataaggaattgatatgatgtccttacaatcttgatgatggactgtctatatttttaagagatgtacatcctagtcacttgtaatcataagttgtctttaactcagctggctccagctaattaaaaaaaaaattggggaga

SEQ ID NO: 3991 - DNA, 1515 bp, Homo sapiens
ctcctgcctcagtctttgtgtagctcatactttcttcacatccacagagtacataccatttcctgctgtcaggcaaatcttagaaatttctacaaatcccagaaagaatgggtaagcagcccctgggtcccttcctagccccttaccttgatgacaagatccacatagccttgatcctcatcactggtgacaggagtgtatggcctgatgaccaggctgccatcaattcgggtggagaggtagatatgtttgcctggggaccgtgcagagagctacataagggttgtctgtgatgtgctgcatccctcaaaatactcaaagagatttgagagaacaagatgtcttgcttcctgctgtggtcccaaggagctacaaggcagggaagatttgccccattgagccctcagttggatctcttataagcgcccagttgaggaaacacttatttccagcgtttcctgccagttactgccaggaccttgacagatgagccaaaagggtctgggcaatgggaaaaagttagtagtgcttgctcagagggagtaattagcaaatcctgcagggaagaggcaagactgttgagtgttaaagctggatgggggtcatggaagccacactctagaggggcccagtggcacctcacagcttggaggatgcagagccaagtgggggaaggggaatggtgtgtggagcaaaccggttgaagcagcgtgtttcatgagatcccaggaggggagtcaccttctgaggataccagggaaaggagcccattccacactttccttacccacaggcagccccagagtgtggtgggcggtgggcagggcaaagcggaacctcttggtgttgtggctcacagtctggagggtggaggacacaagtgtttcaccaagcgcgcctggcgctgccacgtcccttggacatcccaaccaccgtgggtgctgtaccctccatgccaggagcactctggtcccctccttcaccctggccctttcttccccaacttaccgtcttgtctagcagtcgtagcaggtacttttcattggggtccaggagagtgacctgaggccggcgggacctccgaaccaagtaggagcccacagccaggccgagcagagtgaccagccccacccccagggaggccagcaggacggggctctgtgggtagaggaggcagcgtgaccgccaggctgggtaagagcccggggcttgggtggtgaccgtcccaggggtggcgatcccgagctccagcgcggaggcatgccaagggcagaggggtaacctggcggagtcccgagcccggatgtgcgggatcgggaccccagcatccacggtgggcccagagccctgcggggcggggtcggcagcgacagcccctggtccggagctgagtggccagaaccagatggggaggggtcccccagtggaggatactgaatgagggtcttaccgtctggatccccatgacggagcgccttttcctccaccacctgacaagccgacagatcccacaat

SEQ ID NO: 3992 - DNA, 944 bp, Homo sapiens
ggcgccgggaggctgtttttccactcactggcgcgcagactccatcccactgttttcttctctcttttctggagttagattagtctgaagccgccaccagccccaggcccccgtgcagaagaaaagcgggagggaacggcggaggccgccgctgccctgcaccgccctcctggaggccacttggagagtccggccccgaggaggccatggccacaagtgcccacagctggccccaggttgccagcgtcgctacagcccagaccaaggcagaataatctccggatgagctggtggcaccgctgagcctttggtctcaccagggcttcctgttgctggcaggcggggtggagcggagctgctgggaggctgctggataggagaggggtcacggctgcggaagaggaggttcttcgggacacccgtggatggacacggcaaggaaagagcaaggctcaggatgatttatcctcttttcactgatgaggaatctgaggcccagagaacagtcatgaagtgtgatcagaccctgaggtctccaaaaagataatgtccttgcgaactccagggattctggcatcttgctgtacccaccccagcccacacggcaggatcctatccaagtcccttatccacccggacactcactttagcttttacaccctcaaggctgagaccctaaggacacgccctggatccaaggagtccctggcccctctgctaatatgcgccacctggactcccagagggaaagccggtcagcaccccacatgcattagcaccatgggccacccccaagccctaccccaggagaagctcgtggtggcaaaaagaacctaagcatttgaggcaggtcacccaagcttgaatctcagtctgcctctcatctgtgaccctggcgagccactcgtcctcaggaagccttcactttccctagtgcacggcgg

SEQ ID NO: 3993 - DNA, 5904 bp, Homo sapiens
cctttggtttgattggattcatcatgaggcagcatgggtttgcacttgtagaaatcaaaactgttaggtcaggtagtaaagccaatccttgaacttacatctttagttaaggcatcaaagaattgtaagttgctttgcaatgatgccatctccacatggtcagattcttccagtaaactgtgcagatattttacagaataagagctaagtttcagcatgtcaaggaatgatctgtactcaagtgttagtaaacaagggtttttttgtttgtttgtttgttttgagacagtctctgtcatccaggctggagtgcagtggcatgatcatagctcactgtatcctcagactactgggctcaagtgatcttcctgcctcagcctcctgcgtagctaagactacaagcgcatgccaccacccctggctaattttttattttttatggagaaggggtctcactatgttcccccaagctggtcttgaactcctggacttaagcaatcctcccacctcagcttcccaaagagttgggattaaaggcgtgagcccccatgtccggccaacaagacttcctcgtgactataatgtgagcataatattaatagctctgagagagagaagtgaaccagaagaccaacctcagtgtcaggaagtctgggcgtctgtcttctgcatggctgaagacatggggctttgggcaagtcatctgttctctttgaactttggcttcctcacttctgaaataggagggtcagagaagatgtttctttttgctgaaaagttttacagttctctgatctataccccttggtcacacacaaccaaaaagtagaaaacatgagtgcaatacttttccaccagtactcccagtttatacattatcttctcaaaccaataaggaacttctacaaggccctgttagtgatgtgttacaggtgccagcattagggaaactttcagactgttatatctattcgttccttcatccatgtatactattcattctgtatgcagagtaatttatatatgtacaattacatggcagtgaaagataatcagaaaaatgaagttttttttttttttttgagatagttttgagacagagtcttgctctgtttcccaggctggagtgcagtggtgtgatcttggctcactgcaacctccgcctcccgggttcaagggattctcgtgcctcatcctcccgagtagctgggactacagacatgcgccaccatacccagctaatttttgtatttttagtagagatggggttttgccatgttggccaggccattctcgaactcctggcctcaagcgatcctcctgccggcttcccaaagtaccgggattccaggcatgagccaccatgcccagtcagaaggtttttttttaaaaaacacactcctgaactaacaattacaaagagctagtgacaatttcccaaataattatgcataacaggagcccatatattgttctcaaatcataaaccataactgattttgaggaaaagacattctgtcccactgatattcttttcatgagtaagatctggatctgtctggaggcacagaattaatttttgcatgaggaatcccaaccctaccatcattccatggctgaggaattggttattactcctatgggaaattgggaatgttgttggtaccccagccttctcttaagacaaaatttaacaaatgcatacatgctaagatgcttatactcataaggctttgtgggtctcctttctaaggggaatttgaatactaacaagaacaaaggctaaataccaaaagggggctttctaatggtagaatttgggatatcaggtagccacatagagcagggctactttgggggctggagactgcagaaacccttcagtttatacgtgtgagtaaacctaatcacacttgatgtattgctagtgaagtcccagccccctgagcctttgcagaaacccaaagaatgctaaaaagggcaggttttagttcctgccaattatttcatttactacaaatgccccgagttccgaatttacttccctccccaccagaaatatgtcattttggaggcttgtgaaaattaagcattaagaaaatcccgcctccatcctaatacactgcatccacaagtcccaaacaaaatcacttccttggcctacacacataactacctgtttctgtttaggtctgtgactcagaaagtgcctggaagaagtcatgagagggagtcgatcccatcttacctgccataggaagaatagggcctgctcagtagagttcagtgtgtgtgttgaaggtggtggttcttagtccttccctgaattcactaattcgcattgcactcactcttcctgatcaatgagttattgctgagaaatcattgtagtaagtaatacaggtatccccagtaaagccatccctctcctccatacctccgctgtcccttgggttttggctccaggatccttgccccatgtcccaaagaatccctaccttgggcctccctcctcctcttttgtcaattgcacttgaccttttcaggaaaaagaaatcaattgataccttagtcctaatgtttgacccttttctatctcagaatagagaagtccctgtatttgttctttttttactcaagtttaatatagaccacctaggcacagaagctccgtgctatattctgttgcctgtaattgtccttccatctaattgggaaaaggttactctattgaaccatctgctgattcccttaccttttcactcttttgtcagtattcctttaccagtaaattcttggttatctaggtcctgaagtttcattcatgttttttttaaaagctttaatttttcttaggaaaactgtttctctcatcttaaagcagactatgatcttttctactttgttatacaatctgaacataatgaacactctaaagtcaggcatggattttatcataaaagcagatcgtattaagatttttttaaaaaagaaccaggattgaggaatctgtagctaataatttaataattcaccagcatgttttgggctcccacttcatgctggccactgggctaggcactgagggtgcagaagcaaacaaatcagcctcctggccctcagatttgcattccagtgagtccattcataaaacctaactcaaagccagcaacacccccaaaagggctgttggaagctttgtagctcatctgtacagctgtcttgattcctgtacgggatcttactttcttgggaaaatatgttctaaatcctgtttccttgggccattaaaaatccatgctgtccctaatcaatatatagttatgtgtgaccttcttagaattaaaaaaatgccgctggacagcctttgaagggaaaggcagagaaatctgttttgatggcttgaaaataagtgaaaaggtttttagggaaagctaacaagctttcaaagatttcagatctgccagcattcattcattaaggcatgggattaggccaaaagagcctcctaccaagggagagacaggaaccatgtaaggagatctgtgagaccgcagtggaagagtattgaaatagaagccagacctgtagacgtatttgttaatatgtgtgccaagccaaagtacaggaggaggcttggaggcatggagttgtggtggaagcaggttctgaaaagcagaactctgaagctggctcattctcacgaagtcatctggcccagcctcccgcctccaagcacatcctgcctgcagagggtctggctagctgccttttcagctctcgagggatagagattctacaacctccctctgtcatcagttccagagccactcccctttgcactagaagttcttgctttcaaagaatgagggtgtgagggagggaggggtcaagaaacagagtgacaggggaaacaggcagaacaagtcagggcaaaggaccccagcatgaagagttgtggaggtggaggtggggaagcagcctcacatctcacacttccttccttctcttaaatgtgagcagctgactccaagccttgtggaaactctagaaggtagaaccagccatctggggaagctggccttacagatgccccgtctggcatagtggaggttcctgtgctctgagaacgcagtgtgaatctagacatccactgcagcctgggaagagctgtgttttcttcaaaagtctttaactttcacagtcacccctctaaagaaatgttctctgattgaaggcatgcttctattcctactttattgtgtttcatgcattctgccagagtaattacttttcataccaattcttggatgcagagaaatctctggtagtctaaggggatttcgatccaagtaaagctactatctcctattccatccagacttttccgtctgcctccattctctcagtcacatacctagaagcaagccagaaagcctgtccaaccaaaatcactctccaaagcccaagcactttattgttctccctgtctgttatcgagccaaggtgtatttggcctcattttatgccattagttgtctggctttcatggctctgcaccacattacagtcagagcaggaaggccagcagtggagatagaattatggcagaaacccagagtagaggcctctgctggtgagggagcctgcagcactctccacgctggtgggtcctagcatgcccaacagacccccatcccttcccatcagccttgggccttgagtctcattccaactcatcccctcccctttcccttctttccagtcccaggtgacacttgatgcctctgactcctttgaagagggcatcaagaagtgaaagaacaaagtccttttctgttcgggatctgggcccatcctgggagaggtttttggcagaaatggctgcagtggaaccctctgactgccagggtgaaatagtgctccagcaggctgcggtagactcactgccagagtgggtcaggactggcccagaggacagggtcgtctcttgagagtcctcccagctccagggcctgattttaaagcagtaacacgaggatataggttatatacaggctcctggaaggcaggtgccgcagctcctgtgacaccccatatgcctgagcaagcttctccagcacaagagatgatgcaagtatgaatgggtacggggggagcttaaaacctgccaacactgagacttgatgccaggggccgtgcacccgctctgccacctgctaggtctgtgcaatggtcagagcagaggtgtgtgatgagttcagctcccaagcacatccacacttaggaagtgttctgtgtgtttttaaataatccttaccatgtaaagattgtattacatttgtatacaaaatttttttgcattttacttttgtaatatttggggttttatagatttttattttatggccaagtatacttttgtaaggaaatgttgaagtcttgagtatttttattcttttaaaaaactatagttagtgtcaactgtgagcactgataaatattattcatgtgtggttttccttctttttaatccagactttttaagaaactgttttggcatagagctttacttaaaatgctgcttcattttacacattgtgaatactgaagattctaaaaaataaagatgcatttaaaatctctgtgctgttccattgtagaaatggtaatgtgcattgctttgccaaagtggtaattaaatgtttaatggtttagaactcctagttcacaacagggcttctcgtcatcacttgcagcgtgtgagcttccaaataagccgccatttctttggaaaacgcacgcacttaggcatggcgatctcctgttccgttaggaaatacggttatgttgacattatggttactgtgcttgtggttttgcaataaacatgtattgaaagca

SEQ ID NO: 3994 - DNA, 5242 bp, Homo sapiens
tcttcagtttcattaggtcccactcgtcaattcttcttgttgcaattgcttttggaatcttcatcatgaaatctttgccagcgtctatgtccagaatgatatttcctaagttatcttctagggtttatatagttttgggtcttacataagtccttcatccatcttgagttgatttttgtatatggtgaaaggaagggagtgtacatgcccctgtgatattgttcctaatatccaggttgggagaggatattatactcaatattgcaggaggtgtcgaccaccctgaatattacttttaatatccggggagagagggtgatattactctcaatatcatcctgtctacacctccagagattttgggagtaatatcatcctctccaaatctggcgttccctggacaggtcattgcctcagcccctgcctggtgtcctggagcagctttgaggagctacatggacaggacaccaactgtctgcagcacccacatgctctccaggtggatgctcaccctgggctgttctcaggcccctctccccacactgggcccacaccctggagggaactccatgtacccctgcccatctgcccatctgagcctcaggggtcctgggcactgagagctgggctgggctgagctcaggtacacactgtcattggggatggagaggggatgctgaagtgggtgcttctgcatggggcctgcctggaggatcgccacagcaggtgcacccagcagccagaccagcttctagcagaataagtgcactgtcacaggggtatgtgagctgaggctgggggcctggaggtgcagggggaggagttggggagatgcagaggccccaaagatgtcccaaggccctaagacactggtgagggaatggaggagccagcactggtggggaagtggggagggggagatggatggcctgggtctgagctggacacacggtctgtgcccacacttgagctgtgctgtggaggcccagtccccacctgggcatgtcctgtcctctgaggcacagggattcctcaccctcagctctgacccctcatctccaactgctgggatgacgagtccataggcagagccagcctcacaggggacccaaaggccagttcagatggacagcaactggaggtcccaccaggcacacacacatactgtgcagaaagctaatgcactgtttatttgggggattggggggaagcaccgtgccgctgctcactggtagccagccagctgcaggatggtggggtagcaagtatgatgggccatgcaattctggcggtcgaggaagagactgttggtcatggcagtgacgtccttctccaggctcatgtggatgtcctcgaggttgtgcagggactgctccgcttgtagaagcttctcccacagcgctgtgatggacttgtacagctcctccaactcactcaccagcttgggggtgttggggggtgtgagctggggctggggagggaagaagtatgcacctaccggggtggaggggacccaaaactcccaatgggagctggcaggaggtcctgggaagacgccatgaaaggatcccaccaggaaagtggctctagggcagagcataaattactagggtcctcccagggagcgcgggcctgagtgggaatgagtgacccgcgtgcaatctcgaccctggcaggacaggactggcctcagccgaccaggctcagttctttccgttcctgatatttgacggaaggaggcacccagttccttgaaggaactgaggggcagggaaggaagaaaggtacttaggctcagaaggggccactaggcatccattaacaagggaaacaaaaggatggcccatctatgcctgtagcccaggcgtaggtcatactttccaccagaggtggggacagcaccctcagggcagcagggaatggccctccctggcctctctggccccgtggcctccaggagctcaccttgtctgaaggagcttcctcctgggaagatgaggtagcagagggtggggtgagaccacgtgggcacaggtccctggcactgggaggcccccgacccatgacctgcccagtgtcatgtctatatctgtgtgtttaaggcgtgcttgcgtgttgcgtgtggccgcaaagtctccttcccatctcagcacctgtgggggatgtgtgtgtggagattggagtgtttattggagaaggtcgcagcgaggaggtggacgagggcacctgggactgcctcagaggcccaggcagtacctgaattgggctgcatcgcggcacagctccatgttgggccggtgtgagagcaggtacagccgggtctgggctatgtgcagaggtgcctccttgtccttgatggcctccttcagtgccaccatgttgtgttcctgatctgtgatttcccgcagcatctgccgacaggacagtgccccttgggcctgtgcccccatgcccgggcatatggaatgcagagaccagtctggtcctacccaggtcctggggctgtgtccagagggtggtcctgaccagtggccctggggaggcgtggatgaggggaacaatgtgcacggggcccccagtgggctctggagagtcaggcagcctgttgtctcttagctctggtccaagaacccccatccttggtggtcaccaggacccaaatcctgctcaaggactggggactcagaggtggtaaaggccatgctgaggccctagagtcagagccctgcctgtcacgccaggactcttggggacctcccaggcagtcaatgctccccagaccagctcctgcctccatcctccccacagctcctcctgctcagtcatgggggttgcaacgcactgcgatcatacccagtgtcacctggttttacataggtttatggagaggtgacacttgcttctggggtccctcgggttaagtgggacagaggagaaaggtgttgagggcccagaccaggtgatgagagggggcagagtggtgggcaggcgccggagccatctttggggttcagggtgccccaccttttgcaggtggtgctgcagcttgtgccgcgcgtcctccagttcctcacagcggcgcccaaaggccaggttcactgcgtcacactggagtcccaggtcctcggaggtgtcgcgaaggatgcagtccaccagcacccacaggttggctgagtccaggcgctcgcgctgggcgcggcacagattgtcctgtgtgaacttggtccgggtctctggggtggaggcgctgcggggctggggacagccaggagaaggtcggggaggctctgccaatggctgggggccctgccgcgcccccattccctgtctgcaccccatgctcctggaggaactgcatggactccaatgcatcccgtgcagacccacgaagcccagtcccccaagctccctgcctccgagttccccccgcccacaactcccctgagtccacccacaccctacccaccccgggcacttagtcccctcctgcccccgtgaccccgctcccagcaccgctgccccagaggccccctctgcagcacctccgtcccccgcaaccccccttccctagtacccagcgcccgcgtccgcttctcgcacccaggagtttgccatgctcaagtgggcggtggtcgtgctccctctgctggccttgggtggaaatgcaatcctgccggcgcctggggctgaccgcaccccaccctgtcctgtctaagggcaaccaggctgtgcacgcgctgggcacttgaggaggtcttgcatgctttctcatgccaggggcagacagttgcccaagtgtcttcgggggcgagggcctctgggccaggctgggggaagcagcgccgctggggaccccaggcagagggaggcaagaccacagccagggcaagcacgggggcagagctggggcccccctctcttggaaggtggtggagtgccggatgagcctgcacctcggtgctctggctgcggtggcgcccgcaagtctcgtcgaggttgtaagcctccaccttgtccgaccagtccatctcgcagatctccatgtgctctcggttcagtctggggcggggtggggcagggtcttggtgtgtggccagggagggccccgctggggaccctccatgctgcaggctaggcctttatgcccgcttcaggagggagctctgggccggctgtcctcgtgctcagcagtgaccaagagctgccgcccatgctgggaggctgcagatcagttgtggcactgggctttggccactcaaactcaggctgggccggaaactcccccacccagccctgtgctcccactgtgacctgggacagcccctgccggctctgagcttcagggccctgtcgttcaatggcttgccccaggaccagccgtgggtggggtcaggagtcatcccttgggcagccctcgacccaccggatctggctcactgcttgcacgatgactctcttcagcagctcctgaatgttccggatgagctcagcttcctgagggaggagacgccctgagcaccagagccggcccttggtgaggatcccaggaggcccagctgctgcaggccttggtcaacacctgagcaaccagaaatagttgaatgccgggcctgagctctgactgtgcaagttctgctctctcactgggtttatcctgggcttttgggcattctccttggtgtgttgtaagtggggtgttttcctccagggccttctatgggctgctgggaaggtccctcagcggcagttcccacgccccaggcctcaagagtcatcactgctgctcactcagtgcacccaggaacgttggcctgcccctggcctctggacagcccctgaggacccaaactctgggggcccagatgcccacctaggctgcccctcagggctctgtgttgggaaagaccatcctcacaccaagaacaggaggaagaccatgtgtttcttcttactgcctggccagtttaattttctgtgtgtaggaacaagcctttttcccctgtgactggggtctttgcctggaccaccagctacctccttgtgtgccagggcccgagtcctgcacccctctgtccctgggtttgcctcttcctgcactgtcagtgtctccatcacttcgcagacacccttgttgctggcagagggtttgcgggaactgcagcagttcttgaggcactgagagggtgcagggggataggcctgcagaaggggaagggagggaggagggaaggcatgaggggag

SEQ ID NO: 3995 - DNA, 215 bp, Homo sapiens
cgttgtgtgttcgcctcttgacattctcctcggtgtccgaggacctggggctggtgcattttcggttgttgctgatctgtctcaggactctgacactgtccaacttgaccctcttggcagcaggatagtccttccgagtggagggaggcgctgcgtagttgtgctgatgtgtggagacgtggcacctcttgaggaccagtgggctgtgaggaggt

SEQ ID NO: 3996 - DNA, 1488 bp, Homo sapiens
cttgccgtcagccttttctttgacctcttctttctgttcatgtgtatttgctgtctcttagcccagacttcccgtgtcctttccaccgggcctttgagaggtcacagggtcttgatgctgtggtcttcatctgcaggtgtctgacttccagcaactgctggcctgtgccagggtgcaagctgagcactggagtggagttttcctgtggagaggagccatgcctagagtgggatgggccattgttcatcttctggcccctgttgtctgcatgtaacttaataccacaaccaggcataggggaaagattggaggaaagatgagtgagagcatcaacttctctcacaacctaggccagctcctgtctccccccaggtgtgtggtgatgccaggcatgcccttccccagcatcaggtctccagagctgcagaagacgacggccgacttggatcacactcttgtgagtgtccccagtgttgcagagagcctccaccaccccgagatcacatttctcactgccttttgtctgcccagtttcaccagaagtaggcctcttcctgacaggcagctgcagcactgcctggcgctgtgcccttcctttgctctgcccgctggagacggtgtttgtcatgggcctggtctgcagggatcctgctacaaaggtgaaacccaggagagtgtggagtccagagtgttgccaggacccaggcacaggcattagtgcccgttggagaaaacaggggaatcccgaagaaatggtgggtcctggccatccgtgagatcttcccagggcagctcccctctgtggaatccaatctgtcttccatcctgcgtggccgagggccaggcttctcactgggcctctgcaggaggctgccatttgtcctgcccaccttcttagaagcgagacagagcagacccatctgctactgccctttctataataactaaagttagctgccctggactattcaccccctagtctcaatttaagaagatccccatggccacagggcccctgcctgggggcttgtcacctcccccaccttcttcctgagtcactcctgcagccttgctccctaacctgccccacagccttgcctggatttctatctccctggcttggtgccagttcctccaagtcgatggcacctccctccctctcaaccacttgagcaaactccaagacatcttctaccccaacaccagcaattgtgccaagggccattaggctctcagcatgactatttttagagaccccgtgtctgtcactgaaaccttttttgtgggagactattcctcccatctgcaacagctgcccctgctgactgcccttctctcctccctctcatcccagagaaacaggtcagctgggagcttctgcccccactgcctagggaccaacaggggcaggaggcagtcactgaccccgagacgtttgcatcctgcacagctagagatcctttattaaaagcacactgttggtttctg

SEQ ID NO: 3997 - DNA, 3510 bp, Homo sapiens
cttccttctctcttccagctcttcttcccggtgtttctggaacaggccctgagggtcctcgcccacagtgcggcctagaaggacagaggaggacttggccagtgacttttggtgagcgcctcttcttgtctctgccaggagagcctcagcaccccgtccttctgtgtggcctctgccccttcagcatcacgcccctcccccaggctccagccactttgtgccagctgcagccaccgccccttcgacacccccaaagaccccggcgctccaggttccagcacccccatcctgcgccctcttctccacacgcgcatccccccagcttctcacacagcccagaggcctcctgacaccctcagccccgcgcttaccggtgccttcaggcaggctcaggacgccgttgccctccacccagcggtaacaagggaacctgacctcgtccccggctccggggccctgcacagagatccagttgcagaaccaggcgtcgtccttaaggaggtgccgtttgcgcagtttcacaaacagcagcggccccagatactccggtgataaagcctgaaaggtagagatccaacagcgctagcggttgaaacggtttttaaaatagagaaagcgagaggaccgacggcggctccagtgactgctgagtttccagacaagggagctttgtgcaatgaggggcgcacaggagcatgccctcaattccaaggagatcgggtagcggcaacatttattgagcgcttactgtgtgccaccgactgccctaaagccccccacccccgtggcctccgcgcgctttgagcccaatgcgcgggcccttggcaaagagaatcggccagaggccaacgggggcgcatgtcctccccggtatttgactgactcggagccaggggcgcagcccaccccgcccggctctggggagctcaccttgccccgtgcgggccacagtcgcttcccgagcgccgcctccccgtgctggccgaccagccacagctgcacctggttgttggaaccggcatagagcgaggccccagtggacacgcggatgcggtagagacccatcttgctcaaagatgtttcgctccttctggtggagaagggtggacgagctaaataacccagcctgagaccccgccctctcggaggtcgcttggggtcggaatgtgggtggcaggtctccaatcaactccgcctaccgctggggcccccagctccaaggagcagagcttcaaggggcagaattcagccccagtccaaaaggcggtgtcctggcgagagcagggagtggaaaccactatcttgacgggagggagaaaaagaaaaggatttggaccgaaaacacgcaggaagagggaatcaacgcctggtacagcaggcaggcgaggtgggggtaggagttatgcacgtgtgtaccacggactttgggccaagcctgggtggctgggaagccaacctccatctaaacgcacgcgtgcacacacacacacacgcaaggacacgcgcgcgcacacacaagcctcacaagttggattgcaggagagggtgaagtgggcgaggagacccagtttgcagtggcatttgaggaaggtacattcaggccacggaattcattcgaccagctttgcacacttgccttctctgtgccagccactgggactcattccttttgagcataaaagccgctgcctccctgttgcctgcagaataaaagtccaaatgtttctggcattcaatgcccttgctaacctgacctgctctcctcacctctcatcccactgcaccctggcatctcctgtgctggagccatgtgttccccggaaccccccctccccccgccgcccctgctgttctctcaaagaactcacttctgggttagtctggtcatgcttctaaaccctaattcgtctccagtttctttttgggctggagccatgtgttccccagaaccccacctgctgttctctcaaaagaacttgctcctggattagtctattcatctattcatgcttctaaaccctagttcacctccggtttctcaggaaagtcttacccggtactttcaccccccaccaccccaccagagtgaattagctttccttttttttttttttttgagatatagagtctcactctgtcaccctggaatgcagggtggagtgcaatggcacgatctcggctcacggcaacctctgcctcccgggctcaagcaattctctgcctcagccttccgagtagctgggattacaggcgcctgccaccatgcctggataatttttgtatttttagtagagacggggtttctccatgttggccacgctggtcttgaactcctgaccttgtgatccacccacctcagtctcccaaagtgctggaattacaggtgtgagccacggcgcccggcccagctttcctttctaacacttttctccttgcgcacacttctactgttgcacagttaatactgcagtgtgagcatttgtatgtgtgtatcccccactaatgtgagcccgtcctaggcagggactacacacccagcaggactctcacttttgtttcccctggagacggcacagtgtcagggtttgtgggtgtcaataagtgtttgctgaaacacactgagctgaaaaattcattataaatgaatgcttcccttgggggagacaaagggaaacaaattatcaggcaatgtaaacaaaaggggaatactaacataaacttcatggcatggattacaatcagcctggtaacacaaatgaagtccacgaaaatatgtctgtgatgcatattttctggtttgcttgttttttgtttttggtgtttttttttttaatgagatggagtcttgctctgttgcccgggctagagtacagtggtgtgatctcggctcactgcaacctccacctgccgggttcaagcgattctcctgcctcagcctccagagtagctgggattacaggcacccaccaacatgcccggctactttttgtattttcagtcgagatggggtttcaccatgttggccaggctggtcttgaactcctgacctcaagtgatccacctgcctcggcctccccaagtgctgggattacagccatgagccatcatgtccggccctgcttaattgtttactgggaagtacattcatgtgattcaaaattcaaaaggtacaaagtgatattcactagtttctccctcctcttggccccaagccacccagttgctccactcccagcaatcacagttaccagtctcttctgtgcactaatattactgagcaaatacacgcctatctttgtctttttctgcacattgtagcatgccttattctgcatctcgtttttccatagtgcaacaggaggtcattccatatccatgcataaagagcttccttgttctttgctaaggctgccatttgctgtaacgccataaattctactagtctcttgtagtggacacaggttattagtaatcttttgtagctatgaaaaagtgctgaaagaaataaac

SEQ ID NO: 3998 - DNA, 11512 bp, Homo sapiens
agaggctgtcggactctgactgcgcggagaccgctggactctggtcgcggccttagtccgctgatcctcgcttgggtgcccgcccttagcggcccggcgttgaattccgggaagtgggagcttcaggctcgctccgtgcggatcatgttcctgagagaaaccctcctttccacaacaaacctcctacatgcgcacctcagaatctcagtctatttcctgggatcccaacttgcagctgcttacaaatatgtgtgtgtggaaatggaaggagaaaaaagaagaagtttgaatgagttgattaattttgcctatcacatgtggcataatcatgggagaaaggccaggaaaacaaggcttggatattaaattcattttcttatataatactactggttctattttttctatagtccttacattggattatcatttaattacctctgaatgttagactacctcatccttccattctttacccacttttctctctataattgcataaagaggccagatgtggtggtgtacatctgtaatcccagcgctttgggaggctgacatgggaggatcagttgaggccaggagtctgagacaagcctgggcaatatagcgagatccagtctcttaaaaaaaaattataaaccatcttttctattcaggtaagtcctatgaatttaattagcacctatacacacgtggattcctaaatctttagctccaattctaaccattttctgaggtttagataagaattttctaagcctatttgacctctcaacttgaatttttgacagacacttcaaatttattgtgtccaaaactaaactcattaccatctaaaccacttccccatatagtctctatgttttaatacagtcactatctgcccagttcccctaaagtaaatgatctaaccattgttaatcttcccatatgttatactgattgatcaccaaatcttgaaaattctaatcagaaatgtaaaatctattttttctactgctttacttaagtcttgtcattttattttcttttttggtctgaaaggctacctagatattcaattttagttctttaaccatcctcccagttttttggtgtaactcaccacataccacctacctttacagtctgtaaaagaaactgtatccagcggtatttgtgaaaaccaatttgggccccacttccctgtttctgatccattacatatcctgagttcttattctgtctcttttacttcgaattggcatttatgtgtgtgtttgggctcttgtatccatcctatctatcctgtaggatacagacttggctggctgtactctggacccctgcaggtgatgttatcattctcatactctgagctgaagcctctgggtactaaggatgtagcagtcaacaaaaattactattctcatagagtttacattctagtgggaaaagtgcatctgttgaagctcagagatgagggaggggaataaccacaatatttacactttctcacctggctgacctagtttgttaaagagggagagagactgtttgtccagtagattgtaccagcatctcctcccatagttgtccaagggttctgtaagccattgctacttcaccctcttcaaacatatcttgggatcaattgtaaaaaacaaaaacaaaaacagccttccttgcttaagcaactgcaaattcatatgaaagcctgagactcataattgatatgtatagtagggtgatattttacgatattataaggatacaatgtaatcttcacagctttccttttccttggtttgaggcttattacacaaaaggagccagaggattattacacaaaggaagctacaccagaaaggatgctgattagctttgagactcaaagctgactttcctgacctctctaagaagagaattatcttgcaaacctggagaatgaaagggtttcccaaactccttttgctggcattaacacatcaaaggctaggcctgatagctattaggctctcacatcaccactgcccacaataggaaacatcatattgtgacccagttcacatgtacctagaccgaatattatacgtacatgtgaactggatcataatatacatacacacacacatatgcattatcactgaaacaaaaatttaacatgcattttgatatattctatccactacaattttatttctttttaatacactattcacagcacactgaactgtgatgtgcattaaaaaaataccacctaggatttttcaaaagggagaattcagtgagacagaaaaagaagttaattctgcttctgctggggggagggttggggatgggcaggggtgggggccgtgcttagggaaaggatctgaagaatcagaatgttcaaattcttggtgttgggtaggttttgatcagagggaaaatatcttacagtgaagaatagaattatttgatgtcgcttattaaaagctgaaagtttgaagtcactgcattcagggggaactgtaaggtcaccaagacatagtaaaaaaatagataaggatgaggcaactgcagaatgtttacattcttacagggataagcacaggataagctaaaaccacagctggtgtttgaccaaagaagaactggctataactgacattgctctgtgtgggtccctcctgatgacctgggcagtgaaattcctccttatgataatgatattataaaaagaaagaagtaagaaaatgaagtaattggtaaccagtggtggagcaacctgtggtctagttactgtcaccttgagggaaagagtggggagcacttgtgtttgtggtgggttgggtggtggtggctgcaggtggaaagttgtgcaagaaagatgagaccatgaaaatgataaacatgaggtaggcataaaagtgtacagacttgtaggccgggcgcactggctcacgcctgtaatcccagcactttgggaggccaaggcgggtggatcacctggtcgggagttcgagaccaacctgaccaacatggtgaaaccctgtctctactaaaaatacaaaaaattagcctggtgtggtggcgcatgcctgtaatcccagctactcgggaggctgaggcaggagactcacttgaacccaggaggtggaggttgtggtgagctgagatggcgccattgcactccagcctgggcaacaagagtgaaaactccatctcaaaaaaaaaatgtacagacttgcatacttagagaaaatgcctaggtgctgtagacatgttataattaaccgacaaggttgttgtgttcaataaagataatagaattttgtgtctccacattgtctcatcagtttcccccatcctacctttgaagcaacaagtagattaagctgaggtttttccaggctgggttaaatttagatttttttcttccttgcctcccaaaaggggaggaactaaaaaggaagatgagattgttgactgctatatccttagtacccagaggggactaagaggttatagtaaatgaaaagacctcattgtcattgtacattcaagtttagtgagtaaatgtgtgaccccatccatatggtctttgctgaaatgtcacctttcagcaggccttccctaaccacactataatttaccccaagcactcctgtttctcctgttctgctttacacttctacatagcatttatcacaaacaacagtgtgtatgtatgaataatataatgaatctcatatgttcccatcaccaagcttcaataattattaatattttacccatcatttaatctataccctcatcattttgttttgctttgtttgggcttttttctgaaatgttttaaagtgaataccagacatgacatttcccttcatactgttttacttatttaatgtctgtcttctcctactagaatatgtgctcaacaagggcaggaatttttatctactgttcacagaaacagtcccagcatctttttttctttttctttttaaattcattcaagtttgagaagttattcttattccgagcatcttttttttttgttttttttttgttttttttttaagacaaagactcactctgttactcaggctagattgcagtagcatgatcacagctcactgcagcctcagccttcccaggctcatgtgatcctcacacttcagccccctcagaagctgaaattgcaactgcacgccaccacacccagctaattttgtattttttgtagagatgggatttcgcatgttgcccaagctggtctcgagctcctgggttcaagcaatctgcccacctcagcctcacaaagtgctgggattataggcatgagccatcactccagccccagcaccttaaaaaggttcctggcacataataagtacacagtaaatatttttgagtgcataaatatggaatccaaaaagtaacattttcagtctcttgctagttaggcattatctcagtcagttcagggtgctataatggaatatcatagattgggtggcttaaacaacagaatagtttgtttttagtgtatagaaatgcaactaatttttcatatgttggttttgtatcctgcaactctctggatttattagttcgaagagtttttttatggcatttttaaaggattttctatacataagatgttgctcacaaagagggacaactttacttcttccttttcgatgtggatatttcttatttctttttcttgccacgttgctctggctaggacttctagtactttgttgaattgaagtggtgaaagtgggcatatttgccttgttcctgatcttagagaaaaagctttcagttttccactgatgaatatgatgttagctgttggcttttcatatatatactttattatgttgaggtacttcacttctcttccctttttaaaattttttaaaaatcccaaattgtagtagagagagtctgtgggttttttttttttaatcacagaaggatgttgaatctcataaaatgcttttttggcatctattgaaatgatcatatggattttatctgttgatgtggcaaatcacattgtttaattattttgtatctgaaaagaaaattaggaaaacaatcccatttacaacagcaccaaaaataataaaatacttaggaataaacttaattaaggaggtaaaagacatacactgaaaactataaaacattgatgaaataaagaagacatacataaatggaatgatactgtattcatggactggaaggtttaaaattgttaaaatattcatactatacaaaacaattcagatttaatgcaatccctgtcaaaatcccaatggcattttttttttacagaaatagaaaaaaaattctaaaattcatgtggaaccacaaaagaccacgaatagccaaatcaatcttggaaaagaacaaagctggaagcatcccacatcctgacttcaaaatatattacaaaactacagtaatcaaaacatatatacaaaaacacatatacaaaaatacatatacaaaaatcagctcaaaataaattaaagatttaaatgtaaggcctgaaacagtaaaactcctagaagaaaacttaggggaaaaccttcatgacattgatcggcaatgattttgtatatacaacaccaaaaagacaggcagcaaaaacaaaaataagtgggactacatcaaggtacataaacctgcacagcaagggaaacaatcaacaaagtgaaaaagcaacttacacaatagaagaagatatttgcaaaccacattctgataaaggttaatctccaaaatatacagtgatttcctacaactcaatagtaagaaaatggataaccagattttaaaaaatggtctaaggacttgaacagacatttttccaaagaagacatgcaaatggccaacagatatgtgaaaaacaaatgctcaatgtcataaatcagggacatgcaatttaaaacgacaatgagataccacctcacacctgtcaggatggttactatcaaaggaaacaaaaaacaagggttggcaagaatgtggagaaactggaacccttgttagtgggaatgtaaaatggtgcagttgcagtggaaaacaatagagagcttcctcaaaaaatttaaaaaatgggactactgtgtgattctgcaatcccacttctgactgtatatccaaaacaattgaaatcaggatctcaaagatgttagcactcctgtgttcattacagcactatttcaccataaccaagatgaggctataacctaaatgttcatggaaagatgaatggatttttaaagtgtggtacatacaaatggtaaaatattattcagccctaaaaaagaagggaattctacaatatgcaaccactggatgaaccttgaggacattacattaagcaaagcaagccagtcacagaaggacaaatactgcatgatttcacttatttgaggtatctaaaatagtcaaatctggaaattcaaggaaggaatggtagtttccaggagtggaggaaggagaaatggggtattattaatcaataggcatgaagtttcatttaagcaagatgagcaagttgtatagatctgctgtacaacattgtgcctgtaatcaaaaacactgttattgtacacttaaacatttgttaaaaaggtagatctcatggtaagtgttcttacaacaatgaaataaaattaaaaaaaaagaaaaactgccaagtctaacactgctatcctaccagtgagcacttttttcctcaaacttgcagcagccactgctcaaagttctccatctcagtatccatttgtcagtaacccaccatcataggccaattactgcactgggttctagatcatttacacttctacgtactatacaggcccaaggcataattcactagaatagaatttgcagaatgtgttgctctacccattcagctaatcccagcagtcattaccgttacagcttccatccctaaatccccacttccctgcccctctaagaaccagcctctgattgatagtgggataagctgcttaagaaaacctacaggatccactctgctcttggacatctaatgttttagcatagtcagcacattgtcattcttatggtaaatgcaccagatttttgcttagggcactgtctttctttggttaccattccacatcgttaggttgggactgatccctccacctttaatccagacgaaattatgtaagccagtcagagaatctcattagccttgccacagtgcttgggtcatagataaatgtataacaggaaacaggcaaatcaaaggcatgaaacccatttctgagctgtatgttggaattgttgggggcagaatagctctcttcacaacaggtttaaacctaaaaaattttgagctgctggttgcacttttgctatcatgtgtggagagcctgaggtgagcctatctgagactgaagataatgcttaggaaagggaaccaagaaatgactagttaatatcaattgagcaattactatgtgttcatcacaattgatcatttaattctacagtaactcttagaaacagggtccacattgatcatccacaagctggagatgaggtcaataagaataaatgtcttgcccaaagttttacagctaatggcaaagctgagatttgtacctaggcagtctagatctagaacccatgttcagtaccgctatgctacactgtgtcaatgtatgctaatatattgactaataaatacacacttcagaaacagctagagagagagtaagagcctgagagagacaatgagtcctggttatttgtctttgagtgcctggatctaatcatacctgaaatcataaacttttttttttttttgaaacggaatcttgcactgtcacccaggctggagggcagtggcacgatctcagctcactgcaccctccgcctcccgggttcaagcgattctcctgcctcagtctcctgagtagctggtattacaggggcctgccaccacacccagctaattttttgtatttttagtagggacgggtttcaccatgttggccagactggtctcaaacccctgacctcgtgattcacccgcctcagcctcccaaagtgctgggaatataatcgtgagccaccatgcccggcctaaactttttttttttaaattaaataagcaaattcccctttccgctttttttcagaagccagtttgactgttaaaactgataaaactgataaaactcctaatatatccttcaatatgcaaggagtgatacacagaaacctgtatcaaacgtgaaagcttacagatcacactgaaaccactggatggctctacagactttgcaaacatttacgcttgcatctaggagaaatttgaggactatttcatgagattctttgaggtaattcattgaagtaaccaacccttcagtattctccctgtatttacctctgcccacttatgctctctttcatttcttcatgccaagcctgactggcatacaccttgctctacatctagggtctacagcttcaggaaaaatcagagtacatagtgaaagcagtgtcctggtgacctggcatgctgcaacccaggctcccatctcaaaattgcccataaatgtatctgttttccatggaccttccccagaaaagttacactgagccttgtctagtaggggagccttgcgtcagatatagtgtccatctcaaatttgttgctttaagtcatcctaacacatccacgtggggaacctaaaggagcatgacctgaccctcctcatttgttcattttctgttcctgctttcgtcctgtccttaagtgatttccaattggagacgcttcttatttaacctaccatttctgtaggcaaatatttcttaatcagtattacagacaacacaataaacaaaaagattagcaaatattaacaaagtgataatattaaaattaagaatttctgtttcttgaaagatacaattgagagactggaaaggcaagatacgaaaaaaacgtttgcagtgcgtacagcaaagagaccctacaaattaataagaaaagtacctagaaaaatagataagaaatttgattggccaggtgtggtcaatcctagcactttgggaggctgaggcaggcagatcgcttgagcccaggagtttgagaccagcctgggcaacaagataaaaccccgtctctacaaaaaaacagaaaaatcagctgagtgtggtggcaggcacctgtaaccccagctacttgggaggtggaggagggaggatcacctgagaccagggagctgcggctatggagagctgtgatcatgccactgtattccaacctgagtgacagagtgagaccctgtctcaaaaaaaaaaaaaaaaaaaagttaaaaaaaaaatcccaaaacttaatttggtactccatataataggatacacaattgatcaatcaatatatgaaaaggtacgtagcatcattagtcaaaagggaattgaaattagaactataaggagttaacattccctacccagtgatcagaatggttaagaatatcaatactaagagttatgtgggccacatggggtggctcatgcctgtaatcccaatactttggaagactgaggcaggaggatcctttgaggccaggagttcaagaccagcatgggcaacatagcaagacactgtctctacataaaaattaaaacataatttttaaaaacttaaccaggcatagtggcatgtacctggagtcctagctactcaggaggcagaggtaggaggattccttggcccagaaattcaaggttacagtgagctatgatcacaccactgtactccagcctgagagaccctacctctattgaaaaagataaaaagttgatttgggtaatttgttgatgatctgaaactctcacacacttttggtaggactataaattggtacaactttgcaaaaacagtattaatctgctaaaattttaatctcctaaaatcttagggatacgcccaccaggaatgcaaacatgcatatcaaagctacactggaagttcttaacagtattatttatcctagctataaattgcaagcaaccccaatggagttagaatggataaataatatgtgacatattcatggagcaaaataccattcagcagtaaaagtgaagacactatagctatgtacacaatgtgaatgcgtcccacaaacataccggacaccaaataatataaatgcatgattctattaatgtatactcagaaatgaaattttagaagttagaatattggttacctttgaggaaaagaaaagggatagttcaccttgctccagaataccctggtaacatacatactaccatggctgtctggtgggtaattctaccctctgccccaagtcccatgtcccactccagaccacaagcaggttccccagtctttctacccgattcaccaatggaagggatggtggaactgtgttctaacaatggtcaacaactcagattttcctaaacgttgcatatacatgcataactatttgttcatactgttccctctgcctagcatggaattccctcttctctctcagcagagaaacttaatactcccaattcaaaacgcagatggcaccacgcgaggtcagagaaagaggcaagaagttttagtcaacctgtctttgattattggcttgccatatgcagtctacgtgtacttgatcatcgcttaactttttagcctgtttctcatgtatgaaacgagaataatgatatccagctcatgggttgtttaaaggaatacatgacatgataaggtaagagcttattacatattatttttctttggtttcctttttcccttgcagtatcacttgctttcagctatgtactggcaccactcagaataattttagagtcattaattttatttatttatttttctcttttatttcttttaactttattttttttaattttaaagacatggtcttgctttgttgcccaggctggtctcaaactcctgggctcaggtgatccttctgcctcagcctcccaaaatgctggaattacaggcatgagccacagcacatggatccaagtcattaattttgttttatttaatgtaatttatttatttgagacagggtctcactctgttgcccaggctggagtgcagtggtacggtcttggctcactgcaacctccctccacctcccgggttcaagcaattcttctgcgtcagcctcccgagtagctgagattacaggcatgggccaccatgcccagctaattgttgtatttttagtagagatggggttttaccatgtcagtctggctggtcttgaactcctgacctcaagtgatccacctggctcagcttcccaaagtgctgggattacaggcatgagccaccacccctggccctaagtcattaattttaaaaaatgtttatttaggatgagcgtacttggtaggagccagggttagaaaaagagcaagatatgattcacaagaaattattactttggccaggaacagcaagttagtgaat

SEQ ID NO: 3999 - DNA, 3903 bp, Homo sapiens
agagcaatgaagtttaatatagaaaagtatgagttcactgatatggattcaactaattttttacacacattacaactaatttttcagaaactgccatttgtctaattttgatgacataacaaagaagagtatccaccatgatctaaaaaggttattaaaatactattttttccaactccaaatctgtatgtagctggatttccttcatctacttcaatcaaaacaacatacacaacagactgaatacaaaaacagatacgagaatccaactatcttctattaagccaaacattaaagagagttgcaaaactataaaatgatactactattatctacatttttttgttgttttagagaagacagctgtttttataaaaagtatgttggcctggtgcagtggctcatgcccgtaatcccagcactttgggaggccaaggtgggtggatcacttgaagtctggagttcaagaccagcctggccaatacggtgaaaccccatctctacaaaaattagccgggtgtggtggtgagcacctgtaatcccagctactcaggaggctgaggcatgagaatcacttgagcctgggaggcgaagactacagtgagctgcaatcgcaccactgcactccagcctgggcaaaagagtgaaactccgtctcaaaacaaacaaacaaacaaacaaaaaaacagtatgttcacatgtaatggattcattgttgttacttttaaatcatcagtttctaatatggcatttttccaaaatactaattttaatgtttatcatatttcagacatggtaaatattgttaaaaccactaaataaaagttatttggggttgtctataatttttaagagtgtagaagagcatatcattggatttgtcaatgatttcttgaatataacacccaaggcacaggcaacaaaagaaaaaatagatatattggacctcatgaaaattaaacacttttttgcatcaaacagcactttcagcagagtaaaaaaggtgatgcacagaatgggggaaaatatttgaaaagcatatctctagtatggcttaacattgaggatacatagagaaatttaaatattccacaacagaaaaaccaaacaaccccattcaaaaaagggcaaaggaattgaacagacatttctccaaagaagatatacaagcacaataagcccacaaaaagatgctagaaatcataaaaagcatggggaaaaaaaaggagacatatgggactacatcaaacttaaaaatttctgtgcaacagaggatacaattaggagtgaaaaggcagccgggtgcagtggctcacacctgtaatcctaacactttgggaggctgaggcagacaaatcacttgagcctaggagttcaagaacagcctgggtaatatggtgaaatctcatctctacaaaaaataaaaaattagccagatgtggtgacatgtgtctatagtcccagctatttgggaggctgaggtgggagcatcccttgagccaggaaggtcgagactgcagtgagccacattcacgccattgtactccagtgataatagagcaagaccttgtctcaaaaaaaaaaaaaaaaaaaaaagaaaaagaaaaagagtgaaaagacaacccacagaatgggaaaaaacatttgcaaatcttatatctgaaaaggatttactatccagaatatatttttaaaattcctacaactcaacaacaaagggcaaatgccttcatttttaaaatgggtaaaggactttgaatagtctccaaagaagggacacaaatggccaacaatcatatgtaaagatgctcaacatcactaatcattagagaaatgcaaatcaaaaccacaaagaattatcacctcacacccattaggttggatactatcaaaaatttaaaaacagacccaactatatgtggcctatgaagattaacttcacatttaagaacacacatagaatgaaagtgaaaggctagaaaaagacatttcaggcaaatggaaaccaaagagagcaggggtagctatacttaaaacagactaagtaaaaactgtaaaacaagacaaagaacatcattacataatgacagaggatcaatttatcaagacaatataacaactgtaaatatacagctgacccttgaacaacacgggtttgaactgcacaggtccacttatatgcagattttttccaaccaaatgaggatcaaaaatacagtactcacaggatgggaaacccatgtacatggagggccaacttttcatatacagaggtttcgcagggcaactgtgggacttgaatggtgcagcttttgttacacacagaggtactggaagcaatcccacaccaagggacaactgtaaatacatccaacatcaaagcttctagatacataaggcaaatatcaatacatctagagagagagagattataatacaataatagtaggggactttaggccaggtgtggtggctcacacctgtaaccccagcactttgggaggctgacgtgggcagatcactggaactcaagggttcaagaccagcctggccaacatggcgaaatcacatctctactaaaaatacaaaaattagctggacatggtggctcccacctgtaatctcagctactcaggaggctgagggaggagaatcactcgaacccgggaggaggaggtttcagtgagccgagattttgccactgcactccagcctgggtgacaaagcaggactccatttccataataataataatagtaggagacttcaatagtccactttcaataaagccagaaaatcaaaaaggaaacatcaaacttgaactacactttagaccaaaggaaactaacagacataaagaacattccatccaacagcagcagaaaatacattcttcccaagtgcacatggaacattcttgaggacaactcacatgttaggccacaaaacgagtcttaataaactttagaagactgaaatcataccaagtatcttttctgaccacaatggtatgaaactagaaataataaaaagaattttggaaaatttcacaaatacaaagaaattgaacaacatgctcgtgaacaatagccagacaaggacactacaagaaaagaaaattatagaccaatgggactacatcagcatagatacaaaaatcctcaataaggccaggtgcaatgtggctcacacctgtaataccagcactttaaaagactgagacaggaggattacttgagcccaggagtttaaggcctgcagtaaaccaagattatgccactgcactccagcctgggtgacaaagcaagaccagcaaaccaaattcaacaacacattaaaaagatcatccaggccaggctcatgtctgtaatcccagcactttgggaggcgaaggcaggcagacttgaggtcaggagtttgagagcagcttggccaacatggtgaagacccatctctactgaaaatacaaaaactagccaggatggtctccatctcctgatcttgtgatctgcccacctcagcctcccaaagtgctgggattacaggcgtgagccaccacgcccaacctgatcatctcaattgatggagaaaggtattcaacaaaattaaacatcctttcatgattaaaaactctcaataaattaggcacagaaggaatggacctcaacacagtaagggtcatgtacgataagcccacagctaacatcatattgaatagtgaaaattgaaagtttttttcgtaagattagtaataagacaagaatgcttatttcagacacttctattgaaaacagtattggaaatcctagccagaacaattagtcaagagaaagaaataaaatttgtccaaatcgcaaaggaaaaagttaaattgtctgtctgttgatgacatgatctttagat

SEQ ID NO: 4000 - DNA, 40061 bp, Homo sapiens
gctttcactttaatagatcgtgcggctgcacacgctttgggtccatgcatttctctaatcgagctgtaacacttgctgctgcggtccatggctccattccttgaagcccacgagaccaggaacccttggattgagaaaaaaccttcaattgggaggatacttcttatctcatttctaggggcccatccgggatttctccacagcagaatgcacttaaataattacaccagccttgtcatggatgctgctttgaagaacaaagatgctcaagctgagctttcactctctgtccaccactgctgtttgccactgccgcagacacgcgctgacttccatcccttcggatccggcagggtgtcctctgtgctcctgatccagtgaggtgcccattgctgctcccgatccgactaaaggcttgccattgttcctgcatggctaagtgcccaggtgaggggagccagtggcaaactgtaagatgtgccactgagatcccccttcaagttcagttcttcagagtctgcttcagctgcgtgaagtgcttttaccctaagtctccccatcttcttcagaccagccggcatacagcaactgagcagggtaggagtataaggggtagttcatttgagcctgacatggggcactgagataggcaatagcagcttcagagccattctgagtagcgtgatgaaacctcaaaccatcccattctgtcctccctgagacatgaatcatccctttgtccagcacatataaccatgttgtccacattactggcctataattagttacttagtagccagctcggttatcagaatgactatggtgatatcgatgtgcttgtgcttaagtaaaccttattttacttaacaataatcccaaagctcaagactaataatactggcatactgtcataattttttattgtattattagttattgttgttatctctactgttcctaatttataaattaagctttatgatagatatgtatatacaggaagaaacatagtatatataggatatggtacgacctgcaattccatgcacccatggggggtcttggaatagatccaccgaggataagagggaactactgtattaagtaatggggccactcctctttgcatacgttacattccaaatgcatatattctttccactagagccacagagccatcaaagatcttctattatctatatgctgcgtcctagatgatgaaacacaattctcaggaagtattggctccaaactggcattttagctgtgcaggccttttcagcactctctcacactgacagcttctgggtgggtcagtacgtcatctcatggtcataggcccacttactcttctcctttaccataaactaagtcttggtctaatggaataataatgtgttttgatgccagtggaaccaaaactctgcaagtccacagatagtaatgtttactgttgctttacaggtaagaatggtacccccctactaagaaagtgtgtatggcaggtaaacactgagcacacatggatataaacacagggataatagacactgcagactactagggaaaggatggaaggagagagacatgggagaaaaactacctattgggtgctatgctcactacgtgggtctaatacactatgtaacaattctacacatgtacccccgtatctaaaataaaagctgtttttttaaaagaaaaattgctgtaaataatggaaagaaaatgacagggctaatattttgggaatcttagaaaagaattatattcaaattacataagaagaaagacagagtcgggtgcggtggctcacgcctgtaatcctagcactttaggaggccgaggcagacggatcacgaggtcaggagctcgagaccatcctggctaacaaggtgaaaccccgtctctactaaaaatacaaaaaaaaaattatccgggtatggtggcgggcgcctgtagttccagctactcgaaaggctgaggctggagaatggcatgaacctgggaggcggagcttgcagtgagccgggaccgtgccactgcactccagccttggcgacagagtgagactccgtctcaaaaaaaagaaaaaaaaaaagaagaaagacaggagttattatcttagtctgttttgtacttctacaaaaaaaatacctgaaattgggtaattgataaagaatagattttttttttttctcacagttctgggggctgagaagtttaagttcaaggcaccagccagtttgatgtctagtaaggaccccatctctgcttctaagatgtaacctccagaggaaagaaacactgttctccacatggcagaacagtggagctaaaactcatttcttaatgtccttttcaaaagtatttgatctacccatgtgggcagatccctcctggcctaatcgcctcataaaggcccacttctcaatatcattacactgatgattaaatttcagcgttaagttttgagataaatattcaaaccatggcagttgtctatttgaattttaccttcaaaaactccgttcacttatattatcatgtggaacaccatacttctttgagtttgcttcttcctttctctctctctccctctctggatatgccttctcagtgtctcttcattcaatttattctgtctgttctttacatgtgtctattattgagagatcaatgacagttcaagttgcttcttatttttaatgcttttgtatctcattttcatgcctttaattattattgatggactgataatttccaggtctcttctgccagctcagatatcactaatcacagctggatttatatatacactgcttatgagacatcattcaaatcatgctgctcaaaagatgacccaagatctttttattcttaactggggtgtgtgtgtgtgtgtgtgtgtgtgtgtgtgtacatctttctatacacgacactactatagttcacccacaccctaagtcagagacaagttcattgacattgtcacaggccacagccaatcatgtcacagcaactcttagtgaaattgtacacttttgaggctgctagcccagaatgtgaagccagaatcatgctgtttttaagtaactacgtgatcttgggcaatttgtgcaattattctatcccttaattcccacatctgccaaattgaaattaaagtagaactcaacacaaaggtttttgtgtgggtaaaatacattgagatatacacagcgccttactatataaacactgtatgtgtcagctactgttgtgttaagagtattatgattgataacatctactaaatctctctctcgccttactgctatttctctaattcagaattctattattttgcaagtatcactgaaaaagctaacttctctcttcagtgttgctgtttcataatcctttctatatattacagtgattttactaaaatgggaatagaattaagttgcttctttaaataaaattctttaataagattatataatatattttattatatgatcattcttgttcctcctgactaaccaccttattagggattttctggttattttatctttctacataaaatttggatttgacttgacagtgattgcggaaaacatatttctattttgccattattttattacatttatagattaatatggactgaattgtcatcattatgatgttgtgtttttattccaagacattacatgcttatatatttgataacaacttactttaagttctccaatagtatacaatttttccccttaaaaatcatgcacattgattatgaggtctgtttcaagttttttgctttgcaaaatagggtgttttctaattatataatgtatatgttatgaactatttatttttattttgtattcacctaccttaatcatttgccatcatgtttagagtcatttttttcagtcttggctcctgtatactgaaagtgttgaatcgtatcatctgtaaatgatgacagttttgcctctttatttcttatgccttgtcaaatcttaatagctagatacaagaatatttgcttctagctatagcagatgaacttgaatatagccatccgtcttgctagactaattagtaaggctggataaaatatgaaagataaagtgttagagggcacctgagatctctaccaagcagcagagacttgaggaggcaagactccagaaagaagggaagcacataaacataaattagatgttctgttcagatttttgctatgacacatttgccagttgaaagaggcagaaggaggcatctaaaaatcttgaaagtcaaactgtctatgcaacaacattttggacctggtgtgctaaaaaatgaattcacatcagattgaagaaaagcacagggagatgtgaatgatatgggctgctgaataagatgtgtcttcaacacaatctcctattagggcaaaattcaaataaaagaaatatattgagattatatagaattttgatgctgactggccatgaattccagaggacacaataaaaaaattttctgagtgagaggaattggaagataaggctatctggatagctgtatcaggacagacatggctgagaacaaataattgtctgtaatagaacatgcaaattcttccttagaatgtagtaaagggactcctttattcatatgtgctcctgccacaactctgaatgcatagattcttttgacttgacataaatgccacagatttgtttttattttaatgaagtccaataacaggagatccaccaataacctggaggtagcaggtagctattgaaaggaagtttatgaaattattagaaaatgatttattgaaactttctattacccatctcctagcattcaatatctgccctcattaaactctactagtaaatttaataatcaccttttgcacaatcaaatttttattattttggttgttaagtgggacataacaccatggtcccaaattttctatattttaaaatgcattttcttcatttatacttcataccattctaccaattttcctaactggttgaattcattgctttgatttctgattaatttctcatattgtataatccttgagagaaaatacgtccttcacactcaaattgtttgtttccagtgccatatagttaaacctttcttttattcggcatgtatttcaaccttccttgtctctccattaaccactgtcctttcttcccttcacaattggtaaatgttttattttgcaaagaggataggctaattaatttactaaatataatagttttatgtaggaaaatacactgaaattaggaatatgtattcaaaatgacatataacaaacccatttttttccttatcaatgttatcacccaacaatgtggaacaaaatgatgttactcaaagacttcccatttgtcatgttgcttaaagtcatagattccaagaacttaacaacatcgtcaagcaaggacttactgtacttaatatacaaatagtttttttaataccaaaatgtctccttcctttgctgaatgctgattgcatacattaaatctccagttcctcgatgaatgcatattcttttaaaaaacaagctgtcataacctattataagagcatagcaaattagcaatatacgtttacctcctttgtgatagataagtgaagcaagttttgaaaccaagttaataattctgaataaatccacaattttttttaaaatgctgaaattttgtgtaatatttttcaaaggtctttagtgtaacaaattagtgagatgaaatggtaaaatgtgccaattcgcttcctaccatagttcacttatatatcacttgcattttaatccttatagattttaatccttatagatttctgagaagaccattatccttaacaaactaacacaagaacagaaaatcaaataccacatgttctcatttataagtgggtgctaaatgatgagaacatatagacacatagaggggaacaacacacacagaggcctttcagaggatggagggtggaaggagggagaggatcaggaaaaaataactaatggatactaggcttaatacctgggtgataaaataatctgtacaacaaacctccatgacacaagtttacctgtgtaacaaacctacacttgtacccctgaacttaaaataaaagttaaaaaaaggaaaataaatttaaaaagaatattatgtggtctgaacacttatttctgttaatcaaatttctttgtaatcatataattatttagtaccacccacttgtacaacatttattgcatacatcagtgtttataatcatttctaacaaataaacttttttattaaacattgggtagaattttatatgtatgattataatttaatatactgcatcatatatacatacgtaagatgcaatatatcaagttgatataagcagagcttatctgcctgaattcattgtggagatcatggtatcctagatcctcaacttccaatgatatctgtttactcttcattagccaccactgtaaaagaaacaagatttattaaccacttgatggctttctattctagaatatagtgactgcattatcgaaatgcatatggcatgtcatttgggagaataacctggtatagaagacagtgtccaatactcagatcaaaagaaatgaatttgcttcctgattgtgtcaaaaatcagtggtaatctgttagcaattcacttaaactcttttaaggcttaatgtagtcatacaactatgaatgcattatcaagcggagttcacatcattttcagaattgttgttatattattttatgaacctctgtgttttgattatatagttggtagctagctgctgcactaaactgtgagaaagaaaatgacacctaacatcctgaactaggtaaggttatgtgttactacaagctgacttgatgctcccagctagagaacactgttctcctggtgaacataaacaatctcacagagcataacaacatcaggtcacgttgaagggatgataaagtgagataaaacaaggtcaccatgtaccccatgaagtactcgaacatcctcctctctctgctaaaatgaattatggctgcttctttacctagtctatccttcctgtagataagatttgttgaggttctcaattatgaacttgtctgtcttcctgacagcatccaatcatgatcaaagcctgaatccttggaccctcccctgaattaccggaccaaagctcaaatcctgtaataggtctttctcttactgagagaggcactatggctttctttgctgtgtgttttcctttcatgcaaagagtcataaattcaacttgttcaactatcactgtgttcttggtggcctttgtctggagatatttgacaactgaaatttgttcaatttaagtaatgctgatgctttgcaatgaatgctatttgaaatctgtattagcagttatataacttctgctctagcactctatgtatttacttctaaaattaataaaattctgacatgtttataatattctatacttacatgtgtttctccttcaagattttaatttgttatgtttcatggtagtatttgttttagtaatgtacttatgtgatagttattatatgttttaaatcatatctcagttgagtttttcatccataggccacattaatcattttaataagccatgcaggttatatcaattcattttaataaataatgtgatttaatagtttaccttattagtataaacctaactctattgatcttgaaatgcctaaaacatgatttttttgtcttttcttaaagttattaccaataataaatcatattgttttaattctgaaataagtatttggaaactatttcaattttgagacagtgaaatatgttatttttgtggttgcataattttattatacagaattaactgaccatattggatagtttcgatctaatatactccagtatgtcttttatgctaagtatttaaaatgatagaaaatatattttgctcacattgacagaattaaatttgagcaattttctctttctctttgtttaactgaagataattggtgcatctacaatagaggtcattgctgtatctttaacatttcatctataatccttatgaaaagattgcaatatttgccttccttaattaagtattcagttttgcaatttttaaatcacaccaataataagcattttttaggaagaatggagtagagattacagaattattagttttataagcaaagcatatgtgaggtaagtactatattaggtcatatttatttccttttgacctgaaaacttattgaatcttcctgaagttcttattttaggtaaaaatgggacaaaacaaaacaatgacaagcaaattctgttctaaaaagctttaaaactgatatcaaaattactcagctagtaacttacatgtttgagaatacaatattatacacccatgttcatagcagcatttttcataatgcaagatggtggaagtagccatgtgtccatccatggacgaatggaaaacaaaatgtgttataaatatataacagaatctttttcagacccaaaaagggaggaaattctgatacatgctacaacatagatgaactttatgtgcattatgctaagtaaactaagacagtcacaaaaagacatattgtataactccagttatagggggcacctagagttgtccaactcatagacatattaagtaaaatggtgaccaggtgctgagggaagggaggattagagagttattacttaatgagtatagagcttcaatttttcaagatgaaaagagttaggaaggtgatgttgatggttgtacaatagtgtgaatgtatttaatactacttgactgtacacctaaaaattgttcaaatggtaagttttatgttatatatgtattttaccaaaatttaaaacaaacaaacaacttctcacatatgtttatacaaataaagggataactcagccaagctatttaataactttgataaatctacacggttctacgcagaactactatctttagagattagaagaaaataaaaaaatatctctcacagtttgcaatccacctcgtcatagccaaaagcaaacttcctaaagggaaaaaagtctttatacaataattaagggtttgtttcagtcaagaagaagacagatccacgcttgtaaccttatgtgcttttcacattatttcagaacattttgttaaatgtaaaatgctgtaatattttaacaaaaaaaaatcaaaggaagttttttacaacattgtacaccttagaaagttcataaatattgtaattttctttatttcatataatagtgactactcatatggttatgaattttcactagaacgtttagcataagacattgttgcaaacattttcaaaatatatcttagaaacttggggggatgataaaaatttaagatgttaaggtgaaagggaatttaggtattatctttttcaaatatgctatagttacaggagtgtttgtcaactatagatgaaatattgtaagtcggtggaaagttttaaccttccttggtagttgtccattctgtctttggtcaagtccatttcctagaacattatttttttgtcctaaaatttaccaactagtcattagctacatatctaaattaaccaaaagggatatcaaaaaggagtgagaatacattttatatcccttgtttgcacataggtgttttataatttccctcttatcccttttggttagtcaatcccgtctatgtgttttagacattccaagacaattattgtgactcattttggctatgctttttcccttttcagtgtttttacatttgtcacatccttgatccaaaagattcaccctctcttcctatcccagctaacactcttcaaactctcttccacaacctattatttatttttatctttaccttttcataaattaatgtgttacaccataatcattctttatgaatacttgtcttgaccatttaattgaagataccttagttcagggacttgttatattcacctttgcagcctcacttctaagcagagtcagctgcctattaggtaatcaaagaccccactgaataaataaatcgggctagttctgccctctggaacttccaactattacatttactgaatctgaaatatcagttattattttctccttccttctttatctatttagtgtttaacaaatacctattgggtatctgctacatattgaacagatatacagcaaagacccagaaaaaatatgcctgtcacatggaaatttttgcagtcagttaagcatatcatgttctcttgattctaaagcactgttacgaaatttgatgcacttaataaacttaataatcacttatatatacaggcatatctcatttcattgtgctttgctttattgcactttgcagatagtacatttcttacaaattcaaggtttgtggcagccctggttccagcaaggtatcagcaccgtttttccagcagcatgaactcactttatgtgtttgtggcatatttttctagttctcacaacacttctaacatttaaattattattatatatgttatgattatttggactagtgatccatgacgttactattgcaattgtttttgtttttggggtaccacaaaccacagccatataaaatgatgaacttaatcaataaatgttgtgtgtgttctgactgctctaccaattggccattcctctagctcgctctctctccttaggcctccttattccctgagacacaacaataacaattcataattctctaagtgttcaagtgaaaagaagactcacacatctcacaaatcaaatcaaaagctagaaatgattgaagatgaagatatattgaaagccaagagagtctgaaagctaggcctttcacataagtgagccaagttgtaaatacaaaggaaaagttcttggaggaaattaaaattgttactccagtggaaatacaaatgataataaattaaatcagtcttaatgctgatataatttttttttgtggtctgaacagaatatcaaatgagctacaacatttcctgaagccaaaacctaatgtagaacaaagccctaaattttctcaattctttgaagactgacggaggtgaggaagctgcagaaaaaaattttgaagctagcagaggttggttcacaaggttttgggaaagaagccatcttaatgacataaaaatgtaacatgaagcagcaagggttgatgtagcagctgcaggaagctatctagaaaatccagctaatgtatgaaggcagctacactaaacactggattttcagtgtggatgaaacaagtttatattggaagaagatgccatttggatagtcatactgtattagtccattctcatgctgctataaagaaatacccaagtctgggtaatttatgaaggaaagagttttaattgactcacagttgtgcatagctcgggaagcctcaggaaacttacaatcatgacagaagacaaaggggaagcaaggcacctttttcacaaggtggcaggaagaagaagtgcagagtgaggggggaaaaagccccttataaaaccataaactcttctgagaactcactcactatcataagaacagcatggggaatcacacccatgatctaatcacctcccacgaggtccttccctcaacacgtggggattacaattcagattaaaatttaagatgaggtttgggtggggacacagagccagaccatatcacatacctagagaggaaaagtcatgcctggcttcaaagcttcaaaggcagtctgactctattgttaaagactaatgcagctggttggtgattttaagttgaagccaatgctcgtttcccattccaagaatcctagggcccttaagaattatgctaaatgtactttgcctgtgctctataaataaaacaacaaatcctggatgacatcatatctgtttacagcatgagttactgaatattttatacccactattaagacctacttctcagaacaaaatattctttgcaaaatattactgctcattaaaacaatgcacctgtcacccaagagctctgatggaaatgtacaagattaatgttttcatgcctgctaaaacaatatccattctgcagcccctagatcaaggattaattttgactttcaagtcttatgattttcagaaatatattttgtaaggctatagcttccatagacaatgattcttctgatgtatctgggtaaagtaaattgaaaaaaactctgtaatagagtcatcattctagataccattcagaatattcgtgatttatgggaggaggctaaaatatcaacattaataggagtttataagaagttgatttcaaaccccatggatgattttgaggaattaaaaacttcagtagaggaactaactgcagatatgatggaaatagcaagagaagtagaagtggagcctgaagatgaaaattgttgcaatctcatgataaactttaatgaatgagaagttgccttacacatgagcaaaaaaaaaaaaaagcaatgtattaagcaatgtattgagttggaacttactcctggtgaagatacttgtaatcttcaccaggaacctggtgaacgttcttgtaatgacaacaaaggacttagaatactatatattagttgattaaacagcagcagggtttgagaggattggctataatttcaaaagaatttctactataggtaaagtgctatcaaacaacattgaatgcaatagagaaatttttcttgaaaggaagagtcaaagaggcaaacctcatcatcttgttttgagaaattgccactgccatctcaaccttcaacaaccactaccctcatcagtcagcagacatcagtatgaagtcaagagcctccaccagcaaaaaatgtataactcgctgaaggctcagatgagagttattttaaattaagttatgtacattgcttttttagacataatgttattgcacactattgatggtaaggttaactaactgccattataacttaaagaaaatttgaggttaattttattctgagtgaagtttggggactaacagtcttgggaacatagacccagtgcaaaccaagagagtacccacagtggactacacaagacacagtatttataggttatattacatagaagataggagaagggggtagtgaaacaaaggtgatattcttacagttttgattggtgctcagtgatgcaagtatataagataagcaaatatgtggtgaatgtatacagggtaaacaaacatgcaggtgtcttagggtctggagatggatgattgattctatcctgactgtgcttgtctgataggcaaggttgtaatcagtacatgccagtgaaatatttgacagactccagccatacaggtgagagttcagctttagttcataggcctcgtttctattacccatatgtccaaactgcaaccatctcaggtcactttacacatttttctttcagattttctgtttcctgacaacactatatagacaatagtatagcgtaaacacagcttttatataaactgggaaatgaaaaaaattcatgttacttgctttattgcaatatttgcttactgtggttttctggaaccaaacttgcaatatctttgaggtttctctgtaaattgttcaaaaaaatacatcttttttccaaacactaaagtgaaaaaatataactttcttttatatttggggaagtgtatatttatatatatcatagtaaaaataatcaacatgattgatataagaaaagtatttgaacaagttcataaagttatttttacatgtaaattgaaagagaaatggttaataaagataaatcacatgtcatttaacttatatgtaccaaattacccaactaaaaattcatgtttacattaaatatatcactaagtatgaataaaaatgaaagtatactagaaagtgtccttgctactttctcatctgttggtataggtcagctaacatcagaatgataaacatatatgacaatttggagtctaggcatggagatataaaacagaagaggttattattatgctaggctataattattgtagtaattgtttttgctagaagcgttttttctcatcatgatggtgtttttgacaaagcaccagtaacaatggtccaattagttatacaaagtgtgaaaatgcatttgtgtggggaaatgtgatatagaaattgcatagattgctcaggaagatattaactgaattttgagatgtaatcatctggtgctcaaagtgttcagtgaagttgtcttacatgctctgaagcagagctatcacagaacactccaactattactttcaatttagaccatcagcttcggtccatttactgagtggttaaatcagagcaattgattcttctgaatctctgccagttatatccaatatagttcatccaggccatgtgcattcagctgagtgttatttttggacttccataagaactgttctatcatcaactgaacagacatagcttcagaaagaggttcatcatgtgaagagcggagattgcacacccaggtcacaagtgacctttcattaaattacagacaaaatcctattctaaaaaaggccattgaggtatgtgacacctcataacaaggttattttccattcctgtataacatcccacagaagcattatttgtggatgtgaataatgtattttcagtaataaacgtttcacaagtccctatccatttataactcacctatttaataattatctcattttctctatattgcacaagggtgccacaaaattaattataatctttgtatcttgtttaattatgatgataacccatggtatgttttatgaaagggttaaaagggggttacatatataaaatatgatctctaagaaaatttagattgtatgtatcatagtaattatttttttgtttagaactagatagtattggctacaaaaaaagtcattcttcaaaaagtacaaataagttattatttaaattttcattctaatgacagtttagtcagttgcacacacacacacgtaacatatatgcatttactgtatttatctatatgtaaatatattttttaaagagatgaaaaatagtaaacactaaagaaacatttattgcttactaactgttagtcattggacttaatattttatttttttttaatattttaatgctttattagtaaaattttgcatatattcaagagtgtggaaaacatatagatatagatatacatcttaattaataatttagtgaatgactatataaaaaccctcaactacttagattttgaatcccctgtcttgtactgcaatactactgtcaggagacaatgcttcatagttaatgtttctgaaacgtgaggactttgtgaagaaagattatacaaagtcatattaacctggtctagcaaaaatacaatatctgcatcataacaacagtggggctacttattagtaattttgtaatagtctactgttaatcctgctgttttttagaaatttgactagtaaattaagtggggtcatgaaccactattggatttttaaatctttaatactgacatgatttcctgccacaaccctgggattagagaattaaagatggtgctacccttctcaccagctcatcacacaccttttggtaaacagaatgttctctgggccctaccatgaaataaagttcattggcaggatttctggcctgacttagtagctctatgccatcattcccctttttagtttttagaattttgctgaacgttaacaaagaaaaaataatcttatgaattaaaagggggttttattatagatcctgcaactaataatagaattaatagaatagcaacaatatatatgtgcaactttatgtcagttatttttaaagcctacatgaatggaacacttgttgaaacataatttatcaatcctgacataagactatctgaatagtttttatcggcaaataacatatttctgttttaaattcagattatccaacaaagaaaattccaggaagaaacgggctaactggtaatttttcaaaatatttaggaatgaaatgatgagtcttacagattctttcagaatgcagagaaagagggtacacttttttattcattgtatgaggtaaagttaagcttgatactaacatctacaaaggatagtacaagaaagacaagtacaggccaatcgctataatgaaaatagatataaacattctatacaaaatagcagataagatctggttacatacaaatcaaataatgtgatttattttgtaaggcaaaattttctattgaatatcactataactagtcacattaacaagaaaatggaataaaaagaccatcatcatcttgtgggataaattttttaattttgataaaataattgaatattttatcaaataccataactagctatggataacaaatgtcagcaaaacataagtaaaagctattgcttgtgtaagaatatctaccaaaattaaacaactattatctcattcaatagtgaatattgaatgctttctttgtgatatcattatgaagaaaagcacaaccactatctcaacttgtataaatattatataagttcctagctggtataatagaaaaaaataggttaaagtttttgaagaaaaaaaaaaataaactgtctcctagtctcagatgaaattaatgtgtgaataaaaaaatgaaaaaaaaaaaacaaactggtcatttaataaatgcatgtagtgagttctctgtataaagcttaataaagtccagctataatggtggaaaccaaggaactggctgggatgatttaaatgtcctttatttttagggcttagattacatgaggatatgcatttgccaaaacccatcaaactagacacttacatctatattttattattttcacattacttgcaaataaaaacaatttggaaaaagtgataaaacaactaaatgtagcatgttaattttaattctacttctaaaaactgctaattgatagcattattttaatgtaagtaataagggtatagctttcattatactatttatacaacatttctttacgtttttcttttactattaactaataaatttttcactttaaaataaagttaccttatgtgattttcatattgtagcataaagcatctatgaaagaaaagagaccccttttctgcatagatgaccagaaagaaaaagataaaatgtccccagtcccaacagcagtcttctcataaagtcactcctggccacaaaacagaagattctaatgactcctagaacatttccctccatcattatgtgtgaattccacagggcaccagaatgtccatttctactccattaccatctttgcactgcttttccctatttaccatcttagtgaagcaggaggtgtataatcaagtcttaagccataccctggcagtgtaaacggaaacccagctgcagcaactccagtctgtgtccaaggctcagatttgagccaattcctattcctattcgtattcctttctcaattcctatttttcaaaggaaagccaggtattccttgctcaaggagggtttgagatggagttttaaaatctctcaatgcattgtttactgttatatttcaaaaagtataattatctttgtgaaatatttttacgtgaaaatgaagattattaatttgatcaagcactttattattatgccttctgttaagtaattactgaagaaaaaaatagtaattatacctaaaggaattatattggttagtatttatggaatattacctatgcaccatgtaatgggccaaactctattaactcaactcatggatgaagtaattgaggtacagaaagtcacagagaaagtaaattttgggactggagccaattcagagccttctgacactgaaaccagatcttctaagtgtaatagtctaagttctttctagtttaatatatgttatcatattaagaaagtattcattaatttttatcttattagggaatgggtattaaattttgttaaaggaaggtctttttagcagttatggggtgatcatattatttttctctttttatatcaattaatatggtgaattacattaatggatttttaaatgagagttttaaagagagagagaattaatgtaaggatcttttaactgaacttcccaataaatgtgaaagaagttataacacagaaaacagccattttaaattctcaatgaaataattaactttgacaaggatcctcagtccttgtcaaaataattgtggggaaagtttgtggggaaaggaggtctagaggtccagagattcataccaaccattacctgtccaccccccacctacccctatgttttcattttagaccagtgcttgttaatcctccctgaacagctgaagagcatttattttatttatttgttttttccacctttattttagtttcacggtgtacgtgtgcaggtttgttacatggacaaattacatgttgttgaggcttgcatcacccaagtagtaactaatgcttcttattaatcaagggaaaggcgtaccttggtaatggagtgttttcacagaaaccacctgaatcaagtaattcattttgggaaaatgacaatatttactgatttaaccatggaatggatattaaaaacacaagttctacagcattcttgcaaaaacaaaacaaaacactgagttgtatcaaaacaattattagaaaatactaatagtggaagatactagtaaacaactcacccagattactcaaatatgtcaataatctaaaacataaacacagacaggaaaatgctctgattaaggagactaaagaagcgtaaaacctcagtaccatatatgatttttaattggtctctagatttgaaaaaaagctatgaaggacatcttgggtacaattaggaaaacttgattatgtacttatacattaggtaatattataataccatatcagtaataaatatttgggatatagtaatggtatattaccactgttcttaggagatgcctgctgaagtatttggggacaaggagtcttgatgactgcaactttaattttaaaacatgcaaagaaagagagagagagagagagagtatgtaccagaatatattgtataattctttcaaattttctgtatctttaaacttttttacaaattgaaattaaaaacctatataaagcacttcattacatcccactatttaatagtaaatgtgcttcagacactttgttcaggttaacacgaaaagcacaagcagtgtcaggatgcagtcaatacagaacaataacaacaagaaaaccacaatcattgaatgtcttccttttaagctgtcgtgatattttataaaactgtgtgtatagatccgtgtttaaaattatcctcacattttgctttcccttgtttcttcctccttcattatttgtcttaagtagttttttcaccttggtgaaatagttttttccccccatcaattctgttatattcatgtaaattaaaattcagtttttttttcctttttttcagaaaaactatagtaacttgatttataggtacatgtaaatatgttttaaaattcacacttgcagaaaacattttcagtctttcattgacatcaataaggctataagaatggtatactttaagttatctttacttcagctgaacattagctttccatcacactttaatagtgttcatggtggggggtgtttagttagaagtcaggccagagaaaaaagcctcaaaaaactgtgtttatgtaaacttattttatacattactatattcagagaatgcatactaatgtgtaggtatgtacaaataaatgcatgccacagagtatacctttcatgggaataaaataaagtttgtttttctagatctatatttgtcatcttgcacttttatatggaaagtgaatgctctaatgttaccggtaggaagccggctgattgtttgagcttccacatcttaggcaatagtcccgtacagagcacttctaaaatcagtaagttatgcaaaaattgactaaaaatggagtaaagacttaaatgtaagacatgaaactgtgaaactactaggagaaaacatacgggaaattcttcttgacattggccaatcggtttatgaatagatgctgaacatcatcagggaaatgcaaatcaaaaccacaataagatgtcattttattccagttagaatgcctattaaaatgacaaaagataacaagtgttgcagtgatgtggagagcccttacacattgttagtggaatgccaagtagtacagctactatggaaacagtgtggaggttccacaaaaacttaaaaatagaatactatataatccagcaatcctactactgggtatatattcaaagaaaatgaaatcagtgtgctgaagagatatctagactcccatatttattacagcattattccctcaaaccaagatatgacatcaacctaagtattcagcaacaaatacataaagaaaatgtggtatatatacacaatagaatgctatttctccattaaaaaagaatgaaatcctgtcatttgtgacacaatggatgaatctagagaacattatgttaagtgaaataagccggacagacaaatacctcatcatctccctcctatgtaaaatcttaaaagctgatttcatagaagtatagaatagaaaggtgcttagcagaggctggaaggaaaaggggaaaggagggcaggaagaggttggtcaatggttaaaagttacagttagataggaggaacaagctctaatgttctattggacagtagggtgacttctttgttaataatagtgtattgcatatttcaaaatagctagaaaaaaggactttgaatgttctcactacaaagaaatgttaaatggttgagctgatggatttgctaaccaccatgatttgatgattatacaatgtatacatgtatcaacatggcacatgttgcacagatattatgtgtcaattaaaaataagataaacttaagaaaattaatgagttatttgatattttgtgttcaaaggtgttacttgcaatctagataaatagaaactgattagctatagaaaaatattttacattattgtatacaaatctatctagatatgtgtcagaagaattgaatatttacaaaaaatgacatataggaagcactgaattatcatagaatgagagctatctagacttgcacatcattttcttttttaaacttttattttacattcggggtacacgtgcaggtttttttatatatgtaatttgagtgttgtgggggtttggtgtatatatcattttgtcacccaggtaataagcattacacctgataggtagtttctctatcttcacccttctcccagcctccacccttaagtaggccccagtgactattgttcccttctctttgtgtccacatgtattcaaagtttaactcccactcataagtgagaatatgcagtattcggttttccgttcctgttttagttggcttaagataatggcttccagctctatccatgttgctacaaagaacatgatctcattctttttcatagctgcatagtattctattatgtatatgtaccacattttttaattcagtctactgttgatgggcatgaagattgattccacgtcttcactattgtgattagtgctgcaatgaacgtacacatgcatgtgtctttatggtagaacagtttattttcctttgggtatacacctaataatgggattgttgagatgaacggtaattctattttaagttctttgaaaaatcaccaaactcctttccacagtggctgaactaatttacattcccatcagcagtgtataagcattcttttttctccacaatacagaatctgttatttttctgacatttagtagtggccattctgaatggtgtgagaaggtatctcattgtggtattgattgcatttctctaatgattagtatgttgagcattttttcatatgcttgttagctgcatgtatgttttcttttgaaaatgtctcttcatgtcctttgtccactttttaatgaggttgtttggtattttcttgtaaatttgtttaagttccttatagatgctagatattacacctttgtcagatgcatggtttgcaaatatttttcccattccgtaggttttctgtttactcagtcaatagcttcttttggtgtatggaagctctcaagtttaattgggtcgcatttttcaattcctgtttttgatgtaatggcttttggcatcttcatcatgaaatcattgccaggtcctacggccaaaacagtatttcccaggttatcttccagagttttactgtagtcttgtagtatagtttgaagtcacgtcatgtgatgatgcctccagctttgttttttgtgcttagtgcatcagttttctttggctactcaacaaatgctagagacttaaaagtttaaaaaatacaagtttattgtcacagtttccaataataaggagcccagatatgggttagcttagtccttccctccaggcctcaccaggctgaaattgatgtgtcaggctggggtgtgatttcattttaggcccagggttcttttccaggctcctgtggctcttgacagatttacttcctcacatgtaactgtggaatccctagagggcgtgtcttcataatcagccgcaaactgacttcaggtgggtgtccgtactctttaaagacttacctgattatgtcagactcacctggataatgtccattttgataaaattaaagtcaactgtttagtaacttgagtagaggaatgatattccattatatttacaggttctttctgcactcaaagggaggatactatacagagaatacgcaccgggaataaaaatttcacaggaccagttagaaattttgcctatcccaacagttattgaaaaaactgtagctcaaatagttaccctgacactagtatttggtcttggaaaactcacctaagtagttccttagattgtgtgtttcaatacacttagttctaacatggaaatatgaagatcagctccaaatatttttttcccatgaaaaccatatgatatgtttaaatgctccaggacatactgtgtattcttagaatggaccatatctaaatgaaatagagacttggtctctatcagaatccatactaatgtgtaggtatgtacaatatcagtaataaatatttgggaatagtaatggatttacatggagttaacaatctagaaaaacagttttttagttacaaagatatttagaaaatataactttccaatgtcattcttaataatattaagagttccatgcttataaatattgttctgtattatcatcaactgacatagtttacatacgtgtctctgttcaaatctcatgctgaaatgtaatccccagtgtcggaggtggggtctagcgggaggtgattggatcatgggggtggtttctcatgaatgggctagcaccatcccctgggtgacgtcctcgtgatagtgagtccttgagagatctggttgtttaaaagtatgtggcacctccctgcttgctgtcttgctgctgcttttaccgtgtgatatgaaagctccggtttggcctcccatcatgaatgtaagcttccagaggcctctcagaagcagatgtcactatgcttcctgtgtagcttgcagaaccatggctgaaggaaataatgtatacagtggtccatttccaagacaaagtgccttaaatcggcttaggtcagcaaactgcaaaagaaatagaatgtactaggcccttgcgtggatagccaatgcctgcttgttggactcactgccccccaccccacctttagttggctcacctgaaccaaaaaagtcgtctaagataaaagtttactagcccgcaaaatagcttgttttgtccattcttatcagcctgcccaggtacttaggtcataagtcaaatatataaaaagcccctgagctaactaggattgcaatgcattgtgggctgcaacaaaatgcagcaaaacaaccctaaaaagaacacctaaagcccctacccaacaaccaataggtgatgtccgggaagactgtgaccccatagtactcaggctatgaggaacctggaaagggacttgcacactaggggataaaatgcttgttaaaaactgtgctgggttctttgtagattctggatattagccctttgtcagatggatagatggcaaaaattttctgccattccataggttgcctgttcactctgatggtagtttcttttgctgtgcagaagctctttagtttaatcagattccatttgtctattttggcttttgttgtcattgcttttggtgtcttagtcatgaagtaattgcccatgcctatgtcctgaatggaattgcctaggttttattctagggtttttatggttttaggtcttacatttaagtctttaatccatcttgagttaatttttatataaggtgtaaggaaagggtccagtttcagctttctgcatatggctagccagtttttccaacactatttattaaatagggaatcctttccccattgcttgtttttgtcaggtttgtcagagatcagatggttgtagatatgtgtcattatttctgaggcctctgttctgttccattggtctatatatctgttttggtaccagtaccatgccgtttttgttactgtggccttgtagtacatttgaagtctggtaacatgatgtctctggctttgttctttttgcttaggattgtcttggctatgtgggctcttttttggttccatatgaaatttaaagtagtttttttccaattcttttgaagaaagtcaggggtagcttgatcgggatcattgaatctataaattactttgggcagtatggccattttgatgatattgattcttcctatctatgtacatggaatgttttccgatttgtttgtgtcctctcttatttccttgagcagtggtttgtagctctccttgaagaggtcctttacatcccttgtaagttgtattcctaggtattttattctctttgtagcaattgtgaatgaaaaacaaccccatcaaaaagtaggtgaaggatatgaacaggcgcttctcaaaagaagacatttatgcagccaacaaacatataaaagaaacctcatcatcactggtcattagagcaatgcaaatcaaaaccacaatgagataccatctcacgccaattagaatggtgatcatcaaaatgtcaggaaaaaacagatgctgcagaggatgtgaagaaataggaacactgttggtggcagtgtaaattagttaaaccattgtggaagacagtgtggtgattcctcaaatatctagaactaaaaataccatggacccagcaatctcattactgggtatgtacccaaaggattataaatcattctactataaagacacatgcacacgtatgtttattgtggcactgttcacaatagcaaagacttggagccaacccaaatgcccatcagtgatagactggataaagaaaatgtggcaaatatacaccatgggctatatgcagccataaaaaaggatgagttcatgtcctttgtagggacatggatgatgccggaaaccatcattctcagcaaactaacacaagaacaggaaaccaaccaccacatgttctcactcataagtgggagttgagccatgaggacacgtggacacagggaggggaacatcggggcttgttggggggtgagggggagagatagcattagaagaaatatctaatgtagatggcaggttgatgggtgcagcaaaccaccatggcacatgtatacctatgtaataaccctgcacattctgcacatgtaccccaaaacttaaagtataacaaaaaaaattaaaataaaaaaaaaaaccggtactgggtgttcctgctcatcagacccctaaccttgcaagaccatcattaaaagtctcacttttgctattttccaggtctctgagtccattctttgggtttggacaagtgcgtttgtttctcacatgggccagttgaacctcttctttataaattatccagtctcaagtatttcttgatagcaatgatttgtggctcttcacgaagataaatatttatcaccaaacaatgtaaacttcccacatgacaacgagcaactaccatcttgtcttcaggatatttttgtagatttgaaaggcagtagaagccggggacaggggctcacgcctgtaatcccagcactttgggaggctctggcggtggattacttgaggccaggaggtcaagaccagcctggccaacatggcaaaaccccaactctgctaaaaaatacaaaaattagcccagggtggtgattcgtgcctgtagtcccagacactggagaggctgagacaggagaatcgtttgaacctgggatgcggagactgcagtgagccaggtccaaaaaaaaaaaaaaaaaaaaaaaagaaaaaagatcatagatattaattagttcagcaggctgatgttaaaaagtaaaactatggctaagacaactaaaatgacaagatcagatatacatagccagtttatcactgagaacacttttgagataatagtggaaaatatatatttatttagtacgtgcatacaatccttattagcatgcccataagaacatgagtaaatatgcttgtaaataaggcatcaaattagggccaacatttaaaatataaaattgtttttaacattctccttaataaggagagaaagtacacattccaaatgtgtcttagaaataatattattctaaaaacattcattgttatcatgtaccattgctttaagaggtttgtaagatccatttcagttatgacattaaaatagaacagataattacaaaaaatccgaattgacatttcttgcaaatgttttaagcctaggattccatcaaggtattaataaccaatttattttaataaaacctttccattttccatacataaaatgtttcaaatttcccttcaaatagtaacagtgtaatatctattttaaaaaattactgtttaattaaaaattttaccttatattgttggaatacagggaaacacattttaaaatattatatacataagacacatttagctcaaacactgtaaagagtttgaacaactcttgctttgtatgcaatagaagacattttagtgaatctacgttgacatacaagccaaggggtgatattaatagtaatgcaaaataagatatacttgattttatcatgactcttaaactaaccaaaatacttttatttaaaagaaaagcacggagtttaaacaattaatattcactccaaaccaagattagtacaagctcatgtctcaagatttctaatctacttagagcaattttgataaggaaataaaaatcaatgatatggttacccaacgaaaacccactttcatagctaaaaaaaaaagatatgtgctgttgtataacttaactgatattttaaaattacataatttatgagagttacttccttaaaattatctctctctcactttctgtcctctctctccctgttttgtctttcttgatgctatttataactgttaagtgcctaacctaacttcctgtacttgtactggttttaggatgtgtataaataaattttatagagatgtcattgtatcattttaaattatggacatctattcagttagttatgttttttaaaggagatgagaaagaaaacactttctgaatctacaaagtattcttatttctgatgttactgtctttattccattctgttaatcatagtataatctctctttgaagtataaaatagttgaggatcagttttacgccagaatttataagctatcatgctgaaatcctccaaaccagtaagcacatcataaacacacaatggataatggtagtttcaatggtctctgaagttggtttggatgttaacatagctccatcatctactgtgttacctaaggtagttcttaatagctctgagtcttggtatagccatttgtaaattataaaaagaaaatcaatagcgctactataattgaggctattgtgagaattaaaataaaatgtaatataaaaataaaatactaaaacagtttttaactttagtagatgctgtctaaacatgtaggtgcaatcttattattcttgctagattaaaattagcaacagaaactgaaaatcaaatagaagatattattttataacactattttcagttaccttacatgctctgaacatgtaacaccagctctagttctgtaaaatcttaaggatttaatgtgagctacagtattaaaaatcacttaaataatgatcctcatccgcagcggaatctatttcatgtttaacgaggtatgtgttttggatttcatccacgtctgacaaagcagaggcatgggcatcagtgtgttttgcatttttttgtgtgttttatttacttatattttttctcactgaaatatcctaactcaaacttgttggctttcattaatacttatgtttataacaatgtattgtaatctctacccccaacaaacacacacatttaaaatgtgaggttagtattaaaattggatgtttgtactgaaacacattatatacttcccaaactatgtgtctttataacacagatgttaattagaataaatatgaatattaaaatgttaccgaaaggaagatagtaaattcattttcttcatttattcttccctattcatgtgtcagagaaagttctcaaacattgggtcatattttgcagaaagaaggacattttcctagagtactaatgaaggacttgaaggctttttcagttggctctgatttttacctcaccacattgccacttcccctcgatgctgccagaaggcccttaactttactcctccattgagtccctttggtcatctgggctggcttgagtcacctgcagaaagcaagccttctaatcttcacttgggacactggtaatctgtttgtgaagctgtttaaacaccatcagtttcttccagactccttccctttcacctctacttgaacatattagtgtgttacaattctttttttgtttgtttgtttgagacagagtttcactcttgttgcccaggctggaatgcagtggagcaatctccgctcactgaaacctccgccttccggtttcaagcaattctcctgcctcagcctcctgagtagctggattacaggcgcttgctaccacaccctactaatttttgtatttttagtagagacggggtttcaccatgatggccaggctggtatcgaactcctaacctcgtgatccaccggcctcagcctcccaaagtgctgggattacaggcgtgagccaccgcgcccggccttgtgttacaattctttacctgccaaatggacccttttgtgaggaaaacatgagcaaagaattagatgaccgagtttgggaagtctgcagtctgataatctataatctgcaacattgctcccagcaatgtttcatgtgcactcaaataggccacattagcatggactatcttttctctctctcttagcctagccttgattcttatgtcagctgagccaagttgtaattcatgtacgtcactgacaagaaaagggaagctggtcagaggtaattagtcctacctgttgctatagtttgaggcagtacctccacaattcaggtgctgccaatatgatggtattaagaggtggggcctttcagagctgataagtccatgagggcttgttacgtacctcatgaaggtgattgagtccctcataaaagggcttggcagagggaattcctccctttttcctttccaccttcagtcctatgaggacacagtgctcctcccctctacaggatttagtgttcaaggcaccattttgtaagcagacaacaaacctgctggcacattgatcctacactgcttggtctccagaagggtgagaaataaattcttgttctttataaattacccagtctgtggtatgttgttatagcaacacaaatggactaagacatttatagaggctgaatttccttgtgtctatcttctatatagaccgtgtatcatctttgtcttcttaaagcatgcaagagagaaatggataaatgcaactgggctcttctaattactgggagataaattataacacttcacatctctacttcccaaaatctggttatctcttacaggataatgttatattatgctaaaatcataatcctttcctagaatcacctttgaaaatgctacattctttctttcttcttatacacctaacagtgttatagtaattatgatatcatttatatggtatcttaataatcaactaaataaatttgctaattattgtaataaaactaatgcatttggcagaaaggaacatgtttacatataaggactttaaaattttaatttccctgactgacgcttctttttaaatacatttattccattccaatttattctacagttgaaagactaagattagtcaaagacaaattttaccatttcagagatttattcaaacatttccaaaacctcctttttccttaataacccaaattccagtcccaatttggcatctgaagtgcctaaaaatagcgtgtgattattccacagagcccttgatcattgcagtccagaaatctttaatgatgacagatgatgaaggcatgagaaccacagggaaacagaatggcctctgcattccctctcctaagtctgtttgcctctacaattatagccagggtgccattcaaaaattagcttgaacacaacctttaacatgggtgatgtgtgatccccatccacaacctacctcctgacattgcctgataattgctaagactccatctcataggttacaggagctacataaatttaagatgccatttcttgattataagggaggtttttggtcaaatgtagttaatagcttcacctttcaagatgacttttttctctcatagactgagcaacacagctgaccttattcatataataaaatgccatcctgtcacataagcttgcaaacattccaaaacaagctcattagcaaataatgatgccaaaagagtaactttttaaatgtcaataaatacattttacatccttcagataatctgtgaaacgtaacagataattaccagagctatgcctttctctgcaaagttttgaaaaattctgtgaaatttaagttatatttaaaacgtaaagcacatcaatgattctttttctcccagtatgaaagatttttaatgagattctaaacctaagtgacctatttacacaaactcaactgctagataatgagaatgagaaggtggtaaaaatttcagtaatataacctctaattcaaaccttaagtatgtcttcaaaatacctcagaaatacttcctactcaagtctacacacacacatgcacacccacacatgcacacacatcattcaagacaggaatattgaaaaaaaaatcaccattgttaaaatgtcatctattctgtgtaccatcgaccttgaaatgtgtgggcggcaagccacccgggtgccaaggcaagatactgaaggcacaagctgttccagtataataaagaaaatatacaaaataagaagagttataatagaaatatagatatgattatatatgaatattattaatcatcagtttgtagcattactctttattccaatattataataatccttgctctacaattataacctaggaaaaaccaggccatacagagataggagctgaaggggcatggtgagaagtgaccagaagatgagtgtgagccctctgtcatgcctggatagggccactagagggctccttggtctagcggtaacgccagtgcctgggaaggcagccgttacttagccgaccaagaaagggagtctccctctctcctggggagttagagaagactctgctccaccacctcctgtggaaggcctgacatcagtcaggcccgcccacagccatcgggaggcctaaatgtctcactgtgatgctgtgcttcagcggtcacgctcctgtttcactttcatgttccaccctatacatctggttctgccttcaagcagtagcagaattagtgaaagtactaaaaaagcctttgaaatgcatagaataatggcctaagctgtcctctccgccttggctgccaaacagggaagggccccctctcccgtggacacatgactcacgtgaccttatcaatcattggaaatgactcacactccttaccctgccccttttgtcttgtatctaataaataacggcgaagccaggcattcggggctactaccggtctccccgtcttggtggtagtggtcccccgggcccagctgtcttttcttctatatctttgtcttgtgtctatttctatgatctcccgtctctgcacacgaggagaaaaacccacagaccctgtagggctggcccctacaaaatgctgcattttggctacatgatatggtttggctgtgtccccgtccaaatctatcttgaattgtagctcccataattcccatgtgttgtgggaggaacctggtgagagataattgaatcatggggacaatttcccccatactgttctcgtgggagtgaataagtctcacgagacctgatggtgttataatgggaaacccctttcgcttggttgtcattctctgtctgccaccatgatttgaggcctccccagccacgtggaactgtgagtccattaaacctctttttctttaataattactcagtcttgggtgtgtctttatcagcagcatgagaacagactaatacactacgttaatgaggaagtgctatagtttactagggttcagtttagttcaacaagtttcctaaatatccaaaaggggttaaacatggttctaagctatgggtaaatacaaattgctatattttaaaattgcaggctgggcgtaatcccagcacttttggaggccgaggtgggcggatcacgaggtcaggagatcgagatcatcctggctaacatggtgaaaacccatctctacaaaaattacaaaaatataaaaaattagtcggggcgtgatggcgggcgcctgtagtcccagctactccgaaggctgaggcaggagaatggcgtgaactcaggaggcggagcttgcagtgagccgagatcgtgccactgcattccagcctgggtgacagaacaagactccatcttaaaaaaaaaaaaaaaaaaaaaaattgcaataagctggcaaatataattgtaaattagtataataaaatgactatttgaagtcttcataaatgagggaatattttagcaatatttaagaattatttgaaatcaatttcctagggatggagattaaagaatgtattccatgaagaagaaactgcatagtgtagaaaggaggtggttcacgcctgtaatcacagcactttgggaggccgagaagggtggatcacgaggtcagcagttcaagaccagcctgaccaacatagtgaaaccccgtctctactaaaaatacaaaaattagccgggcgtggtggcatgtgcctgtaatcccagctactagggaggctgaggcaagagaatcgcttgaacctgggaggcagaggttgcagtgaaccgagatagcaccactgcactctagcctgggcgacagagcgagactctgtctcaaaaaaaaaaaaaaaaaaaaaccagaaaggaggcatggaataatatacctttgaagaagaaaaaacagtctctcttaaggctgtatatttcaaggatttaatcattttagacaaagataatgccaaatgaccaaatgaccattatttgcagatgttttaatggtcataaatgttttcctaggattttgtagagtgagaaaaataagttcttgtagtgtggagcatgatacttatgaagactattgggtataattgccaaataatacactattatatatttcatctatttttaacatagttttataatttaaaaatacatcaaatgtttggatgtcttctaggagacagacagacttgaaattaattcaattttataaatgattcccctaagattaataataataaatgacatgtttaaagtatctaaattgcaatgttatagaagcagaacaaagccctaatgtaatagtaatcctagtgggctgtagcagctgaaatgaaatgactttaagcagatttggatggttattacccacatgaaatcccttaagtgacttttcccctactcaccctttcttttagcaacttcctcacaccccgtggcctaggactctagacatgttaagatatgctaagggaatcaaagagtagaacatagtcataaatggcaaatcatttgactttactacataaaatgaaaaactgaagcacactctgtgaaatctaacaagttatgcattgtgtaaagataggcattataaaaaaaacttttcctctttggaacatttataaaagaaatgatataaacataaatgacgtccatgcaatcagtttaagaaaaatattataaaaatgttcttattgtctcacaactttgttagactttataactacctccatactaatgaatgtcaatagtcaggttatatttctgttttcattcattttctagtatacttcagcctataaggtacattataaggtaagtattagggtcttctctgttgaaagtatttgttgtgaaactaaaatcagatccttacctaatttatttggttgcatgttaattcttccataaattatatagtacaggataaatgtgtcaatactgctttcattaaataattttaaaattcatttgccaatgcaaaaaacaaagatcttttttaaagaaaaaaaagttatgcaaagaacaaaatccattttccaataaagatgttaagaccacagtgaggaaacaaaaaatattaaaattatttgtcaatgaaaatctggtattcactatatttttctgttaatatgaatgtctcagcatcagttttgttggctcacaatatattcatgcaatttcacaggatgtggcctacaagttaacttttattttttaccaatgaagaaaagacagaaatctaatattaaataaagaaattcgtactaataaaactgtggtaattcatttttaaaatatgtattcatttctttcttgcacatttttcctttctctatagtaatatttcttattcatttcttaaaattacttttggtaaaaaaattaaagcaagtattattctccattacacttatattgttgttagaatctcaatgaatagtttcctctacttttctattgaataattttatgtaaaattcatactgtttgtgaacacatttcttttaattatatacccaaataattttttcttaaatattactgagctgaaatatttaaatattagctaaaatgtactattagggaatgatatcctcagttaatgacaagatatgagctatgtagccaattttatttcaggtagaaattatggaaaacctgctcctactatatattctattatgccatgaaaatctgtatctctgatattcaaaatgcatcagtaaaaaatccaataacaatgcaaaattagaatagaatcagtaaggttcttagaatgtgatcaaattaaactagggcctaaaagttcaatattgtctcatattcaagaagaatcaccttaaggtaaaagccaggacctccacagttgaataaaaggacacagatcaatgagttacatgatgacattaaaagacaatgataaatctatgttcattgcaacaattgggcctatatgaaacctaaaagtgaatgtaaaataatgtgttttgttgaaaacattataatcagatgtatttgttgtattactaactgacccaaaagattagcagacccattatgaaaaccaagtaatgttggtgtttcacctccattgaatctttgagtgcttcttgagaacccaggtagtgtgattacatctaatgttactacaagtgaggcactgtagctcttagctcttgggtctggctgccataactaaataccatatactggggggcttaaacaacagaaactaattttctcacatttctgtagctagaagtctaagatcaccataccagcataattggtttctggtgagataatttttccttgcttgaggatggcagccttctctatgtccttacatagttgaggaagagagatagaaaaagctctcttacgtctattcttataaccctatactgaggactccaccctcataattttatctaaacctagttatctcttaaattccccatctccaaataccatggcattgtggggttagggcttaaccatataaatttgggagatggggacacaattcaatccatataactgattatattaaaatgagcaacagaaaaatcattagcactatttgatataacatcatgatctgttgcccctatactattgtcttttcaaataaatgtttacattgacagtattcaatcaaagataactaagcaggtctgaaaatgcacaatatgccaaaaaatgaagaaaaggggcataaaaatctacattattaaaagatctatagatgctccagttgttgcagttagcttaaagaaactttgcggtatacagaattttaagatgatcaagtttcctgtccctgatttatacatacagacttatgttttcaaaaattaatccaggtatagctatgaaggagtttttgaagatacaatcaaggttctaaatcagttgatcataagatacacagataatcctcgatgggactgatctaatcaggaaaactcttgaaagggtcaagtcttctcttggctaaaggtcttggaagtgtcagaaagattcaaatttaaaagaaaatcatgggagaaatgaaattccttttgcatcatcactttcatctaggatatactcaaatgcatatgaaattacttgagccatatctattttagtaatttgttgcaaaatatatcaaatgtaaaaaagaaaaaaattatatagttattttagttatacccatgtcatcaccaaagagaatttcataacttactgttttggagttttattttttggttgttacttagatttttcttttttttatgtattttttgcatttgggtggttacttctgtgaattgtttattcatagaatttgcatatttacctgtgtatatttctttttctttattggttttacaatatgtttatattatagctattgattctattttatatattctgaaaacatattttccagataataatataagcttgtagggttttttttttattttctttctttactgtatatttttatactggaatgttgaattttgatataattagtaatcaattctttactttcatctttttttgtctcattcagaaagtgttctccactctaaaaataaaatggtttgctcactgtttaaattaattttcataaattataaaatactgttaaaatgagtgaattagaataaagataaatattttcacaaactgtacacctccatgtaaccagaatctgaataaatataagtaagaataaccaacagtcaagaggccctcccattctcccctcatcagagtaatcactatcatttatctaacaccataagtttatcttgctagttgttgaattttatacaaatggaatcctatagtatatattgtgtcaaatcataaatgcatgcttttctgcactgtcatttgcacactcaacactacatattttgattttttttcttatgggttttcatatacttacaatgaggctgtatcattttgattataaaatcactaaatactctttcaaataaaatctctacctcattggcatattgtcatgtacccagtgcctatctaatgaatccaagtgtgttccagttgtgactttcaaatttttctgctcagccacagctttctcacaggtgcttcatggtaggccaagtgaatgaattgtggaagacaaatgcataggtatagtatgatcccaacacgctgcacaatgatcatccactgatttcttggcttgttttttaaaatagattccattttgagaatactgagatgattcagtatattcagaaatacaacttgggcaaaccttcttgccagaccttgatcctggaggtttgcttaaggattttgaaataaaatctgaatgagacgagaggaaggttaaaaaaaaaaaaaaaaaaaaagaacctgtggttataaagagaaatttaagattaactgcaaataattagcagtttatacttaatatagcattcctatacattatgctatttgtcttaggaattactatcatcaagtgatgaatatagaaaataaagctcagctgttgcctaagtttctatgattagatgttggtcctataaaaattcaaactaaggttttctcactctcatttcactgttttgacttttcctaataacaacaaaatatgtcagttaaattgtatctctagggttgaaaatatgattgttgtgattttatgctatcacagtatagaataatgtactagaataaagaaattgtggccaggcacggtggctcacgcctgtaatcccagcactttgggaggccaaggcaggcagatcacgaggtcaggagatcgagaccatcctggctaacatggtgaaacctcgtctctactaaaaaaatacaaaaaattagctgggcgtggtggtgggcgcctgtagtcccagctactcgggaggctgaggcaggagaatggcgtgaacccgggaggcagagtttgcagtgagccgagatagcgccactgcagtcctgcctaagcaaaagagcgaggttccgtctcaaaaacaaacaaaaacaaaagaaactgctcagttgaagcaattcaaacttaaggggcagcagcaaactaaaatttgtatttaattcaattatatattaaaaagtaaaaacataatgggaaatgataaaggtagtagcatgctttagaaaggcaattgcatttataatccatggggagcatgtagaggccatctgaggacctcaatatttcatacaagaggctatcaaaggtaatccaggtatcaaggtgttttctatattcttctaatttatgttcaacaaaataatctaaagatcaaaacattaaaatggaatgtagattgttaaccttttcagaaatatgttgtgattttttttctgaatcctcattcagtcattaaattatttttatgtactaaaatcagctgtaaaaacagaaatgactcttatttggaaaatgtatttagagtaaaataatcatggaagagtttggttggttataatatactttacataagatttataaaagctaatactttttaccaactacttaccctgagtaatgtcttgctctgaataataatagtgaacaaatataaataagtattaatatagagctcatatcttcagagactttcatatatatagaaagatatgagaaaaatatatgaagtatcaagaatgggatattatactgtataaatatttttgattttataggtgaatagttcagaagactgaatgattaatttgtcataatctgaaataaatgagcatacttaaaattacatttaagcttttcatagaaaatacgggtcagaaataagaaaggatacatgttctatgtgcatttcacgtgcactatcattatgatttttacaacaatgttatatataacataaatatatataaaatcaacgtgtttatgttccatgtcatttaatttttattttgccctatcaaggtttaaatcttatttgagaaatattttatttggaagcagtaacaagtttattggaatccaaactgaagatttatatctcctcatattgaagaaa

SEQ ID NO: 4001 - DNA, 3467 bp, Homo sapiens
aaacaatgatgatgggaaagaaagagtgattgaagagattaaataaatggtatgacagtgggtaggcaacaaatataagtggtaagcagatcattttacgtggtcatagtgttagaacaatcttcaggaatacatcaaaatgttaaaactggtcaaaaactgcattgatccctttgacaatgggggctatatgttacttatcttaatactcttcacaacttgtacacaacagatagtggattggtattttaacaataaacttacctgtgaaaggtctggtatatcacctctgtcaattccaacttgctgtaagaaaagcattgtatttaataaattataataaaaatattttataaataaaatttggaaaaatgacatcacggctagtaccagtaatattttaaacagacttcttaagaatcaggaaaatatttaatctccaaaaatactcaacatttccaatggcttagatattatttggtggccctaaaagttcttaacagtagggaaactagagttggaaagtcaacaaatctaagttaccatccctgtcttctgaacacctgtatgtaagctaccttgtcacaatctgaaaactcccctctcttctatgtgtaatatgataaaaacactatggtaagaatgagaaagcctgaccatgaacaagctctttgatgcaaaaaaaaaaaaaaatttaagaaacaaacctgaagacatcgactttgtctttctccataaaacatgctttccctggaaatcaccacagataacactttaaaaactcatgctctgtcaggtaggccaggtttacataaatgtcaagtgatatctaatcaggatataactgtcttctcaaaccaattccaatataccttcatgatgctcaggccctaggcaatttccagcaaaaaaagatagaaacggttcctgtgtattctagcaccccaattagaaaactattttctgtcccgtggctgtgtttcattttctaatcagtctcccttccttttgtgacctctcaggggctggtctcagaatgatgtcagcagaaaatctgataaaggccagatatggtggctcatgtctgtaatcccagcactttgggaggctgaggtgggcggatcacgaggtcaggagatctagaccatcctggctaacacagtgaaaccccagctctactaaaaatacaaaaattagccgggcatggtggcaggcacctgtaatcccagctactcagcaggctgaagcagaagtaattaggtataaaactcttttctccaaattaactgttacaatgaatgaatatatcataataaatttttagccagctttaagtaacaactcagtcaatattgtttatccatatgacacaagataagaaatgttattaggctacagcagtatttacccaacaaattaataattccttcattgtatgctgcaaacagtctaatggcatctttgaacaggagcatgaaggcagcatttattaccccatttgtaagttcattgctattaacctagggaaaaattggaaaataaaattagctaatcttaggttttaaatgacattgacaaaaagatttccttcaaattaagatacagtaaattcatgcattaggcatgttagtgaaaaatacatttattttctctaatacatacataaagatcacggtgcagtagctaccatataaatgaacattatttattattattaaatttgctgtaaccagataattgtatttatttgactaaaagaatactggaaatatttttagttttatctcaaggaataaatcaaaaagataaaccaaattaattctaagttcttttttagcacatgaaaattaactcgttatatatagaaaaactaagcacaaaattgaatggcaaacaaaaaactggtaaaaaagttatttgcagactatctagtagagctgatgtccattatatagggagaatcctaataataaataaagtaaatgaaaacaatttacaaaataaaaaatacatatggataataacgtgaaaagaaatacaacttcacttatcaggtaaattaaaatacaataatcaaatcaaattactaaaatatcctttcctgaacatcagactatattactcagtgcccataagaatgaaaaaagaaaagaacacggtagctcatgcctgtggtcccagcactttgtgaggccgaggcaggaggattgcttgagcctggcagtttcaaatgagaccagcctgggcaacacagcaagaccttgtctctacaaaaaactaaaaccaagaaaaggcagctgagcatggtggtgtacccctgtagtcccagctactcaggaggctgaggtgggaggattgcttgagcccaggagttggaggctgcaatgagctatgatcatgccacagaactccagccagggtgacagagaaaaatgctgtctcaaaaaaacaaaaaaaagatgaaaaagcaaaaacagacacctgttgagaagttagtggctcacccttttggaatataagcaatatttattaaaaatttaaatgtttatattatttgaaccaccacattctttttctgggtgttaaacctattgaaataggtttacaaatagaaacacacacacacacagagggagagacagacaagagacagagagaggagagagaattgagtgtagcactgtttaggataaaaaaacagaataaacatctatcaacaggaggattagataaattgttattatataacaaagtacaatacagacattgaaaagaataagaaattttaaacaaatacaatatattaagaaaaatatgcatggttggaccctgagattctatacaaaccaaaataatgttgaataactgcatcagtaccccatgccttctagagcaggggtcagcaaacttttttttgtaaagggtcagatggtaaatattttagactgtgggccacacagtctctgtcataacttttgaactctgctgttgtaacataaaacagccatagataatatgtatcagtgagcttggctgtgttccaataatactattgaggacactgaagttggaatttcatgtaacttccacctgttacaaaataccatttaattattttcaaccacttaaaaaacatacaaaaacaggcagtaagctgtagttggataatctctgttttagtctatgaaatacctgtaagatttattgaatgtttactgaacacttactatgtgccacattaataggcaatgggggtacaacagagaacaaaagtgacctagttcctgccctgaagaagcttaaaaactagcaattaaacaatttaaaggaaaaatctatttcagcatgaaactgtcacagttccattcactaacttgcactcacaatctctaaaacaaaatgacaaataaataataaacaaaacattgttaagatagatgacaaaaaaacagaacagagttgaaaac

SEQ ID NO: 4002 - DNA, 1016 bp, Homo sapiens
gctgttgctgttgctgttgcgcggcggcggcggcggccgccgctgctgccgccgccgccgccgcttccttagccgacagggccactgtcttgaccccgacgggcggcggcggcccgggggagcggccgtcctggaagcagccgtgcgcccgcttcagctggcgcgctgtctcgatcacgaattcgatgcgatcagcgccctcgtagttgacgcaaccgcggcatacgggttccgagaagtcccagatcatggcccagggcatgcggggcaggtcgcacaggtagcaagattgtctccgggacgaggacacctgcgccgccgacatgatgcctgccctggggaaggtaggcccccgcccgggctgtctccgcggcgccttctcctccgggaggactggccggctggggagggagtccgactgcgggggagggaggagggggggcgagaaagttctgccccaggggctggagggaacgcgagtctccaccgccggcgcagcgcctcgccgtgggggctccaccgcccgggcagcggacgggttcagccctctcttcgcccccacctcctactgcggttgactcgtcgcgaggggagctcaggcgccttcttcctggtgctgcagacttgggctggaagctcccggcccgaggggagggggcgagggtgcccggtggtggccgccgttgcctcttggccccctccccggagtggctggtgcgtggaagctcgaaaggggctgtctcttcctctccccggggacccccctacgagctgcgtcctctccccgacgggccccctggggcgagggccagagggttcagtgccacccggtgcccgggtccaatcttgctgaagccgctgcttccccggaggaccgggggagggggtggcagccgagaaaggaccttctcccctccgcagcgtcggccgttctgctggcggcgactgggtttgcaccccggagggagccgccgcggccactgcttccaggacgcacgagagcagaggagaggagt

SEQ ID NO: 4003 - DNA, 6488 bp, Homo sapiens
ctggcgaagaagatggcggcgcccatcacacacataaaacatggcttcccttcaaaacaaaaacatcccggggccggggcgcgcggccggcgctcacctgaggaccacatggtgaccgagaactcgccctccagggtcttgatctgcacctgcttctgctcccacttcttgttgcccgggtcggcgccgccgccgcccgccgcgccggccccgccgctgaggtaactcttcttgccgctcttcttgccgccgcccttcttgacgcggccgcctcccgacgacgacgagccgccgccgccgctcttgccggccgccgccacggtgaccagcgtttgttcaatgtagtcgtcgtcgccgccggccggcgcgggcaccgggatgagaatctgatcctcgaagccgtcctcggcgcgcagcccgtccgagtcgtcgccgcccaccacctcctcgcgcgtctgcaccaggatcacctcctggtggtggtgcacctgggtcgggtcgtcggtgaccagcggctgcagagcgatcatgggcgggtggtggtggtggtgatggtggtggtggtggtggccggcgtgcccgtggccgcccccgccgccgtggtcgccaccgccgccgtcctcgtcgtcgtcgtcctcctcctcctcctcgcccaccactgtggtctcgatggtctccaccgggatggtctccacctcgatctcgtgcagctccacgatctcggccggcatctccgagccgtccgtggcgatgtagagggtgtcgcccgaggccatggctgagggctccgccgccacggccgcggcggcctcggctcctcggctgcgggcgggcgggcgaggaggcggccggccgtggggaaggaaggcagagggaggaaggcggcgagcgggcggggggagagggggcgggcggcgggggaaggggcgggcgccgcggcggcggcggggcttccccgcctccctcgcctcggtgcgcccgcgcccgcgctcgctcggccgctgctcgtctcggctccccgcctcgcctcgcctcgccgcaaccgcccgccctggccgcgcctcctcccgccctccgggccggcgctccgcttcccccttcctcctgcgcctccgcctccttccacacaaataccaactcctcaacccgagcccagatctcgccgccgccgccacactctgctcgggcccggcctcgcgagacttccgcgctggcctcagcccgccccgcctcgctgccactcgcccgttcgccctctcgattctcctctcggccaatcgatctgtccgctggcctccgcggccccgcccactcgccgggctcctcccggattggggccgatgggaccgggggcggggcggctcgcacgcgccctggctggcccgcggcgcgtgacgtcagcgcgccgccgccgccgccaccgcctcccgcttcccggtgtcgcgcggctgccgcccttcgcggtgcaacagccacaaaacccgccgcctcgggccggggccgcactcgggaacggggcgtcgccgctacagccgctgccttgggagccggtccacactgccgttatgagctgtcgcactcacgtgcgcgaaagtctgcagcttcattcctgaagccagcgagaccacgaacccaccgtgaagaacaagcaactccagacgcgtggcatcaagagctggaacactcaccgcgaaggtctgccacttcactcctgagccagcgagaccacgaacccaccagaaggaagaaactccgaacatatcagagcgaacaaattccagacacgccgcctttaagaactgtaacactcactgcaagggtccgcggcttcattcttgaagtcagtgagaccaagaacccgcgaattctggacacaatcccaactacttgggaggctgaggcagaagaatcgcttgaacccaggagcgggagattgcagtgagccgagattgtgccactgcaccccagcctgggcaacagagcaggactccatctcaaaaaataatgataatatgttttgggagggtgaggcttgtggatatcttgagcccaggagttcaagaccagtttgggcaacatcatgtctctacaaaaaatataaaaattaggcgtggtggcatgtacctgtagtcccagctactcagaaggctgaggtgggaggatgcttgaggccaggaggaggaggtttcagtaagccgagatcgtgccactacactccagcttgggctgaaaaaggtaatgtattcacgagacatcggttttaaaggcacaaaaggctagtgtttcagaaagactcaagccatgtttttctctgctctcacaccaatacagcaacaatcaacataagacttctgtgaccccaaaatatatgggggtttctccccaccagcaagcaagcaataagcaatcaattctgcagcagatgccgtctgggtgtcctccaattcaattctgacaccatctacctggagctagcatcagatcccacaggtagccacccccgttctcacaccagtcgccaagtccgggcctccggagcttctggcttcaagttggggttcccacaacctctgccctgggtttaatttactggcgtggctcacagaactcagaaaaacctgtacatttgccagtttactatgaaggatattatgaaggagacaatgaagagacgcatcggcgcggtattggggtaggggtgcagagcttcatgccctgctggcacaccaccctccaggagcccccatgcacccagtcatccagaagccctcccaagcctgtcttcttgggtctctatggaggcttctttatgtcagcatttctgcccccagggtatggggtggagccttctctggaataagggtcttatgacccaagatcagattagggtcctgccttgggcaggtgaaaggaggcaggaaaaggtcagagagattctgtttcccgaggtctaacactcgcaacgttctttttttagttattctttttatttattttttaccttttcagtggtgctgacactcccaacattgtaacaaaagactaacaagggctctgggagttatgagataggaaccatggatcacacacacacacagccatggataacatggctaaaccccatctgtacaaaaaaaaaaaaaaaattagctgggtgtgatggtgcacctgtagtcccagctactcgggcggctgaggtgggagaatcccctgagccctggaggtcagggctgcagtgggccaagatcgcaccactgcactccagcctgggcatgggagtaagattctgtctcaaaaaaacaaagcaaaacaaaacaaaacgtattctcatcacaccatagctagtcagtgaaaagccagtcttcccccaactcttgtcccccagctcacctctccagaaggaccactcctagtagtttcttgggtatgccctccagagacagtcctcacaaatatatgaaaacacatacataatattctgcactttgcttttcacataacactggggtggagatctttccatattatagcacagaggttcctcactgttcctggctgtgtcagccactgaggtacactggggtggtagggtggtgaaccccaactccaaggggacagaagctcttgcacttgggacccttccagaccttgccctatgcacctcttcatagggtgttcatctgtatcctttataatctcaaccctaattaatgacattgagaaattatgattgggccaggcacggtggcctgtaatcccagtactttgggaggccgaggcagggagatcacctgagatcaggagttcaagactagcctgaccaacatggtgaaacctcttctctactaaaaatacaaaaattagctgggtgtggtcgcacatgcctgtaattccagctactggggaggctgaggcatgagaatctcttgagcctgggaagtggaggttgcagtgagccgagattataccattgcactccagcctgggtgatagagtgagactctgtctcaaaaaaagaaaaaaaattatggttgaattaagactctactccaggccaggcgtggtggctcacacctataatcccagcattttgggaggccaaggcaggcggatcatgaggtcaggagtttgggaccagcttggccaacatggtgaaaccctgtcttttactaaaaatacaaaaattagctggacatggtggcgcgcgcctgtagtcccagctacctgggagactgaggcagaagaatcacttgaacccgggaggtagaggttgcagtaagccaagatcacaccactgcactccagcctggcgacagagtgagattctgtctcaaaagaaaaaaaaaaaaagtttactccagctcaaagcttgaggccgtccacctggggaacactgacttcagaagaatgaatgggtcaggtcagcttccaaagtggagaagggaaggttttgtttacatacgcagttcacaggattgcaacattttccatgcaaggtcagtacatatgctttagcaatttgattggttatggcttgtcacattccaaggaagattgctttaatattctgtgaggaggggtgctgattcaaagggatctatttctggagccacagtgctttttctaatcatttataggaaaaggcagaggctgttgaagctgctacctgactcaggccacatagccacattcctctcaaggctcaaaatagttttggctgggtgccgtgcctcaccctgtaatcccaatgcttttggaggccaaggtgggaggatagcttgagcccaggagttcaaggttgcagtgagctatgatcacacctctgcattccagcctgggcaacagagtgagaccctgtctctataataataataattcaaagttccaatagctttaagtttgaattatttaatttcataataataaaccagcatatataaagtgtttcattgagtttgtttgttttagagatggggtctcactatgttgcccaggttggagtgcagtggttattcacaggcatggtcatgcacaatgactgtagtctcaaactcctaggctcgagtgatcctcccacaccttctctgttacctatgactacaggcatgtgcccccatgcctgcctgcctgcctggctctatttccttaagtttttttttttttttttttttttgagaaggagtcttgctgtgtcacccaggctggagttcagtgctgcaatctcagctactgcagcttccacctcctgggttcaagcgattctcgtgcctcagcctctcaagtagctgggattacacgtgtgcaccaccatgcctggataatttttgtattttttgtagagacggcattttgccacgttggccaggctggtctcgaactcctgacctcaagtggtccacctgcctcggcctcccaaagtgctgagattataggcatgagccaccgcacctggccctatttccttaagttatatgagtcattctagcccataactgaaccagaggaggcggtcttggaaacctccagcttacagtcgctcagtcagaaatatgtgaggatggatttacatttggcttctgaaatgggggcagttttgtgggactgagcctttaatttgtggaatctgatgttaattccaggtagatagtgtcagaattgaattgaattctaggacactcagtgttggtcagagtggggaaaattcgcacacaaggtatcagaagtgctctgtgtgagtgtagacaaactgttttcacaatgtgtgacccagggatgcttctgaaacttcatcacccatggatgtctttcatttatagagcttccttggcacagaatttaggtatcagatgctgactggtgattgacttgtgactctgagcaatggccatgttgaattcataccctgaaatccgcgatactgaagcctacaattcatcctttcaatttcccatagtaaaaactcaggagaaaaacagcctgattctaaatggggcagctccgctgggagttggtagataggacacccaaactgcagagaaaacctggaataaagtgaagctcattttaagaactcttgagtccaaaaccttaaaaacacatgcacttttcagcccagcaattccacttctaggacttttccagggtgataaaccagggactcagatattcccccagggttgtttccaatcactcaaattggaaaaaaactcagtgtccacagaaggggagaagggggggtgcagaacagaggcaatggggttgtggttaagtaaatggagatgtagccctgggactgggtcccctaggacgagggaaacatgagcaggaaatggataaatagaaagataatcgagttttaagcccccagagagaaggctggttacgaaatagtatatacgatgtgattttttttttttttttttttgagaaagagtctctctctctcacccaggctggagtacagtggtgtgatctcagctcactgcaac

SEQ ID NO: 4004 - DNA, 427 bp, Homo sapiens
gttttagggagggagagcggcctgggtcctgggtgttgtgtgcggagctgtggcgtcgcgtgtgaggcgcgtgcagggtgagtgtgagtggacgcgtgagtgtgtgagtgtgcgcgcttggagcgtgttaggcgagtgcgtgcgcccacccctgcgcccctcctcccgcttacactttgatcttatttgatcggatcgtgaccccagccccgccgggccgacccgaaatgaaaagctctcctcctgcgaagccccctcggggcgctgtgcagcgaggccccttaggcggcggccacgctgtggtccccgaggtcccggagctggccctgcggggcccggcgctcagaagtgatgaattgatcagatagacgaggccgggcttgtccccggccactgattatcgaggcgattctgatctgggcacggc

SEQ ID NO: 4005 - DNA, 217 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggt

SEQ ID NO: 4006 - DNA, 978 bp, Homo sapiens
aaaggagatgaaatagagaaataaaatttctcttggactttcacactggaaaatgacaagccattctgtggatcaataatgtacttggtgctcccatgaagctgggagccgaggcagaggctcatgagtttgaggctctcaacgagctccccagcactgcgagaggccagctgcatggagttgctggggccggcacagcggcgtgtggtacccgatgtattggtggggttgccacccgagccgctggagggactgcccccaccagcattgttctcactggggctggccttgtccacccctccactggcattgcttggcttgctctggcccccgccatccccctcactgccagggggcccctcgctgctatcccgtcggtgccaggagtaggtgaacccgctatctttatcgagccgccgccggctttcagaatcatcatcactggtctccgaactactgcagctggagccccggccctgacttttcctccggtggtagcgtttgtgaactgtacctggagaagctatattcatctttaacctgctcaacttgggaggcagattctcatccatgtcaaactcatcgtcagattccccttcctcaaagatctggttgaggacgggcgcactcttcctggatgtcaggcggttggttacagatggcttccggcgcaaaaccacttgtgttgagagggacatgggtttcttgtcctcctcatcttcctcttcatcttcttccaccctgaacagacacttccgcccactggctgtgggttttaagcttgcgggtggcaccgtagagagtgctggtccagccaactcagggaggtcatctttcttagctgagtcacacaggcctttgctcctgtggccattgaggacactgtcagcagcccgagcaggagactgagggacagtcgcgtgggacaaaggagtggccgtgaggtcatcctcaaggtcctggggtacatcaattttg

SEQ ID NO: 4007 - DNA, 1070 bp, Homo sapiens
gtccccttccaccacgcagaagctttactttcgctttcactttacttttgctttcactttaacaaatcttgcagccgcacactctttgggtccgcccgtttctctaatcaagttgtaacactcgctgctgtggtccacagcttcattccttgaagcccgtgagacacgaacgcttccattgagaaaaaccttccatcagaagaagacttctcgtctcagtgggactgctgagttgaatggtacctctgttttaagttctctgaaaagtctccaaactgctttttatagtggctgaactaattttcattctcaccaacagtgtataaatgttcctttttctctagactcgccagcatatgttgttttttgactgtagagtaatagccattgtaactggtttaagatgatatagcattgtggttttgatttgcatttccctgatgattagtgatgacaagcattctttcatgttcgttggccgcttgtatgtcttcttttaagaagtgtctgtacatgtcctttgcccattttttaatgtattctgttttttgcttgttgtaagttccttacagattctggatattaggcatttgttggaatatgagcatcaggtggatgatatattaacaaaaaaattaatttttcggtaattttaagaaactgaaatgctcacacttcagatgtgagagaataatctacatactcaaagtggagcagatttatgtatttcacatgccagctgatcatctctagtaaaaatagaccccgttgtattagagacaaatacttcaaagaaaatcttttgacaataaagtacaactttctactttctgacctaaatcttcacctttcagtcctggagagtatttatcgtaatctttttttcagggtgatgcaccgaactacccagttctctcccttaggagttttcctcttttttcaaacctgagaagcaaaagtgccataacaattgtgaaacgattcagaagaagaatgtcagcttttgacaagtcaacttttatctcacttgaagggacaggaggaaatcagcagatgaaaggagaattgat

SEQ ID NO: 4008 - DNA, 5983 bp, Homo sapiens
gccgtggtaacaggcctccggtggagggcggggaccctcggaagccagctgggtggcgatcgcttgtctgccttggcaggccccttgtgcagtcttttcccggcgtgagcgtgcagggattgaaaaggaatgctttatggttcagcagagagccaccacgcaggatgcactgggacctgagaaccgtcgggcagtcccacgagctctttcatgaccagctccaaccgacaagtacacgccccttcgcactccactagctagtaagctgagctacaaggtgtgccaggcacccaggacgccgattcaccgcttcaggtgggctgtttgtgctgtgtccccagaaagcctttgctacttatccatcagtcttagctggggcaggagtcccttcttccaaaaggcttctctgagcctctctgggaccttgagttaggaattttgaccctaccgtgggtctggattattctattaattttttttaacagtgcctcattctttcgcccgggctggagtgcagtggcaaaatcacggctcattgcagcctcgacctcctgggctcaagtgatcctcccacctcaccctcctaagtagctgggaatacaggcacatgccaccaggcccagctaattttaaaatttttttgtaaagatggggttctggccatatttcccagactagtctcaaactcccaggctcaagcgatcctccagtctcgggctcccaaagtgttgggattacaggcatgagccaccaggcctggccacattgtcttttaacacatgtaagcagccaccctccttcccacacacacacaaaatactgtgaattcttcaagcaaaaggactttgtctgattcatctctggatccccagtgcctgacagagaatcaggaaattttttttttttttttttgcagtgaaggcccagctcaaatgccacctcttccatgaagacttccgtgatccacaatgatagcatctccagcaattgcttctataatgaatagcatgagtcattctgcaggatgttgatcttcctttttttactcctagactgaatttttccaccacctggatgaacatagcagaaagaacatagtgttttagagtcagacacaataggaatcaggcactttggaatcttggctctaccacctttgagctatgtatcccaaggcaagtcacttcccctctctcagctttaaaatagtaataggattgctgtagggattaaagtaaatcaacatatgtaaagtgcccacacaggacctggcatatagtagttgcattttaaattttttaaacaaaatgtaagcatactatctttccagggtgttcagaagcctgaaaaacaccttggatcttttctcagagctggatcacaaagatgtcacactgtctcctgttctgacacactgagtggttcctcatggctggagcctggggcgtgtggtcaggtgtttgttgagaaaggagtcgcttgatcaggtgtttgttgagaaaggagtcactgggaaatcccaaatattatctgattgaactcatgtggtgccaagatctgggggaatttcacagaaaacacatttctgtttctaagctgtattagttttctgaggctgccataacacattatcacaattcttgcttgagcccaagaatttgggaccagcctgggcaacatggcaaaaccttgtctctacaaaaatacaaaaattagcccagcatgtcgttttcacctatagtcccagctactgaggaggctgaggtgggaggattacctgagcctggggaggttgaggctgcagtgagtcaagatcatgccactgtactccagcttgggcaacagactgagaccccatatcaaaaacaaacgaagagtgatcatccagttactcactgctgggtctgagggaagcccaaaggcagtgggagccagagaaaatagttgagagtcagatttcacagtggaggtgacattgaaacagggtattgaagggccaataagagttcaccaagtcaggagagagggaggaaaggacattccagcagagagcaggatctattctttccacaagcctttactgaggttcacctttgcacaggctagctactgggttctggaaatgcagagctcaagtaaacaacccttctcccacttttcccaaatgccgaaaacattaggagaactaggactctcatccctaggggcattgggaagaactcaaaagcctgctgcttgcaaagtattcaagatgatgtaaagcatttaacacactgtctgggagatagtacatttttaataaatactagctgtcattattttcatatgtcctatttcattctaaaaacttttctttcttgtttttgagacagagtctctctctgtgactcaggctggagtgcagtggtgcgatctcagctcactgctacctctgcctcccaggttcaagtgattctcctgcctcagcctcccaagtagctgggactacaggcatgcaccaccacacccagctaagtttttttgtatttttagtagagacaggatttcaccatgttggtcagggtggtcttgaactcctgacctcaaatgatccacccacctcagcctcccaaagtgctgggattacaggcatgagccaccgcgcccggccctaaaaactcttttattattgggatcctatttcataatatggctgattgtttcaacataaaaatattttaaatcacagaattaaattattataatatttacatagtgctatatatcccccagagaaacatatatccaagtttagagaacatagattataaggtggccaaatgcaatgtatatgcaatgatagaaggggtccaaggtcaagtggtaagagtgaccaactcttcaggagctggtgggcaaggtcagagcaggcttcaccaaagttataaaggatgattgggagtttagtagatgaacaataggtgtttagatctgtttggctcgggaatagctagtgttttaacagctaattagtaccatgttgggtatttaaatcaaacattcagtttccagggccaaaaagctaagcctaccccaatccatttgcctccacttcctcctcccacctcatgggcctgatgcattgggtaaacaagagcaagatagggcagatgggtctttcagtgtctcaaactgtattgagttaaatctatccccttcctttcaacagagccctctttcttccattcacttacctgtctagtcaaacacccatcagacctttgccaggtgtccagcctgggcactacgtttcagaaaatgatgcacatagaatccctaactgaaaggagatcgcagctcatttggtacaaagtggtaagtacaataatcgagatgatgtataaagtacagtggaagcactaagagaaaggtgctaactgtcacgtgttgtccaggaaggcttcctaggagaggagagtattctatgcaggaggaacagcatgagcaaaggcacaggggtagaggaagtgacagcagcagagtctaacatggctgaaacaaaggctgcatgggagagcaacaggcaaaaagattggaagaggaagctagggccgggtgagaagaacctgactaccaggccgaagaacatgagtttcatcgtgggcaacagaaagcacttagaaagatggctcaggcagccttgggggaggggtagctttgaaggggcaggactagaagagtgagacgcttgcagaaagcaggtgagaattgtaaaagaaaaaggccattccccaaagaaactgcacatacccaagaaccctgaaaggcaggtgcctagacagcattttcccttctcctttcccaactcggcaaggtcattttctcaaaaaaggcttcccaggtctgaacgaactgctacttcctctgggctcctacagcagctgtctgacctctcttcagtatgtgtaactgtgtgcctagtcatatattgagcagtctacatttgtccctcccactctgctgtgaacctctgcttttgatttctctgagtccccagcatcccaacacagaagacaggctccatagcgtcattgagcaaatggctgaatgaatgaagtcaatgaatgaatggacaaatacttgagtaagtgaatgtttggatcacatgggggcctccattcctcccgactagacacagcccccagagaggggaaatgagcttgctaaggtcacacaaagtttgtagcaaagctaagacaaagagttgggccttttgtccccaagaccaatgctctttcctcagttccagtggttttcccactgccactgactgtaaaggtgccagtgtgaacacaggagcttgtgaatgtgcaggccagtgagggtaacacgtatgggaaataagcacatctaacccagggagctgatataccgagagttgtccagagaaaactttccttgggaactgatgtttgcagtgaggtctgaaagatgagtaggagttaactggacaaaggaggctagtgagggcaggggaagctgttggataaaggaacaggaggaacagcccatgaaggactatatggagcattgcagcaactcaaagagaaggccagctggtgccaaggaggaagaggagaacactttcgaaagaaattggtatttcaaaaccaaaaccaaaccaaagaccaccttcagtttctttaacagtttagtgttgttcttactggtaattttatttacttatttatttatttatttttgagacagggtcttgctctgtcacccagtcttgagtacagtggtgtgatcatgattcactgcagcctcaacctcctcccaggctcagtcgatcctcccaaatagctgagactacagcgcattgccacacctggctaatttttgtattgtttgtagagatggcttttgctatgttacccaggttggtctcgaactcctgggctcaagtgatctgtctgccttggccttcccaaatgctgagattacaggtgtgcatcactgcacctggcccttatttgtaattttatatagtagaagcagcactatcctttggtgcttagagcttctgaagtcctaatccagccctgacggcatagaatgaggctggagatgctggcagggccaggtcctgccaggcattgtaggccacagtggagtttggatttctttgaggctcatggacaactattaaggggtttaagcaggggagttacatgctctcatttatgcttcagaaatgtcactctggctgctgtgttgagtagattcgggggtgggcaaagcagtgaaaatggtgatgataaattgtgacatttcttcattgagtttgaggacagttaggacaaaaatgtgctgagttcctggtaataaaggcactcaagggacgtctgatttccctgttaggctgattctttgactggtgagccactccccaggcaggcatagcatcacagagtttctgagaaggtacaccctggatgcaaagcagtgttgctgaaagactccatgccaggggtaagcatctggagaccagtctgaacctttagcttattcattgcatgattttagacaaatcaattcccctctatgagtctgcaggtttccctaggacctagagggaactaacatttgctaagtgttttacatacattattactctggtcaatccccacaggatcctgtgaagtaggtattatttatttgttttattttattttttgagacagagtctcactctttcacccaggctggagtgcagtggcacgatctcggctcactgcaacctccacctcccaagttcaagcaattctccttcccaagaagctgggactacaggtgttagccaccatgctcaggtaatttttgtagagatggggttttaccatgttggccaggctggtctcaaactcctcacctcaggtgctccacccacctcagcctcccaaagttctgagattacaggtataagccaccgagcctggct

SEQ ID NO: 4009 - DNA, 3066 bp, Homo sapiens
gactccctcggcgaagaggcccccgcggccggccgagctccgtggactccgcaggagcggccccgcccctcacactacgccgggcggttccctccgagccccgccgggacagcgtcgacgctgcacacaccccagagaagccagaggacggcgcctgcaccggacacagcgcaacaccggcacagcacagcgtccacaccacaagtgagcctaggcagctgtgtctacactgcagacgccggcctgagcgcacgcgtcttcatgcaggctcagcagagggggaagaacacctccccgagggtggaagagctgtggccagcagacagatggacggacagacggacacaggcgaacaggcagcgcaggggtgagccgagccggtcaaatgggccaggacccggctccgtgtgcccttcacagtcaggatgacagaaccccgtggaatatgaaaaatgccgggagacagaccccggaggcacagcccctcaccgggcagggaggccgccagagggaagcgcagctccaggtgcgcgcccccccacgcccaccccatcccccgctgggcagggagggaccccacctgcgccctcaggcggtgctcaagatggggatagggtgagctgcagaaccgatttcatctctggagtgaaatggaatgatgggtttgtgtgaaatcaggacagagctggggaggtggcggagccgggacgggaagagggcagagcagtgggctcattccccggaaccagcatctcctggcccggtttagccactgagggaagcttctctgtgtattgagcctggctgcccagagagcagccccaccctccctcctgctcctgctcctctccctcccccaacttctcgtcccctcttcctcacccctgcccccacctccagcctgactctaacgctgcactggcctttagtgtctcagaacacagagcagttgctgggcagaatcccccgtgccacgatgcgtccacgcacaacacgggaactaaaccacccgaaacgcagcaggttaaagcagcgctgggctcctggtcctcacaattctctgggtccatgggggctccctgggctggctcatgggccgccatggtcaccagcagggctggccaggccgggcagcagacggctcctggcagctggcgggtggggctggccgtcgctgcggcctgggctgtcctccgcacggcctcctgcctcagttttctgtttctgatgagccccgtatctagcggttcagagcaacgccagttcatcccctggcagcttccatggccaggactcagccacggtgtgggtggatttgccactcagggctcacagcctggagtccaggtgccagcagggcaggtgccgttctgcaggctctggggaagaacccgcctgcaggctcgcgggggggcctggcagctctgggggcctgcagcggcagggctgaggtcccggcctccttgcaggttgtcagccgggtcccctctcggctcctgaaggctgccggcatcttcctctcaagggcccttcccatcttccaaccggaaacagcatggccagttctcctggctctgaggggctagtgagcaggcgaggccaccccgatgaccccccttttgagtttaactgaggacggcgcacgtcctcacgttccagggctcctgtggagaaattccgcacaccaccctcaccttcctgtaggtcaggccggttccttctgcggtgggcgtgggagagccacagcccagtggagaggcgttgcaaggccccacaccccttccaccatgttctaccaaccacggcaaatcaaaggccaccgagacccagggcctagggacacagacccatcccgggaggggaggtgccgcccagtcacagtcccaccagtgcatggacacagggagaattgcccgggccccgggtttggtgaatccggcagcccgccctctgccccagcgagtcccttcccctctcataaaaccgcattctcccctccctagaccaccagagccccatctgattaaggcatcgagatcaaagctcagcagagggcggctcatgatgggcagctcaaaaaaataaacccaccaatcagagtccgtgttcctgtgaccggtggcgggttcggatgcagaggaggcttctcagtgcggttcctcctcatctcggaacctgccaccccactcaagcccgacataggccaggacagccaggacggccgcagcgagggcaacacgaggcccgtcgacatcctgaggcccccgggcctgtcgccgagtcccggcttggggagtgtccccgggccacactggtcctgctcccggctgtgtggtctcccaggcgcgtggctcctccctccggggcccaggctctggtgtgagccactttttccataggagacgcccatacttgcagctcacgcctttgtctggtgccctggcctcacacctataggaattgggtacctgggggcctcttcatctttacttgtctcagcttagagaagcccagctacacttcctccatgcctggattcatgcacggccccacagggtgaggcctggacaccctcacgggcactggggctccacggatgcagaaggcagcctggcccggtagctcgggggtctgagatggaggtggagtaagacagagtgacaaaggctgcgtcctggaggcaggctcggagcctccctgagctcagagagcccgcgtgcgccaggaagccacacctgcaggacccgagtcggaactcagaggctggtacagccgcggtgcttgtcctgtagataagaatggcctcctctggcggccaaagttaattaaactgacaatcttgataagttgcacagttacctgctcggggacaaagaagatgggagccttgtttgtggtttcttcttgttctttcctgtgccccacagtcattttaaaattaaattaaatggcttatctgcactaacccaagttgaccggctggtatttcctgggcggcgaagtgctggctgcccggcctgtgccctgcacacgctccccatcagagcacaacgtcgccgggccacg

SEQ ID NO: 4010 - DNA, 614 bp, Homo sapiens
ttcattcaacatttcctcaatgcttactatgtgcctagcactggggtacaatgatgaatgagataaactggacttggtggctcacacctgtaatcccagcactttgggaggctaaggcaggaggatcacttgaggctaggagttcaaggccagcctgggcaacatggagagaccacatctctaaaaaataatcttaataaaaataaaaaataaaaacaaagaaaaatgagacagggtcctttccagggtgatgtgccttctcttgtcaccacaattgcagcttgtttacgcatttgctaaatggttgctagggcttggatatttgtcccctccaaaacttatgttgaagttcaacccccaatgtagcaatattcagagttggggcctttaagaggtgattgggtcatgagagctctgccctcataaatggataaatccattcatggattcatgggttgatggactaatgggttgctacaggaatgggactagcagcttcataagatgaggatgagagaactgagctaacacactcagtcccctcaccttgtggtgctctgcaccacctggggactcttcagagagttcccaccagcaaaaaggccctcaccaga

SEQ ID NO: 4011 - DNA, 306 bp, Homo sapiens
agctcgaagcggttgttgactcggacgccctccttccctgcgcccccgggacgccggacaccaagctcccgcttgggcccttcttcttccgcgtcatcgtcatcacggagatcgaaatgcaaggcgccgggcccgaggggctcctggccgcgctgttcccccctcagcctccggagggcccggcgcgacataggaccgaacgaccacgacgtctggagagagggagaaggaagcgcagaaaactcggctgtcggcgcgcctgcgcactcttcgcgcggggtcgggggcgggggagctggctgcgcg

SEQ ID NO: 4012 - DNA, 3762 bp, Homo sapiens
gaaccccagctgcaagtgagactggaaaaatggctctcagagttcccgcctctgcagtagaggaagacactccagaaggagttgagaatgggtgctgagtgcctcttcaggatgtctgtcacacctcaggaaacctgccaggaataccaaagggagtgaaaaatccaaggttgggaagccctgggacattgaagttacaactggacgataaaaacagagttttttccttgtgacgtgaccactgtgatgtaaagctgtatctccttcatttcatcaagaaattcttaaaattctcccccaacgtgctttcatctttcccttcattgccaactctgtaagaagtaccacgccttttctttgaatctgattctcctccaagaagcaatgcttctctgaggctttcacctttgctcacatcaaagcccccacactgaataaataccatccttacatgcccttccagagactccactaatggacgagcttcatccagcaaaagataactggggaaacttcagcaaaaggactgttgatgaaaatttgctgtatttgattatatagctaagactaaaacagggaacatggttggaattatactaagtaaatatgatatgttctcacaaagtagaaagaatgcaactaactaatatagaagaagagggaaagtaaaatagtattgtttacaattttataggtattgggtgtgagttaaattataccacttaaaatgaacagaacagacagtaaaaagtgaagtaagaaaaaaggacagaggtatcataaaagatacaaattcagaggtattgaaatacttatgcatcaaaacaactatggcaaaattttactgattcagtattatgcctatgaaaattattcagttcagtgatttggagaagagggtaaagaaatgtttacacatcagaatctgtggaggggagaatgtgtgtctggaaagaaaatggtattttgtctcattggtttgatttgtttttagttataatatttcatctattttgaattttataaaaataacagtaatgtatgtgatttttatgctgatgaagagaaaatggattcaaaaaggttaagaaacactaatccaagggagcctccagaataattgtggccatctgaatttgaacctcctcacagaacccttaaattcaacaggagcacaagataatcacccatggtccatgccttcagcgttagtggaagatggaggataccgcaaatgttaagtgaccaataagtagagaaacaaacaccatattcccaatgaactcccatcacttatacccactgtaagctgtgtgcagagagtgggagagagaagacttaaaatccccaggaaaaagaggaaagaggcagagaaaacttagacatagcataaacaaaatcacctccagaaagtaaaagtttcactgctaagtgacacattcacagcacagttaaagggaaggggattgaaaataagcagaaccagaagtagcagcttcaaaggagcattgcttcttggggagaatcacataaactaagaaacagtagtgctccttagagacttgatagtgatgagaaagaaggagctaagagggaaaaatagaggatcttgcagaaattagagagaaataagacataatggcccactatcccattactacccatttctgcactgcactgacaggagaggatattcctgaattaagaacctgtccaaaaaattttaaaataaattttaaaaagcaacctaattccaaaaagagctactattagaagaacacatacacacacaaatgcgaatcattacagtttaactgatgagaattcttaaccaaaaccaaccaaagagcagaagaaaactgtaacccaacattccaaactgaagtagttatcttcaaacaatgggacgtatttagaaaaaaaaaaaaacccagaaacagaaatttgataactaaggccatagtgggcacaaaataggaagacatgcaatgagttgattgagctatggaatgaaattcaagaaaaatacaaaatcatttcaaaaatgaagaatagattacaaggtagtgagggatagtagatttgaacattgaacaatttcaacattgaaaaggggcagtaaaataacgaagggaataaagaaggatgtaaacagggttaaacacaagtgattggaatggaggatgggcaaataggatccaacatacatatgataggagctcctggagaagaaaaacaaagcaatggaatggaactgtaattcaagaaaactttccagaaagaagagaaaatataatgtatgtattgaagaggcccactctatatctagaaaaactgacctagagagaataactgagatatttttagtaaactatgaggctttaaaggtaaacacacacacacacacacacacacacacacacacacagataatcctcagggcctatgttattttcctgtggctgctgtaacaaatgcccacaaacttggtggcttaaaagaatagaaatgtattatttcacttttggccagaagtccaaaatcaaagtgtcagcagggctatgtcccctccaaagcctccaggggaggatccctccttgccttttccagcttccagtgcctccaggtgttattttggcttgtgagtgcatgactccaaactccacctctgtcttcacatgcacttttcctctttatccctgtctctttcctctattgtctctctcaaatcccccctgtgcctttctcttataggaatacttgtcattgaaattagggcccacctggataatccatgatgatctcatctcaagatccttaacttaatgacatctgcagagactggtttatcaaataagggactgtggctatatcgctgacctcaagaaaacctgcggacaaaatctgctaaagaagtatcagcatctatttcaaaagttagccattattttaagaagactgtgctggaagacgggtatttaacacaaacagatgcaaaagatacggggtttcaccgtgttgaccagactgattttgaacttctgggctcaatcagtccacctgcctcggcctcccaaagtgctgagattataggtgtgagcccctgcgcctggccagggatgccgttcttcactctccacactccaaccagcaatgaaggagatctgaggtctcggcatcctcattcacacctggtattgccagttctttctttttaatgttagccattctcataggtgtttgtattttcaacttacacttccttaattactgatgatgttgatcttttcatgtttaatagggtggaaacaaagttaaacagatttctctacggcagcaggactcagagcttttttgaattgtctgacgggcagattgctgggaattctttttctatggtcaagtaaagattacaaggctagaattccagcgaagctattttggcaaatactgacctacatgattgaaggggtccagaatatgccaccccaaaatatgccactttgacatacggcttattttgggctgcaagcgattgaaaatgagcagatgcaggatgaatcctctgctctctttttctacctgaaaccagggcgtaacattccctttgtggaaggtgttcctcgactcccatagcaggaagtgtagagcaactcttaccatcaaagatggacagtcagcattgagatgagtctgcataaacaaacttttttttttaaagtttgttccattaatctcccccatgtatttgctagtcacttt

SEQ ID NO: 4013 - DNA, 1793 bp, Homo sapiens
tctcaagagactctgccccaagtgcttaaagatacatactgcacagctctgtatccataacatccgaaggcagatgaaggctagggggcatgggaggctgggcatggagggtgaaagtgtcaagagagagaagacctggcgccttaccaggatggagccctcctggccatggtgccggtggaactgcaccatggcttggaaggggaaatcgcagatcacgtcactgttgaggacgaagaaagggtctgcagtctcagagagtaggtcacgggccagcgccaggggcccagctgggggaaggggacaggtcaccaccttgctggaggtctgagtccctggattcaggctcagcaggcccactccaggctgggtcttacccttttcctggccttaaaccctcccccaagggacctttctgcctctactgacctgtccccaaaggctcctcttcatgggacatggagattcggattcccagctggaaggaagaggcccccccagtcaggttctaccaggatgggaagttgggcggggaccgagaataagggccaagagtctgtgcctcaccctctgctcctgtgccttcatttccttctccagcacctgcgacatgtagctcacggccaggatcacgtggtccacgcctgcctgtcagaacgcaggccgacgggcgggctcagtcagaaggtacgggagcccctgacccctagtcgctggccatccctagtcccgccagatccgaacgcgactctgatcccgacccagggtcttaccgcggctagcgcctccacttggtgcagcaagatgggcttattgcagaagtccaccagtggcttcggggtgctcagcgtcagcggccgtagccgcgtcccatagccccccactaagatcagtgccttcatcgcgcctgcggacgttgagggggtgtcccgggctctgaggtgcctgcagcccgcctggccggtccctgccgcgcactcccaacgccgtgcccggccccgcgcccttcaccaacccgcctgacagactctggctccacctcgtccgcccggtcgccctgacgccggatccagggccgccacaacacagaacgcgacaccgggtagacggctgctggccccgaactcaggccggacccggcgcgggcagtgacgcgaccaccgcgggccaatcggctgccgcgtacgtggcacggccgccggcgtcggaacgttggagcgcagcgctgcgacagacgtagccaatgagcgcccgagtacgccgggctgccatggagacccgggccgggacccgcgggtcagctggccattggcggatccaaaggcggaactggcgccaagggcgaggccttgttccctgcttcgccgcggtccagcagccgccggccccgccccacggccccggcctcgccccgagggtgaccagggaaggctcccgggccacgggattttcacaaagacagactcgcctccgtttctagcggctttatttttgacatacacgacctcagacacaagcggggcgggcagcgctaggtgtacagaaaggagcgggctcggaccgagcaccccctcccccgcacgcaaggtccaaagcaaacgcaactgcggcgggagccaccggcgcaggcctcgggcggtggagacaggcttagcttccaggaaagagcagcagagagcgattcccagaacgcgagggcttacagttccccgagaagcaaaagaaccaggtccttcccagggttctccattattttttcctcattaaaatatattttaagtcagcacaaacat

SEQ ID NO: 4014 - DNA, 6249 bp, Homo sapiens
gaaccccagctgcaagtgagactggaaaaatggctctcagagttcccgcctctgcagtagaggaagacactccagaaggagttgagaatgggtgctgagtgcctcttcaggatgtctgtcacacctcaggaaacctgccaggaataccaaagggagtgaaaaatccaaggttgggaagccctgggacattgaagttacaactggacgataaaaacagagttttttccttgtgacgtgaccactgtgatgtaaagctgtatctccttcatttcatcaagaaattcttaaaattctcccccaacgtgctttcatctttcccttcattgccaactctgtaagaagtaccacgccttttctttgaatctgattctcctccaagaagcaatgcttctctgaggctttcacctttgctcacatcaaagcccccacactgaataaataccatccttacatgcccttccagagactccactaatggacgagcttcatccagcaaaagataactggggaaacttcagcaaaaggactgttgatgaaaatttgctgtatttgattatatagctaagactaaaacagggaacatggttggaattatactaagtaaatatgatatgttctcacaaagtagaaagaatgcaactaactaatatagaagaagagggaaagtaaaatagtattgtttacaattttataggtattgggtgtgagttaaattataccacttaaaatgaacagaacagacagtaaaaagtgaagtaagaaaaaaggacagaggtatcataaaagatacaaattcagaggtattgaaatacttatgcatcaaaacaactatggcaaaattttactgattcagtattatgcctatgaaaattattcagttcagtgatttggagaagagggtaaagaaatgtttacacatcagaatctgtggaggggagaatgtgtgtctggaaagaaaatggtattttgtctcattggtttgatttgtttttagttataatatttcatctattttgaattttataaaaataacagtaatgtatgtgatttttatgctgatgaagagaaaatggattcaaaaaggttaagaaacactaatccaagggagcctccagaataattgtggccatctgaatttgaacctcctcacagaacccttaaattcaacaggagcacaagataatcacccatggtccatgccttcagcgttagtggaagatggaggataccgcaaatgttaagtgaccaataagtagagaaacaaacaccatattcccaatgaactcccatcacttatacccactgtaagctgtgtgcagagagtgggagagagaagacttaaaatccccaggaaaaagaggaaagaggcagagaaaacttagacatagcataaacaaaatcacctccagaaagtaaaagtttcactgctaagtgacacattcacagcacagttaaagggaaggggattgaaaataagcagaaccagaagtagcagcttcaaaggagcattgcttcttggggagaatcacataaactaagaaacagtagtgctccttagagacttgatagtgatgagaaagaaggagctaagagggaaaaatagaggatcttgcagaaattagagagaaataagacataatggcccactatcccattactacccatttctgcactgcactgacaggagaggatattcctgaattaagaacctgtccaaaaaattttaaaataaattttaaaaagcaacctaattccaaaaagagctactattagaagaacacatacacacacaaatgcgaatcattacagtttaactgatgagaattcttaaccaaaaccaaccaaagagcagaagaaaactgtaacccaacattccaaactgaagtagttatcttcaaacaatgggacgtatttagaaaaaaaaaaaaacccagaaacagaaatttgataactaaggccatagtgggcacaaaataggaagacatgcaatgagttgattgagctatggaatgaaattcaagaaaaatacaaaatcatttcaaaaatgaagaatagattacaaggtagtgagggatagtagatttgaacattgaacaatttcaacattgaaaaggggcagtaaaataacgaagggaataaagaaggatgtaaacagggttaaacacaagtgattggaatggaggatgggcaaataggatccaacatacatatgataggagctcctggagaagaaaaacaaagcaatggaatggaactgtaattcaagaaaactttccagaaagaagagaaaatataatgaatacttgtcattgaaattagggcccacctggataatccatgatgatctcatctcaagatccttaacttaatgacatctgcagagactggtttatcaaataagggactgtggctatatcgctgacctcaagaaaacctgcggacaaaatctgctaaagaagtatcagcatctatttcaaaagttagccattattttaagaagactgtgctggaagacgggtatttaacacaaacagatgcaaaaggtacatttacgtgtcactgtgaagcagtgatggctccttatttaatcagacatctgctcttccaagtgcattttttctgcttgcaatagtggctcccagggaaggggtgggggtactgatgggcctgacggtgggtggaaaaacccaggccttctgtgtgccatgcagcaatgttcagcaatgtaaaaaatgaggccttttcctattaaggaaatcaacccaggtaagtcaggtttatctgaaagtctttgtgctgagagaggggttacatgtggaggatttcatggccagaaatgagaggaaagggtttctagctgacccagtaggcgggggtggggggtggtattcttgttttcttttggaagggacagggtctcactctgtcacccaggctggagtgcagtggcgccatctcgactcactgcaaccttcgcctcccaagctcaagcaatccttcgacctcagcctccagagtagctgggattacagatgcacgctaccatgcccggttaatttttgtattttttgtagatacggggtttcaccgtgttgaccagactgattttgaacttctgggctcaatcagtccacctgcctcggcctcccaaagtgctgagattataggtgtgagcccctgcgcctggccagggatgccgttcttcactctccagttggtttccctccaagctgggatttgaactctcttatctccagggttagggttgcagacggagttgtaaggacagaaagggaagaggaatacacacatttttagctgacggacttggccccagctttgcaggctaactgaaactcccaaggccttgagatttttgaaaactgccatatttcctctagttgaagactcattttatattttttcacatgttaacatttatgaaattgggatgtgtaatgtacgccctgtcaaaaaattttccagcagccatttagaggagtgacacgtccacgtggcctacctggcctgtggccacacctccttagccagcttcgtggaagtatctgttcatccattttgtcactttgttttgttattttcattggtggcacagcacactgttaacttagattcatgtccctaattgccactgaaagtgtctttcacaaagataactctgctttacagcattggagcaaaagtcaccatgcgtgcaaaagattgcctggcacatgccaggcattaggcatcgcccccactgcacagagtaaatgacacacttttcaaagcaaggggaaattggtatgactacttcatgcaccattaaaaaaaaaaactattattcaggctccaaaatctttaaaagcttctagtgattttcaaaagaagctgcttaatgtttatctttaaaataaggaaaaacagaattataagtttggccaaagaggaaatgccaataaaccactaggattctctatgatgccctcaaattacattgtcaatcttaagtgtgctgacgaggccaagctcataagcatggccggaaactggcattctccataccgctgtgagtaactgtgggtgtccaaaatcatgtggaagagtatttagtctctgataatgaaacaggccagagttaaactttggtaatgaaagcagcatataatggcatggataagtgaattctaaagtcatttaagaagacacacagtaagatgtgcctctctctctctctctctctctctctctttctctgtctcttcctttcttttcctcccgtttttctttctttttttttggcgggggacagagtttcattcttgttgctcaggctggagttcaatggcacgatcttggctcaccgcaacctctgcctactggattcaagtgattctcctgcctcagcctcccgagtagctgggattacaggcatgtgccaccacgcccggctaattttgtatttttagtagagacggggtttctccatgttggtcagcctggtcttgaactcttgacctcaggtgatccacctgcctcagcctcccaaagtgctgggattacaggcgtgagccaccgcgccaggcccctcccttctttgtttctaatctctcttccttccttcttttctttctttctcccactgaaatgctgctattaaattgatagagtatcttataattgatggtatcttggaattggggaaatagagtgtttgtcaggctgcttgacttagcagctgagggttgaagggatggagataatttcaaatcagcgagattactggatttctttttaaaaggtgctggtgagatagaatcaccataacagagtcaagcgcagataaaaaagatcagcaaaggccagattccctcaacttattttgaatggatggagaaatggtgaatcttcggtttgtgagtatgaccagtgggtcatatgggcagaaaagcaagcggcagtctcaaaagcagagggcatttagaatccaaggttcaagctggaagagatcttggtcacctccttgttgaatgccttaattgaatggatgaggaaaatgggctcatatggcagaaataatctgtagagctaggacaggatcctaggtgtccagccccctgttctatggattttcatttggagaagtcagtcatgtacctgcctcagggcctttgcacctcttttctctttgcccagatcattcttcccctaaatagccacatggctttcttcctcatctccttcaagtttttgcttaaatttcagtttgtcagtgaggtcttctctgaccatttagaccagaatatgccatcttaaaatatgagtatggaagacaagaatatgccaccccaaaatatgcttcttgggcataaggattattttgagctgattattttgagaaactgcagacacaggagttctaatctgaaaacagatccctgtgcaggggaaatctatacctatcacggaagtctctgcttgtaagagtgtctccctctcagtatcagggcaagaaggatgcgtggaagtcactggagacttttgtcaatgaagcaggtgctgacttaattctccaaaacaaaccttacccttgtctaccctgagtttcctgttgacttccccacagcactccaaccagcaatgaaggagatctgaggtctcggcatcctcattcacacctggtattgccagttctttctttttaatgttagccattctcataggtgtttgtattttcaacttacacttccttaattactgatgatgttgatcttttcatgtttaatagggtggaaacaaagttaaacagatttctctacggcagcaggactcagagcttttttgaattgtctgacgggcagattgctgggaattctttttctatggtcaagtaaagattacaaggctagaattccagcgaagctattttggcaaatactgacctacatgattgaaggggtccagaatatgccaccccaaaatatgccactttgacatacggcttattttgggctgcaagcgattgaaaatgagcagatgcaggatgaatcctctgctctctttttctacctgaaaccagggcgtaacattccctttgtggaaggtgttcctcgactcccatagcaggaagtgtagagcaactcttaccatcaaagatggacagtcagcattgagatgagtctgcataaacaaacttttttttttaaagtttgttccattaatctcccccatgtatttgctagtcacttt

SEQ ID NO: 4015 - DNA, 1333 bp, Homo sapiens
ctctatccccagcagaggcagcggagaagacaaggccgggaggcaccgggctaggctgcgcaccaggcccaggcctgtccctcgggaccgcgcgtgccgcctgaatccgctcccccgtcgggcccggtccagctggcgcggcggccaccctcacctggatgacctcgttgacctcccggatacattccaccatgtgttgtagaatctgctcggccgtgagcacctcgtagcggtaatcctcctcctgctcatgccccggcccgccaccaccaccgccgccgccgccgccgccgccaccgccgggccccagagcgctgccgccgccaccgcccgtctccccgcacagcagtccgtcccgctccccgccgacgcccagcccgggctccaccagctccacctcgcccagatccagggtatcatcgtccggctcgtcgtcgtcttcgtcctcctcctcctcggcgccgctgtcctcctcactgcactcctcgtcctcgtcgaactcgtagttgtagccctcgtccgagtccatggcgcgacgcgcgggggcccggcggacgctggccgaggcggggagagggcggggacgccgaggccccggctctcgctccggctccggctgatgtccggacgcaggcctggctccggccccgcgagccgcggctcctccccaggagcggcggttggcgtttgacggctggtggcggcggggagggcgcggaggagggagggagggagcgagggggccgcttgctgcccgcctcagtcagacgcggctccgctccggcctccgagagaaaacagtccccaacgccacctccacggccgctgctatcgctactgagccaacaaaggggcgtgcgtcaccgcgtcgcgctgcgtcgtcgcgtcactcctctttgcgtcactgcgccccgccccaccgcccctgcgtggagcccggggagaccccacggcccggccttcctgggcctgggacccgaggggagccgagcgggaattgctttcctggttcgatccgctgccgctgtgagggccgagcggaaacccgtagaccttttatgtgaagagattgcggcctcctggtcaccagtcaccgagagagggacccctggaccgcctacgtggtggtgtctgccgcaggccatagggatccagcccacttaggcagtcccttggggacgcggccttccctccggagcggaaaggcgcttcccgcccgccctgcggtaatcccggaagccctcagccgttaagctaaaatttctgttgctttggctactgatggaaacctgttgtaagtggaacctctaaactgtatgacaggtgaacccac

SEQ ID NO: 4016 - DNA, 8540 bp, Homo sapiens
gctgtgctgcctgtccaatcagaggatccattttatggttgatgcgaatacaacggtaacccgatcccttgcatggcttttctgggaaccagtgatgtttataatgttctatagaagaaaagaagaacagagaaacaacgcttaggatcgttagctcccactgcggattcctcctaccccaggctcctttgaggagcgaaaatgaaaactatcaactttttaaaatgtccaggattgcatccgttgttgtgcatgtgcggggatggaaaaagcgggcagggttttagaaataacacagtagtaccggacaaaacaatctccaggaaccaaccggttgagccgccaaaacaggaatcaggcgcgcagcctcggccagtcgggaagccactggcacctatggccaggcgagaaactgtttactttctccaccccaccccagatgcacacaatggagttgatggctttggagatgagaagcgccaccggactgttaaccccgaagggaagaaaaacaagcaaccctaaaccacgctctgggcagggctgttaattgtgccggtgacaaatccgatgattaatgggcaggggcaggaggcgcggggagacggcacgtccgttctgagctggctccggggcagcggcgcagcttcccaccccggggctgggccgccgaccacgcaacggttggagggggctgaggaaaggggacgtcgaacccaccccagccccacggctcctttgtccccaaatccgccgacggtcctcggaccgcagctcccgcctcggtgggcttaagtttctttgttgtgcgtgttgtcttctcctctccgttttgccagctggggggaagggggcgccctccgtccagcccctaaagcctcgcggggaaccgctgttagcggccacccagcgcaaccacaccggtcccgcggcggggcccaagcgcgaccggccccggggcgctgccgaggttcccgcagccccgacggccggactctgacccagggatgtggggcccgcgtccctccgacgccctcgccctgctcacctgccagcagctcctgcaggctctggctgaaggtctgcagctgtcgctcgctcgtgagccccttggtgcggagaaacttggagatgaaggacacggcggcggcgatctcgcctatcatggtggcggcccgggtgtagaagggatgcatgggggcggcgtgcgggggcggcccggggcggctggggctcggcggcgcggccccgacggcggagcagccaccccgggcttcctcaccgggcggaaggctgagaggaagagagggcgtgaggggcggacgactacttttgtctttctttctttagactaaaaaagttattttcgagacaggaggcggcaggagagaggaagagacgagcgatggcggcctggtcacatcgctcggacctccccagctgcctccgcctccagctccgcagcattcgaagatctcaatagctgcatttccagctccgagaggcgaagagatgcaagcgccgtgcagcaccctttatagtgccacgaaaaggaagtggcgtagctggagcgtgatggccgactccagccaatccgaatatcgcaccattgtgacgcaagccggttcggagccgaaaggggcgggaaaagagttcaggaggcgggtccagagatagggaagagagggaggagctgacgtaatccgcttgtaaacaaataaacccggagtggcggctggagacccagttgcttgtgtcgagggagggagggagggaacagagggtgcgcgtgtgaaagctccgcccccagccctagctcctccttcccgcttcagcaggtccaggctctgcgccagtgcatccttctccaagagtgcgctgcctgggcccgcttgccctggagttaacttcagcagtcaacggagagaagagtggaaaccttactggatgcggacaggagagccagttactgaaagcagatataacgcggatcctgtaaagagtgaattgtatatttccacatatgctggacaataggcagaaagtggagacccaaagaacttgtgatatgacggacataagaagcttcagttggcctcaaatgtcaaataatatccttcctgaataatcaagaatgtcaagcttttactttctacatcttggactgtactttgtaccaatctcaagtcccatatgatgcactttctaggtgaaaagtttttttttacagaccttaaatttttctttatttactttttagagtgatggtatatattagtttcaccacgttagtaattcatgctatataaatgataagccaaagtaagaaaaatagtgaaatgaattgcaaatctaactacattttttagtttccataatcaccacagaaattgctgttagtgcacttgatccaagaagagtcattcacaatctctcccttgcatgtttcccacctggatacagattcgtttagaggtcagcctctgacacaagatcagtcaatccaatgcctgccattatagttttggaaaggtgcctaaaaagacattaattttcctccaaatgacagaaactaaaggcaggtgaatgcggcagctattggtgtacttggatgctgaggatcaggcagagtggcttggtaatgagagagatgaatgagacagacacccagagagaaaggaaattaaggagcagtaaaagcattttacacccctccctccactctgccaaccctcagggctcatacacttttgctaactatatcacttatgtgctgttgtataccaaattacctcaaaactaagtggcttaacacaacagcatgtattatcccacaatttctgtgggctgagaatctagacagggagtagttggatcccctgtgtcagagtcttccacgagtttgcagtcaaagtcctgactgaggttgtggtttcatctgaaatttcaaatggggaaggatcctttcccaagttcactcatatggctgcagtaggattcagtttcctgcagactgttacactaatagcctcagtttctcaccacctgttggccagaggctgcactcagtttcttgtcacataagcttctcagctcacagcatggcatctgcctttgtcagagtgaaaagagaaaaagccaccaagaaggaagtcatggtctaatcttggaggagaatcttatgacttttgctgctctcttcttgttagaagccactacatccagcctctactcatgggaaggaaatgacacaaggtgtgggtatcaggaggcagaaatctttgagagctgttttaaaagcaacctaacacactgacatatttcagtccttaggcactgtaaaatagcccaaatatccctgcagtacatctgaatgcttgcctaaattctccaaaattcttttctattatttacaatcaaaacttcttacatatatcgaatagtttaattaaatccaaatttagaatcaagaggcaattgtattatgagaaaatatattactacatttctaagttcctttgtcacacatacacaaacacaactaacagagtatttaatagtgataaaggctgagatatgagaaaacaaaatactaggaattcttactactaggaaaataaatcctatgaagatgaaaattgctgaaattttcaagtagatagtgaaaatacatggtggttgtggcatttcttcctctcctccccttcttcctcctcctcctcctcctcatcctcctcctccttcttcttttaaaaccctaaatactttcatggaggtcatttatttttccatgcttttcattttctaaacatcttagttttctctcatcatcttatacagtggaaaaagtaagcaaaaaaaataggataacactatgataaatttgaatgtttctctgcttcagattacaaggtacgtttttgtggtaattataaaaattgaaaaaaaaatggtgaaaaccccttatcttgggttactgtgtcaagtaggaagttgagcagcatttcaaaaaacacctttagcaaaagtcccctccctggtttttcctgcaaacattaacctcaagcgtttagttccttccatattatttatacatttaacctcaaaattttatttaagaagtcacaagaagatctaagaaaaggcccaaatgtcagccatctgtggaccagacctgaaaatcttcctggaggagatgaaaacctctcatttcatagaactgaaaaagggccattgtatagaccagcagctgcggtgcagctcctccaggtctcaccactgaatcaggaatcctataaatatgcacctcaaccacataaacagtttctcttcagtttctggattggagtttatctttgctgtgcagaatcaatttagctttggacagaaaaatttgcaagaaatcaaaaaagcgggtttaaaaagcaaacaaagagacaggatgggcacgatttcctaaacataccagaacagagccatgtgttggatgctatataagaaagcaaagaaattcccaaaagattacctcaagttggtttctcattttggtaaagatttcttgtgtctcttggttctatcaatttaaatagagcctgaaagatacaatgacagtataaactatgtccaaaagacctccgaatcggaaagggaagtttggtgcctcccaaaaggagggtgaggggcaggagaatatggtgaatatatatcacttttcgcaggcgcctcttctggattttgaccgttataaagcagaacaaatagataaagaaagaagactcacaaatggcttttttcattaagatgatatacctttcatttctactttttctcagttgataagccccaaaataacacagagacactgaaaaaagccttcttacaaccttcttacaattttctatactgccagtttcaccagccttttaggtgttggttgggaccctactggcctctaacgctggttttttcagtagtgtatccaccaactggttctgattggcacttttcatcttcaaatatgcgatgttctgcctcactgacaatggcagatgggccagtaaatctcaatcttgacctcacattaggatcacctgggaaagtgttagaaaaacaaaatcccagtgtccaggcttctccctggaccaatcaaatctgaatctctaatggtaggattcatgcactgatattttttgaagcttcccaatgactgccatgtgtggccaaagctgaaaacccctgttagattctattttggtatattaactatgatcttaactaatgaaagttgctgaactgctggggaacttgactaagcaatggaatatcccttagaaacacaatgaacacccactaattttaggcagtaacacaaaattattggggccttaatattctctttagagaaatacattccacagaattccacaagttgtagatgacatgttctcgcttatgaaagaatatgccaccaggttcataggagaaaaaatatggtgctgcttttactaagccaccaaagagaacaacataagaaaatcatcaattcctaactatggtgaaagtgcctataatatatcacaaacatgagaagcaaccttttcaccattaagtggactctgacaaagcagttaatagaatcttgaagtctagaaggaatcctttaagatgtgtaataatactattctacacctgaggaacttagggtcagagataagtggctagtctgataatttactgctcatgaggggtgttataaaaactgcccttgtcctcattcctagtccaggggttgcatttttaatgtacacagaagcatttaatttcatgtatggccaatagtaaacgctcaataaattgtagctgttgggagaagtaatgatgatagtattaatgatcacattggtaataataatgtctacggggttttccagtgttataaacactgccttaaaatccttagcaaataaaaaactatttcttgctgggcacagtggctcatgcctgtaatacctgctactcaggaggctgaggtgggaggattgattgaggccaggagttcaaggccaccctgggcaacatagcaagaccccatctctaaaaacaaccaaccaaacaaaaacctatttcttttgttgatgacaccttatttatttgaaacacaagaaatttaaaaagcaaaataataaacaggggaaataaaaagcctttcatttagagctgcaatgaaaatttagcatagtctttcactattgaatgactcatcagttgaacactttatgtaattaattataaaatatatgtaatttgatctgattttgtctagaagattctagagtatcattttccttatgcaaatactatacatatgtttatatctaaagagttaaaggtactttcacaggttatttaattcaattctcacatacaattagaaaacggagatattatccctccttctttaaaattaaaaaaacataagctcagagaatgaaaggggacgtggctaaagtggctccactaataagtggcatggccagtagttcatcacaggttttccacctttgagactgtccttaggttacttctttggactatgtcactctggccttttgaataattaactttacagagcaagagtgtaatgctatgtccctggctttcatcaggcaaaatgtgaaacacatccatttgaaaacttgctttttgaaaacacaggacctcattatgttgttcagtgtctctcctttaaattctcaacgacaaattattctccgagttcagagtcaggaaagtatctatatcatccaccaaaaccgggagctttcttttgttagatctagagagttatatgatccattgaatgtccctccttgccttggcttctagggtgctcagagcaaagttttatacttagtcactccggttctggttcttctcaatccaagtttctattgcatcctctctctcttccccttcacctcccaaaccactaccacctttaatatattactttcgctttttgtatttatcagtgattcaattttattttactgtgattttggtaaacatccgtagtgttcaactacttggcagatttgtccccctttttgtgataatagaactctaacacttcttggttacatcacatgttttactatctgatgattatgttggtcatcaatccttcttctgcaaggaacacaatataacaacattacaatgcatctttgttttgtttttgctgatttgggtagaacatagcaaaaataaaaatgcgttcattttctgtcattttggtaataaatctgaagccatgcttaacagaatagttttaagtttaaaatgaaataattttataaatattttacccttttaaaacaaggacgtctcagttcttatggcatcaagatgctcaaattaaattcacaaggctcttcaggaccaattatatcggtgtttaaccctcccagtgtcttttttgcatcttaatatcattgatttctttaccaataatgccaaatacagaaactacccctgcttatatggcttatatgtgtactttgtgtatatgtgtatatgtgtactttgtgtatatgtgtatatatatactttgtttctctaattggtattattcagattcagtgcctcaaaattggcgataatctcacccatggtcctcttctcaaaggttcaaaatgtggcttaaagtattttatgtgtgcatgtgtggttcacagaatcagttttatatcttttagttatacctcctgttactgactgtttatgcctcctcaaaactcatatgttgtttgggcatggtagttcgcgcctgtaatgccagcatcttgggaggccaaggtgggaggattgcttgagcccaggagtttgagatctgcctgggcaacatatatctcctctctactaaaaataaaaataaaaataaaattagctgggcatattggcatgcacctttagtcccacctactcaggaggcttaggtggcaggaacacttaggcctaggagttgagtctgcagtgaaccatggttgagccactgcactccagcctgggcaacacagcaagaccctgtctaaaaaaaaatgtatatatatatacactatataatatatatattaaatatataataatgtataatacatatataaatatatattaaatatatgcgtgtgtttgtgtgtgtgtatatgtatgtatatgttaaagctttaacccccaatgtgatgatatttggagataagacctttgtgtggtaattagggttaaattaagtcatgatcataaaccttcaggatgagattagtggttttctaagaagaggaagagaaagggagagaaagaggagagagctctccatcatgctgaggacatagctagatggcagctgtctgaaagccagaaagagagctctcaccagacacagtctctaccagcaccttgaccttggacttcccagcatccagaactgtgagaaataaatttctgttgtttaagccacccagtctgtgctactttgttatggc

SEQ ID NO: 4017 - DNA, 8693 bp, Homo sapiens
cttgtctctgctgcatgacagctggggctgtgaccactgtgggtaacgcagcagctggggtgtattatggtctaacggctcctttccttatatgtctaaccctggcctggagcactggaggatgaggtccgctgactgcagcgtccatcctggtcctccccaggcactgtggcctccctcacagcatggctgccttgggtactcggacttcacgtggaaggccagggctccgagagcaaatgccccagcaagacagaagctcagccgcctttgatgacctagaagctaggcagcatccattgtactgccttctatgggttgtgagtgagtcccaaacctgccttgactcaaggaaacggaattaggctctacgtcttgactaggtagtggcgaagttctggaagcacatgagtaggagatactgtgacggtttcatctttggaaaataccatctagcacacctgaatctgctttcagggggtgtaaggggatttccatggcaaaatttgaagccacatgtggtcactgctttgtactgaggaaacaaagtgctctgggcatccagaaagggggtacgttttttcttactgggataaatctggctgcattttagctaatcctggaaaattgatcgacaaaagcaaaggaccaagaaagctgcttatatcagtgtctcctccaccctcagcctccagtagcatccctacgttttacaattttatttatgtcactttaaataaggacattgagagggaaaaggcctcatcgacataccaactacaggccaggtggaccttcggtgcacacacaccccagcgcccacagagatccaggcctcctgtgtatgaatgtgtgccatgaatttagacctatttctcgccttccgggctctctattcctcatcctccatccaagtggccatcttgtgcagtgcatcctctgcaatttgaggtgaccctcttctccagctgctgctgcagaaccccaagtgtggtccccacaccccctcacggtacacttcagcaggaaggtgcttctgcgtccccctgtcctcatcctccactgcagctgtcctgcttcatctcttcctcctggactcaggttggccttgggccctgctccaaaaggagcacattcaccacagcttcagacttcctcctgctgccgctgctcctcggaagcaaacctggtgactgctgatgtccaggcctagaccatgcctggcagagcagccatggggtggagaaacaagtcctcaagagggctgcgaggagaggcacagagacggtcagggaaactgaggtcacacaactgggaataagaaggtggggtgctggggggcttgtcaatgtggttcttccacagaggatggaaagccccttcatttctgcccaagaaagtatcttcagcattcaccgaaatctccccaagagggaagcgccgcaggaaggggaactaggaaggaaatacaagctggtgcttactccatctgggaacgatatgcatatgcaattttttaaatcactcattcaagaaataataatgaaaaatgagttataggcaatggattagtaagtgctgatcagattgactatgtaagtgaattacattcaaattacatgtgaaggagctctatcaagggcaattatgggtccttcgagaggctttaaaaagaggagggatgaaacttggttaaaatgggggctcgttaaaggcaagaggagtacagaatggttgaggtaactttctctgtgccccactgtcagccctgctctgccaagcaggcttgcaggtggggatatttgcttgctctgggttcagcaagtccttgtgctgccttgcctaacctgcttccgaggtatcgggttttaagctggtgtggcaagaatgatattggcctttgtgttctaaaggagtggcatgaagcacagtggaccttgatcttcaattgacgccacagtctccctaatccactgatctccaatcatcccactagattagccaccctatcaggcagtatttttccatgtcccatgtgctcaaggacgaagctttaaaagcaagcttggaagcttatgcgatgcagtacagtgtcgggggttggcaggggagagaaaagcaaaggacttacatttgttttagaaattgctgccaaaagataagcttgtctgtgcaactatatgacttctgacactgaggcagggaggattgtgaaaccaggatagacagaatttcagccagcaaataagtacacgttcactttagccagggggtggggtggggaggcggctgggaagggactgagtttatgaagaggcctagagtaatagtttctgaagcattacttatctagtgctaggcggcagagttcattttgtttgtatgcggtgattacttgcagtctacatgcagaaaaccagtttatctaatgaagcgcaggactacaaatagaggtttcttaatagaaccaggcgactgccatgggcctcaccctgaccgctgggtcacagagccttaccatcggggactaggctttgggaggcactgaggcaagttggagaattagaaaaggagtcagccatgagttatgtcctggctattaccgagagataatctaaaaaatgaaaataaagctgcatatcaggagttggaagcaatgttttactgaagggcagtccggagacatgcattttgtttccaggtgttcaaatgcacttcctcttgctgagggggcccgaaagcctcccgctggctgctctgggtcccaggtgcgtccagacgttgccagacacacctctgtcagtgtcccgaagggcaaattctaaagccaaggccatttgataaagcctggggaatttattgcaaggcagatggacacagcagcagcacataagagcacacgcgtggggctccagcccggccacggggagaccttttctcagcaaagggcagcactgctcgctttgctggggcagccctcccaggaagatcccagaagagatggtctgaggtgtgtgaacactgtgaatgtcatggacaaagctcagcgtgggaccccatgggacttcaggttattaagatgtaaatgttggccaaaagcttatgtgtgaattttatttttaagttgtgacttcgccagtgcacaagcaggaggagggagagtcggtattactctgcaagagctgtttctccaggtttctgggtgtgttcttgagtgaatagaaatctgacaccactgagaattcactgacaaaggctttccgtctgcaaggcagtgtgtcacgcactggccctgaccaatcccatttggagctgaagactccagaacatggcggaaggtcatttctgcagcagtgttagctgttccacagctcaaagaggaactaaaattaaagacaggaaagcaacattgtgaaaatgcctatggcagccactgagagttacaaaacagcctcaactatctcctaagaaatgatcactggggatgcatgttttcaaactctcattggatgccctgtatgcacctgttgtaaagtcgagaaatcacaccagcaccagcactgctttcctgatcacctgttgaaaatgtaatggacacgaaataccaaaaacgggattaaattccccaccaagaggacatccttttcgtgtcagcggcttcccagtagcagtttttcacaaaatcgtgtttaaaaacatttttctataggcaatattcacctagaatggaaaacgtggctagaatagcttattttatgatcttagattttctctgtgttggtgtgtctctcctcccatttctgagttctgtttggcttaaatgtgtaatgatctgaccactgagctttgtcacagaactagggtaggaggacaaaatattgagttaggagaagttttcaaccagcaatttcccaatagtacatgatttccttttttgtcttctttttcttcttcagaggagagcagggtacattctggagtgaggacatgactacaagttgtaggcaggaaatactgtttcatgacaccaaattttaaaagaaagagactttagaaaatggtcatattttggccgggcacagtggctcatgcctgtgatcccagcactttgggaggccgaggtgggaggatcacttgaggtcaggagtttgagaccagagacatggtgaaacctcgtctctattaaaaatacaaaaaattagccaggcatggtggtgcacacctgtaatcccagctacttggaaggctgaggcaggagaatcgtttgaacccgggaggcggaggttgcagtgagttgaggttgcagtgaattgagattgcgccactgcactccagcctgggtgacacagcaagactatgtctcaaatgccctgaaagcagcagatctcacctgcattggaggatgagacgccacatgaagaagaaagaagacgccacagacagcagcgcagtaccaccttccagagatgtgagtgtgaccgtctttgaccttctagcccagctgctttccctgaatgcaatgcatgagcaggccaggcaaaactagagagggaagctgcccagctaacccacagaattatgagagataaaaaatcattgtcttaagccactaagtctgttatgcagcaatatatagcattcattcaacttttgtctcatgaatactctcatttcttttataagttcttttgtggttcaaattagctcaaatcagtttctgatgcttatgaccaaatgcccctatgtgatagattttgaggggttaagaagcttgctcggatcacacagcggtaagtagcagcacttcatctttaacccacctctggcccactccctttccataggtccttgttgcctccctccctaatcccttccagtctagtttcctcactcattttagcatcttgaagatgcctgaccttttgtaacaggcacttagaagaggcaataatcaagctgtgagctggaatactgggtttctcatccaataaccaggttggcaggttggtaaccatacaagggacttttcaaactggagaattagtgtgctgagcacaaagtggtgagtattttgagagttactgaaatataattgacataacaataaaaatacaatatttaagtgcatgtatttcaagtgtacgatttgacaagtttggttatattatatacacctacgaaaccatcaccacaattaagaaaatgagcatagctatcacacacaaaagtttccttgtgccccttggtaattcctccctctctcctgcccacatctctccttttcccaggcaatccctgatctgatttctgccgctatcaattcgtttgcatttcctagaattttaaataactgaaaacatacattaagaactctttttctctggccgagtatggtggctcacgcctgtaatcccagcactttgggtggccaaggcgggcagatcacctgaggtcaggagttcgagaccaccctggccaacgtggtgaaaccctgtctctactaaacatacaaaaattagccaggcatggtaatgggcatctgtaatcccagctactcgcgaggctgaggcaggagaattgcttgaacctgggagacagaggttgcagtgggctgagatcacgccactgcactccagcatggacaacagagcgagactccgtccccaaaaaagaaaaaaaaaaagaacttttttttctccagcttctcccacttagcataattatgttgagattcagccatgttttcctgtggatcaataatttatttctttatattgccaagtggtattccatcgtatgtatataccatagtttgtttatccattcaaccactgaaagacattagggttgttttctgttttgggttaataaaacaaagcttctgtgaacatttatctacaagtctttgtgtggatataagtttccatttctcttaggtaaatatctagggtcataaaataagtatatacctaaattttgaagaaactaccaaactattttacaaaatggttgtattattttacctttttgccagccatatatgagagtgtcaattccttcacattcttgtcaaaacttgatgtgttcagtctttttaattttgaccattctaaaagcatgtaatggggccgggcacagtggctcacacctgtaatcccagcactttgggaggccgaggcgggcagatcacgaggtcaggagatcgagaccatcctggctaacatggtgaataatactaaaaatacaaaaaattagccgggcatggtggtggatgcctgtagtcccaggtactcaggcggctgaggcaggagaatggcctgaacccaggaggcagagcttgcagtgagctgagattgcgacactgcactccagcctaggtgacagagcgagactctatctaaaaaaacaaaacaaaaatgaaaaaaaaaaacacacaaaaacatgtaatggtatcccattgtggttttaactcacattactgtcagaggcattggaaccagagtgactccatcttgagcagaggctagataaaataaagctgagaccttctgggctgcattcccaggaggttaggcattcttagtcacaagatgagataggaagttggcacaagttacaggtcacaaagaccttgctgataaaactggatgcagtaaagaagctggccaaaacccaccaaaactaagatagtgatgaaagtgacctctggttgtccttactgctcattatatgctaattataatgcattagcatgctaaaagacactcccaccagtgccataacagtttaccagtgccatggcaacatcaggaagttaccctatatggcctgaaaaggggaggaaccctcagttccaggaattgcccacctctttcctagaaaactcatgaataagtcaccccttgtttagcataaaatcaagaagtaacaataagtataagcagctgagcggcccatgctgctgctctgtctatggagcagccattcctttattccttcactttctttgttttttgttttttgttttgtttttttgtttgttttgagacagagtctcactgtgacacctagtttggactgcaatggcgcgatcttggctcactgaaacctccgcttcccaggttcaaacgattctcctgcctcagccactacaggtgtgcaccaccatgcctggctaatttttgtagttttagtagaaatgaggtttcgccatattggccaggctgttcttgaactcctgaccttaagtgatctgcctgctttggcctcccaatgtgctgggattacaggcttcaaccactgagcctggcctactcctttgctatcttaataaacttggtttcagcttactttatggactcgccctaaattctttcttgtgcaaggtccaagaaccttctcttggggtctgcatcaggacccctttctgccctttctggtaacagtaccataataacaaatattatcgagcatattttcatgtaattatttgcaacttgtatatcttctttggtagagtgtctgttagaatattttgtctatctaaaaattgggtttgttttcttattattgaattttgagagtgtgttatatgttctggacacaagccctttatcagagatatggtttgcaaatattttcttctagtctgtgacttttctctcttaacaatgtcttttgaagagcaggtgttttaaattttgatgaagtcagatgtatcaatttatgattttaataaatcatgcttttagcatagtatttaagatacttaacccaaggtcacaagagttttcttttagaagttttagttttaggttttgcatttaggtatatgatccattttgagttagtttatatacattgtgcaaggtaaggactgaggtttttaatttttgcatatagattaccacttgtgccaacctcactgttgtgatgatatgatagaaatcactgtcttttctccactgacttgcttttgcatctttgtaaaaagttggtcatgccaatgaaactgacccaattttcccatagaactgatgggaaaaactgtttacagttttgttgttgttttttgtttttgtttttgtttttaatgaacattgaagtggactctccaggttttaaagcttgagaaacttacatttgtcttatctgagtttatttctcaggaaaccagctgtcaggcctcccagatagtatcagaaagctgaagatttccagatcgctgcatcctaacagcaaggtgccagaaccctgattcaactacctactgcctgttgagcaactcctacataaactcctaactttattggttacagagacagattttagacttgtctcccatatcctggctggcatcaccagcaataaagcctttcttcctggcagtacttgttgtctcagtgattggctttctgtgtggtgagcaatcagacctaagctgaatccctggcattcaccaacacataaatgtgcagttctgtttctggactctctcttctgcttcattgatctgtttttctaactttatgccaaaattgcactagtttgattactgttcctttataataagctttgaaataatgtcatattaggcctccaactttgttcttctttttgaaaactgttttggctattttaggtccttgcatttccataaaagtattagaatcagcttatcaatttctccaaaa

SEQ ID NO: 4018 - DNA, 327 bp, Homo sapiens
atgtcagacgcagccgtagacaccagctccgaaatcaccaccaaggacttacaggagaagaaggaagttgtggaagaggcagaaaatggaagagacgcccctgctaacgggaatgctaatgaggaaaatggggagcaggaggctgacaatgaggtagatgaagaagaggaagaaggtggggaggaagaggaggaggaagaaggtgatggtgaggaagaggatggagatgaagatgaggaagctgagacagctacgggcaagcgggcagctgaagatgatgaggatgacgatgtcgataccaagaagcagaagaccgacgaggatgac

SEQ ID NO: 4019 - DNA, 17865 bp, Homo sapiens
actggtgggagcttggaaggagggtagaagggagaaagaagctgattttatttctccttctgttgaagtctctggcagtggcagcagtagcagcagtggcagcagctgcggcaatagcagtagcagcggcagtaggtgactgagtttctgctcaggtggagtttcaacagcagtgggggcagggagtgctctcgcagcctctgcagcagggcgttcctgggctctggatctggcagcatcagtgtccgtgacaggcagcccttggtgggagtttaatttctcggcttcctgaaagatttccaataacggccgtggagcagcaagtatcacagcagcttcagccaccgagcaatcaccgactctttgtggatcacaccatatttccttttgttcagccagccttaggacggccctgaaagcagcagatctcacctgcattggaggatgagacgccacatgaagaagaaagaagacgccacagacagcagcgcagtaccaccttccagagatgtgagtgtgaccgtctttgaccttctagcccagctgctttccctgaatgcaatgcatgagcaggccaggcaaaactagagagggaagctgcccagctaacccacagaattatgagagataaaaaatcattgtcttaagccactaagtctgttatgcagcaatatatagcattcattcaacttttgtctcatgaatactctcatttcttttataagttcttttgtggttcaaattagctcaaatcagtttctgatgcttatgaccaaatgcccctatgtgatagattttgaggggttaagaagcttgctcggatcacacagcggtaagtagcagcacttcatctttaacccacctctggcccactccctttccataggtccttgttgcctccctccctaatcccttccagtctagtttcctcactcattttagcatcttgaagatgcctgaccttttgtaacaggcacttagaagaggcaataatcaagctgtgagctggaatactgggtttctcatccaataaccaggttggcaggttggtaaccatacaagggacttttcaaactggagaattagtgtgctgagcacaaagtggtgagtattttgagagttactgaaatataattgacataacaataaaaatacaatatttaagtgcatgtatttcaagtgtacgatttgacaagtttggttatattatatacacctacgaaaccatcaccacaattaagaaaatgagcatagctatcacacacaaaagtttccttgtgccccttggtaattcctccctctctcctgcccacatctctccttttcccaggcaatccctgatctgatttctgccgctatcaattcgtttgcatttcctagaattttaaataactgaaaacatacattaagaactctttttctctggccgagtatggtggctcacgcctgtaatcccagcactttgggtggccaaggcgggcagatcacctgaggtcaggagttcgagaccaccctggccaacgtggtgaaaccctgtctctactaaacatacaaaaattagccaggcatggtaatgggcatctgtaatcccagctactcgcgaggctgaggcaggagaattgcttgaacctgggagacagaggttgcagtgggctgagatcacgccactgcactccagcatggacaacagagcgagactccgtccccaaaaaagaaaaaaaaaaagaacttttttttctccagcttctcccacttagcataattatgttgagattcagccatgttttcctgtggatcaataatttatttctttatattgccaagtggtattccatcgtatgtatataccatagtttgtttatccattcaaccactgaaagacattagggttgttttctgttttgggttaataaaacaaagcttctgtgaacatttatctacaagtctttgtgtggatataagtttccatttctcttaggtaaatatctagggtcataaaataagtatatacctaaattttgaagaaactaccaaactattttacaaaatggttgtattattttacctttttgccagccatatatgagagtgtcaattccttcacattcttgtcaaaacttgatgtgttcagtctttttaattttgaccattctaaaagcatgtaatggggccgggcacagtggctcacacctgtaatcccagcactttgggaggccgaggcgggcagatcacgaggtcaggagatcgagaccatcctggctaacatggtgaataatactaaaaatacaaaaaattagccgggcatggtggtggatgcctgtagtcccaggtactcaggcggctgaggcaggagaatggcctgaacccaggaggcagagcttgcagtgagctgagattgcgacactgcactccagcctaggtgacagagcgagactctatctaaaaaaacaaaacaaaaatgaaaaaaaaaaacacacaaaaacatgtaatggtatcccattgtggttttaactcacattactgtcagaggcattggaaccagagtgactccatcttgagcagaggctagataaaataaagctgagaccttctgggctgcattcccaggaggttaggcattcttagtcacaagatgagataggaagttggcacaagttacaggtcacaaagaccttgctgataaaactggatgcagtaaagaagctggccaaaacccaccaaaactaagatagtgatgaaagtgacctctggttgtccttactgctcattatatgctaattataatgcattagcatgctaaaagacactcccaccagtgccataacagtttaccagtgccatggcaacatcaggaagttaccctatatggcctgaaaaggggaggaaccctcagttccaggaattgcccacctctttcctagaaaactcatgaataagtcaccccttgtttagcataaaatcaagaagtaacaataagtataagcagctgagcggcccatgctgctgctctgtctatggagcagccattcctttattccttcactttctttgttttttgttttttgttttgtttttttgtttgttttgagacagagtctcactgtgacacctagtttggactgcaatggcgcgatcttggctcactgaaacctccgcttcccaggttcaaacgattctcctgcctcagccttccgagtagctgggactacaggtgtgcaccaccatgcctggctaatttttgtagttttagtagaaatgaggtttcgccatattggccaggctgttcttgaactcctgaccttaagtgatctgcctgctttggcctcccaatgtgctgggattacaggcttcaaccactgagcctggcctactcctttgctatcttaataaacttggtttcagcttactttatggactcgccctaaattctttcttgtgcaaggtccaagaaccttctcttggggtctgcatcaggacccctttctgccctttctggtaacagtaccataataacaaatattatcgagcatattttcatgtaattatttgcaacttgtatatcttctttggtagagtgtctgttagaatattttgtctatctaaaaattgggtttgttttcttattattgaattttgagagtgtgttatatgttctggacacaagccctttatcagagatatggtttgcaaatattttcttctagtctgtgacttttctctcttaacaatgtcttttgaagagcaggtgttttaaattttgatgaagtcagatgtatcaatttatgattttaataaatcatgcttttagcatagtatttaagatacttaacccaaggtcacaagagttttcttttagaagttttagttttaggttttgcatttaggtatatgatccattttgagttagtttatatacattgtgcaaggtaaggactgaggtttttaatttttgcatatagattaccacttgtgccaacctcactgttgtgatgatatgatagaaatcactgtcttttctccactgacttgcttttgcatctttgtaaaaagttggtcatgccaatgaaactgacccaattttcccatagaactgatgggaaaaactgtttacagttttgttgttgttttttgtttttgtttttgtttttaatgaacattgaagtggactctccaggttttaaagcttgagaaacttacatttgtcttatctgagtttatttctcaggaaaccagctgtcaggcctcccagatagtatcagaaagctgaagatttccagatcgctgcatcctaacagcaaggtgccagaaccctgattcaactacctactgcctgttgagcaactcctacataaactcctaactttattggttacagagacagattttagacttgtctcccatatcctggctggcatcaccagcaataaagcctttcttcctggcagtacttgttgtctcagtgattggctttctgtgtggtgagcaatcagacctaagctgaatccctggcattcaccaacacataaatgtgcagttctgtttctggactctctcttctgcttcattgatctgtttttctaactttatgccaaaattgcactagtttgattactgttcctttataataagctttgaaataatgtcatattaggcctccaactttgttcttctttttgaaaactgttttggctattttaggtccttgcatttccataaaagtattagaatcagcttatcaatttctccaaaaaaaaaaaaaaaagcctactgagattttgattgggattgcactggatttatagaccattttggggagaactgacatcttaacaatattgagtcttcctcccatgaacaaagtatatttctttatttgtttaggtcttctttaatttttctcaacgatgttgtatggttttcagtatatagatctttcagagttttgtcagattaattcttaagtatttaatatttttgacctaattgtaaaaggtattatttctttccgtttcaattgccaatgggttattgctaatatatagaaatgcaattgattttgcctataactttgctaatagttctagtagctttttcatgtgaattccattggctagtctacatagctcactgacgctctgttcattaaaagaattttttccctctgagtttccttttaggtagcgtcttttgctatgatttcaatttcacttttttccccttcttcaatagctaatctgctactaatcctatagtgtttttttcatctcaatattgaactttccatctgtagatgatttgagtcttttctaaatcttccatgtctctatttgaccttttaaacatatagaatacagctatagtaactgttttaatgtccttttctgtttattctactgtctgtgtcagttctggtttgatttcagtttattgattattctcttcattatggctagtgtttacctccttcttttcatgatgagtaattttttatttgatgccagccactataattttatcttgttgggtcttgggttctttgcaatcttataagtgttcttcagctttgttctgcaatacagttaagatacttggcaacacttgaatacttaaagtcttgcttttaagattttttaggtggtactacagcagtgctcagtttaggcataattattccccactactaagttaagacccttctgtgtactctatttattgcttcatgaatcatggtcttaaatgtggctggtaagaataggtactatttctagctgtgtccgagtatcagacattgtttcttctaatccactcaggtggttcttttggccttgggtaattttctgtcatgcatgcacaaatcaatactcagaagaatacttaaggaggtccctctgcaaaaccctagaactctgtgtgcacaaatctctcctctctgggaacctgcttgtgagttctcactgctgtggtttttccaaccttcaactctgtctccccaactcagggaggccttggggctccaccagggttccctctccctatatcttagcctcaaaactctttcacagtagtaaattttggccactgtatggatgacattatttatgtctcatctcttaagtatcaaagtatcattatccttaattgcctggtgtccagtaccttaaaattgctatttaatatattttgcttttttttttttttcagggaggagggtaaatccaatccatcttgaatgagcatatgtattagtttttatgctcctgataaagacatagctgaggctgagcaatttacaaaagaaagaggtttaatagacttatagttccttatggctggggaggcctcacaatcatggcggaaggcaagaaggagcaggtcacatcttacgtggatggcagtaggcaaagagtttgtgcagagaaactcacattttaaaaccatcagatctcctgagacccacgagaacagcacaagaaacagcacgggaaagacgtgcccccatgattcaaccatctcccactgggtccctccaacaacatgtgggaattatgggagctacaagatgagatttcggtggggacacagagccaaaccatatcagggtagaatggtattaaagaaaaagattttcttacacttattaaggcagtaagaaagatttattcaagattattgcaataggtatcaagactgtgcaataggagacaggaaatggttgagctcaactctgaatacagcaaaaaccactggaggtttttagccagtgagcagaatgggaggagaagagtcagtggatggaaaattactaagaggagaaatcaaaggtgggaggattttccctaaactgacttagcaggactcttgttacaattggactaggcaggctgaagacaggatgcaaggacaaagcttgttgaaaagaggcctcagaggagctcatctaaaatttggtcaaggggagggtctttcttggtccctcctcttgttcaagggaaaaagagacattcttctttcctttgaacaatataagtcaatttctcatttggtggcctttttttcattaaggacaagctgagccccctgctgaaacttggtagcagggcagccagttgagaagatttctagatgtcaaggcatctttagatgatggggtgaggactgcagtggccatcccagatcatggattttctggtttgcagtttgaatgtccttggtgatggcatagacatcagtgtcacagtcatggttatttttccgagcagagtgtagaagtgtccaacttcatcttgaagggcttctttagacagtcacaataaagatctgggaagttaggttttagttctcagtgatgccaaatcaggacagtgggagaaaaattaaaaacctcagtttggagagtggtagccagatagtaaagggaactagaagaactgagaatttggtaaggactgacaagctgtgcatgatgacaggatcccgttcaatttacaagtagataacaaaacctgaaagacaagtacaggaccagaataataacccataagaaggtgctatagtttttataaaatatctttctacagtcatcccccttttttgatccaaattaaccaaagtaagattattcttgtttacaaaataagtcttgtctcattatatttgacttacttatttgcataattgcagcaagaatggcaactgaccaggtaggcttatttaagtttgcattgctggaactttttacaagtaatctcagattatgctttcaagagttcttgaagctataaagccaagtcaagcaccaccaggccttatctgcaatgcctagagattcagatgggttcttctcttcttgaggtcctaaaaacatcctgagtttctttggcctgccagaaagtcaccttcctgactcacctgtaaggctgggaactccataatccagttggaaatgcagaaatcacctgtcttctgcgtcgatcaggctgggagctgcagaccggagctgttcctattcggccatcttggaatggacccccatgtcttattctcaaataaaacattttggtcaaagccttgattatctaatcaatttttaaaattatgttctgttacaaaaaggacagattcttatcgaacccatataaaatagtatatcaccattgatacggtttggatctgtgtccccactcaaatctgatgttcaattgtaatctcccagtgttagaggtgaggcctagggggaggtgattggatcatggggacattttctcatgaatgttttagcactgtccccttggtgctgctcttgtgctggtcagtgagttatcgtgagatatggttgtttaaaagtgtgtagcagctggacatggtggctcacacctgtaatcccagcattttgggaggccaaggtgggcagatcacctgaggtcgggagttcgagactagcctgaccaacatggagaaaccccatctccactaaaaatacaaagttagctgggtgtggtggcgggcgcctgtagtcccagttactcgggaggctgaggccggagaatcgcttgaacccgggaggccgaggttgccgtgagccgagatcgtgccactgcattccagcctgggtaacaagagtgaaactccgtctcaaaaaaaaaaaaagaaagtgtgtagcaccttcccactctctctttcttccttctgctctgagtatgtgatgcgcctcactctccttttgccttccacatgaccggaagtttcctgaggtctccggagaagcagaagctgccacgcttcctgtgcagcctgcagagccgtgagccaattaaacctcttttctttataaattacccagtctcaggtatttctttatggcaaagtgtgaacagactaatacaaccatgaacataaaaatactcagtaatagtttctgaattatggaaggattaggaaaaaagataaatgttccatttttgttatagaaatgtatctactaaattgttacatattatagctaacttaagagaaaaagaaaaggggttccttatgtccagaaaatagaacattaagaacaagcaatgttccaaacaaaaagccataaaaattatactccttctttagttgattcagtcctatgtaattaattcttgttttgcttgatcatgggttagcagtttcatgaactcaactagagtttcgaaaaccctcactcagtccagcagtatgatattcaagttttttaggccatgtcagtatcagatgggggctggggaggttgatgggtagaaaattattaagagaagtaattaccaagaaaaatatcaaggggaggggaattcttgctaaactgactttaacaggattcttgctgaaggcagaccagtgtggtcagaggtcaaggttgagggactctcactaaattggcttagcaggatccctgctaaaactggactaggcaggctgaagcctgggtccagggatgagtcctgttaaaaagagggctgagaggggccttctaaagtttggtcactgagactgtctttgtcaagggcccttcctatgtagtatttatgacggtattttgtctggcattaatagagttaatattgtgtgcctttcacagcaaatcaaaaaatatcagagcatttaagagtatcaagatatcatgttgaccttggaactgatagcttgaagcaaaaaaataaaaaaattgctgcttaattcctctgataagctcttgaaataactgaactctaaccctggtaaccgtcacctacttcacaaggttgatggaaggcacaggtaagaagagaaagccataactgtttgaagatgggcagattctgaccaagactccagactgtaaggccaggaaagagagagggctttcctaagtcttgagcccaggtgtatgcctggatccccagtctgggctctggcaagagacaatcaaagatcccagcaaaaatattacactgttccaattcatggttaaaaatgttggcataggtagtggtatttatctctgggtttttaattgacaaccaggagcagcgagttaatattgaagagccctattcaggaatgaatatacacactccaggggtggtctgttggaatttgaaagactattaagaggctcctcctttgggaggccgaggcaggcagatcaggaggtcaggagatcgagaccatcctggctaacatggtgaaaacccatctctactaaaaatacaaagaattagcttggtgtggtggcacacgcctgtattcccagctactcgggagactgaggcaggagaatcgcttgaacctgggaggtggaggttgcagtgagccgagatcatatcactgcactccagcctgggcgacagagctggactcggtctcaaaaaaaaaaaaaaaaaaagaagaagcagctcctgctctagagagtcagctataagaacttcctctatcctcaatgaacaccaacagctttgctatctggcataatggattttaggagtcattttcattggtgaagtaagagttgttcaaaatattatgggctgactggaagcactgtatcagattgcatctccttgcataaacagggtattatgacctagaaagcctagtggataatgtatgcccttccaaatgctgtctctggtttgggatttgaatcaggacttgtatccacagctcatagaaaggttcctgcacctgaccctgactagacatgaagctaaatcatgctgttcgagtactgtcacatctgccttaagtgaatctgttatgtaaggcacctgtcagtgtgccagcagaacaaagcaccagtacttggttgagtttacagaactggttgtaccacgtttttgagcctgctggcttctaaatgtttattttatggccgaattccgtctgagacttgctttcattgtaacataccacctggtatgaagctgaggagacctatagccctcacctacatctattatgggcccacatacatgtgtttgtgtttcttagcttagggaggtttcagaagccccgaggctggagtaaagcatggttacggactcttgttgtagcagaaatgttgcttactgtctttctatgaccctttgtatttctgtgtattggttcttcaccactaataataaaccgcctcagttcttttcttagaaggacgttgaacactaactatacggcattgagctagggatgaattaaaggggagctccctggaactccaggaactgttttcaaaatgtgcctgtttgtgtttatatggtaacgtttggctgaatccatttcaccttctgagtaacacttaaggcaaagctgaaattcttgctgtcaacaaaacccccaagactacaatttctacccagcctctttcaaaaagcatggaaaacctcctccattccagcttatttttgcattgaggctggtatttcatttgtttgttctttcgctttctttaagcaccactgcccagcagtgtggcgtgagtactgcttgctttctgctcccagtctcacttttttttttttttttttttgagacagagttttgctttgtcacccaggctagagtgcagtggtgtgatcttggctcactgcagcctccacctcctgggttcaagtgattctcctgcctcagcctcctgagtagcagggattacaggtgtgcaccaccacacccagctaatttttgcattttttgtagagatgaggtttcaccatgttggtcaagctggcctcaaactcctgacttcaggtgatctgcctgcctcagcctcccaaagtgttgggattatgggcgtgagccacctcgcctggccccagtctctcatctttgtaccacacatataactttggttttgtaagtaagaaaatgcttactccttgctgttgactacactgtgagattccttttgagaaccccacaaataaagtcaatacaaccatcaggaatccttagactcattaaaattccagaccctgtaaaaacaatatttcctgttgaatctcaacatgaacaaagagtgatcaactgagagtcaaacgtgactgtgggatgagtgagtttggacattaaccacatgatgtgtagaggaggcacatctcttgttgacactcgcttgtccatgtgacacttctgctttcctgacacgcactcatggataccacgagtgtgtgtgtcatgggaagtgcacgccaccgagcgggcgcgggggctgaccgggctgggtcactgcagtgaaaagtcatgtggaaaaagctaccattcatttaattgttttcacttctcaccttgaactcagctttgtgaccactctgtgaaaacaaaaccaacacaggtatcctgccacagaatcgccatgtgttaaaagattccacagaggtgtgactggacagcaaacagcgtttttcagagagctccctgttagtggcaaaatgaacattcccttaggagggcagatcccttttctcaaaaggccagaggatggggatgcggaagggggttgactgtctgattgggatttatgccagtggaatgcagccaagttgtgcttataaaggccttattcttcctcaggtcagagcagtactactgggagagccaaggcgcttctctggatgcactcaactacagggatctttcttttgtacatgcttgaatatttaccattaggtttgatgtagtggaaagactcctggatttggaatcggaaactctgaacgagaagacacttattttgtcacggtacgggaggaaatgtatcttccttgcccatctcaggttcagggctgaggcccatataagaaaagacagattaagaagagaaaagtatacacatttagttaatctaagttttacttgacacgggaaccttcataaggaaatgacccagagaaacagttcagcctggcttcttttgtacaacaggtttgacgagaagtggccaggtgtgcggaaacgtgattggggaaagagtgtggtctgatgggaataaactgggggaaactgagcaaggcctgtttgttcagcttcttctttgtcttcagaaataaggatgttccctttctccgggtctagggagggcaccgctcacaggagggtcttacgatgacctgcttcaggagaaggtcagaaaatccttcttaggttttacgacctgattcagcaggcaaggtgaggggaaaggtgagagggagcttcttgcacgtgccatctctcagattccttcagcttaagatattcagtgtgtcaaggtaccacagtttggggtagcatgtcctgaaccctgtcattacttaaccattctgagcctagagctgtcttttgtaaaatgcagataatatcccacgccttacaggacagttcaatcagaggaataaataaaagtgcctatgcaggtacctggagcatagtacatgctcaataaatgtttttgctctcaatctaattttaaaattaattatatcggtgtaatccttccatagctcttatttaatttttatgtttgactccccaaggaggttgtaaatacatcctagagggaagggaccttagattatctttttatgaaaagtcaacagcagtaagtgaaagaaatcactgtacattaaatttttttgtcaaatgaatgtcactgctttctaaaagtacttaaaaaacactgatattatgcaacttcctcctagctctggagacatcctggaggttacccttatgactcaactaagaaagcccctcaggactgaggatgggacaactgggatgtaattgggaattgagggggtgatggagagatccactctccatactgttctctaggaacagcggggacacacctgctgctcttgttcatcagctcgtcagccatcaggctgcccctttgctcttgcttttaatacactagcacctgtgcaggaaaacagaagaaaagaacacacattcttcaggcctttgtgatccctcctgtgttcattcgagtgaactagagaaccagagctgggaaaacccccatggcgatgcatgcaaagacatgcacacaggtgactcctgtctgggtactagctggaacaacaaacactatgctatacgttctctgaggtccacgtggttgaacttgagtctgagaaagcatcttgtctgatgggttcacccagaagcatctcaggtcaggacagaaaaatcctgacatcaggagcatccatgctgctttgccttgaccaaccggtcaccctgagtgtgatggaaactagatttactctggctattgaggcatggtctttctcttgctctctttaatagaacttccttctttcactaacaatgaggttgagaaagtatgttgaggcttaaatatttcaacaagacggagcgccaaaagccaggagcttcccagtatttctgaagctctttccgcttttccagaatcaaccccctttttctatttactgtcatccattaaaatataatgctctgtcaacaccactgtttctgttttgaatcttccaagcctgggtttggtaaacagttttcaattcattgactgttaatcattcatttatctgcatgttcaatgacaccagcatttgctgtgttcttcctatgtgctggtcgccgggttttacagatgaacaaaatgaagctcagaggataatcacttctccagtggcagctgctaagcagcagagctgggatttgaaagaagctactcaggctttaagtcccatgtattttattcaatacacctaatttcaacatctagcaaaaatagaaaactgatgataatctacctgtaattatggatactttcattctttttttattttaattttttttgaggcagagtcttgctctgtggcccagcctggagtggagtggtatggtctcggcttactgcaacctctgcctcctgggtttgagcaattctcctgcctcagcctcctgagtactgggactacatgcatgtgctaccacacctagctaatttttgtatttttagtagagacggggttttgccactttggccaggctggtctcaaactcctgaccttaggtgatctgcctgccttggccttccaaagtgctgggattacaggagtgagccactgcacctggcctatcctttcactcttaaaggaacttttccagctattccacccaactggctgccagcgttaccttcctaaataactttgcctttatcatctctaggtcaacataccatcagttcaggaggaaaaaaataggtttgagattagagattgggaatattggttcagacgccaattcttaattgcaagatctcctatacttttaattatacttgtaggggaggaaaaacatttgttctctgctctcctgtgttcagtggttgggggccccaggaattaaattcacacaagacagactaccaagagagaataacagatacaattatgtatgctggcacaggaattcacaacgaaatgtgattcgaagaggcatttagaatttggagcttatataaaccatcttaggctggacaaaggaaaggggattttgggcttctgagatgggaggtaagttatgggaaggtgaagggagaaaatgtataataaacaagtgttgtttaataacgtttgttaggcagataagagtcgcctcaggtgctaaaagttgtctctggagtatttctcttcctggtatgggaaagggagacacccttacaaatggaaatttatgtcctgtttttagacagaataggggatggcagacagcgaattgccttcagctcaaaacaattcttacgccaaagtggcatatttgggggtggcacattctatttcccattatacccaagatgcatgaatctgaagccctacttttttgttttagtacacattacttccattgttatttagctcttttccaaggctataagctacttaaggagaagagaagtggtttctttagttttgtgtctgtggcattccctcttaaaagctactgtttatttagcacccatgatatctcatgtgctttatgtacattacccccagaacactttcagttaatataaaaatctccatttcacagatgaagacatttaccctcagagagattaattggtttactgaaatcattctgcaaatatgtcgcaggggactcaggatttgttcctagatctttgtattagtcagcgtcttcaagagaaaccgaaccaatagaatgtgtatttaggtatatagagagatttattttaaggaattggctcatgtgattatggaggctggcaagtccaacgtctgcagggtgaaccagcaggctgaagactcagagaggagccaatcctgcagtcaagtctgaagactgtctgctaccaaagtccctcttgctcgggagaaggtcagtcttttgttctatacaggcctttgtgaacccccaacatttgagacaggtctaagttaatttagaaagtttattttgctacaaaaattaatcaggcatggtggcaggtgctggtaatcccagctactcaggaggctgaaacaggagaatcacttgaacctgggaggcagaggttgcagtgagccaagatcgtgccactgcactccagcctgggcaacagagcaagactccatctcaaaaaaaaaaaaaagaagaaaagaaagaaagtttattttgccaaggttgagaacgcatgcccatgacacagcctcaggaggtcctgatgacatgtgcccaaggtggtcagagcacaccttgcttttgtacatttttaggggacatgagacatcaatcaacatatgtaaaatgactattggttcaattcggaaaggcgggacaactcggagcaggcagggggcttccaggtcacaggtaggtgtgagacaaacggttccattcttttgagtttcggattagcctttccaaaggaagcaatcagatctgcatttatctcagtgagcagagggatgactttgaatagaatgggagggaggtttgccctaagcagttcccagcttgaattttcctttagcttagtgattttgacggcccaggatattttcctttcacaccttcagctgattagatggggcccaccacatggggaagggcaatctgctttgctccaagtccctcattttaaaggttaatctcatccaaaagaccctcacagaaacgtccagattcatgttaagccacatatcggcacactggcccagccaagtggacagaaaattaaccatcagcattttctggtaggaaatttcacactcacttctttttatcacattaaggttcttctcaacgtaggttagttggtgaccttgagtcaagttcaagccatgcatgttaacctggagcaaaagccccccctccccatcttacgtgaaatgtgtaatcaccaatttcaggtctttgtttacagataaaatttctaagggattttctgtctctggaaacttaaaaggccaacctgatgtgggtgttttttcatttgttttgttttgttttgtttttgagcggagtctcgctttgttgcccaggctggagtgcagtggtgcgatctcggctcactgcaagctccgctttccaggttcacgccattctcctgcctcagcctcccgagtagatgggactacaagcacccgccaccaagcccagctaattttttttttgtatttttagtagagacagggtttcgccatgttagccaggatggtctcgatctcctgatttcatgatctgcccacctcggcctcccaaagtgctgggattacaggtgtgagtgggtgtttttaaagagtagagacattctcaaaggatcctgtctctggagccagctttagggacctcttggttagttctggaagacaatctaatacaagg

SEQ ID NO: 4020 - DNA, 1342 bp, Homo sapiens
agtttctttgcctaactctgagttgcttgagtcacatttttgcatggttcttgattgactttctggtgctctgcctggaggtctttgcttatctgtgagttgcctgagtcacatttttacatggttctggtgctctgcctgcaggtcaagaaggagccagtatctccaggaggagtgagagagtgctctgccagtgtgaagtgtgaatccttgagaggctgtggcaagggtccatgcctgaatgtgtagaacaagaacagctggaggctgtggctttctccaggaagaggtttctaaatctgcctcttagaagatatcagaaagttaaagtttctcttgctgccgccgtgtaagaaggaccttttgcctcccaccatgattctaagtcctccccagccacgtggaactagccaagtaatctaagaaaggcagaatgacagctagcctgggaaatggaataacatcacttctgtcacattccattggccaaacatatcaaacttgatacagcatgagaggggactatacaagaatgtggataccaggaaatgaggatcagtggggaccagcttggaggctgacaacaacaggagatgataatgaatagtgaaaaatgccaagcagacaataagcagaaggaacagaggaaatccacaaactggataattgtttcttgagtaactgaccatcaatctagatagtggttgcagtaatttcaaattcttctcttccttttcacttcaggctttcatttggtctcttttcgaatcagaagacccagaaaacttggatccacttctggctctcatccctctgggcagtgtgatttggattgagcagatgctccggctgccactccatcatatattggaaacagcattactttatagtaaatcatgaccacggtgtatggcaatgaagttgcatctgaagcagccggcaccctatgtgctagctggcttttagaccaggagactgtgaatctgtggtcaggatctctttagggctgctaaatatatactacccactatcactcgctggagctgcagaccctagttttagagtttcacttcttaaagaccttcatccttattaaaatggtaatatccttactgtcatcaatcactgacacattggtatgagtgagtttgagtctggtttgaagagtaggtttactggaggaggaggctcacagggaagctgggagggaacccacagctactctgcagagaaggagagagggaggtgaggtgtggaggcaaggggaagagagggtggctatactaacagtctcctggctagagaggaggattggaccattttgcattcttttttttttttt

SEQ ID NO: 4021 - DNA, 568 bp, Homo sapiens
aacaagtccagcttgatgagtaggatgctgggttcattaaccctctccacctgttcaccgctttcagctgagattggctcagtgacccgggggcgtgaggctgaggcatgcggtactgactgaagattggctctggctcgtctgagggcacggatgtccttcccaatgcctcgtgtgagttggtaagtattgccagctaaggaaagaaagttggatatgttctcacccaaaaactccctcacctccttcaatttgtcaaggcttttgatgaccaggtcgtgggcttgggcttgtgtccaccacttctttccgtagtccatggtactgctggtaatcccggtcaaagcggctgtgattcccaactccatcccaggttccaagagtacaaggctgcctccctctgtgaagggtgccagacccatgccgacgagggtcaggatgccagaggaaatgctgagagagccagacaccacattggcgatggtggtgcctttgtggaccttctgaaccccatctgcaagggcacggagccttcttatgttatcctcaagctcacttttcaaccgag

SEQ ID NO: 4022 - DNA, 1222 bp, Homo sapiens
agtgccaccagagaagccgcggacccggcccgcagataacacccgggcttgcagagcgctttcatctgcccgacgcggaaatctcctgcagcgatcttctaccttcagcgtgcatccgcagcacccagagggcacgttaaagagagattgagaaccaccagcaaaactgctgattcagtaggtttggggtggggctgaaaaatgtgcatttctaacaagttcctgagaccgactgttgctgctggcctcaggaccaattttttctataaagcgcatggaagtcagagtgcacccaagagattgttaacccttaaaaaacagaaaaaaaaaaaagaaatcaacaagttagaggcaaataagtgtgaaagaaagtggatagtctatttggggattctgaaagtccctgaggaaagttgactttggagaccagatcacgaagcacgacctcttaattgccgaccttttgttatagattaactcccttattttcttgttcccagctcagaccagatggcatctgagataaaatacgcattgaataagataaatgaccgcttgactattacatccttaatgtggaatgttaaatagacccttcccaaaaagaaacactgccttgaaccaatcaaattgctatgcgttaaccttctatggaaaatgttgacatcctgttaagcttcccagaccctgcctgtgtaaacgaccctcaaacttctccctttcgaagcactgacccccatcttttggagtctgtgtcctaccgggtcgccatcctcaaactttgcactcaaataaaccaatatttaatcatattgcccgaatctcattattaaggtttacgtaagcgtttacttagtaatgaaggttgcaaccaggatggcaaatcagagattgtgccactggagaggggcaagggagcttatgtttataggaatttatttgttacataaattgtcagattagttcattggtgaattaaacgaagaagtctttagtcattactagaagagtgcgtttgcgtctgtcagaaacaaaacaaaaaaactacatacagaatattctttcttttttgggggggggacggagtcacgctctgtcgcccaggctggagtgcagtggcacgatctcggctcactgcaagctccgcctcccaggttcacgccattctgctgcctcagcctcccaagtagctgggactacaggcgcccgccaccatgcccgg

SEQ ID NO: 4023 - DNA, 1373 bp, Homo sapiens
gttgctgctgttggtgtggaggcggtggcgggatcggaggcttagggccgctctggcccgggccaggacccatggggccgcgattctgattgaggcccatgccgggcggcggagaacggaagtcgtggaggccgccgcggccgccgcctcctccacgcctgtggaagccaccaccgccaccgccacgactccggaaccgatcccgagacatgtctgtggtcaaggggcggtcgaggcaaaagcgaagaagacgctcaggaaacgtggaggccaccttgcttctcacaaaatggcggatgacacaggcggcgcgccgcctttgtcctcgtcttatataggccagctggcacggccccgcctactccacgatcgacagctccaatagccaattgcaattactatgcttgatgacactaagttgcgaacctctgatcattcctattggcccctgggtgagaggcgggaggcatggggggactgaagtttccagttggccagtgagcgaagaaggcgttggctgtaggccactatgatttgctaggagaaatttgaatgggtatgccagggcaattttcacttgcgagcaaataaccagggctctatccgctcctgcagagaagcgttggaggtctcttttctttcttgattgtccctaggagcaatctactgatatccttgcccagaaaaacagatgttttccgattcaaaatcagaaattgagtgcctgctgtctaccctacctcgtgccaactcaatgaaagtagagaagtaaaatcttaccgatttcaaacatacgcagtcttaactgatttcattatggaacctcataggaatacagatttattgtagcagcataaacttttcaataggcttctgtgggtgcgcgctttgttcaaaaagagcccttgtgtgtatgtgtgtatatatacacgtttacaaacaccaatcacaggaggaatgtaaatattccactcaacactttacgaacagactaaggtacttttaaaaaattacaatgttaggctgggcactgtggctcacgcctgtaatcctagcactttgggacaccgagtcgggcagatcacctgaggtcaggagttctagaccagcctggccaacatggcgaaaccccgtctttactaaaaaatacaaaaatttggctgggtggggtggctgacgcctgtaatcccagcacttactttgggcgccgaggtgggtggatcacgaggtcaggaattcgataccagcctggccaatatggtgaaaccccgtctctactaaaaatacaaaaattagctgggcgtggtggtgcacgtctgtagtcccagctactcgggaggctgaggcaggagaattgcttgaacccgggaggc

SEQ ID NO: 4024 - DNA, 1033 bp, Homo sapiens
gggcggcagcggccagggccgggttgtgtgggctgaggaggcccacgagggttgacaccagctgatccaggaagggcaaagatatgacctcgctctcctcgtaacggtgcacgcgccgcctgcgccgcaggtagaagtgctcctgcagcaggcagtcgcaggcgaccgcacgcagcgccgcgaggtccagcgcaggttcaggttcgggttcgggctcgggctcgggctccgctgggggcggcggcagacccgacaggaacacggtcttggtgaagtactggtaccagcggtcggcattcagcgcgaaggtctgcgggtaaaccatgtacttcataaactgcatcttggtgaggattcgcagcttctcgtctaccgactccgcagcgtgcaccgtcgcctgccagcgctcgatccgccgcagccgtgcagctttgctgtcggctgtcatggaggccacaatcggcgggtaccgcgcgacgggggtcgccgcgacgtcttggcaggtcgtttctgtagccgtggcggcggcattagccgcggtgtgcaatgaaagcctcggaccgcgtagcaaaggcctccaacacctggccgccgccatctttgcccgcgattccggacccagaggtcaacttaagcaattgtccttgccctcttgctgtagggaccaatcggaaagcggaatctgagccagtctgggaaaggacgattctcagtgggcgtgggttatgttgcgtcattcatggtttagccaatcatataacttctccagtcgtggtttcctgcgtttgtagatggaaggaagaacttgtgtgcttagacctgacgctgggaggagatgctgccacctaggttacttgtaggaccctatacggcaacctcctttgccaggaactatttataaacatcctgcaggaaaatgcagtgaagtagaagagacagggatatcccagaaggttatgcaaaacatcaagagaagatgagagggtaaggtttatagactgagttattagaaaaatgcacaatggggtttggg

SEQ ID NO: 4025 - DNA, 1740 bp, Homo sapiens
agacaacctccagagcagggcagcaggcagctgctagagatttatttctccacttagtcgtctccgcttgcggcttcctcccatgagtgaggaccaagagaagccccctgtctctgatgaaagtgggggatgaacactgaaccaaacccacactgctcagcacatttgatgcggccagaaacagactgcaaaggctgagaaagcttttcaggggccgtctggctgtgtgggtgcgaagacctggctgtacttggaatcacctgggaagacttacaaaaatggtttccgagcctcacccgcaaggattctgacttggtaaatgaaaacttggaaagataaacctcagataaggggggactactgtattcattccttcaccatggcatgtctgtgtctgagaatctacccttaaaaacaatctggatgcaaagaagccgtaagatagagcgcagtcccttcatttcataaaagaatgaaactaactcaaatacacaatgcaatgggtgagtaaagtattgcactacccttaatgtaatattgtggggccactgaaaacatgctcacatgtttatggaaatctgagaagtgtttctatctatggcatttcatcacatttaagacactgttgattagagaacacaccaccatttcacgtacctttaaggaagaaaaaaatacccagaatggttatttaataagggacgtctaagtaaagctgggatcctaaagggctatttctttggtgggaggagaatgataaacagcctcgtcaggcagaaagagccagtgtcccagccatggacccggatgcagggagggaacaaaactgcccctgaggacgtgcacaagccagtactcatgctggtttgagtctgaatttgcacaaacatatggtctggaaacacctcaagcaaatgctgtaactgaatttaagtttaaggttatgtcaagttggcagtgcccccaggtgactggcagaaacaaatacaaccacctctagaaagaactgaatgttaacaccagctgacagtgcctgtaaaacatcagccactgtacagtgcaagatccagagacgttaaaatgtgaagtgagttttagaattaaccataagtaaaaaagcagaatcaaatgggtatgtggaggatgacatctctttgccgagtagaccgactggaaggaaaaacacagtaaaatgttcacagtgatcttctgtaggtgctaagactacagcattttctttctttaaacgagtctgcgttttccagctttttctaaagtgaccatataaaaaaaggagaaataaggagacgcaagtgagagaatgactttgggtggggtagtcaaggaggtgaccctgaaggaggtgacacctgaactgagaagggaccagcacaggagaagccacctgaagagttcattgctacatgtgtatccaggacaaggacctggggcacagggaagatgcttgatatgtatttgttaaatgaatacacgggttaaggaaggaaaaagctgctaaaacaggagcctaagtctcaaggggtcccagccagagtctggctcttcagggagccattctcactggactgagctgataaacagggcagggacgcccacctggccaacagcagggccctgtggaaagtatgcagctgcagagttagcagagaaccatggttgtgggtcttgggcctgtttccccatctgtcaaatgaggttagtgctttgccacctctgtct

SEQ ID NO: 4026 - DNA, 333 bp, Homo sapiens
ggcggagggaagctcatcagtggggccacgagctgagtgcgtcctgtcactccactcccatgtcccttgggaaggtctgagactagggccagaggcggccctaacagggctctccctgagcttcggggaggtgagttcccagagaacggggctccgcgcgaggtcagactgggcaggagatgccgtggaccccgcccttcggggaggggcccggcggatgcctcctttgccggagcttggaacagactcacggccagcgaagtgagttcaatggctgaggtgaggtaccccgcaggggacctcataacccaattcagactactctcctccgcc

SEQ ID NO: 4027 - DNA, 335 bp, Homo sapiens
agggcggagggaagctcatcagtggggccacgagctgagtgcgtcctgtcactccactcccatgtcccttgggaaggtctgagactagggccagaggcggccctaacagggctctccctgagcttcggggaggtgagttcccagagaacggggctccgcgcgaggtcagactgggcaggagatgccgtggaccccgcccttcggggaggggcccggcggatgcctcctttgccggagcttggaacagactcacggccagcgaagtgagttcaatggctgaggtgaggtaccccgcaggggacctcataacccaattcagactactctcctccgcc

SEQ ID NO: 4028 - DNA, 7270 bp, Homo sapiens
acttctctcctgggggccaaactgggaaggaaaggctaagccacggggcttcctgcttcgtgcttgtgggtttctggggtcctactaaccactcctctaatcgaatgtcctgaagcccagcgactcgacggagaggccaaaggtgcgagaccactagccaaacaggcttctagtcctcacctcccggcaattcgctgtgtgaaggtgggcgagtcatgtcccatctctcgagtccccatcttagagccggtccccagcagacctttaagcttccttcctactctgccatatggctctgagctccggtgcaaaggcggctgggcagtgggtcgcgcggaccttgcccagagtggtctgtctgggccgcgcactgctggcttagctgccttttcactctcgggactcaacagtggacattgcacctggggaagaaatggccgcgcggaagttatttaaggactcttcctggaaggagtcacctgagcggacctgaattccatctgaggacggaggacagattccgggccctgaccctggccctgctcttcgcgcagatccaggactggctatcagtcgctctgaggatgcgacctacttgtcgccagcttccacttggttccgcgccaggacaggttttactttcatttctcccgcgcgcgcctccgactgctggggaggtcaaggacagctaggcgtcggcccacggccagggaaggtcccgtggtctggactcgttccttccagtctccaccagtcctggggggtggggcgcggcgggggtgttcgttctccagagaactctgcgactgtacctcgctgccacctcgctgcctcctcgctgccctttacaaaagctcgtgattccgtgggggaaacttgagctgtggctctgccaggaggatcgcgaagcaagtgcccttggttcaaactcctctttgagctgcaggcagcttcaaaaaggaaagcaagcccaggagtgtagggagactcagaggctaggctctgccagcctcgggtgcctatgccagcaacctcttggctgtgacaagaattcccacctgagagtcttggcatgcactttatcagcctggtgcactttgccgctctggcacttagagatctgtcacttgagaaccaagtcaattctttaagtaaaatcttggattggcagctcaaagtattttcctagaaagcccctatcttggagtgagtgagtgtgtgcgcgagcgcgcaccccgcttgcatgggtgagtagcaggggctagagtgctccccaaagcttcgtgggtttaagtcgaaaaaagataaggagtttgttaaatctgggcatctatgttttttctcgtgaaatctcgagtttgtttaattaatcatcgttaacgacaaaaaaaaatcactagaatgcatttctggttcagtggttctatggagaaggaaatgctgcagtgggagttctgatcctggcaatttattaacataagttgcatccattcaagtggcagtgattgtagattcacgttgagcaaggacagtacaaggaaggaaggaagtgaaggaagaaacatctttaaatttctggcaagaaaagagaaaagaaaaagaaaaaaaaatccttgttaatgaagatctactttttttgtgtgctccagaatttcaaaaggtcagattacaaataaacctccaaaccactgtaataaatgtgtacatcctgacattagggagacacacatacacatatgctaaagggtttttgcgtaatggtgtttcaacttcttcacattccaattgaatgatttttaggccctatatccaagcctgattcttagtaaagtttggagtttaaaaaaatatgtggtagtggtttctcagctagcactgtggacacagttcttaaagccagagtggccatactcaggtctttcagagaagcattgaaaaataataaatatcaatgatattaataagaataactaaaatgtgagtagctaagtgcattgcataattatctcagatgcctcctttatcaaacaggaaattttatgatgcatttattattaatatagttcaaaatgtcttttaagctgaggacttgtttacaaagttcacttgaaaacaaagttcaagatgcatcctgaagtcataacacaaagtgatttagagaaagaacacaatcagccttgtggatttgatcacttacaaggagaagtaaagcaggatacaaagcccagggcacttttttgggatctctgacttctctaaggacctaataaaaatatagatcctttccagaaaaatgaacatgtacataaaccgattaaagtataaaataggcatacagttccgggaggttgaccaagtttaaaaccctgacacagaataaaaaacactgtttccatattttaaatttctgtctggtttatagtggtaagggcaaggaggacagttaacctccctctttagggcataatattttccagagcatcagcataaagaaaagtaatgcgtttgctgcctcatttttgtgctcctgtacaaaacaggcagagagtaacagtcagttcttgtacatggtaaagccagaaggcaaacctccctgaagcttaaataaggtaaattactgcagaacaaatgaaagagaagagatggtccagtacagtggctcgtgcctgtaatcctagcactttgggaggctgaggcaagtggatctcttgagctcaggagttcaagaccagcctggcaacatggcaaaaatccatccctacaaagaaaaaaaaaaaaaaagagagagagagaagagaaagtagtaaacctaaagaagcttgttacaataatacctgtaacaggacaaaatgaaattacttcaagagaaatttgctacagagggcacaataaatggcattaatgaatggatgataaaagagatgattaggccatttgaatcatccatagccaaagagaatggtgttaatgaaagcaaccatcatgctacttgtctccagatagggatcctgtgatatcagattagaagcacctggaaagaagcaattattttatatatgtatatatatttatatatatttttttctttttatagagatgtggtttcatcatgttgcccacgctggtcttgaactcctgatctcaagagatccactcgccttggcctaccaaagtgctaggattacaggtatgagccactgtgctcagccaagaagcaattctgatttataagcctgaatgaattgatagttttttcattctttcaacaaatatttactgattatatattatatacccagcactgtgctaagttctcaacatacagtaatcaccaatgcagtcatcaacaaacttaccctcaacgagcttacagcctagtgacgtagccagatataaacaaatccttatcagaattatgtatttacatgattataaactgtgttaagtattctgaagaaaaagcaagactagggggatctaatattcgaaatggaggaaacagcatgtgcaaacactcagagatgggaaagaacttggtacattagaaaaaatgaaaggagtcctgtttgataggaatgcatagaatgatagagaaaagaggcctgaaatgagattaaagaggtcatcagggtcagagtaaataggaccctttccgacatgaagattttgcactttatttatggtgacatggaaaactattgacaggtttgaagacaggagagacatgatctgatatacatttatttaaacaatcgttttggctatggaatgtggtagatagattagaaaggtgcaagaaaggaagcagcacggtggtggtactctggagagactgcagagagtctagtccccccataacatttattataccccctccccacatacacatactcattccatcctaaagttcaccagcttcactgacatacactctgttcagtagcacacggcctgctctcagaagagcccacacttggtggaatgctctgctgaagctgttttgaaattctccaacatttctgaacaggcagtcctacattttcattttgcactggactccacatattatgtagccagtcctgctcatcaaacatgtgatctaagtaaaagtagcttgtaaactcttacagtacctatatatactgtagctgctaatgtcaggggtacttcaaatgaatgttaagattcaaccattcatctcatcacacatggaccgcaactgcaggacacttcctttttttttttttttttttttgagatggactcttgctctgttgcccaggctggagtgcagtggtgccatctcgacccactgcaagctctgcctcctgggttcacgccattcttttgcctcagcctcctgagtagctgggactacaggtgcccgccaccactcctggctaattttttgtatttttagtagagacagggtttcaccgtgttagccaggatgatctcgatctgctgacctcatgatccgcccaacttggcctcccaaagtgctgcgattacaggcgtgagccaccacacctggccaggacactttctacgtcatctatgaagccttttctttgcaccccaaacacacactcaaggtagaaatggtgtgtttgctatacaaatttaattttgagacaggttcaataacctgcttactgtccttaacttttacctatatagaaagtttgaaaccatcggtgaagctgggaaaacagttaagaacctattgcaataataaaggtagaaggtgataacggctcaaactagtggggtggcagtgagggtggagagaagcggacatatttgggaagtaggaacaataggactgagtgatgaatgtggggctgagaggcagctgtcaagggtaagattcattaaatttcttgcttagggaactaaatggttgaaaatatagcaatggatcagggaattttccaccacagctgcatagtctcctttgttatgctttggtagagacgatctgaagaggcctcagccctgcctggtgatgtttgctcaagtctgactctcatactgcctccttgaactactgtggctaaccacagcaagcacttgaaatgactgtacagatcaaaccacttactccgcaatagcccactaggggcaatgggctgataagccttgctcactgataattagctctattttgtcttttttaaaattttttattttaattttttgaacgggagtttcactcttgttgcccaggctggagtgcaatggcgcgatcttggctcactgcaacctctgcctcctgggttcaagcaattctcttgcctcagcctcccaagtagctgggattacaggcacctgccaccatgcccagctaatttttgtgtttttagtagagacagggtttcaccatgttggtcaggctggtcttgaactcctgaccttaggtgatccacctgcctcggcctcccaaagtgctgggattacaggtgtgagccaccgcattccatctatttcgtcttctaaagcaaaaaagaaaggtatctgccacatacacatcatgatagtgttacatacccttcttcccttcctgctcccatcagccttcaggaaaacaaatctgggcttgctttactctctctctctttggtgaaaggtgatggtggttattgtaggggatggtctggctttcagccaacctcagtaatcaggctgccttgtcagggcttatcagtttcaacaggctggcagctgttggctgagaagcaaagcacagctttagtgtatacaaaatatgttcacatgtatatacaaacacacagtgcctttctacatgtacctaggatatgttaaaatctctgtgtgacaaaatgggcatttgcaaatggactggaagtctacttatgacagtaacagatgaaatatgcctaaaagcagaatagcatttgattctaggcttaaaaacaataaactttgattttaaaaaattaaaataatttaaatgagtacttgcaaatgaaataaaagccaagacatttaaaaggtaaaacaagaccccttaccactacaaaattaactcaaaatgggtcaaagtactaaagagctaaaactatgaaggaaaccagtaaatcttcatctcacctttaatatggcaataattttttagatataacactaaaagcatagaaacaaactaaaaaagtggactttatcaaaattaaaaacttttttgagccaaaggacattatcaagaaaatgaagtctgggtgtggaagctcatgcctctaatcctagtaccttgggagggctaggtgggaggattgcctgaggacaggaggttaagaccagcctgggcaacatcatgatacaacatctctacataaaaataaaatgaaaaataaaataaaaataggaaatatttgggggggggaatagggcataacaattttaaaaagaaaatgaaaagacaacgtacagaatgggaaaatatctgcaaatcatatatctgacaaggactagtatccagaatatataaagaactcttacaactcaacctcaaaaagacaaagaatcaattaaaaaatgggcaaaggacttgaatagacatttctccaaagaagatttagcaatggccaataaacacatgaaaagatcctcaacatcattagtctttagggaaaggcaaaacaggaccacaatgagatatcacttcacactaagatagctataacaaaacataaacaacaggaaaacaagagttgacaaagatgcagagaaatcagaaccctagtgcattgctggtgaaaatgtaaaatgatgcagccactgtggaaaacagtagtaacagaactacttaatccagtaattccaatcccaagaatatatccccaaaattgaaaacaggtactcaaatacatgtacatgcatgtttgaagcagcactattcacaatgccaaaaggtggaaacaacccatatgtccatatgggttgttccagataaacaaaatatggtatatacatatgatatggtttggctgtgtcctcacccaaatttcatcttgaattgtaccccataattcccacctgtcatgggagggatccggtggaaggtaattgaatcatgggggcgggtctttctcctgctgttgtggtgatagtgaataagttttatgagatttgatggtataaaggagagttctgcataagctctcttgtctgccgctttgctctccttgccttccgccatgtggaactgtgagtcaattaaacctcttctctttataaattacctagtctc

SEQ ID NO: 4029 - DNA, 2200 bp, Homo sapiens
ggcagaaaaggggctgagttgggaggcaagggaggtaggaggaaagggatgaaaagaattaggcatgagataggaaggtaaaacttgggagagatattatagaattagaagggttggaatggagctcattcatcatggctgatgaagtaaactgatgaggtggagagagacagagtcaaggcaaggccaaacgaaaagatcttccatcccactcttcagtttcttgcgaagtttttcttgattccgccaatccacacagtttcctttataaaatggaaaagcatgaactaaaaaacccagaaatagctatctggcttagatttacaggataaaatctccatgtctgtaaaaactttaaggcagaaatttgggatttatggtacaaaccctttaagggactgtgagtcagtaatacccacagcactcaacattgtgagtttccacacatccctggacttgagtgagtctttccaagtgtttgttaatggtacaaatgatgacaaaattagtggttcaaaaatattaaagtgcacatgctttttgctttctctatgtatacagagattacatatatgtatactttctagcgtctagcaagtatggtatggctagggataattatgtttttctgattattttgtttcccatcaaacaccccacgaattttacagcagaccgccttcttgtcaccatttgaaagaatgtggtcagaaaagtaatgcaaaaactgccactttggttttgtctgtaccttccaggtcatatctccgtacctcacttcctgacacaaacaagttttcactgttgtcagcaacaaagccctaatatagctgcggaagagaaaaactgcattgcattttgcctcctgcaagcatcatcaacagttactggaggaacgtaattccagaaagcttgaaagccgtggtgatggtaattatgtatcaaatgcctggttctatttctgttattattgttttgtcatttctgttttcccagcgatctgactgaactcgcagagggacaaatccagtttttctttttgacttttgtcaaactaaatcaggcctgatagaaaactcattgctctccggggaaacaaagtaggagccacgaaatgtcattttaacagagcgtgggtttggtgactgtaggaaaggatttgaggacgctccttctgttcggcttcctatgtcatgagcacaggctccacgcacgcacagacaccacggctcccggatgctgtggctccccgatcggggctcctgcagcgccagaagcccctccgggatgcttcgaggggctcccggtgggtggaggtacggacgccgctgcggccgccgccgccagtcctgctgctgttgttgctgctgcagtcacgtgggagcccctttaagtttccatagagaggcctctctggtgtcacatgatggacatgatataatgaaacaacattgtggagaggaaagcattaggggagcccacggctacaaaaacaagtgagtgagaagaggtgggaggaagagaaactacgccacctcccctgcagccgagtgcacgcagcagcctggcgtgacaagtgggcgacgccggggggcagggagccggggtccttggccctggccggggaccccaccgcccaccgcgcggaggacaacttttagccggcagcccagaccagcgcggcacctgtctccggagtctccaccgctcctcccgattcatcccagggaaattctcaagaatacgctctacaaatctacgtgcgcatcattttcacctcgcgtcgcgcccgggaggaaggaacgaggcaaggagctaaagcagcgtgcgttcagccctggggcattttattaatgcttttacgagttagaagagttgggataatttgccatctggagtttctctgccttgctgatctgagctcagacctgccaatttaccagagataattgataacaccctgtaacagctgagtaagtagattcttctgttttactgcttttaaaaaaagtttaaagttttaaaatagtataaactttaattgggttctttaaattttgttgttgaataatgcaattattatgatattttgtgaatatttgtaaataatgggattctggaataaattaatccccgatgatagaaaagagttaatgaacactttctccatacataacactttagcattcaagaaacatag

SEQ ID NO: 4030 - DNA, 929 bp, Homo sapiens
cgcgttgccgacctccagcagcagtcggcttctctacgcagaacccgggagtaggagactcagaatcgaatctcttctccctccccttcttgggcagcaaggcgaaccccatccctactcactggagctcagctttgatttttaacctcccttccccacccttccagaacacacacattccattccaaaactgattttataaagacattttaaacataatgatgcaacttggtgtgcactacagcaaatgtacaggtgttttttttttaattgtttccaaaaccgggacctggatttaagatgtaatttttaaaatttctatttctattttttctgcagcagttgggttagaggaggaggagccttttagcctctcataaactgacctctctacttcctcgtgtatttttaagattgattgatgatgtggaaagggctttgcttgtctgctactgaaaactttatccttgcggtttttgtggaaactgcttttggaaagagaaaagaaatgaactttactgacttgacatttttgcacctcccgtttttctaatctgggctatttttatttttgtttttttacagtgagatttttttgatcttcagctacagtaagttattccaatttttttttaacatttttcctgactttccgctgatttcctttttattgttgttactagttactattacttattattattatattaatacttatgatggtgatgatgatgatgataatgacactgatgatttttaaccggattaaaatcgagtttttctgaatgtttctaagaatttctccggcctcctgattgactttggagttttgcatcttgggagagaaagcgaaggcattagtatttttaagtggtttgatcacgtaaaccttttctctcccaaccccacccttgccctcatccccttcc

SEQ ID NO: 4031 - DNA, 3273 bp, Homo sapiens
atatcaatacatactaagagtgaagatttaaaccttcctctttcatgaaacaccaatcttgccaaataaactccagtcataattaaatacaggcaaatgtagtatcaggtctattttagtaaaggcaaattcttgccattcctctcagaactctttttaaaaaagtaatctattaaaaccaaagtttctaacactcaccgacactccacaatttttctagtaaggctgaatttattccatgacatttttttcaagttagctgtaaacactccaccctcttcgattgtgcaacaaccaaacacatcacacaaatacaagtcacaaaaaagggaaatacagtttaagagtttgaatttaggtaagttttgagcagaggatcttagagcagtgcacaacgcgatataaaagttaacatttaacaaatcatattaattcacattattacgaaaggagatgccggaaagagcctgaaccagttaaagcagccgccatcttaaaatgcgggatagaagttagagcaagaaaatgagactaaaccaccggaggtggaggttccgctcactcccagagctccgaaaaatcctagttttttttcaacttaaatcgataatatactatcaaaccacatttcaagtaacgaaacaagggtgttattaaatagaatgaggcaaaaataggtacattagctttcccttactgccatcgcaccccttatccacccccactctccagccaaaaggaaaagggagcttccagaatgccttttacatcagttcccggtgtccctcggataaatagcttcgggtgaaaagctgcaactacaaaatacaggaagtggcaacactgtgtcattccatctcctcccaaacccacttattcggtgtaacctgcccagagtcgactaagagtttctactagactcactgactgaccttcaatacgcaagacttcttctacccgaccctcagtcaagttcgggactcgccagattttttttctctcctccgagttttctttcttacccctagaaggcctagataaccttgatctcacaactaaactaagttttcaagcaccaagaataggaagcgccatgacatctgctggagcgtctctccgcaattcggacccccaaaaaaactccttcttaagcagcaaaaaaataaaataataaaggcgccttaagtcactctcctccacccctaatttgcaccgattccactgaagcactcaggataacacctcacttgccacaagtgttctccgtttcctagctttaaacttcatttcttcaagaagtatatctgcgttctccatccccccatggaagaagtgatccaagaggtattttcagaattatgcttccttcccacccccacgctttcctcttggcccgagccttccttttctcctaccaccccatgcccttgtccccgcgggttaccttattaatccgtttcagcgccatagtgtgtgcttgtcgtctggctcctcactctctcggtgtatgctcaaaggtccggccaaaactcttgattatcccggcggcggggcaggattgtctcgtctcacaccagctctgccagacacaggcgccttttgcaaaaacggagcagatcagcactcgcacaggccccgaagagcccctgatgaatccaggtcccttaagacagccgcgatccggggtgggtggggtggcgtggcaaagccaccaacagcctctgtaccgtgctttcggcccgaagtgggggcgagggtgacgggaagagcggaggtggtggctacaagtttaacttcccggcctctagaaaggaagagacccgggtgggagaggaagaggcgtaggagaaaggggtgggtgcggggcagggtccggagcccagcagaggaggagccggggcctagtcggcgctataccggcgtcactagggcaaagaaaggcaaggggggagggggaagcataagactccggacggacgccgggctgctttcggtttctgtccaaaggtgcggccgggaaaaggaaggaaataaaggaagggagacttgatgtgtattgctatcctcgcagcgagctattctgtgtcacccctgacgccaccgtacactcactccgccttccagcgcgctcccgcgcgcgcccgcccagccacctccaccacgcgcccgcgctgtccctgaggctccggcttaggcgcgaggacgcgcccattccccctcctcctccagcaggagaggccgcggcttccccaaccttcccaccctaacccaccgcacccaataggctggccgctcaagccgcccaggtcccgcactgcccctcttacccggccggccactgggccggcctcccttccctgccctagccgtccacacccacgcgtacagaggggccggggcctccctcaagctgcggcctcggcctcctccccgcgcggcagctggtgcctccccggccctacggggctcacgcgcacgacacagccacaagatgtccgctctgacggaactactgccagctgccacgctccgcccctccccctcctcctgcctcttcaccgccgcggatcagtccgccaacgccgccgtcccgagcacaagaccgatgtgaggccgaagccagacggcttgcttcccacgtccggggccgagtgaatacgtgtcaagcccttttccttcttctcggaacagcaccttcttactaaacagatcggagattggaccaggagggcgggggagggaggaggatcatgagctggggggagggtgaacgagtggcggaaacccttaggctcagagaagcatcgagaaccggaaggagaccatgggaggaagtacctcttgacttgctactggtacctggaagagatgtaacacctgaccatgggacatcaagtgactgtgtgaatcaaactgcccatcatgaattgttgttatttgactcatcaaactgtacaactggatgaacacaggagcagtgcactacatatgggactggaaccatgaatgagcaggtgactcagactcctatagtacctgcctctactccttcagcacttctccctcaacccacataaactgtcatcataatgagttccctctgaccagttaatggaagagaaaaaagtatggatgttatggatatcctaacatatttctggccattggacccctagaaacctgtggcaagtcctggaagtttttcaaggttcatcttgcaccttctagcatgcatatgtcgtaccaaagcatgtagaatgctgcctacttctg

SEQ ID NO: 4032 - DNA, 359 bp, Homo sapiens
gttgttcttctccacgtcatagccagcggctgccagcgctttcttgagagcggccaaagatacgccgctgcgctccttggaggcggcaacagctttagtaatgagctcggacaccgggggcccagacgctttgcgcttggccgcacctgcagacttgcgggccttcttcttcacgggagtcttctcggcaggggccggagcagcgggcgcggcaggcgcagtctcggacatgttgaaggcaagcgtgagcgagagcaattcgagccggaagcagaggcactggccgggactcgagccgcggcgctgcgcccgcccgtttatatagggcggagctgcgccgtgattggtgcgctgtccag

SEQ ID NO: 4033 - DNA, 5842 bp, Homo sapiens
gggatttcgggctccagcagcacgcagcctccagtcttgagtgactcctgggctttggctcagcagtaactcctccataaaaacaagtgtgtgcatctggctgttagaagaattcatgctcatccgggaaaaatgaggaagctgtgagtaccagtggaaggaacgagccaggaagagggactggaaccatctcagaagccatgcccctcaggctggaacttgccctgtctcctcgcagatgaggtaggaggctcagcacgggctggtgggagcagcccacagcagcagtgagggtcagtgggcctgtgagttaagaagaaggtggcacagagcgagggtctctggatcctgactgtttgacttttccatgattaggataagtagccagggcttggctagttggagagttactcgaacctcaggtgacagttgtaaggcagcacatagtgaaaaagagtcctagcctgggaaagtccaaaaccttaggtctggtttcagttcactcacctatctctgtgacatagcaaagtctgttaatttctctaattttctgattagtagtatagttgcaggaatgaaataaaaatggtcctgattactcagagattcatttactgattactctttttgtgacctgaataaagagtacaacatctctcaaaaggtaacaatatgatgtttcaggaaattagagaagttaagagactttgctgtatttactatacagatagttgactgacagctgagcccggacccaagattcatttataaaatgaaggagttgagaagtacatactctgaggtttatcctaaataaactgaagtctaggcaagtggctgagctaggtttgccatgaatcaatctgctgagtatatttcttggtaactagttcatctttccttaattcagtcaacaaatatgatatcaagtttagtaagatgatgacagttgtcatgtaatactccatctggaagattgtatgcttctcagcttccctaacttttcttaatctaccttaagcttcctttctgaaaggtttctgtctttcctaacagtctcttctttccgccagctacctcttgtgtttaagaattaaaggaagatgagctaggaatcaagaaatacgcagaactgattcctgtcactggcgccaccctgccacttgcccagagctgtggtataaatttttttaataggctgaaataaaaatatgaatagcattttggtattaagcattaaattgataaaggctatgagatacacctgctctcaaccatgttaattttttattattggtattaataaattattacttactaacatattaacaagaattgcattgagaaacaaagcatccacaggccaaatcttctgaatttcaaatgtttatattaatgcgttgtattctagaaaagtagaattgtcttaagtagctttgtaatataaagtcatctatcagcccattacacctattagaatgttttaacctttatttcccacttttttgtttctagactgagtgtacttggtctggtatttgtggcataacttacggaacacataagaatgatacagatactatttaatgatgacctaatacaagcttagatagctaaggtgaaagcttctatggccttaacattttcctcttgaagaatgtattttctgtaataaaatacagtggctacttgaaatctataaacttatgtgaggtctggataaatctgagcaactttcttctttgtgctccaggaacctacgcactatatatataaataaagcttaagtaaacatcactgcaatctgtgttttgtttgattatattacgtattgcctgatctttaaataatgatgaaaaatagcctttaacataaaccatgaatggatatgcacttgagggaaacagtttcttggataattaaactttaatttctcaccgtggattccttggatcttgtaatattttttaaaacagtcctggggatttatttttaaggcgtccaaatgaattattagttctcaaaagccatagtatattcatgggtcgatatatcctcaaaacactatttttaaactgcttagtttatttttcttagcgtgctcatctgctgcataattttctttgctatgtatgggtcacatgcttcctcccgtccataactcacgcacttaaaattctcacttcctgattgagccatcagattacgtaaaatgtaaatcagcctgaatacctaggagcaggaattttaagggagaaaatgccgttttctttttctgtgtcattattaacccttaaatatcagagtgagtgtctgctcacctatttgtatttggaaacgagatactgttaggggtttttcttggcccttccctttcagattgaatcagactttgctgctttccttatacaaaataatgtaccaactagatagacggtgggagtggtatcgttgcaggaatgaaaccaaaagggttccgatgattgagagagattcatttattttttaactcttctcatgatctgaatgaagagtacagcatctatcaaaaggtaacaacctaatatttcagaattgcaagtggccatttagcctttctgctgcctgatataaatgaaagtaattcctagcaggcaggatgacacttgttttatcacgaatctgacaatccagcacattttctcaagcaattttgaagttgtcgtagtaacagcatggcatttggagggtctttttagtagttctttagctagagttaattaattgtattaactctggatgtttttctttttactcctctttgacaaacaagggctataattgctcaaatatgtattttgtgttctatattttttggtgactatagtttaaggacgtgatgtttttaagtggtttcagtaaaaggttatcagttgatttcagacacattaaacttgggtttttaatttctctgtaaaattccactatcattgtaggaccaggatttagttttatttaagaagtgaatctggggagatatttgcacaaattgaattgtggcttgcttccagtggttgcaactatccgttgctttgattttggtgtatttagaaaaagaactggggaatgcagaaagggaaatgtgtcaggcttacaggagaaaattgtttctttagaaatgcaacaggcaggcacaccaccaaaagcatgttccataaaagaaaacaaataaatttgattttgtgaaacttaagaatgcagtgctctttgaaactctaaaatatacttaaataaattctcccctaggaagatttgtgggaactttttattggtggaaagtaggttggaacttctagtattaatagtaaaactctgtggcagaaattcttgccaatatggcggttggtgagaaaggaatcccgtttcttgggcagggagagggtcagaagaaagaattgtctgtactcagtctggatgccgggacttaaaaagtatcagatatacaatgcttttgttttcttgtataagtgaacagagagatgtgacacttctaaaaggtcttgtgagttttgtgggtttaatgctaatgccactatccttactgttctgtgagtatttgttcagccacgggtgattcaagagagttggggtatcagcatgtgcagccaacagcagtccaggtgctaatgcaccaccggtgatgtcaggagttacgagacagcggtttccaaacactgcagtaaacaaggtcaaagtgtcccgtttcgctggaagaagttttgtttttatgagctggacagtacatggatgaaaagaaatgaaaataacttctgatgtagggtttcttaaatgcagtttgagagagcaagataggaaccagtactttcaaaatatggcaagtgcaagtcacaatccctagtaagatattccttctcattttgtgcctttgactcttatttagacagacgtttaagtacgagaaagctaatggcgcagattctgctgactgtgtggctctcgtcttaatgcgttttccaaccttgaacctgagaatgccagaggattgagtctctggacgttcatctgagcagatatctgctggccgcctggttcctgagctaacaagtgggtgtcccgggcttgtgtgtgtagtcacaacagtggaggtgccacgtggcacccagaggtcgactggggctaccgcggggcttcccgatcctcacaagtgtgtcttcagtgtctgacatgaactgggaacttggggcatctttagaagcacagacatttggagttccacggcaaacctggatgtaagcactcacacagcttttaaagtgaaagcagggaccttgaggaaggaatcgccgtcatctcattgccgacctgcttactgtgctgggaaacaaagtaagttctgtttgtttctttgttagtctctcctgcgtgttttttcttgctaatgttattagacactcaatatccggcaaatgccaagttttttccccttcattgggaagtaggatatagtttattcaatagctgattgcttcttttatcttttccctcttcccatatctagtgtgccggcttgctgtttagagataggaagagattgaaatttattatcaaggagaaaacaaaaagtgttttgttttgtttctaaatggtccaagaactttgccattaggtaaatgactatgacacagacaaggcgttttgcatggtatgaccaggagcacctctagcaaaacagccccagttcgccgccctgatttccatttggaagcaggcacagtgggtttccccaggaccgatgttaacgcagagggtccttgtgcaggaattgtgcagaaactaggtgggaaggtgtcacagacaagaggctgcaatttaaaaacgcatcaggaaatggaaaagagctgcgagaatatcaattatttaatgatgttgataaaaacaaatttaatataaaaatgagatacaatgtatagagacctaaccctgtcaacagcaactaaactttactttcatgttagaaagttttgtgccatgtagatttatggaaaatgtgcttaattgcctctagaaaataatgaagaggcttcgtcacctccatagaagatcctgtgacactagcctaattctgacacatggctcctgttttccattttgtttgtttttttatgctgatcctctctccagagatgtgatgtggattgattaacttgtaatataaagttctatggtttctgaaaatgcagagcaaatagagatgaagagtggtttgtgatttgttattaaatgatcttcccttctacatttaggactgatttttactgtagaattttttttttttttttttttttttttttttgtcaacttgaacagcaataccttgaaggtaaaaggtgggagcacgactggagtgtggaactggaaagcagaaaccaggggtgttacttctatgtctagtatggaatgttgtgaatttaagttagagcttctgtgtcctgggaattcatattttatctcaaagtggtgctgataggactggaggtagctgtatttcatttgaaacattccagcctctttataggaatatctgtgaatttttaattcagcaaacatctttaagtgtgtcatttatgtatagcgttgtagtcagagctgtaattgtttcaccattaaatttacggaaattcagtttgtaagtgaaaaattaagaacagtttgaaagaagggcgaatgagcagagcattgccatctaaacagtcttgttaaagatagtgccaagtgagcaggactgtcccttctaagctgcccctcctaattaaagggaaaggtggctgccatctgtcttctt

SEQ ID NO: 4034 - DNA, 1191 bp, Homo sapiens
ctcgatgtgctaatcaagttccccctaatttgacatactagaatctaatactagaggcagcatgacattattatgggggaggaggttgagaagcactaacctcgaagttagaatttctggtttgtcatcccagtctgctaattagctttctgatttaagacaaaatactttttctgtgccttctgggggtcaaattcgatttttaagattctctcagttggaagaaatctaactaaaaatatacttaaaataattctttggtagtatattattttgaaatttggtccagaatcctatttgtttattcctgtagtatacatacgtctgtagttacccagtagtctttgttgtctttgggccatctaaagtatatttgggctgggcatggtgtctcacacctgtaatttcaacactttggaaggccaaggctgatctcaaacttctggcctcaaacaaacctcctgccttaaccttccaaagtgctggggttatagatgagccactgtgccccgccatggagtcatgtgatacacatagtaagctgtcagatatttttgataagttcaaatagacaccaagtaaaaaaagattcccatttattctccccagcttgccaaccccctaaattaagtaatgaaatgaaaccagcaccttttcagtatatctgacttaaaatcattatttattctgacccatttaactgtttgcaggattttttccctagagcagacagctataggcctgtatcattaaggattctcaaataagtgaactattgaaaccacataaaagccatcagttgcaaattctacttctctttgtttaagtagctaaaaatgaaagtggtggaaaaaacaggagataagcatattaagttctctactagtgctgaatctttaaatgactagctaagcagcgaagaagaaatcattctagaatgcagtgctctggatcctgctttgttataaacagttataatagcattaagttaacagtatttcacttaaacagctggacaggtggagaaaacattgtttcaggagttaggctttgtaatcttagacttgagggttttctcaatttctctttgtttatgataaagaaaaaccctattactactccctttgtttttggttaaaaactgaaaataactgattttgaaatcaaataaaccagtgtaatataaagcca

SEQ ID NO: 4035 - DNA, 1168 bp, Homo sapiens
catttaaatggttgaaagtaatagctccaggagaattttagagtaccattttctttcaggctgccatattatccctgtttccatttgccatggataattggagggtcatggtatagaagcaagagttaataacagaacttgcctaaatgtgttaaagttcatgggggaggggtggcaaataccgtattttaagttatgcaattgcccttttaagaaagtcaattctattcacttgttaactagaaacattgcttagattgaatttattgaagcaaaaagaaaaggcaatgagagagaacttttatcttccttcctgtcacattctgtaaagttgattatgacttctgccagacttagagcaacaactttagttcattttaacatttttttttaatgaagagcatcaaagaatggagtagtccttatttaaactgtaatggtgtcaagtctcactgtgtgcacactctcacacatacacacacaattatactaattctagaaaggaaccaaaggtaaataaccagtgtttccattatcactaaatggaaaaattgactggaagttagagttgtgccaattaatcattttgttcatcaactgttctggtaacttatttttttttattggaatcttaaattggaacaactgttacagaatgtatattgctccagttctaaagccagttaaccctgtgccctctaacttatgaaccttcatttcaaaacagtatgtgggaagtcctgtagtttgataagagtaaaattattttaaagaggataatttaccattttactactataaaataagttgatatcagttgaccattttattttttgatggactctttttgttgggagaaagaaatgaatggaagaaaaaaatatgttgcttttatttgaatattgattactaacaacttataaactacattgcaggaaatgaagaaatattttgaaattagcaaaatagcaacagtattcaagtatctgaaattttaatatggtgagtcttagagctttagactttcctataagtgacagtatctaagttattcttaatagtcacacttgataattctgctgaccataagcagctaacctacagttgaagatatttatgtgacatgaatagcctgtgttttaaaaattaaatattttatataaaattg

SEQ ID NO: 4036 - DNA, 36514 bp, Homo sapiens
acacactcctttcccagcccaggggcacgcgaacaaaatgaggctcaagctgaccaggccgagccggaggaacgctggggcttggcagcagaagggatgggaccagagagaagggtgtggaggagaccccagtgagggccaggacatttcaggtaaagagaggtcatatctccgtacctcacttcctgacacaaacaagttttcactgttgtcagcaacaaagccctaatatagctgcggaagagaaaaactgcattgcattttgcctcctgcaagcatcatcaacagttactggaggaacgtaattccagaaagcttgaaagccgtggtgatggtaattatgtatcaaatgcctggttctatttctgttattattgttttgtcatttctgttttcccagcgatctgactgaactcgcagagggacaaatccagtttttctttttgacttttgtcaaactaaatcaggcctgatagaaaactcattgctctccggggaaacaaagtaggagccacgaaatgtcattttaacagagcgtgggtttggtgactgtaggaaaggatttgaggacgctccttctgttcggcttcctatgtcatgagcacaggctccacgcacgcacagacaccacggctcccggatgctgtggctccccgatcggggctcctgcagcgccagaagcccctccgggatgcttcgaggggctcccggtgggtggaggtacggacgccgctgcggccgccgccgccagtcctgctgctgttgttgctgctgcagtcacgtgggagcccctttaagtttccatagagaggcctctctggtgtcacatgatggacatgatataatgaaacaacattgtggagaggaaagcattaggggagcccacggctacaaaaacaagtgagtgagaagaggtgggaggaagagaaactacgccacctcccctgcagccgagtgcacgcagcagcctggcgtgacaagtgggcgacgccggggggcagggagccggggtccttggccctggccggggaccccaccgcccaccgcgcggaggacaacttttagccggcagcccagaccagcgcggcacctgtctccggagtctccaccgctcctcccgattcatcccagggaaattctcaagaatacgctctacaaatctacgtgcgcatcattttcacctcgcgtcgcgcccgggaggaaggaacgaggcaaggagctaaagcagcgtgcgttcagccctggggcattttattaatgcttttacgagttagaagagttgggataatttgccatctggagtttctctgccttgctgatctgagctcagacctgccaatttaccagagataattgataacaccctgtaacagctgagaggaaaatggaagaaacggagatacttttagtgaagcagaataaaccactgaacaggaaaaatgaggaagctgtgagtaccagtggaaggaacgagccaggaagagggactggaaccatctcagaagccatgcccctcaggctggaacttgccctgtctcctcgcagatgaggacaagtcctgcgcttggggatcctctgtacgcccgttcactggtgcaggtcttctgaacaaatgcctcctgaggatttctgtgcctggaaaatatctgttaacagactgcttttacacctacgtaagtagaggcttctgcttataagtcaacctcaagggagttttattttgtccctggatgattcctcagtacatttttctttttcttttttgaggtagggttttgctctgttgcccaggctggagtacagtggtgtgatcacaactcactgcggcctcaacctcccaggctcaagcgatcctcccacctcagcctcccaagtagctgggaccacaggcgtgtaccacccacgcctggctagttttttaaaatttcttttgtagaggcagagtctccctgtgttgccctggtttcaaacttgggccaagtgattctctgccccagcctctcaaagtgctgggattacaggtgtgagccaccgtgcctgacaagcctgatatgtttttttaaatgatcattagtatttgatctctactctttttctctcaaccacccaactcccggtttacggtcaggaagaatctataacatgaactcctgcttaaaaacaagggtatagatcccatattcaggtcttagactgggaagaagagaaggcagtcaaaaatattaaatatatgaatttcagtaaattcagttggggatgccatttcagctttgcagtcagttactccagaatatgtcaatgtatggcaaagcatgtgacagcaggatctctgcaccctctccatttaccagctgtggtggatctcttagccacatctctgtttataatgtgcttattgaaaactaatgtattacttttattatcatagctaccatttactgaatatttacattgtgctaacactggttcagatggcttcatcatatttacctgatttaatcctcacaacaaccttatgtgctaggtccagttattaccatctttttttttttttgagacggagtctcactctgtcgccaggctggagtgcagtggcgcgatttcgtctcactgctgcaacctccgcctcccaggttcaagtgattctcctgcctcagcctcccaggtagctgggactacaggcacatgccaccacgcccagctaatttttgtatttttatagagacgagacttcaccatgttggccaggatgatctcaatctcttgacctcgtgatccgcccatcacagcctccaaaagtgctgggattacaggcgtgagccaccgcacccggcctattaccctcattttacagatgaggagactgaggcacagagagttaaagtgatttgtgcagggttgtgtgaggagctggtggcagagcttggcattctggctctggagtctgcatttggccatctcaccgtacagtgtcatagaaacaggaaactcgagaagataaactgccaggctgtattttggagtcagtattttaacactgtcaccatctcaagcatgatctgtgggactcatcactgtgctctttgacttgaacttctttaaggttagtgggaaaatgaagctttagagaagatgggactggcctaaggtcacactgcatgtcagaagtgtggtggagggtccaggtcttctgaccattcagtgcaagccaaattgtgctaatttccaatttttctccctttctcttggtgagctatttggtgctacttctactcctcatgaccaaagctggctttcatggtttactcatgtacttactgatgaaaccctgagacttggggccagtgactgttcagaggtccatgtgaagatgcgctgaatggtataaaggacagagcagtaaagagtgctggctgaatgcctgggctggcaatcaggcatgttggagtttgagtcccagtctgccactccagctctgtgaccaagaggaagtgaagtcatgtaccctttctaagtctctagcccctcttctgaaagacgaagatgccaccaccaaccatgttagtggttgtgaatgccaagaaagtccatgtgaagcacatagcatagtgtctgccatgcgttaagtgttccaaaaatggaagctatgactatttcacagagtacacttcccatcacttttcagttcattttggccttctccctcaaaagcactccagtgttctgatccagctgataaaacaccaaacattcacatagtgctttaaaagtgacccactgtttttacagactgcattacatatgaccctaacaaccactgcaatatagaaattcgcatctccattctccagatcaggataccgaagctcagaaaaattaaatgatttgcccaggatcacatagttagtaagcagcccagccagatcctgtgttaacttgttcatccgcttcctataagaaaacatccattcaaggcacatggggcaacaaagaaggacttagagctgtgtggcccctcgtcagggcagtaccagttgcacccatagtccggcctgaatactcagcttaggactattgtgtccaatgtcccaaacattttgaagctacatcttaaagaagtgtcctgctcagatgcagttctccttgtgaaatccgcaggccccaaggaaagtgactttaatccagtttgctcatgcaagaacagactggcatttcacatccaggaaaacaatggatttgtactgttcagcttttgccatgcaaggagttcctggtgtggtttattaatttacatctcaggctccagcttcactatcaatcagatttggaagaaaaaagttacaaagaaaggcagcttgctgagaaacagcggaagcatgacggtacagactgggttttgaaatggagacacattctcatggcttgtgggctgagagacactgagaaaggattttgttcttgaaagatgattgttttaatgctggagatggagagttttgacaattttaagtgcatgttctgtgtgtaagaaagagtcattacgttttttttttctttcagatgttgccatgccttaaaattgctgatgattaaaatagaacatcctgagttacagaaattcagccctagtgtatcctggcctaaaaatacagaacaatcaagttgattgttggaaatgagaggctaggcagggttggaaacatgctaatgtttactgagtgaaatctttccttctcagtagagttgcccttgcagctgaaagtcactgaaagactcaacaaaataagcagatcccacttgtctcactctgttctcctatgcatgccctggaaagagaatgaatgagccctttttaatttatcaactggttttcttccatctctttactagtgagccatgggggttttttgccgttaactgggtagccagtctcttcatggagacttattttcaggaaactagcctcttgctttatgtgaaaacaaggacccaactcaagatgtcttatcacagtgtgttctgttgcgtaacagttgcatctgtagtccagcctcaatactcaggttgggactgttttgtcctgatgtctcgaacatttcaaagctacgttcttaaagaaatgtcctgctcagatagagctctccttgtgaaatcctcaaaccccaggggaagtgaccttaagccagtttgctggcttttcatgtcacagaaaacaatcgactgccactactcagctgttgccacacaggagtacctggcgtggtcactacttgccaactcagtaccccactttctccccaaggacataaaagcaatgtgggaagatataccaaatgaccttgtcacactgggctaatatgaagagcccacagatgcaaaataatgtatcatacctttattcttctgattttttttttttttttttttttcggagacagtctcactcttttgcccaggctggaatccagtggcgcgatcttggctcactgcaacctctgccacccgggttcaggcaattctcctgcctcagcctcccgcccagctaatttttgtattattaattagtagagagagggtttcaccttcttggccaggctagtcttgaactcctgacctcgtgatacacctgccttggcctcccaaagtgctgggattacaggcgtgagccaccgtgcctggccttttttttttttttttttttttttttttgagatggagtctggctgtattgcccaggctggagtgcagtggcatgatcttggctcactgcaacctctgcctcccaggttcaagtgattctcctgcctcagcctcctgagtagctgggattgcaggcatcccatacccggctaatttttttgaaacagaggcttgctctgtcacccaggctggagtgcaatggcacgatctcagctcagtgcaacctccgcctactgggctcaagcaactctcctgcctcggcctcagcctcactacaggcatgtgccaccacgcctggctagtttggttttttttttttgtatttttttagtagatatggggtttcaccatgttggccaggttggtctcaaacttctgacctcaagtgatctgcctgcctcagcctcccaaaatgctgggattacaggtatgagccaccacgcttagccttctgctgaatttttgagaagcatacataaagacaatgtaaaaaacttagcatatttgtttggccctgctaagggcatggttgaatatatagtgtgtgtgatgtatttggtgtatgagatatatatgatcttatcagacataagtaaaagaaattcattcttcaggaaaaattttccccataactgaagtgtcaatcatttgaaaaaacttctaggcagtaggcaaacactgtgactagttatttatcaaaaataagcagactttagagttttgtaactgatgagaataatctggctgcttcttttgtacttcagtcactgatactgcgaattagagtagcatatacagaaggatgcagggggtccctaaaggaatcacagaattagtgaaaccattatttgagagttgcagtgattcttctgtcctggcacttttcccagttttggtgcttaaatttactatccacttgaaatgtgtcactgcctgtcacttcacaaagtatgtgcctttcactgcagtcaacaagctgtttacatctttgatgaaatgattgccacgcatctccatagccctggtgttctattcccttattcacagagattttttttaaaaaccagcctagcagcaataggtatgtgctgtggatgcttctccatgatgataaaggatgagtttgtgctgggatctccttatgaaaagataactggccaagcccatgaggaacaagaatgttatgctaatcagacccaaggtaaacagcctgcagtgcacctcctgactgattagcactgaacccacttggaatcatcaaccacaggcacgtggtaattggatgttcttctaatacacatagtgagattgtaaaatgaggatgatatatgaggaaagtcagacggagaaactaaagttcagttcttaaatacaagccaagggaacagactaagtgaatggtacagccaggattggagcctggttttcacaaggtggtatgtcatgataaaacaagccaaagaaaaggttgggtagtgttttgaggctaaaagagaccaaagagtcttagtgaatcaaccttgatgcgatctgggtttgaaaaacctataaaaaaccttttgtttggagaaagtgggagaagttggatgtaggctggatatttgtgggtaccaaggaattgtttgttttcttaggtatggtaagattttgtggttatgtagaagagtgtcttcattttatagaacgacctcaaagtagttaggagcagtgtatgtatgggtggttatcaatttactttcaaacaatgcagcaaaaaatatgtatctatattacatataattaaagcaaaacatgataaaaaggaatagttattgaatttagatagtatggatttaggaattcattgtattgtcattccaatttaatgtataaaattttttataacagtttataaaaacagtgcacacccctttaattaggtggcctgggtacatgaagtatctttttggatgcctagaacacaaaaagggacgacaacaggccacctaataagatgataccaagaactataccatgacggcgaaaaagaactgctgcaaaaaataatttgccaaggagaactcagagtacaaagccttacctttggagtagagggaaggagagtcttaagtaaagctcacaaaaacccctaactcatagatgcagtctaaggaattcattccggaagcgacattagcatctcattagtgccattatgtgacttacttggcctctgagctagtctattttcttccctagaccccaaaatctcagtaatcctttggatccaagttatctccaagtgaaaataataggtttaggaaagcgtttttcttcaacttctatggagcacttgcttgctttgtcctatttgcatgtccgacggacggttctccagcaccactgctagtcgtcctccgcctgcctgggtacttgatcacaggatgcctctgacttctcctgcctttacccaagcaaaggattttccttgtcttcccacccaagagtgacggggctgacatgtgcccttgcctctaaatgatgaagctgaacctttgtctgggcaacttaacttaagaataagggagtcccaggcatgctctcccatcaataacaaattcagtgacatcagtttatgaatatatgaaatttgccaaagctctgtttagaccactgagtaactcacagctaggtttcaacttttcctttctaggttgtcttgggtttattgtaagagagcattatgaagaaaaaaatagatcataaagcttcttcaggaagctggtttcatatggtggtttagatttaaatagtgattgtctagcaccatttgaaatcagtgttcttgggggagaccagctgcgctgcactaccaacagcaaaagaagtgaatgggacagctctgaagtatttgaaagcaacagcaggatggctgtgagaacctgcctcacatgtagctgaccccttcctcacccctgccaacagtggtggcatatatcacaaatggcagtcaggtctctgcactggcggatccaactgtgatcgaaagttttccaaaaataagttgtgtctgtattgaacatgaacagactttcttcttgtcattattctctaacaatactgcataacaattatttgcatacatttgcattgcattaagtattctaagtaatctagagacgatttaaagtatacgggaggatgtgtgtaggttgtatgcaaatactacaccattttctatcagagacttgagcatctgtggattttggtatccaaggggctttctggaaccaatccctcaaggataccaagggatgaatgtaattgtacaggatatcgcattgttggaattttatacttctttgtggaataaacctatagcacttaatagatagtacagactcattccattgtgcctgggttaaagagcccaatgtatgctggatttagtaagatttgggccctcccaaccctcacgaccttctgtgaccccttagaggatgactgatttcttttggtgttcagagtcaatataattttctagcaccatctgaaatcggttataatgattggggaagagcaccatgatgctgactgctgagaggaaatgtattggtgaccgttggggccatggacaagaactaagaaaacaaatgcaaagcaataatgcaaaggtgatttttcttcttccagtttctaagttgaatttcactgacctgaattgcatgtggtataatactaacaaatggttcactattagcatatcatgaatggttatactttatagaaattccatagacttggtgggggttttgttttggtgacggatacctagaaacactcctggggaaaatcgatgactggcttagatgatgggaaaggagcagcgagggagtcaattctgttgttgatgagaagctgcaccagctatctctgaactctcctctcttagctggctgaggagttccctccatggttaaacaggtcattttcttacataaggaaaaatggtccagagaaactgggtttctatggctgagacagaactgtgctaatatgtgtcagttcagtttagaaggcaaagcaacaaaagcaggtgctacttgaactaggatcctagagtatacctttgatatggtttggatgtttgtcccctccaatctcatgttgaagtgtgatccccagtattgggggtggggcctggtgggggtggttgagtgatggggcggatcccttgtgaatggcttggtgatgtcctcacttaacgagttcctgctcagttagagggagccggttgtttaaaaaagctggcacctccttcctctctcttgctctttctttcttgctccctctctcgccatgtgacatgtctgctccctctccgccttccaccatgtataaaacatcctgaggcctcatcaggagccgagcaggtaccagtgccatgcttgtacggctgcaaaactgtaagccaaataaacctctttactatataaattacccagtctcgggtatgtctttatagcagcgcaaaacggactaacacaacctcactagaagtgaagtcattagaccaaaaacaatactgagtttttaggtccactaagaggcaaaaataaaaggctctttatagcagcatgatttataatcctttgggtataagcacatgtatgctagaacttaaagtataataataaaatataaaaataataaaataaaataaaaggctcaagaatgagccatctcggccgctcctcctccaggggcccctgtgtgcagctcccaacacaggtactgcacagaccggccacctgctgtccccatgtggcgtcctggagaactgcaggggcacctggtggaatttgggccttgtccttctgttttctttctggcctggaaaagccactggcctcacaatcaagagttaatattctatctaccctgcttaagctttcccgccctctcacactgcctccctccttttccctcctgcctgtcacttgtctggaaaaggccttttctcctcggggctaacacatgcaatttgtagccaaaacattctgtctaccacacaaatccaacgagaatcaggatcattccaccacatctttttctatcccatggttattattttcccaaaactcttgtcttttgctttcttacctattcgctgttttccctaagtaatcttatttactcccctggttccaaatacatccctatgtgttgatttccctcaaaccagaggtctggcctgggatattttttgagacatcttgctttttatatttttagtagctcctaagtataatagttcagcctgctcttctaaacttgtctcaatttaatccatttatgcttgaggttgcaattttttgaatttttgccatcagaccttggcaatgaccttgagcagtaggagacaactcccacatgcttagcattccaataatggaacactaggcatataccaaagccatccacattgccttctccccaaagccagctctccctgctctgccccatggtgaaagctgcgaacaccagaggtctgtgacctcttccctctcccttacccacatccatactcagcacaacttgttgctgttctctctcaattctctctttaggatccatccctttctctgctcttcctagacagctttctgggcccacccctcgccattagtctagctttgttatagccaccagttaatctttgtaaaatacatacgtgagctgggcacggtggctggtgcctgtaatcccagctactcaggaggctggggcaggaggttgcttgagcccaagaggttgaggctgcaatgagccatgattgcatcactgcactccagcctggacgacagaccaagatcccatctctttaaaaaataaaaataaaaattgtttaaccacatgaccttgctccttgtccctcacttttagctgaactcttataagtgtgtcaaccaggtaccagacccttcatgaccccatgcctacctgtgtcaccatcttctggctgtgcttcctggggcctgtgttctgtgctcacccagctgcttgctgctgagaacactcaggtatcttggcatttcttagcctgtgtctgtgctatttcctctgcccacatctcccctctcctcctcctcgtcagctagggacctccagcccctagggactgtaagctagggacctccaacctgcagcccctggctcaggtgtaaacttgtctaggaagccttcctctgccttctgcatcaaggcttagatccctgggcaaaggctttcttctctgtaccccttcagagcctgatggcacttcgcatgttatattctcatgattgattacctactaggcttctctgcaaggctggaaaatccttgctcctaggagggacggtagacaagaacaagacatactgtgtacactccattcttacattccacgtgagctatcctttgtgtaggtgtctgtggcaaatcttccttctaggctgcagcctctacttttcatagtttctctccattttcatctgccatgtgcatgaggaataaaaactacttccaatgatgaccaaaataagatggaagaaaataaccctgcttcaaagaacatttctgagaccataaatatgattttgatgtatcttccattatggattacccatgtggttttttttttccttctaaatgcataaacaggaattgtttaataggctagagagccatgaaaagcaaaataattaaggattgttgtcctcatttcatagaagagcaaacaaagacagaaaaacagatgtgccttaaccaaaaagggcagtaaatttatgcaaagcagactgaacccccattaaaagtaatcatttacagcgaccaagggccaagcacgtgatcaccaccctcctctcccaatagctctgaagggtgggtagtatttccccagcttatgcacgaggaaacagatgcacaggaaagtcaagtaacttgcctgcaatgccacggctagtcaacatgagagtttgaattacaaatcaggtggcggtggcggtggtgatgatgatgataatagcagcttatcatcatcattgagctcttattttgtgttagatacttggtaagtattttgcatgaattagctcatttagtctgactttcaaaacagccctttgaggtcagtgttattatcatcattcccattttgccatgaagaaacaaaagaattaaataatccaagatcgtctaactgacatttccaagcaggagcacaaacccagatctctgtgattccagagcctgtgctcttaaatcagcactgctcatttcagtgtgggagatggcgtaaatgggtgtgttcacttgctgggcagcctcatctgtggtccccttgatccccacctactggcattcatgccctgtgctattccctcccctggagtgtggactggacctagtaatttgcttctaatggatggaatatgtcaaaagtgatagatgtcacttctgagactaggttacaaatagactgtgattctgttgtcttcttcctcaggcttgcaccctcacgacatgctctctctctctccctctcctcttttctctcttctctcccttctctcctctctcttatctctctcttctctctctcgtacacatactctggaaagccagctaccatactgggaactgcccaatggagaggcccacattccacaaggaactgatgtcttcagccaatacctcgccaggacctgaggcctgctgagagtcacgagtggccttcgtgggtcctctctcaacgagcttgcaggtgaccactgcgccagccaaaaccttgatggcagcctatgagtgagtgaccctgagccagaagacccagttaagccatgcccaggatcctgacctgcagaaactatgacataataaatttattgttttatgccactaacttttggggttacttatgcagcaatagatagctaatacagctcatagtatccttatctagcctcaaacattctgcctttagtatctaactttcctaactttttagataaacttttttgggggggataattttagatttacagaaaaaaggcaaagatagtatagagagttcctttatatttctctcctagtttcctctattgttcatatctcataaaacgatggttttgggttttttgagacggcgtctcactctgtcacccaggctagagtgcagtggtgatcatagctcactgcagccttgaactcctggctcaagggatcttactacctcagcttcccaagtagctgggttcacagcatgtaccaccacacatggctaattaaaacatatatatattatataatatatatattttaagttattagtaagtatatcaaatactgctccagatttacaaatggttattttccactatgatgtcaatacacattaatttgtaaaatatgcaaataattttcctgtaactattcaaatggaaaatattcaacaaagaatactaatttccttcttaattcctgtgttgtgtgatccaagtcacttgatctttctgggtttgttttctttagtatcaatttatcttactagaatttaacaacagttgtgtaatacaatcttttaatacttgtaaacactctgcagtgcaaaattctgtatttaaaaattcctatttcctaattgcttaaacatttagctgcattatttgtagcgtttccaagtgatgcttaaagacaatccatataaaaccaacatcctcaggaaaagaataagtggtactgcctagagaaaaagtccctcctacttattacatctaccctcctggttgaatcttttttttttttctttttctgagacagagtctcgctctgtcgcccaggctggagtgcagtggcgcaatctcagctcactgcaacctccgcctcccaggttcaagcaattctcctgcctcaccctcccaagtagctgggactacaggcacacaccaccacgcccagctaatttttgtatttttagtagagatggggtttcaccacgttggccaggatggtctcaatctcttcacctcatgatctgcccgcctcagcctcccaaagtgctgggattacaggcgtgagccattgcgcccggcctgaatttttttaatatgatatagaaatgagaaaaatcattatgagaaactaacacatacttatgagaaaaaattagctttgtatagatcttaaaaagccctttagtgagacagggttttaaaactcttcttggtgacctaacaaaaaaacccaaacaaatatttaaacaacaacaacaacaacaacaagaacaaatctgaagctgattcacaagagtccaagtcttggtggccagtgtttgctgcttagttgactctgagtgactaagctcttctttgtagccaattcacctgtttcaatagttgactaataaaaaaaataggcaataaaatatgttgcagaatgagggggtgccaaaggagagagaactgaaatctaattggaaaaaagtgaagcgaaacatagtgtaagctcattcacaagacattactacccagaactctgaattcaagttttctcttcttctccatttttgaaagtgtcagacgacaagaaagcaagctgtttactaaagaactgcagcatgaataatttctgtattataaatgataagatattctattttgaggttagtttataattcatttctgtctgttgtgcctaaaatcttggctattcagaatgatgacggctcctcagatactatggaaataataaatcatcaaaggcatacatttattcactctttcgtgttaactaaagcagaatgtatagcgcagagactttgtaaacaactcttacttaactgaaactacaatagaatctgtgtactagccatacaaaatccactatacagtgttccttcctttattattgaggttaaaaattcacataacataaaacttaccgtttttaccattttaaccattttaaagcatacaattcagtggccttagtatgttcacagtgttgtgtgaccatcaccactctctaactccacaacattttaatcaccccaagaagaaacctgtacccattaagtagacattcttcattcattcctcctcccagctcctggcaaaatctgctttctacagacttacatagtctggacatttcatgtaaacggaatcatacaataggtatgatacatgatacatacatacaacagggatgatgcatgataaaaggtacgcagccttttctgactggcttctttcacttagcatgatgttttcaagattcatccacgttgtagtgtgtatcagtacttcattcctttttatgactgaataatattccattatttggatagacaacattttgtttatccactcacaggttcgtactggcatttgagctgtctcgttctttaaatttaaacttttatttctgtcagtgtaatatatatccataaacaagtaagagggcactgagtcccagagcaaacaaacagctgttctctgtcctactgttttctctcgcaggcagctgctttcaaatcatttatctgtttcttctgataagagattctatagactgttacttccattttaaaatgctcatacctctatgtcttcattttgactttatttttttaatttttttaatttttctactatgggaaatgagaatttagctttaactccactgccacctgtacacatattactccattcgccttcacaatttagttagaacacagttttcggttaactcaagaatggtattgataattatatagatactgttgatatcataactacatagttttagatttccttttaaaacttcttataaactctgagatgaataatttcatcattttaaatttaattcatgatatacttaattcctaaaccttacagaactgtaacattcccctcagcattttcagaccccacacacagtcagtgtgtgtgtgcgcacacacagtcagtgtgtgtgcgcacacacagtcagtgtgtgtgtgtgtgcgcgcgcgcacacgcacacatccttcagcagtttcctgacaaaggtcatttttttttaggtttttcattttgcccatattttattgatcatttcactggttatggaattcctgactggctcagattttggttttctagcccccagtgctgtgaagaggtctgatacaatgctgatttctggcccttttgctctggaagttttgaggagattctgtttatcctttgtgtcctttaaatttcctgagtttgtgccataatagaggtctttttcatttaatatacctttttttttttctttttcttttttttttttttttttgacagggtctcacctcactcccatcgcccaggctggagtgcagtggtgtgatcacagctcactccagcctcgacttcccaggctcaggtgatcctctcaccacagcctcccaagtgggtgggactacaggtgtgcaccaccatgcccagctagttttttgtatttttagtatttacctccattctacagctgttaaaacagaggcatcagaaggaagaacagctttccttggtcagtgaggatgggaagaagctctagtgtttcctctcctccattccttctgggtataatggccacccattgcagtgggctttgatttttttccaagaatggagcttggaaccccatagaaattgtgttttgttaataagctgacggaaggatttttggcatcgattttaaattcccatagtctgcttctagcgaagctccacacctctcatttactctctctctcctcttcaggggccaaagaacaaagtgtagtcaactgttttgaagccaccctgttttgaagaggcgttttccactcaggtggccttgcaccgaatggccaaccctgcccactgtacggaaacaatagatgctgccttagaagggagcaagctggcactgccctggtatgtgggtgcggccaggaagctttgggccaaactgtgcagacttgctgtctcaggattagcactttctacagccagagtggagacgaagggcaggaggcacacagcccttcctcctggagatgaaaggggtctgtaggtggatgaggaccttgttcaccaaaagtcacaggaggaagtcaaagaggaggaggatagaaacatagtggtgcttctatcacctataaattctgcattcatgaaaaaaaaagtccacaaaattatggccctgaaccaatctgtatcaaccctgaacatgctggatgccacccactgtgggttgggcagaagatggtgcaggcctgacagaagttggtaaccaatactgtgccagaggcttggtgtggcaggaggtgacaggacaaaggtaccagaggatgccagctgggtgtcagccttcttagctgtcagaactggtcttggaaaaaaggacagccgttgggtatgcttttgtaagaggcatttttgctcttgcagatagctgcctctctcttccttcctgtgactgaacaggccagagaggaaggtcaaaggcaggcaagagaacaaggacaaaggcacaaagtgtggattgtacatggactcctgttctaatccagctcacttaccagctttctatgtcaaaaaacaaaaaattagaaacttggatgggaaagaggctggcacaaatgtaaattatgaactgagttccaaaggaaaagaggcaacagataagagattcttgtgggtaccttacctgcgaattactttgaaatggccttggaagggtcctgatgggcatggaaaaaaaaaacccactagccccattttcccaatatagaagcgaaggtcaatagcagtacctcgaaatgtctgggaagtgaaagtgacagagaaaaagaggacttgtggacatatgtgttggccttttttatctgaaggtgctatggctggtgaagatgggctgcgttctgggtccctgggagagctgatcctgagctcatgtctctgtcccagcagcaggagcccctcagtgctatagaatgtgaggtctgctgtgagtccaaaagaccagacatgtgacacattcctctgctttctggagcatagtatcagcccttagaagcagctgttcacctctcctttagtagctcagcaagaattcagttcagtaaaaatttatttagcacctaccctgctccaggtactctctaggcactgagaggggttttcctgtactgtgcccagaactctgctcctcaggcctttctcagctcaggatactggcttaagcagctaaactgatcgcaagtgccacccttccatgctgctaaaaacccatgctgttctcctagacaaagttaatgtctggctcaacataccacaccttctctcttaagtccttaagttctgagaaagggatcccaggaggtatgcaggactcttgatgttgaatgagaggcaagaccctccactcctgttgctcgaccctctcccaggtcccctagaggaaaggctcatcctgtggcttctccctcctaaaccaatccctgtgcatccctttctttgtttgtgccacgtccacacactaatctctctgccttgtgttggcagatgctggtgggatggagctgcagtttgtgtctctgaagcagattaaacactgtctgccccagcctgtcttaactatcttctcactggttaacagtccttggaagaataaacaatccacacaagctctcagaaagcagaagttccatgattcgtgaccagagtctcatagcacagaattcatctctaaaaacaggtttgtagctgaccagactccaccaactcagatatgtccacccctaacttgaaatgaaaggtgaggggaaggtcgagctcagagctcagtactctaaggactgcctctggtcaggttccagatcagaacagaccactgtcctgtcactattggtctaacacatgggatctctggtaacacacatagtacattctactttgcatcacccacatgcacgtttttctcaccaaatagactgtaaacttcttgattcagggtccatattcctagcatatgcctagcataatataggtactctctgtgttcaatcacattagcatggaaagtactattccctgcagattctgtgggattatggaggatcagcctatgacagagctttatataaacccacatttgctgaatgtcagcaatgaagcagcccactgctgctgactccagtgaagtcagcaaaacccacactgagcagaagcccttgtggttgtcttaggaactgtgacatacctcttatcattcgccataaatggcaaaaatattgtgcttggcctgccttgagtttactttggggccaggttgttttctgacaattcaaagaactactcctatgtagatggcgttcaggaaatgggagcatccgaatctataaattttagccagaaatttccgctatattttatacctcaaaaggagctcaagggagcagataaggttggtagaagtacagaaggggggtgggggtgctgcacttccccatatcacttctagcacatctcacaactaagagtttgaatctactacctttgtaggagttcaattttcaagttcagaggattcagcaccatggtcagagccaatgacataacaaatgtgaacctgaaggaaaccctctctgtaggaggaaaacaaagggagtctttcagagaagtattctctgtcttcccccactctgataacctctaagccaatgcttaggttagccagaggaaaaaaaccaactcccaactccatgttatgacaggccccttctgtcttcaagtgttgcctgaactaggaaccataggtctcaatctgaatttatcccattgtctttctcactttggcagtaagttatgtcttcttttttggtgatttttttttagagacagagtcttgctctggcacccagattggagtacagcggtgcaaccacgactcactgcagccttgacctcccagcctcagatgatcctcccacctcagtctcccaagtagtcaggactacaggtgtgcaccaccacacctggataattattttttaaaacttttgtagagatggagtcttactatgttgcccaggctggtctcaactcctgggctcaagcaatcaccctgccttggcctcccaaagtgctgggattacaggcataagccaccatgcctgccccctcctttttttttttgtatttttaatttatgtatcatagttgtacatatttttggggtatgtgtgatattttgatatatgtatacaatgtgtaatgatcaaatcaggttaattgggatatgtgtcatcttaaatacttacctttttgtgttgggaacattacagttcttctagctattttgaaacatacaataaattattgttaactatgattttcttactgtactgttgaatactagaacttcttccttctaattttatttctgtacccattaaccaacttctcttcattccccctgcccccactccgtacctctcctctgataaacaccattctactctccactactggccacttccatgagatccactttttaaactcacacacataaatgaaaatatgtgacattggtgctcaataacatgtagttccatccatgttgctacaaatgacaggatttcattatgtttgtggtgaaaaaatatttcactgtgaatatataccacattttctttatccattcatctgttgatggacacaggttgattccataatcttggctattgtgaatagttctacagtaaacattggagtgcagatacctcttcgatatattgacttcttttggatatacacccagcagtgagattcctggatcatatggtagttttatttttagtttattgagaagcctccatactgttttcatagtggctattgtacttacattcccaccaacactataccagggttcctctttctctgcatccttgccagcatttgttatttttttctctttttgataatagatttctaactgaagtgagttgataactcattgtggttttgatttgcatttccctgatgattagtgatgttgagcattttgtaatctacctgtggccatttgtatgtcttgagaaatttttacccagctcttttgcccattaaaaaaaaatcagattgttattttgctattgaattgtttacatttcttacatattctatgtattaattcattgttagatggatagtttgcagatatgttcttccattctgaaggctgtctctacactttgttccttcctttgctgtctagaagcttcttagcttgatgtaatcccatttttctattttttgctttgacttcctattcttttgcggtcctaccctaaaaaatctttgcccaaaccaatgtcctgtagcatttcttcagtgttttgttctagcagattcatagttttaggtcttacatttaagtcttgaattcattttgagttgatacttgtatatgatgaaagatggggatccggttttatttttctgcaaacagatatacagttttcccagcaccatttattaaggagactcttttcccccccagtatgtgttcttagtgcctttgttgaaaatgagttggctctaagtacaaagacttatttctgagttcttcattctgttccattggtctatgtgtctgtttttataccagtactatgcttttttggctactatacctctgtagtttaatttgtttgttttctgagacagggtctctctctgctgcccaggctggagtgcagtgatgcaatctcgactcactgaaacctccgcctcccaggttcaagtgattctcctgcctcagcctcccaagtagctgggattacaggtacccgcgaccatgcccagctaatttttgtattttcagtagagacggggtttcgccatgttgaccagactggtctcgaactcctggcttcaaacaatctacccacctcagcctcccaaagtgctgggactagaagcatgagccactgcatctggcctgtagtataatttgaagtcagataatgtgatgcttccagctttgttcattttgttcaggattgctttggctatttggggtctttcgtgttttcatataaattttaggattttttttttctatttctgtgaagaactgtcattggtatttttataggaattgcatcaaatctgtagattgctttgggtagtattgtcattttaacaatattaattcttctgaaaagtgagcatgggatgtcttgccctttttatcctcttcaatttctttaatcaatgttttgtagttttccttgtagaagtcttccacctcctaaatttattcctaggcattttatttgtagatgttgtaagattgctttgttggtttctttttcagattgttggctgctggcatatagaaattttactgatttttgtatgttgatcttatatcctgtaactttgctgaatctgtcacttctaataggtttttttggtggactctttaggtttttctaaatataagatcgcgttgtttgcaaacaaggataagtcaacttcttcctttccaatttgcatgccctttatttctttctcttgactaattgctttggctagtactatgttgaataaaagtggtgaaagtgggcatccttgtcttattctagttcttaatgcaaaggctttccattttttcccatttaatattagctgtaggattctcacatgtggcccttatcacactgaggtatgttctttctttcttttttttttttttttttttttgagatggagtcttgctctgctgcccaggctggaagtgcagtggtgtgatctcaggtcactgcaacctccacctcccaggttcaagcaattctcctgcctcagcctcccaagtatctgggactacagatgtgtaccaccatcccttgctctttttttgtattgttttagcagagacgagttgtattagggttctcttttactgtattagttcgttttcatgctgctgataaagatacccaaaattgggaacaaaaagagatttaattggacttacagttccacatggctggggaagcctcagaatcatggcaggaggcaaaaggcacttcttacacggcagtgacaagagaaaactgaggaagaagcaaaaatagaaacccctgataaacccatcagatctcatgagacttattcactatcacaagaatagcatgggaaagaccagcccccatgattcagttacctcccactgggtccctcccacaacatatgagaattctgggagatacaattcaagttgagatttgggtggggacacagccaaaccacatcattctgcctctggctcctccaaatctcatgtcctcacgtttcaaaaccaatcatgccttcccaacagtcccccaaagtcttaactcatttcagcattaacccaaaagtccacagtccaaagtctcatctaaaacaaggctagtccctcctgactgtgagcctgtaaaatcaaaaacaagctagttacttcctagatacaatgtgggtacaggtattgggtaaatacagccattccaattgggagaaattggccaaaacaaaggattacagggcccatgcaagtccaaaatgcagtggggcagtcaaattctaaagcttcaaaatgatctcctttaactccaggtctcatatccaggtcacgctgatgcaagaggtgggtttccatggtcttgggcagctccacccctgtggatttgcagggtacaacctccctcctggctgctttcatgggctgacattgagtgtctgcagcttttccaggtgcatggtgcaagctgttggtcgatctaccattctgaggtctggagtacagtggccctcttctcatagctccattaggcagtgccctagtagggattctatgtgggggctctgaccccacatttcccttccacaacatcctagcagaggttctccatgaggaccccaccgctacagcaaactttttcctgggcatccagccatttccattcatcttctgaaatctaggccgaggttcccaaacctcaattcttctgtgtacccacaggctcaacaccacatagaagctgccaaggcttggggcttcaaccctctgaagccacagcctatgctctgtgttggcccctttcagccatggctggagcagctgggacacagggcaccagcatgggtactcccctgggcccggcccataaaaccactttttcctcctgggcctccaggcctgtgatgggagggactgctgtgaaggtctctgacatggcctagagagacattttccccatggtcttggggattcatattaggctccttgctatttatgcaaatttctgcagccagcttgaatttctcctcaaaaaaattgttttttcttttctactgcatcatcaggctgcaaattttctgaacttttgtgctctgtttcccttttaagatggaatgctttttaacagcacccaagtcacctttttgaatgctttgctgcttagaaatttcttccaccagataacctaaatcatctctctcaagttcaaaatttccacaaatctctaggacaggggcaaaatgccaccagtctctttgctaaaacataacaagagtcacctttgctccagttcccaacaagttcctcatctccatctgagaccacctcagcttggaccttattgttcatatcactatcagcatttttgtcaaagcttctaggaggctccaaacttttccacattttcctgtcttcttctgagttctccaaactgttctaacctctgcttgttacccagttccaaagttgcttccacattttcaggtatcttttcagcaacaccccactctactggtaccaatttactgtattagttcgttttcatgctgctgataaagacatacccaaaactggtaacaaacagaggtttaattggacttacagttccacatggctggggaggcctcagaatcatggtgggaggtgaaaggcacttcttacagtgtggtggcaagagaaaaaaaagaagcaaaagcagaaacccctgataaacccatcagatctcatgagacttatttactatcatgagaacagcacaggaaaggccactcccatgactcagttacctctcactgggtccctctcacaacatgtgggaattctgggagatacaattcaagttgagatttaggtgggttacacagccaaaccatatcacaatttcaccacactggccaaggtggtctcgaactcctgactttaagtgatccacctgcctcaccctcccaaggtgttgggattacaggcctgagccaccatgcctggcctgaggtatgttcattctatacccagtttgttgaggatttttttcatgaaggacattgaatttaactgaatgttttttcaacatccattgaaataatcacatgttttttgtccttcattctgttgatgtgatgtatcatgtttgttgatttgcctatgttgaaccatccttgcatccctgggatgaatccacttgattctagtgaaagatctttttaatgtttttgaattctgtttgctagtattttgtggaggatttttacatctatgttcatcagtgatattggcccacagttgattttttcttttattttttgtttttggtagtgtgtttgtctggttttggtatcaggataatgctggcctggtaaaatgagtttctctcctcttcacttatttgaaataatttgagtagaattggtattaggtcttccttaagtgtttgctagaattcagaagtgaacctggcaggtcccaagttttgaagggagactttttattgtagcttgatctcatgacttgttattggtttgtttaggttttctgtttcttcatggttcaatcatggtagagtatgtgttcaggagtttatccatttcttctagatatttcagtttgtttgtgtatagttgttcatgatagtctaatgattctatttctgtggtattagttgtaatgtttccttttttgtctctgattttatttgtttgggtcttctttatttttatcttagtctagctaaaggtttaccaattttgtcttttcaagaaaccaactttttgttttgttgatcttttttatttttttagtctcatttcatttatttctgctctgatctttattatttctttccttttactaattttgggtttggtttgttctcttctagttgcttgatgtgcatagttagattgtttatttggagtctctattttttaaaaatgtggatatttactgctataaaattccatgttagtactactttttctgtatcctatagattcttgtatgttttgtttccatttttatttttttcaagaaatttctaaatttccttcttaatttcttcactgaccaaccggttgtctggaaacatgttgtttaatttccatgtatttgtacagtttttaacattcctcattttattgacttatagttttactctattgtggtcagaaaagatacttgatataatttccacttttttgtatttgttgagacttgtttcatggtccaacatatagtctgtcctggagaatgttccatgtgctgatgaagaatgcgtattctgtagcagttgggtgaaatattctgtaaatgtctgttaggtccatttggtgtacagtttcactctgatgtttctttgttgattttctgcctgaatgatctttccattgtcaaaagtaggatgctgaaatcccctcttactgctgcattgcagtctatctctcccttcagatctattaatatttgctttgtatatttgggtactctggtgttgggtgtgtatatatttactattgttatatcctctagctgaattgacctcttaatcattatataataaccctatttatctctttttacagtttttaatttaaagtctattttagctcatatagttactcctgctcttttttggtttccattgcatgggatatcatctttctatcccttcactttcagtctatgtgtatctttacaggtgaattgagtttcttgtagacagcatattgttgggtcttgttttttaatccatgcagctactctttgtttttttaattggagaattcagtccatttacattcaatgttactattgatagataaggccttactgccatactgttacttgtttactagctgtaggtaactcctctcttcctttctttgtctttctttgtggttaagtgatttttctctggtagtatgttttgttactttttatttttagtctatctgttataggttttagctttgtagttaccgttaagcttacaaaacaaatcctacagttataacaggtatttaaaactgatgccaacttaattttgatcataaaaaagcaaagaaacaacccaaacaggttaactcccttcttcctccacatttacagtttttgatgtcaccaattacccttttttattgcctgtctcttaacaaattattttcaaaattattttaatagttttgactttcagtcttttggccaaagatataagtggtttatcacaattacaatattactataataattacgttagagtccttttctttcagtttgaagaatttcctttagcattttttgtgggacagttctggttgctataaatataaagtccgtctgggatagtctttatctctccatttctgaagaactttttttgatacagtattcttggttggccatttttttcctacaacactctgaatattatcatctccctcctggcctgaaaagtttctgctgagaagtctgatgccaggagtattggatctcccttatatgttatttgcctcttttctcttgctgcttttagaatcctctctttgtctttcatttttgcaagttcgatgtaatatgtcttgggatattcttatttgggttgaatctgattggtgatctttgatcttcctggctttggtatttgtatctttctccagggttggaaagctttctattatttctctgaagaagctttctacccctttgtctttctcagttccctctttaactccaataatgaatattttcttttttgatgttgtctcatacatattgtaagcttttttcattatttttattcctttttttttcctctgtgtatatccaaataatctgtcactgattacttctgccattgatgctctatattgcatttttcatttcattcattgtatttttcagctccaggattttttgatttttaaaattttttcaatgtctctattaaatttttctgatacatttctgaattgattttctgttttctggaatttcattgagtctccttaaagcagctattttgaattatttgtatgagagatcacacatctctatcactgtagggttggtcgctggcaccttgttttacctcatttgtgaggtcatatttccctgaatgtttttgatgcctgtagaagtacaacaatgtctacatatttaggaattaggtatttattttagtctttgcattctggctttgtttgtgcctgtccttcagagggcctttcggattctaagctgactgactgttgtgttccctgagcctgtgaccactgcagccagatatctcagcactagaggacactccaagcccaggcttgccgtgagtttcatgaggactctgaggttgacatggctttccagcccagatggacctagagaagaccccaggcagatactggactgagggacctgagtccagaaaactgtccttgtggcccagacaagtgtgtctcccagcagatctctgcatttctcaactgcagcaagaggagatggagttgagactggaccacttcaggatcagctgtgagaaggagctggtgggcctatctcattgtctcagatgaacatgcatcacccagctggtccctgtatgagtggggtagttcctagactgaagcagtaggggctagagctgagactgggccccatggaatgtgctatgagagactggagagcccagtctcagctcagaggggtttatatcacccagcaagtttctgcacaaataagctagtttcttgtctacagcaggaggggctggagctgagtctgggtgtccttgggatctgttgtgggatggaagctaaagagtctgtcttgttgggccagacaagtacacatctcccagcaggtctcagcacaaataggatagttccctggttgctgcagagggcagggtgcagctgagactgagtccacttgggatctgctatgagacagaggttggcaagtgtgttggggacattcagacttctgggttgtgagatatgggcaagtctccttctgggtccttgtatgagcacctctgaactgagacatcagctgagaaaggctggagcagagccacagggccacttccaggttcactgctgagactgatgtcagtggacagacgagtctttctgccaaggctctagtatgcgcaattccttctagactccttggcagatagtttcggttgcaagctcaaggccaaacagggctgtagccaacggcagaccccaaggggtcccagtctcagctctggcccctcctgctgtagctggggaatgatcctatccatgcagaaactttcttggccatttccaggcatgaacctggaagcaagctcaccagatcaactgacctgggtgttggtctgtactttcaaaacaaccctcctaggtcttgcgccctctcagggtttcacaaactcctatctgaatcctgaggctcccactgacagacttttgactgtagatgggtacaaaaattcttgtacccatattgtagttgggggatatgagcaggttgccttctattttgccatcttggtgatgacactcagtaaatgctttcttcatattgactttctggtcctgctaatctgtgaaatggagagagccactgtatctcttagctgtgttaatccaaatatctgagtgatcgtccaagacaaggaaagaatctgactacaagggccctggaggaagacccctggccccagaatcatttctctgcctccacctctcgatggcccttctaagagaaaagatacatttatggaagtacagactgattcagaaagtgggggacatagtggaagggagctaacatctgctgagtcccccgtgtgtcaggtatgaaatgcaaactctcattttaccctcacagcaactcaatgaaggtgagaatgtctagctccctttcctaagtacatgtacacaaacgtggaggcaatgcacagtgttgaggtgtgcactgcttccacgaagttgaggaagaccattcttgttaataatcaagtacttgccccatgtgacaaaatacatgctttcctaaagaagtacatgaagttaagtcacagatgaaatcctactaatctgcagtttgcatttaagcactcagtaattccaggcatggtgctaagcactttacctaatctcactcaatcttcacaacaaactctgcaaaacacatatattattatccccatttttcaggttaagatatggagatttgccgaggctgagtaatacagtcagggttgcacaactactaagtggcagagtcaggatttgaactcatctctgcctgacttccaaggatctctgggtcctcagacataaggaaaatcacaatggagaaaatacttgttatatattgtaaggaaaatattatttcctaataaaaataaaaggagtcaaaattactgaagttgaacatcccatcaaagtttctctgtcaccctacaaggtagagagcagtgggaaaaaaagggacagtcagctttaagttttgttccttgatttgctgccatgctccttcaggataagaactcctgtggaatagatcagacttggatatggaatttaaatagatagttcaagttttttttccctctaatttcaggcttagaatctagcaaagttagaagggaaatccttccactgggtatgtaaaatgttaaacaagcccctgagagtagatgactctttgcttctctgacctatactagaataatatataaaatggaaactgcaataaatgaataaaaccaaatgacacagacacacatctgcacacccactgtctgtgtccgaatgctgatacactgcaggtacagtacagtgacagggtgttcctgggaagccgatcaatgattcccttccacagttcaggctttattacaggaggtattcattagctaattacaattagtcgagtaccttggtgtgccttcttcaagaactcctttaaatgctcctcttttattctattttcaagttccaaaagcagatgcttcttttatggaaaagcctaattgctgtggaatctaatgcatgtcctacttccatatccaaatctcctccttcctgtttaatggacagcattctcatgactcacctttgatttatgggctggaaggcaccacaccttttttcggtcctgcctgcacatattgttaagtgtgatcaactctggaaaaaagcattcatgagttatgtcaataatatgagacactaaaagagacttgtcctacaaacaaaacagtaaatgacaaatccaagttgttttagtcccatgtgcttctctaccgcaccctagagcctataatgattccgttttcttcatatttgtggcacaaggaatgcctgaaaactcatccttaggtaacatgcgcctcattagtatttgttcattctaacattttaaattcttttgaattggcaaaaaggaacaaagagaagtgaaatttagatacctaatagatagtggaaaataacaaaacagcagcctataaatcaatggaatgtggcgactgtgtgttctgtggtggtggttcttgttctggatggtatatatctctgaataatttcccagtattcacccaatttgatgctactatgaaaaaattatgtctctaaaatccacattccaaataactcttgttgcagataattcccttcttcccttttcccatcctaacagaatacaattttgttcagaggacgacggaaaatatatcccattaaatacttgcctaacacactgagtggcctgtgacacaggtctggttagtgatgctgacaaaaggcttctaggtatttatgtgaaagctcttgtgtttctactcaagcactgctccttccgccttgagcgctgatgtgaagcctagagctgcggcagccatcttgcaaccgtgagatgaggagcgtgagaattacagcctacagctaagggtggcagagaagaatggcaggagcctgggtccaggatggcaccactgcctcctttactagcttcagacttcttattgcttgaaataaatgcccatcacaattgtttaagtcactgctgctatggttctttgatgcttgcaggtaaaggctacaataactaatacaggcttacagacaccttagcttctgtttctaaattcccaaattaaagctatacatttcttttaaattcagaaagaagctaagtagccgtgttgcccttatttggggtctggcattgacactccacaacagcctcttgcattcattacaatcaactagagacagacaaatactggagttaaatgggggaaaaaaagaaattataagcgtataggtaattatgaatagttactggatctcacagtgagggacaactatgtataaaatcaatggaattataacctttagatgggcaaaaaccaagtctgatgagaccaagtattgccaaggttgtggggaaataagatctctcacatactgcttgtgaagtgggtggactgggcaactacttcagaggacagtgtttccacatctagtaaacataccttctgctccagaaatccttgcacatgtgcacaagggctatgcacaagaatgtttactgtagcaccatcttgtagcagtgaagccctagacatagtctagacgtccatcaatagggtgatggataaaaacattgtgatacagtcttaacatataaaaactaaaaagcaaaactcagatctccacatcaacagggacggatttagtagcatgctgaagctagctcatgagaactaaatgctaacatttcagttttgtgagctggctgatgttacttctatagcttggtataagctatgttaagagtatttacaacatggaaattagcaaaagctacatatcattccctccccacaaaagctggttgttaaacatttactagcacgtcactggacagacttcaaaaaaacagttaaagacatgtttcaggggagaggaaagtttcagtgatgcaagatgaattagttgaagagatctacatagcatcgtattaatacacagtcaacagtgctgtattatacactttaaaatttattaaagatgagagtttgtgttaaatgttttcaccatacatgcacatatcccaaaataaagggacacaaggaaacttttggagcttatagttatgtctgttaacttgactgtggtgatggctccatggatgtaggcatatgtccaaactcatccaactgtatgcattaaatatgtgcagtttattgtgtgccagttatatacctcaataaagctctttttagaaaaaaggcaagttgcaggatgaaaacagtatgatagcacatacctaaagtttaaagaacatgttgagacatgtaatatttgtaatactaataagatatagtctagaaggacagataccaacttgtgataatcattatctctggagaggggccacgtaataggtgtggtaaaggggaaaagggggcttaggttttttaatctgttatgttctatttacttaaaaatatttgaagccaaaacaatgcactaatgttgttcatttctgggtggtaaatataaaatgcttactctcctctttgtctattatttaaatttcaaaataaaagaggcaaaatgaaatgagagtcaaagaaaatttgctcatcacttttcattgcctgttgatgagagtctgcaggaatcccactgctggtagagacgtaaaatgatgcagccactgtaaaagctagttttgtggttcctcaaaaaatcaacatagaattaccatatgacccacccattccattcttagtcatatacccaagagattgaagagcatatgttcaaacaaagtgtttgtttgaacacacacctgtgttgtacacagttgttcatggtattatttgtagtgttgtttataatagtaaaaaggtgggaacaacccaaatgtccctcaactgctggggaatggataaagaaaatgtggttcacaactactaggttgggaagaatgaaaatataacaagtgttgaggatgtggaaatattggaacgctgctacattactgttggaaatgaacaatagtacagccactctggaaaatactctgacggttcctcaaaaagttagacataaagcaaccatatgacccagaaatttcaccccttagtgtaacttaagagaaatatgcatagtcaaaaaaactctgtacacatgttcctcaacttatgatgaggttacaacctgatgataaacccattgtaagctgaaaatctcataagttgaaaatgcataatacacctaacctaccaaacatcatagcttaacctaacataacttaaacatgctcagaacacttatattagcctactgttaggcaaaatcatctaacacaagcttgtccaacccatggcctgagggctgcatgcagcccaggaacagctttgaatgcagctcaacacaaagttgtaaattttgttaaaacattatgagacttttttgtgattttttttttagctcatcagccatcattagtgttagtgtattttatatgtggcccaagacaattcttcttcttccaatgtggcccagggaagccagaagattagacacccctggtctaagacaaagcctattttatagtaaagtattgaatatctcatgtaatttattgactattgttctgaaagtgaaaagcagaatggtcatatgggtactcgaagtatggtttctactgaatgcatatcatttttacaccactataaagttgaaaaatcataagttaagccatcataagtcagggactgtctgtacatgaatattaatagcagcattattctttacagccaaaatgtggaagcaatctgaatgtgcgtgaattgaatgaatcaatgaaatgtggtgtaacattcgaatgcattatacaaccatcgttagggctgaataatgtacaacagaatattattcagccattaaaggaatgaaggactgattcatgctacaacatgggtggactttgaaaaccttattccaagtgaaagaagccagtaacaaaagatcacatgttgtattcattagtttatatgaaatatccagaataggcaaatcgagacagccaaaaagcagattaatggttgtcaggggctgggaggacaggggatggggagtgactacttaactggtacagaatttcctgttctggaattaggtagtgatggtggttacacaatattgtgaatgtaccaaaagtcatgaattgtatgcttttaaatggctaaaatgatgaattttatgttatataaattttacctcaataaaaaaagttatttaactatgacatattaaatgatactgattctagagagactgcattgtaagaaaagatgtgtctcagggttgataaaatgttatatatttgatgacacagaaatctggagcttctggcc

SEQ ID NO: 4037 - DNA, 10781 bp, Homo sapiens
acccaccccgccctcccagcggcgcgcgcccgccgaggtaggtgtcagagagccgaattcgaattatttgcgacgcccggacggagtttcgtatcttcggacgagaaaagtgcgatgggagtgcaaagcctcccctgctcgaagcagcaggcgcgccggtgtcacgggagccgaggagcggtggccgtggctgtggagtcggtgctcgaggcgtcctcccaggtgggagaggtggcggccttgcctgggcgccctgggggctctggaacagagggaaaagtagtttacggaacgtgaacttgtttgagggttctttcaaaactctcaagtgtcccgccgcacactaggatatagcagtgcacgggattaggagcagggttactaaattttcaagcagttgaccccagcccgcctttcctgggaccttggttaggtcatctgctgccaccatggtgtctgctgggatacggtttattcattcaataaatgtttggtgcctgccagttccgcggctcaccatgtgcccaggtgagccgaggcggccaggtaatcaggctaagacgtgagcagtgtcttggatgggacacaggcctacgtcccggaaagcccagatatgcaaagtccacaaactgtcttccaactttttctttgacttcttaacagagcccatgaaacttaagatgtttgatggagaaggagaaaaaagaaaagtctacctataaatggaaacacatttaacagtccccaggggtatggggcggctgataccaccagaggccttgagcaaacttgtatcattttaagttagctttgaaaataaaaagacactgttagccattcaaccggatgactgaaattccccccttttccccagtttgctccacttcgagtaagaaaaggtgtgacagatgaagatgccacatattatttttcttggccccttcaggtacactgctgcccccattgtacaaggcctcttttttatgaatctgaaaagacaacagagggcgattcaaagtcaccaaacaacacttggaattaagaacaggaagcgcagcctagacaccgtcctgccctgggctgctgcagacccctgactttcttgaacttggctgaaaagttggggccaggtttttgtcacactcctgatcatggatggcctctcttccacacaaaaatacaccttattttgaaaatgctcaaaggaactatcctaggttgatgcttttcacctaaccaaagatgcataaaaatattgtgcagatacacctgaatgtgctcataggagaactcagcagtaaggcctcagaatcgatgattcctaggctgcctgtactagtgatagtgaggctcactaccatccaccacctaaattagaaccgcttgatgacacagcacaggttctatatctttagatggtaaattaaaaattcctggctgaatttgattgattgtcatttttaaaaattgttaaagacttgtaagagggaagaataggccagacatttttgttatgctccatttgttcaaaagcatcttccttcctgcttctactgtggcaaagcacagatacattgtctttaagaggtacaaggtaaatagtaacaaatacaacctagatacttatgccaggagctacaaagttatacaatgaatataatgaagagcctccttatttggaaatctctgagctccattaccaccttccccttttagataaacatcacacctgaactttaaaaggagtgaaactgccccatgtcatatactaacatgcgtcctaggcaaggcacaattgggactattgtcctagaaatgggtaacgcaagatcaggctttactcctttcagctctcaatctatgaggccactcttcaaaacaaaaattttttaagtgtaggtttcacctatattttattatgactaactactgatggataaataaagcattcactttgtaaataaatgacagcaggtggaatcatgggtttacaggtaagcaaatgacacccagagtgctgaaacacaagctggtttgtggtcagctaggctgtctgttttcactccacacaaagtgaaagaagagattttactgagcttttggcctcaaatttgacctcttgaggccctaaaagttgtgatttttttttttcaagtcttttagttttggaggctaccatgtgtgaccttttcatatgagttagtaatttaattgatcattactgttttaagtacctagtttatgctttgaaagtggggcaatctattggcataactcttggaacagtccagatgagagagctttccaatggaaggggcccctcgtctggctcaggaagagaagggagttatggagatttcagggagggacaaagggcagaatatcttgggtataaaatgcccaaggaaagcacagatctctggctcaggagacttgcttcatgcccaagccagccagttgagatcataacacatccctaacctaaaacactaggtcacctaacgaaaaaacttgtttaaacagatggtgtcacacactacatggagatatggcctcgaaacatttctttccaacattccatatttgacaacaatgaacaacgtcccacatcagggtttgaattctgtggtcttgtcagcttcgtggtgataaaggcagtttgtgttccttggcccctgggtatcctcctttctgagtaagaatgccttgtctaccttttgaagcagtggacttgctacagcttagaatcttgaaaatactgttctgcttaatgctgtcactcagtttttggacaagaatgttatccttggcctttcattagttggggtcattttaagttgtcttccaagagcccagagcaaatgtaattataatattattttaatagcctaggaaacaataaataggtttccactgaaacagaaactttagctgtaaggttttaataatagtatttagcacttccacagtgtttcctgtcttcaaagcacgttctgcactttaattagctagaatgactgaaactgctattgcaaatgaatatcaaagcctatgtcatgcagatgatgaaagcaggaattgtaaaaagcatttcctagtctcagttaatccttgtaagaaggctctattactttagaccataaaagttcttagaaatcgaatgtagtgattatctaggacatttttttttcttgtcatattcactagttagtaactccaaccataaagtaaccctaaacttgtattcaaaactaaacatgatataaaacttcatttcagaagacttgaagtcaattactgaagaattaactacatggccatatgacattttcctatttattatccatcaactcattttaaaatgatctgtttttaattcagaacatactctaattcaaacagaatgtggacgtacattggccagtgtatttggacccaatttcttgagccagtggctttgagatgctgttcaaacatctacttaaaagcatggcacataatatgagggcaaagaggacgttttgcagcccttcttgatctttcctgactctctgatggggaggcaccatctgtgagagaggcttcctggtctctgtggacagacgcccaattccccaggccatcagtgcctttctcaccacatccccatgagccccagcgtgggcaggaatggacttttaacaaaaccaccatctacctcaagaagggggaagctaacaaaaagagatgacatgtattactttgttccttttagaagcctaaatgatatgatgcacatgttacccttcattgaagattctaggtggacacacaacttggatatcaacagggagcagaaaacaaacccactagcaggaccaaaaggcagacccatcagcagaacacaggcggcagcttccacaagtaactccaaaactgaaagtcaaatccaggagaagactgaggaagctccattttctttgagcacttaattgtaaattaagatttgctgatgatgatgggctaatttaagctaccgtggaaagagggaagaaatggaagctgctgatcgtaggaagcagtacctgtactgcgcagggttgcagtgacctaacaccaagaaataaaaactctggaaaactagcccttcacatatggaaggtatgattacccccgggtatgggagcccctgggagaactttcactgggtccatgggtttaacctgaggtgagaaagcagcagtcacccaggaaggtggttgactttcaagagcacttggcaacagtgagggaaggcacatggggagttgcgggatgatgtcagcatgtagtaagaggggaactctgaaatgtccaaggccagcccaagcaaacggcgctatctccacgtggtgccctggtctggagagggaaggaagaaggctaggctatgttttgccaagccaagacttatcacagaggaagctttcctcaatcccttccactggtagcaaaggccctggatccctgtcttctgccaagatggtgccaaatagctcaaccatacaaaggaaatggatataaaacttaattgggacccagagacatctaatctctaagttaaagcaccactccttttactcataaccattggaggcatcccaaagtctagaaaagccgaaatgaccctcaattcatattctggtgttatttaacccacgcctctgggaggcgctcaagaacaggataatttaatgtcattctcagcctgaaaagttccttagttttcttttaattaaatcagtaattattttaaatgcatcatttcaacaagataccataagttagttgaatgaatgcatgtaaaaccaaaatgttgactggcataatccccaaatcgaattaatattttaatcttaggtataacatactttatatttcatacctggcacgttcttaaatgtgttaaatgtgttttccacaacttggcataactatacatccactcagtttattgggtggggaggcagagaagagaactttgtttaaaaacaaaacaaaacagaacaaaaaactatgactaaaggatagaactctacagcagacatttagtttctacaattgatgccaaaggtagaagagattttgagaggaaaaaaaaaaatagatggataatttctaaaacatgtaaagcaaaacagcaaatatgcaaatgcaagggaaaaaatacacaactagcagcatgaaaaccccagggaaacaaacaagaacatcattgtaattgatagtaattgaacccctgcttaaccttcctcccaatacctgataattctgtgaaatcacccagctgtcacgcttgtccttttagaaacatgacattgatttgtctagcaaagacccatcattagaattctgaggtctgcttaatggggccactaataaatctaagtcatcaattcttgaccttttgtttcctgaaattctcggtatgtggtaaactgctgaaaacacattttcaaggtctgtgactgtaacatgaaaaataaaggatcaaggctgcgctttgaaggtctgatcatatctgggctctgccctgcctgcacccccgagggaaaataagtaagatggattcggaacagcatctgggggtcatatcaataccctcttttgggctgagctatttgcaaataaaaatggactgtgtaagactgaactacaaagggagatgtgccaaggagccattgccccttcttctgcctctccatgttcccttcttcccccatctgcctggctttttactgcactgagagatcaggaaaaattccagccaagagagtctaaactggctatgcacacgaggaaaaagagagagagagagattatctagtctcagttttggtgactttgaaataaaaggtttgggttggggagggtcagcttttttttcaaggaacagaatcatggaaattttttctttttctgtaaaagcgaaatgcttctcaaccttattttttgctggctggattgagctggttgtaacctaagacaaaatgtgggcaggtgccttcagcttcctctaaattctaagatggctgcaggcaccagattctgacagtgatgttgctgagagtctagccataaagatatctttccacacggttctctctccacgtctgcctagaaggactagcctgctgcttcatttcccccctcctctgcagccgatttcagatggctgcagcagagaaagcgagacccccacaccttgtttgtgtgtacccttccttccgcacccctctgagtgcatttgggctgtgttggggtaacatcaggacaggtggttggctgagctgatcctctcaaatattcaggcaaactggttgtttatagacaaaacatccagatgctttttcacgattgaacttttgaccaaattgattgtatgctttggtgtcaagaagacaaaaacccaagtcaaaaaggtccccagaacaggacatctgcaggcaatgaatagtaggaagaattacatatttctagcagtgaaaaatgtgagttttttagattgtgctaaatgactcgatattgaccagagcaaagctacaagtgaaagaatggatctttttaaggttatattgttcccatttatttggctttgtgctgccagaaagtggcttggaggcttgctttttagtgctctgtaaaatgtaaatggtctaaattaagaagctatctaatctcaaacaatattaattgtgacatgaaaaatgagaccaattcttccgacgttacaatcaccaccacctcacattaactgatcacctcactgtgtttctcaaaagcctgcatattttccttttccaaagtgcctatttttaagaggagacaaaaatcctcaaatactttacttattctgatgctgaaaatgtggtctcctgaagtgggcttcctttggcctccaggctctgcaaacctctacatctgatttgtctccctcccccccccacccgcacccccaccaccaccgctgcctctgcattaaaactctttctaaaataaaaccactaagcagccacgcggtcataagccaggatgctgctcctgcatctccctccttccagacagaactgccggaccctaatgttgctttccagaaggaatagggggaaaatgcattttcacatattttttaagtgtttttccctaaatgggcccattaaaatcagccagatcactgttcctccatctctgtagcaggcagaatcaccacgcatggagataggagcaaatttgtatttccagttggctctgatggggagattgcagttgttctagggaaaggcgatctctatccctgcagtactgcctcacaatttcaagaccactgcctcctcccataagattctgcagatgttgcactttgcttgttaaacctcttgctaaatgtaagaagtaaagttgttttacttgtaaatgtccgtaattcacctactgcaaagccctaagtccttgctgtttcattaccagctgcccattaataaccatcaaattagaagtgtctctagcagcatgacaatttagtgaggggaataagaacagaaaatcacaaattgttcagaaaagttgctgcatagcaggcctcctggggccggggcccgatgccccttggtgtttagttcaaggccatggggctctcttgggtgacatcacttctaacatagatactgtgtaattcagttacacaaaagcagcccagacaagcaggctcacatcatctcttgtgctctgcgtaagtctgcaccagaggctctcaacacagcctgcacttcctgttgcatgccaggaaagggccctaaaaccaaggagggaggtgaaaggaaacacaaaataatgcaccttctttgtttttgttttttttccgccctctctgctcccttcatctctaaggactccacagctaacctggactcattttgttacttcccattcccaggaagaaaggctttttccagctgtgagagtctagggttcacttatatctctttctaaacactagcagcccagaattctcaggccacttttgggcattgtggcaacacaataggtgcctcctgtggaccccatgcctccaatcagagcagggattaccggcaaggccgggaggtgggaagtcagtgacagcgccgttctctcgttcttgcttgagctgactgtagcctcttaacatctggtgctccaactctttccccattcctaaaacacggctggcttctgcccatcagagcatcagtcctgggcttcctgggctctgtccctttatcctgctctgaagcccttaagtgtccatttcaacctcacacttagcacctgactttaaagaaaaacatccttttcaacaataaggtatgtgaccacttgaaacccctccaaggctttcaaagctggtggagcagagcacaactaggagaaccagccctggggttaaaatctcacggaaggaaagggggaagctagcatgtagcaggtggctcctttgggccatcctattcaccatttgcccctggctgactagtcctgggcccccacagaataggccactggtgcacaggctcagggaagggcttctctccccctctccaactgcatctgtcatttggcagtgacagccgctttgcactctgtaccttggcagctcacatctctttcagagccccctcctttccccccaccacgagcctcctctgtaaaaaccggaaaaaaaaaatcttgttctttcatcataattaaagtgctgtcagggaaaatggcatggctgagttttgctgctgttgaaatgaccctcctcctccactcctcttcgcttctctcatttgctaaagtggtcctttctctgcctgaaatcaggccctttggtgatggaaattttagcttaaagcagagttctaagcagaatcctaaccctgcgagggtggggagaaaatcaatgttttgagctggtgtctgtttgcagcgaggtgctggtgaggccattttcatcaggaggaacggtggtggtggctacttctgggctttagatccacgcaaggtctcctaaatacaagtcactgtcatggtacacaatttagcaaaacttggaggctgattttccccgttgacttagctaagggtcaggaggaagctgtttagaagtacagaggttctgcatctgggagggtaaaatccaaacgcctctcatgctcagagggaaagcatgcctgcatgtttactatcactgctggcctacgtgcttgtgtgtctgaaataaaactgtaacttatataattcgatgctctcctcctcactgagtgttactgagtcatgcttgggtgggggggtacttcttgtgcgttgtggacaccgcatcatgtaggggtctttttaacacctcatatcattttgtgacaatgtcattctaatcctgttagccattacagaactttctgaaaataatttcaggtgggtgacattaaaaaaataaaaacccgcccctctgagtgactttgaactctgccattagaatccatgacatctattcaaatacacattatgggagggactcataatattcatcccagctgtcacctacttacattataaggaaactcgagtgttaggagctttcaaaattagtttaatttccttttcctaaagatcacgcatctcagaaaggccccttttaacttacactggggaacttaattggcaggcttttgggtttctataagagtattgctaatatctggcaagtcaagatggcaatctgggccgccctcaatggaatcattagctgttaatacacctctgagtaactctaagctaaggtgtgaaatcaacccaagcgccactaagccccagtttttcctaaggatataaccgcaggacagttgggggggctgtttatgtaacatacaaacaacaaggttgttttgctgctggcttatttgctggcctggactcctgcctccttgctccttcccccatgcccttcacattatatttcttttttaaagaaagtaaagcaaccgtatagtactcaagcctcttttatttcctgactgttgtatgtgtcatagccgtggacgctggagaaaaacatggggcttgtcattatcgaccggagccggaatgagtcaggcaccctgaaggctacgatctgaacctgactgccactgaatggggtggggggggcaccccgctgccaggcagaataacactaagcactatgctgctacttggagatctggtgtgaggggtccacgtgtcctggggtcacagtggaagaaagtcaactcattgcttagagggctgctaggcagccatagacttgggttgggaaaacagggtatggggctggaactagaagtggggagggggtgactgcccaaatgctctcccctgttccccccaatgcctcttgttagaatgctactcttaggaaccccactattaaaaatgtgactctctgggcttttgggcctctaaagctctttatgaaaatgcacatgtcccttacgagtagcctcatcagcctttgccagctaatgggattaactgaagagaacacagccacctgcagggaggtaaggaggcctggggccaaatcacttttcagatgtgccatgtgctcatccacgatcacccagaacacaaaattcaggcattcttgtttcggtggcaatttttaagaagccacaacttaataattctataaatctcaatcatattcactatggagcaaagttcacctgagagttctttcagttcagtcatccagacaaccttcc

SEQ ID NO: 4038 - DNA, 12821 bp, Homo sapiens
ctctattatctcggcttctcgggaggagcctcatctagtcagtcacgcagaagtttctctttcgctcttcgcgctacacacccagattggcttccagcgcgcaggcgagtggggcgaaggaggggggacaggagtcccggaagggccgtccggcgttcacacccacccctgttccgctcctcccgccccaaacaaagtcccccgactctaggtccaggatacgttacctgcccggcgctcccggcccctcggtcaccgcatcccccgctgggcgcgcctggtacgggtcccgctccccggggctcacaaagtggtcgcccctggctgggcggctgggtagatgcccctctctggacatgttggggcggtttttggggtggagggaacgcgggaagtgaaagcggaggctgggacaaggggaacttactgataaaatggaaaaaaaaaaagcccacagggcccaggtcctggccgggggcgaaagaggcctgttacctttcggggggtcgcggccgaccaagaagggagccggggagtcgcccgcccccctcccccggcccccggcccccggcccccggcggctgcggcagctgcacacagaagcccattgtcgccggcgtccggcgcgcagccccgcggactcggccccgcggccaagcgcgtcagcggccccgtcagccgggccgggctccgtgacgcgcgcgcagcccgcgctataaataacctgccgccgggcggctcgggcggctttccagtgacgctggggcggaggcgcggtaggaggagggcgaaaggaaacaataaaaccgcccggcagcctcccaagtctccctcctcccttcccaggccgcccgcggcccttcgcgtcgagctcctttttccccgccccggcccgccctgcggggagcgcggttcgcgggtgggaaggagcccggcgtgctggcgtccccgagtgctgccggggccccggggcgggagggggtttttcccgcaccctgggatggcgaggagggaacttggcgacaagtttagtgaggggatcgctgtgttcctttctagtccagttaaaatgacccgagcttttcccgctccctcacacacctattctagtacaggtcggatgtgtttttggggtagtaagtcctcaaccgaaaacaaaagcgaaaaacctgtcgtcttcaacgtaagcattatctaggtttttgtggggccaggcttgcattagtgttttcattcggggggttgtattatagaaagggtgccccgtagtagcagcgtgaggaagggttccaggacccaggctgtcagctccggtgcatttacaggtctttttgccgtagaatttagcataggcctgaaacatggcataaatgaactttctaaaagtctataatctcaacgttaaagagcttactttttaactctggactttaataaaggctcccactttaaaaggggctttctctataggaaagtattaatatttttgtggagactctcactgctaccttccatactcaggcaattctgtcacacaccctgacacttgtcctactcattaaggtacccacatacaactggaggtaatctgttttcttggaccaacaattaatagactataaaactgtatttcgtcttgagcaaaatgtctcagctatgaacatgttttctgaggttctgatatagacatagataaaaatttgcagatgcaagcaaggtgttgcagtgacttggcatggttagagtgagttactagtgttgggggaaatggttcttagttcactagtgaggcaaagtggtatagtagaaggttctctgagctggggtttagaagataaagaaatttgagttttaattatgtcttcactgtacttttctgtgccaccttgcagaaaccacggcctttctctgccgcactttcttcattaacattaaggactgatagttccttttctacccttacattctaggatgttaaaggatattgtgtccagggataaagttttatcaaataaacataagcacccagtgtctcatgggagacaggtaacaaatgtagattaatttggtgttctgacattttaaaattttgtacatcttaaaatatattagggccacttcaggaaaataatgaattaaaatataccattaaaactattttaagaggaaaaactagtcacagtctgcctcatttacaggacagcagacatatttacagtctaatgatgtcacaggccctttccaacaccacgttttctcatgtgagcaaatggattatgggtagcaaaatgcaatgagatcactttctccaattttgctcccatttctggtttgtgtggtttttaaaaggaatgtttccgttgaaagacactgaattgtttatcactaagtggtgttattgagacaagggaaagttttctgatttatcagtcagaatatgctttattcttctttcttcaggttggtgaatcagaaaacataaaagtggcaaaataagtttagagccaaaacatttgcttcatatagtcaccgccaaagtgtgatcacaactaaaagttaaccaatatttttccagttccaaaagcacatctgtctctctttcccataaaatgtttgatatgtctaatttaacttagccttaaggttctttcttctgctccttataaagaggtatttttctttcactgctattttcctgaaacactgagcttctctcataattttaaattaaagcccttttgcttacttcttatccctttttaacgtgatgttccattttccattatccctgcccttaaaaatttaataggatgagaactagcatatattggcgaaatttgaaacatgcccgattttagaggggagggaggaaacaagattagctttagaaccagtagaaatacagtaaaacaaccagtttcctcaaaactaacaaaaacaaaaaaatcataacgaaattcgtgaaataggggactgaaaatacggaaaatattttatctggatctcattgataacataaagcttgttacaatttttcaaacatagtgaatgttttagaatgtgaacatttcccaatcttctgaagtttctgtctacctgaggttaaatcctttgaaagactcctctacagcaacagtattgaagaatttattagagaaactacagtgaactcttgccttattactcagttaatcctgatctatatttagagagtggtgccagccaggttgaggcttcaaaggaatgagcacaaatatttaccatatcctgtgcagtagagttttggtgattgaaatgaaaattcatcttggaaaatatcactgaagttatagtataagcaaatctcagcaaccttcaaatgaataaatagaaggttaacaagaaaagtgatgagggattctcagtattccaaatgaaagaaaagagacaactcagatttagaggtaggagccttcttcatttaaaaggccaagaaattcaggcagacagtgtcttaaaaataagggtgactaaattcaggaaaattacagggctcccaacattagttaaaaatgtggacatatacgcacataaccggcccttctgatgaggctgtcctgattttaatgggtaatgcctcaagctgcccagactttggtatcctcccattgatgggagccactgcaaacaactttgttgttctagtataaattatcaacctccaactaggatttgttaactatgaattttttaaaatcctctgtgtgggtttagggtcctagacttgtttgccctcggtttcattcctggttcttctttcccctcctctggtccatatcacagggacactaatccctgcaagctgcatttccaagcttccttgtgagctggttgccagctgggtttgaatgggaagctggaggaggacagtggagagctggagggtaggaaaagctagggtgttccccaccacactgccacactccagctccggccaagtgatccatgacctctgaccctgtgccccggtatcacagcctctttcctttattcttccattttggagtcacagtgccttcatccttttgaaaaataactgtcccttttttggtttcttagctctgttctcacctgttttacaaatttattgaattaaattctccctatgttaaatactcagagcagtttctgttttcctggttggagcctgaatccatatatccctttgacaggcattactggaccgtatacacggaaaattcgattattccttgaatttcttttgctaggaattcttttttaaaatgtgctacttagaagtgctaataaagggttcagtcctcagaaaagcaggataaaacctagtacactttaaaaaatcaatttcctgtgggcataatattaaaaattataaacacaaaatattacataacttctcgtaagtcagaacagggcaaatacatagctgaggctgagacataaattccatgccaataagaagggtggcatataatacctgtcaaggcttaatttacatcacacatttgtgaggcctactcattcactagcttgtttgccaatggtctccgcctcctcagatcttaaacgagagaaggagagagagaaagaagaagacacttacattactaatttgaaactttattatatatgtgattccttggaataatattttgaaatctacatcatgtctgtatttttcttttccctgtattttctgctattgcttctctcctccctctccacccctgtaagcagatctcctactgggtgttcattgtcccaagaagaggtaaaaggaaatgcaaacaaaaatgatctatgagtatttatggctttgttttataaaatcctaaattcttaagaaaaagaatccagagtatctggaagaagcttcaaaggggaaaatatttttctgaaactgttaaaaggattcccgtgggcacatacaaggggagagagacagaacgattaggtttcctgagggagaaacaaggaactagaagctgatactggggaagtagcccaagtaagaagaggccagggtacacttggcaaaggaatcccaagaggttgtggttttagcatccaggtgtgtcacgggagacaaatcatcacacaaatactacctagaccttactcatctgtactagagattgcactagttcttctttccattgaccggtcttcaccctagggagccaaagtgactggtcaagacttgtacaggagccaccaggagggatctctgtatttctttgttctctgtacttgaacaaatgtaaattgccaccacagggcacaagcctgctggagaacagagccaacacagagaaaatggatccaggagatgaagatggagaaactgggtgctgaagacctttgagctgtttttggagctagactgatcactggactttcaaatcatatgagtaaaacctggctgtgccctgttgaaatcaattctgttgcagtcatatgcggtggaatctgttcttcttttgcatcctacgtaaccagaccaagctgtggggtgagtgcttttcttgttctccagtgccattttcagacctgttgtcttcctgcatccttccaaaccccaggctctgttaaagttgtgccatcagagttttttgggtttctgtaaagatgagatctcactatgttgtccaggctggtcttgaactcctggcctcaagcagtcctcctgccttggactcccaaagtgctgagattacagacatgagccatcacacctggccctgtgccatcagactttggcacctattccccttccttgttgctgtcatctagagaattcagttaactttattctttgataaatttagcacctggctcattggggcttttttcattattattctgatgttattctcactcacttccttctttctgacttcaatgcccactcaaatattacatctaataccttagactccagtttccagatcctcccaccttacaatagaatgatataattcttcaccgaccatcagctatccactcctgtctaaggtcatacttctgaccttgtaatcatcaataagtccatcatctccagtatctctagtaccagcatcccattctttgactattgtcttctatcctaaaagctcactaaaccaagaatatctatacaaacaatatcttgcctttattaagactctctaatctggtgagtttatgactgaatcactatcaatctgtcctcttcaggtactcccttccttattcactcaccttagactctgtaatacattattaagccactgtttgataacacccttcactcccttgcctctgccaccctccttcaccttagccgagctgcaaccctcttatacccaatggtccccatgcaacaacacaactgaacactggtgaagacaaaaacgtatgcttgctagcatcactttaaattctggctataaatctcaagtgggtagtcaagagcagtattattaaacctgtaggacttttgcattcccactttccaaaatgataatttcacctcatgtcttaactccttaaatctcctgacccattttactgttcatagtctcagcttataacattgcttcataaatcattgagaaaatagaagtagtttgacaagaattccctcacctttccaatcaaatattatctatcctcctcactctatacctattttctgcctgctcaatttattgtagagcaactgtctctgctgctgtcactggtacactctctggttttactctggaattcatgcccccctcaccttattaaaggttttgtttctcaattctctgctcattcttccctgaatcatcacttctttcctcaatcactcccattgtcatataccagttctaataattcctttcttacacacacacaaacacactgacaactaaaacaataataatagcaaaaagagcagcaaaaagaccttcacttcaccttccatccttttccagcggtctcctgtgtctcagcttaaatgttttcccagggggtcttcctcgtccacccatttaaaagtagcagctcagttattttttatcatattattcaatttgaagtctcttcattgcatttatcactctcttatgtgtgtatatgttaatgtttgtttactgtttttctccacctccccccatattacataagctctgggagtgcaagtgtcttctgtcttttcatgtctgtaatctcagcacacatgataggcgaagaaagtcctcaataataatctttgagtgagtgaacgaatgaatgaatgaatgactctgtgtgtgtgtgtgtgtgtgtgtgtgtgtgtgtgtgtgtgtgtgtgtctacaactagaccataggattcaccagggcaaggactttgtgtcttataagtctttgtagttggtgtttaataaacacttgttgcatgagtgagtgaatcattgctctaaatgagcaataatctaaagataaaagttattaacatgatgttccgcttttaaaatttgcattggcatttttactttaacaaaatcaaaatgatttcttttaggattatactaattccttttaaactagtgctaatttgtgtgacttatccatatgcatctaaattaatttttctaactttaactagagcttataaataaataagtatacatatatgtatgtagatggatggctatatatacacctacccacacatatataaaacatatgttagtcctgttctaaggatctgccaaactttcttggtaagacttgccaattgcaatcatgtgacaggatgacagttctcttctctgggagaagtccagacttccagtgtctgggacagaaataatgtagaccaagaaacatatatagctgatgatggatgatttttggctctcataatgtgaggtttggtcttcttattgggagactatgaaaatcattagatcagaaattatttttatttctactcagttgaaagaagttttccttctagtatttctgtatgcaggcatactgcaaagacaatttgcttggtcaatatgggtttatactaaactctacaactcaaagataggatgagatccttttgccagtgtagctgtcttatttttattggcatagtgactgtgtgtccaaatatacaccaattatagatgttttcctgttgtcagtaatatggtactgtttaagagtgaagacgttttcactctcaggcaaaactgattctgaggacatgacagggatacttcagtgattgcatttatgcgcacagaggaggttaacagttaggaatgctttcagtggtaagcaacaaaataattagcagtgcttcaacaaattggggctcagtggctcaatgacataaagagtgccatctttgcaattccaatgaccttcctgtcaaagtcgaatgatggctgcagtgcaaaagtgtgctagaagcaggaggtggtgtggacaggtgagtttctctttttgcttatattctcttatcaaggagataaaaacacttatcctccaacaaactcctccaacaaacttccctttacatcttattgcctcttaatttgtcccatgacagttcctagaccagctgccgaagctacctttcctgagaactaaaatccttgcctgatttctgaacaaatggggcctccacttgaaagagtggatagaggaatggtttttgtgatggcaaggaatagagcctgccacagcgggctaacaaccacactcatgaagtttcatggaggagatcttgcttatgttgaattcaacagaagccgacaggtaatacagttgagaaaggttgaaaaggcagagagagagagctgcttctgcaagtgtattgaacaatcaaaggcaaataattcgttacagctgggcattctgtacatgtagattagtgagagatgactgcagaggtcagcagacctcgtgccataaagacaacatggaagcagggagtcaagttctcatacctttgggcattcattctgaaattgctaaagaagcaaataaatgtctgtctgggctttcccgccatacatgactgagaatatccagacatttctctatattaaagaaaaaggagagagcagtcattacttagaatgtctttttgtgcttgcgcgcacgtgctctctctctctctctctccccctagctaaaccttggctggggagttttctgcattttgctaagctagattgtactcaatgggttatagagccccagaagatttttcagctacacttcgcccactaaaacctttggagaaaagaggctgaatgcttgcagtgaaactagtcctgctaccctaatcattgttgatcaggccaagaaaccagtacctgaacccaaatttgtcccagtaagaactcaccatattgggtaaagacaaaccaacaaaattagatctcctcaccttgagaagggaaactgaatgagagatgtatgctagaaatgtcagtagcagaagcaacgtgcagaggaggaaggagagagggcagaggaggaaggagagagggcagagggaaagagctagagagaaaaagaaaaagaggaaagtgaacaacagctgggctctggaaattaacataataagtctctggctattggaaactgaggaggaaaaaagaacacagaaagtgtcaatcaactctcagacaattctttagtgacatggaccatattatcatgattatcttcagttcataggaatcattaaatctattcccaaaatgcaatctaatattctcccaaggaatataatatattcaaataaaattattgacaaaggttacaatcgtaaattatttatcaggttgaattactccccaccttccagggaagtctcaggttgaggtctttggaaatagtcatgccactgtttcctctttgagtttatggttaatggcacagagagaagtcttttcttccctgggtagttctgagtaagaaaacaatagtcaaacttgaatgtaatcactgaggcaacaagagaaagaaaagtaatgtttagttaacagaactgcagaccggaagagacaggattcatggatctgccaaggtgaggaatacagcctgaaatgcaaatagaagcagattggagaacaggaaagaaacttctggagaaagcaggcaaagggacctgttccaatggaagcacactttatgtctcccagaatagtagttccccatcctggcttcctgtcagaattacctgcagttcgtttcaaaaaaaacacatttccagaacttgctcaattcctgctgaatcaaaatatgactttttatgcagctggcctgtcacctacacatgatgaactttttcctgtccagaggaaaatatccatgatgatggcaaaagtcctttcttgagagctgtcttttattctcggactaaggtcatcttaattttttattataatattcttccttttatgaaattgttatgacaaaacatgatgaggttttttttaatgttcttacttagcaaaataaaaattagcaaaactattgctaggtctatgaccttggatggttcaccaaaatcaccatcactagttcctgattttaaaatcagagtagtaaaacctggctgggcacggtggctcacacctgtaatccaagcactttgggaagccaaggcaggtggatcgcctaaggtcaggagttgggagactagcctggcctaacacggtgaaaccctgtctctactaaaaatataaaaagtagcctggcgtggtggcgagcacctgtaatcccagctactccggaggctgaggcaggagaatcacttgaacccgggaggcagaggttgcagtgagccgagatcgtgccattgcactccagcctgggtaacaagagcgaaactccgtctcaaaaaaaaaaaaaaaaaaaaaaaaaaaaaagagtagtaaaacttaacagcattgttttgtgtagattataggaaataacatgtataatacaactggtacataagaaacacccaatatgttctctatgttatcaggtaaaatactttggtttgactcttgttactcaaatgataggatgatttactgtttcaggtaagtgaaacgtcttgacattgtgattggcgtccagtctccttcaaacaggactctgcttttctatgattctttctgttgtcccttccactatgttttgtatttgcctctggtctagcttctcaaggtagcctccaggatgcacagagtgagagaggatgcttttccctaaaccaggaacaaaattccagccctaaggagattggaccactcccgaccaatgagtttggccagggaggtcatgcactgattggctcagccctggatcagtctacttctcaaccaatcaaggtgctaaggaaacaggattaccctaaacgatttaacacaccgggactcattcctgaagctggagatgctgtaacacaatcaaaactgtaaggcttaaaagaattaaagtaggaattgccgcaattcccttcctagacttattcccaaatatacttactatggactacctgcatacagcagccccttcacatatttttactgcctgtcataaagtagtctgggttacatttaaagaagctgccagcacttaatgcatagaagtactaaaaatttgttactgatgtttgaaaaatatagaaaattagaagcggaatggctgagtgtagtggcttacacctgcagtccctacatgttaggaggccaaggcaggaagactgcttgaggccaggagtttgagacttgggcagcatagcaaggctttgtctctacgaaaaattgaataaatggataaataataaaagaaaaggaaagaataaagaaaattagaaggggaagaagcctcttatcccaccagagagtgtaaatgattattaaaatttaatgtagctctccctctccctctccctctccctctccctctcccgctccgtctccctctccgtctccctctccctccacggtctccctctgatgctgagccaaagctggacggtactgctgccatctcggctcactgcaacctccctgcctgattctcctgcctcagcctgccgagtgcctgcgattgcaggcacgcgccgccacgcctgactggttttcgtttttttttggtggagacggggtttcgctgtgttggccgggctggtctccagctcctaaccgcgagtgatccgccagcctcggcctcccgaggtgccgggattgcagatggagtctcgttcactcagtgctcaatggtgcccaggctggagtgcagtggtgtgatctcagctcagtacaacctacacctcccagccgcctgccttggcctcccaaagagccgagattgcagcctctgcccggccgccaccccgtctggaaagtgaggagcgtctctgcctggccgcccatcgtctgggatatgaggagcccctctgcctggctgcccagtctggaaagtgaggagcgtctctgcccggccgccatcccatctaggaagcgaggagcgcctcttccccgccaccatcccatctaggaagtgaggagcgtctctgcccggccgcccatcgtctgagatgtggggagcacctctgccccactgccctgtctgggatgtgaggagcgcctctgctgggccgcaaccctgtctgggaggtgaggagcgtctctgcccggctgctccgtctgagaagtgaggaaaccctctgcctggcaaccgccccgtctgagaagtgaggagcccctccgtccggcaaccaccccggctgggaagtgaggagcgtctccgcccggcagccaccccgtccgggagggaggt

SEQ ID NO: 4039 - DNA, 13814 bp, Homo sapiens
agtgagcccccgtgaaacaaggggcgtccggcagtccctttccacctgtctccacccagaggaaaacgcagggactgagacaccctcatcccctcccttcctgccccgccgctggagctttgtaagctggagccaggaagccggagtgtggggaacttgaaaggtctgtagcccctgctgtgacaccgctgagcaggaaaccgcgtgcgtccacaagcagccccaaggccttgttgtaggacagtggacagtttgctctcccggctgaggctgcccaccccagggttcctgcagtgcctcacctgcccccggagacgccggcccctgtccctgccaagctttccagggtccccccatgctggggtgacagaggcagtcccccaagaatgaggtaccccagctgtcccgtcctcctataggcataaaacaacccccacccccgccacacacacacacacaagctgtttctgcttttggcccagtcaagccaaaaactcccctgctctgggtggggattgttgactgactgtaagtgccacgtttgtggagcataatctctaattcttgaaacaactcagcctggagcgttttattattattattcccattttatctttttttttccatttctcctagccttgtaattattactcccattttatagttgaggaaactgaggcttcacaatgttgcgtggctcctggagagctcataaagccaatgagctagggctgcaagtgtgggctgggcaatgactcccaggacgcaaaaagccaggcacagtggaataggttgccacggaatacactcgtgaacagaaaacattccaaacccaaaccagagagagtgcgtgtgcatgtgtgtgtactttacacacccaagaaagcccagccctgattgcctgccttaggaggtaggaggatgcgagagactgagtgtccatgtccccctagacgcatatgttgaaaccttcatcccagcgttatggtattaggaggtggggcctttgggaggtaaataggttgtgccgggggagccctcatgatggaatcagtgcccttaccagaggccagagggctggtgcctccctgctgtcacgtgaggacatgatgagaaggcagccatctgcaagccggaagacgtcccctgcctgaatccgaacatgctggctcctgatcctggatttccagcctccggaactgtgagaaatcaatgtcagttgttgagaagcacccagtttatggtgttttgagacagctgactggactaaggcagaacgaaagaggggaagactcacttgtttcttcacaggattaaacaggtgagcaggtggatggaaagaagggggaggagggaaaagggggaaggggagacggacaggtcaaaggagaggagaaaaatggactttctttttacataattttctgtatttctgctttctgtaataaggttgagctgcttttgcaataatagtattacaatttatgtaaagcactacataaaaatattaaacaaatcttccactgtgctcgtcacaaaagcattagttaaagatctaactagggaggccaggtgcagcggctcacgcctgtaatcccagcactttgggaggccaaggtgtgcggatcaccagaggtcaggagtttgagaccagctggccaacatggtgaaaccccacctctactaaaaatacaaaaactacccaggcatggtggcgcgtacctgtaatcccagctgctcaggaggctgaggcaggagaatcgcttgaatatgagaggcagaggttgcagtgagctgagatggtgccattgtactccagcctgggtgacagtgagactccgtctcaaaaaaaaagatctaaataggggattccctcctccccccaccacagtccaccaacacacgacgatgcaggccacacactcactgggagggcaaggcttggggcaggggcggcagggacagtgggcagagaggtctttacctgggccagctgtgtgagcaagacttgggcaagccctttagccccaccccccacactcaaccccctctgtaaaataggctgagaatacctacaagtctgtgtgaaaattaaatgagagactgggtacgtgtgtatgcaacagcgtctggcacaccgtgtttgataaatagcggctaacatgattaactgtgtgttcacattatgtgaatattcttaatattgctcctggtcctaatactaagaatgagaaattaggagcattttgttaatcaagccccaagctttgttagccttcacaagcaaattgatcctttacacagttttttaagccccaaatttccaagtattgtttatcgtcttgctgcccctccctgccagctcttgtttttggtttttttttgagacggagtctcgctctatcgcccagggtggagtgcagtggcacgatattggctcactgaagcctccacctcccaggttcaagcgattctcgtgcctcggctaggattataggtgcccgccaccatgccaagctaatttttgtatttttagtagagacggggtttcaccatgttggccaggctggtctcaaactcctgacctcaagtgatctgcctgcctcggcctcccaaagtgctgggattacagccgtgagccaccaagcccagctcccccactcttgtattttaatgagcagttagcaggtgttccacccgagggggcctcacccaggtgccagagggagcacaaggcctaggtttgtgcaggcaccggctgcagactggccacagggctctcccatcctaggcccctctgggacatgctgggcaccccccgaaggttagcctgccatgaatggcccagtgagctgggttttggagttcatttttaaggagctgtttatactcggtgagacaggagcagcctgacatgcgcccagaacctcctgcccttggccccacaccgccctccccactctctctgccctctccacactgtgctggtcccgctgcccactcctcagagactcacccccggctgccttttggtgtctggccaggtgcattagaggtccacccttcaggatgcacccctctacccactacgccatgtgctgaccccaaaatcctggggtgcagagccagagagtggtgaagacacgctggcagcccagatgtgtgcagccccagagctcttcccgtccccccgcatgcgcgtggatagcatggctgggacagatgctggcctccagccccacggtgtgaggctctctcagaatacctgggtcctggggaggcctcagccaccattgcctgtgggactggccaagccgctcagcctctcttaagcctgcactcacctacagataatgatccctgccgggtgatcatgaggggatggcaaaagagaaagtgcctggtaaatgtgtgtgtaaaagactggtatagcagcccagtgtgtgccaggctcctaacccaggcagccttagacaggggaggccaggctctgagagcagatgaaactagggttcagagattccacctgggagcagggtcaagctgccctctggtgccccatgttcgctgccgggtcagagacacgccaccttccccctcgaaagcgcttcctcccgcagggcaaatgcttccgcagccccagtggtcatgctaccctgcagccactgtagcccctcaggcctcctcctttttacttttttaaaaaattgtatgatttttaaattttttgtagagacagggtcttgttatattgtccagactactcttgaactcctgggctcaattgatccttcagccttggcctcccaaagtgctgggattacaagcgttaagtcaccacgcccagcccaggactcctcctgagccaagaggctggggcctccaggtaccagtagggccggaggcctcaggaagcccctggtaaaggagctcccagagcaaacaaggtgaccagcgtgcagcacacaggcggggagtggggctgtggggtagcccctggggaggctgcacagaggagctgtttcccgctgccccttcccaatgccagagcccatcagggccgacactgctgctgcctgtgggcaggacaaggtgaggggcacttcctgaggaagaggggcttagaggccctctccccgaaccctgggccagcctctggggctgccatctcacagacccttgatgtgggggcatgggcttcagcgtgactccctggcaggtgccacgtgctcaatgagctgatctaggtgctgaaagggagatagcaaggcgggcctgagccctagcttgaggacttctggggcatggcttggggcagataacacaggcaactttggcaaaagtaaagagagacttcctggacatgggggctgttgctctgtactagaatgggctgccaggtgatgtgttccagtcgggtggcactgattctcaaggagaatcgcttgaacccaggaggtggaggctgcagtgagctgagattgcaccattgcactctagtctgggtgacagagtgagactgtctcaaaaaacaaacaggccagactcggcggctcatgcctgtaatcccagcactttgggaggctgaggtgggcggatcacctgaggttggaagttcaagaccagcctgaccaacagggtgaaaccccgtctctactaaaaatacaaaattagctgggcatggtggcacatgcctgtaatcccagctactcgggaggctgaggcaggagaatcgcttgaacccgggaggcggagattgtggtgagccaagattgcgccattgcactccagcctgggcaacaaaagcaaaactccatctcaaaaacaaacaaacaaaaattgcaaaaatagtacacagtaccacgtaccctccacgcagttccccctaatgttaacgtctcgcgtacgtaaccgtggtgcatttgtcaaaactatgagattaacattgattcaatactatcaccaactgcagactttcggtggatttcaccagttttccactaatgcacttttactatttccggatccagtccagggcgaccggggtgcatttagccatcgtgcctcctccgatgtgagatggtttctcagttctttctcggttttcatgaccttggcccttttgaaaagcagtgacgaggcattttgtgggtgttcctccatttgggtttgtcagatgtttttttcatgattaaactggagttctgcatttttggaaagaataacatggcgatgaagggcccttcccatcatgtcatatcaggagtaggtaatttcaacacaatttatcactggtgatattaaccttgtttcttgattgaaatgatgactgcaaggtttctccacggcaaagctgctatctccctttccatactttatttgttagaaatgtgtcactaagtccagcccacactcaaggggaggaaaattaagctccatttcgtggaggggagttctctccatatattatttgcaattcttctgtacagaactgtacctttgcttccatttgcttatttacaatgcattttcgttatctcctgtcccctccctctaagctgagtggctaggtgagcccctcccctggggcatgtgctaagggagagctccatccctgtgctttctccttgcatttcgtgaactataccataatcattactttccttgtgagcttccttaccaagggacagtttttaaaaagtcatttatttagtagtcatcggcaggcacctttgtcaagtatttttctgagcatgatctcattttactcccatgatgtcctgtggttatagtttccatccccattttacagatgagaaaacaggctcagagaggttaagctactggcccaaggtcacacaggaactgtgtcacacccctctctccccagtgcccagcccagtggctggcagcatatccggctccaacaggaacttgcttactgaagagcagcccacacgtgaatgggcataaaaaagcaaaacagcaaactcccaggtggttgtccatcactgcctctgggagttgagcctatagtcagggagttcagtgagttcagtccagggtcttgccccctcctgccatggcccaacaccatcaaacagtaagaggggtccttcttgtagtagagcgacagctcccactttttctttttctttttttcttttttattttttttaagatggagtctcactctgttgtccaggctggagtgcagtggcgtgatctcggctcactgcagcctccacctcctgggttcaagcgattctcccacctcagccttccaagtagctaggattacaagtgcacactaccacacctggctaattttacccactttttcaagttcccacacagcagtggtaaactggggagaggacagctagggttagtgaaaggaatgacgattccgtccaaactgtgagtgccagatgattgcagacaggcagactgtgcttctctcagctccccatgccatgcagagtgacccagagtgacccaacgagacccagcatggatctatgagtgacactgagccaggaaggtgtccagggaggggctgcagaccaacctgggcacgaggcctctttctaagcccaccctggttaagtgctttgccagtttctaggtgaggatcagcctcagcctgcactgggcctactcagtaaaggtttccacggtctttggatttggagcccccaatttagggcagagacaagtataaactgaccaagcaatagaagagatgcccacatgaggactcctgggaggggcactgactgcagcctgggtggcggctcctgggcagagggggagctgctgtggctacggaacaggccagcaggaggagccagtggtgatgagtgccctggtgccaggaaagcccctggcagagggcctggcctgtctgggggaggctggtgactcctggttccaatgtgctcagctctgagccagaggccagcctgcctcagacggggcatttccttcaagtggttaaaattcgtttttgtgctgagtcaggaagctagccggcttgggcctccccacctccaacgctgagtggcacacagtaccagtcatcagcctaagcagagacctgggtaagtgccccctggctctgcccaggggacaggaatgacagcagcatcccaacagattcctgctcaggccccgcagggatccacaccaagtcaccctgtgagatgtttctccactggtcactctgtcagtgccttgagctcctggcctggctggccctgctgccctgtctgcgctggtgccagcactatgctgggtcactggggaagtcgggctggcaacatacccagatgcaagcagttggctgagcagatgggctgggtagccacgaggacccttggaagcctgccctcccaggccagtcggcggtttgttctgttgcccagagacatgctggcctcctgaggctttcttctggggctgctcctggggcactctgtccaagaggtggcagggtggcactgcagtgtggttcggggtgggactcagcgtgagtctggaggcagggcatccagtcattcctctgcccacactttgagtaactaggacaggctgcttctgttctctgtgtctccatttccctttctgtaagatgcagagattggactaaatcagtggttctcactgccgcgattcctggaccagtggtgtcaacaacatctgggaacttattagacatgcatatttggccaggagcagtggctcacgcctgtaatctcagcacttagggaagccgaggccagcagatcacctgaggtcaggagttcgagaccagcctggccaacacggcgaactcctgtctctactaaaaatacaaaaattagccgggcatggtggtgggcatttgtaatctcagctactcgggaggctgaggcgagaaaattgcttgagtccaggcagtggaggttgcagtgaactgagatgatgccattgcattccagcttgggtaacagagcaagactccgtctcaaaaaaaaaaaaaaaaagacatgcagattcacagaccccaggaagacctgctcagtcagcagccagtgggtaggcccggcaatccgtgttttaacgcgccttctgggctcatgctggagaaccactggcctggacaaaggcctaagcgtcttcctaggcttatttcaattcactgggcacccaccgcataggaggggcttgtgccaagagctggagaatgcaaaggcggacgaggtatgaagctggtaccaaaagggcacctctgtttcctgggtggctacctcctagctgtccttaacacccagctcaaatgatgtcttctttgggcactgtcccagaccagccctcccaccagttcctcagacacgagtaatcgggtcccacctcttcccccgacgcctgtgccagcacggctcttggtatataggatgtaccattgtttgtgagtcagtttcctgctgaacagtagggatgggaagggccgagggtggctcctgttcctccacggtcccacagccctgagcaccaaggggtcccattccccaacatagactgtactagcccagcctctgcaaggcccctgccaagtgcccatgtcctcaaagaagctttcagggcccactacacccatagccccattctggggctttcctttggcaaaagttgcagattgggccatgtggcccccctactctgagcctaaaagcctaagccaacctggttctccctcttgggaggtttgaagacgtatcacacagtgaggttgtagcgcagcctggagacacagaaagaaggccgagtgcagccactgaggcagccagaaccacgtggcaggaggtgtgtccagtgtggggaggggtatggcagccacagcaggaacaaactgcactggcctcctcaccctccctggagtgatgggactgagcacccccttttgtgcctggtgggagctgcccacagcccccgactctgggccagcttacaaggactcagcacgtgctcttagcagcctcttttccaggggcaggcagctgggacaaagcagcactggacccgagctggagggatggatcccgggccctccactcactggccgacaatgacgggcaagtggcttcacctctcgtccctcagtgacttcatctataaatggggctgaaatcagggaatcaaaaggcatgaagagctagcccctagcatgacacttggcctacttttggtatttaataaacgtcttctgacctggtcctccttcgtacctcaaccacatcagacacagcgtcatgatgatttttcccctgagcaaagtggctttgtgtgaagttgctaggcctgagtttccccatctaaaatacgcaggttgacctggatgatctgtgcctcagctacacctacagacctctctgctcaccatcatgagtgcccctagcaaagggagacaggggccctggggtgttgggaggaatggacactcaatttccagtcaggcattgaacaggtcagtggattagtgggtctgtgattcattcatccatccattttgtcaaccatttgttagatcatttgtcaaccagccagccagcccagtggctggtcagctcacagcatattctggtccttgtactgcttccagcccagtaaactcaaccaaagagaaagagaacagaagaatgagaataaacaaactccaactgcccacaacaacacactgagtgaaagaagccagaccccaaactgaacatactgtatgattttctttgtattataaaagtgtcacacacacacaaaaagtgtcagtacatccaaaaccaaccgaaagtgtcagaagccatgataaggattatcctatgcaggggatcagggaaacggtaagtagtgactggacggcagctcatggggcttttgggattctggtaatattctgtttctaaatctgggtgctggtgacacagtgtttgcctagcgaaaattcattgaattgtacatttaagtttttacactttcctgtatctacgctatgctatagttcaataaaaatttacccaaaaaaataataaaagaaagaaaagaaaagcaagaaaaagcaaggaaatgcacagagcagttaactcagcaattccagttctaagagctgcttatcctgtagttatccttccaggtgggcaaatgatggaggggcatgatgttcctggaaaactggaaacctaaaagtcttggttattcaaccagaatgttaaataaacaacacatccatatgatggaatattacttaaccattacaaagtatgatcgttatgtaccaattgcaataagcccttagactgaaaagtcagtaagtgagcccaggaggtatacagcactaccctctgtagcagcaagcgtgcatagccacaggctctctctggaacgacacaggagaaagtggtggcattctggcctgcaggctcacgctctccccttaggggatgttatctgtggccacatccagtctgcctgccagaccatgctcttcccgagggtctacggagcctggtgccagtagtcttagttcagtctccaagtgaatgattcgcaatagtctgtagcttacaaattgccatccctctgactgcgggcagggccagattcaggggtttggcgacgaccacagactgtctgtccatctggaagatgggctagatgtgcgcagaacaggggctcatggctgaagagggcacagttcccacatgcgcctgctgtccaaggagcagaaacagaccctggggcaagagaagccagagtgccagttcagggagagctgctgccgccttctgtcctgcaggaaagaagacttggcaaggtcacaccggcaaaacaaggatttgtatgcaggtctgactccaaagcccgggcatgctgccttctgcagaggccaatcagggagggcttcactggggagtcatatgcagtctttttttctttttttttttcttttttgagacggagtttcactcttgtagcccaggctggagtgcaatggcatgacctcggctcactgcaacctctgcttcctgggttcaagcgattctcctgcctcagcctcccgagtagctaggattactggctgattttttgtatttttagtagagacggggtttcaccatgctggccaggctggcctcaaactcctgacctcaggtgatctgtctgcctcggcctcttgaagtgctgggattacaggcgtgagccaccgcgcccggcggtctcatgcagttttgcaaagtcaaagcagacgagggttggcatgttccacgcagaaggaatgctgtctagaaacagaagagagtggcgtgaccttgagagtacagggttctgtattgggtcagtgggggcaggaaggcagcagggaaagcaatttgggaaactggtcagaaatgatgcaggaagtgctggctggagcctggctacaaagactcatgggttcctggccatggagcctgaagtcagtcctataactgtttggattccaactgacggcttgaatacaggttcagctccacctctgcttccagaagatcattctggcagtgaggtgagggcagattgtagggcgtctggctggagggagggagacctgttgggaggcagtggcaacaattcaggtgagcaggtggtggccaggacaagggctggcgtgggtgacataagagtttgagaggaactgagaaggaagaagggcatgtaattggcggaagacagcaactgtgcgaaagggaggaggtaaaggtgacgctcaggtttctagatcaaggaacagggtctccagttgtacccttcacggaggtgagaaatccagatttggctggaatccgagttcagttttttgtttgtttttttgagactgagtctctgacgcccaggctggagtgcagtggtgcgatctcggctcactgcaatctctgcctcctgggttcaagcgattctcctgccttagtctcctgagtagctgggattacaggcgcctgccaccgtgccaggctaatttttgtatttttagaagagacggggtttcatcatgttggccgggctggtcttcaactcctgacctcaggtgatccgcccgcctcggcctcccaaagtgctgggattacaggcgtgagccaccgcgcccggccctgagttcagtttttttaaggacacaattagaggtgctcacgggatgttcaagcagggaggctggtggataccttcgattcgctcgttcacctacgtggacttattaaacagccaggctccctggccttgggagagtccttctggtggggagacagatgataaataactgaagtaatggaaaaggggcagttcaagaaaagtgttgtggaggaagaaaacaagaaagcccgccagaaggggactggaggtcggccccgagggtgtgtccgctagagggggcctctccaggtggactgcgggtgagagtaaagggggcatgtgggggaaaagcattctagggaacagcaagtgcgaggacctggagacggcagaggggctggtgggacaggcgcccaagaggaggcccaggctgtccctccggggcgtggggagaggcatggggctgggtccctgcaggagctcacaagccacagtggggagcagaagcgttacgctgagtacagtgggagccactgaaagggttaaagacccctgggggtgctgagtgggaagaggctctgggagctggagtggacgcagggagaccagttataaggcgaatgcaggagtccaggcaaaagagaatattccagtgtgtatcttaagacttaactttttacacacagaacaccctgcgcccctctcagagcctccggggtcttcatgcgagcagtttatcacggttctttcgtcttaaaccctcttactatttcagcaaacaccctctcctcagcctggtcaacccctctgcccaacccgagtgggccccgaaggaacaagtggggaccagagtcctgctcatgtgagtggtggggcccagcccgttcccctaagaccagaattctctcgctcagagcaaagccccggggtgccgggattctctctctgctcccgctccctggatggagcttttaaaaaaggaggattcctcactgcggcctctgccccttgcactgagcgccaacccgcatcacagctcagcaaaggcgcgcgcagtgaacagacggaggaggggtggctcctcgctgagctgaaggctgcggcgacgaaaataaacagcatggttcctgctctccacgaacctggcgctgcagacgtgggcaaaccacaccaagagacgcgagcaaccgaaatatagggagaaaaaaaaaggtgccctggacagcgggctagatgtctcctgcaggctcgaggacttcccggagggggcggcgttttctcggggcctgggaagaatgggcgggtttcagcgggcgccttctgggtgactgcccgtttcggcttcccctgaccccgtaacagagcggaagaggcccagagacgccagaggaggggcgtcagcgggacactcaggccaataagctctgactcccgctgtctgcaaaaatgaccggatgcaggaatgtcacctagaaccggccagctttccgacctctccggtcaaggacgcattcctaagagacgaagggagaatgacagaagttaaaaacaaccaaacaaaagccaggttgaggcctctaggtgggtctccgctaccgatggattcagccggtggggctgcaggaggttcctataagcgtggtcccctctccccgcaccgagtccggccc

SEQ ID NO: 4040 - DNA, 921 bp, Homo sapiens
agcattaggggagcccacggctacaaaaacaagtgagtgagaagaggtgggaggaagagaaactacgccacctcccctgcagccgagtgcacgcagcagcctggcgtgacaagtgggcgacgccggggggcagggagccggggtccttggccctggccggggaccccaccgcccaccgcgcggaggacaacttttagccggcagcccagaccagcgcggcacctgtctccggagtctccaccgctcctcccgattcatcccagggaaattctcaagaatacgctctacaaatctacgtgcgcatcattttcacctcgcgtcgcgcccgggaggaaggaacgaggcaaggagctaaagcagcgtgcgttcagccctggggcattttattaatgcttttacgagttagaagagttgggataatttgccatctggagtttctctgccttgctgatctgagctcagacctgccaatttaccagagataattgataacaccctgtaacagctgagaggaaaatggaagaaacggagatacttttagtgaagcagaataaaccactgaacagtctgtttcatcttcataaaaacgctgctttcagtgcactggatttattttacaacccactaatggattaccctacagtttgaaaaacattgcgttagaccagtttgactgttgtcaagaaccaaaaaaggaaaaatgaggaagctgtgagtaccagtggaaggaacgagccaggaagagggactggaaccatctcagaagccatgcccctcaggctggaacttgccctgtctcctcgcagatgaggtaggaggctcagcacgggctggtgggagcagcccacagcagcagtgagggtcagtgggcctgtgagttaagaagaaggtggcacagagcgagggtctctggatcctgac

SEQ ID NO: 4041 - DNA, 664 bp, Homo sapiens
tggactttgcacaccacgtgttcgtctgtgccctgcatgacgtccttggaaggcagcagcacctgtgaggtggctgcgtacttgccccctctcaggactgatgggaagccccgggtgctgctgatgtcagagttgttcttgtatttccaggagaaagtgatggagtcgggaaggaagtcctgtgcgaggcagccaacggccacgctgctcgtatccgacggggaattctcacaggagacgagggggaaaagggttggggcggatgcactcctgaggagacggtgaccagggttccctggccccagtagtcaaagtagtcacattgtgggaggccccattaaggggtgcacaaaaacctgagtgtgtctcgcacagtaatacacagccgtgtctgcggcggtcacagagctcagcttcagggagaactggttcttggacgtgtctacggatatggtgactcgactcttgagggacgggttgtagtaggtgctcccactataatagatactcccaatccactccagccccttccctgggggctggcggatccagccccagtagtaactactactgctgatggagccaccagagacagtgcaggtgagggacagggtctccgaaggcttcaccagtcctgggcccgactcctgcagctgcagctggg

SEQ ID NO: 4042 - DNA, 1013 bp, Homo sapiens
ctggatttgggaaacagctggtacgtataactatgccattttcctacccaaacattaacatgtcttcctgtgatttttagggtagggtagttctatccaggggtaattttgtcctctgtcccaaggtcatctgtcaatgtctggggacacttttggttgtcataccttgggggtgatgtgtgtgactggcatctggtggatggagaccagggatacagctcaacatcctacagtgcccaggacagcctcccacaatcaagaagtgcctagtgccacatgtccatagagatagagaaatacaagcgtagggggaaagtgcctcagctggcattcaaagacctacatcaagcacctagattctcaatgccacacgcaccttgtagcaccttaataaatatcgttgccttctgggctccccactccaacacttgtgcatattccctatttcttacatttcagtaagagtcaatctaattagcttaatttttttggaaggaaaatctgagaagaaatggaagcagagaggactttgcaagaagggctactcaactaattcaaagcgtggagttgagcatctggaatgcgagttttgcttctccaggaaagggtcaaatttctgaatttgatatagagagcactgcagttgccctatcacttatcaatctcttggggatattctgaatgcatccttttttagtaaacgaaaagggatgcaggaagtaaaactgaactcttacgttgtgagcggcaccgtcggtttgaaggaaaaaatttccctctctgaacctgtgttcctgacttttcgccataatcagtaaagctcaggaagaaaggaagtgttgaggcatccagagcttgccacagtgagatgccattctcacgttgaagccaaaaggcaatggaggagaagctctattgagctcagtggaagctggaggcaggaatgagggatcgctctgcagaaactggagatggctcaaagcagaaagggcacagggaagaaatactttatt

SEQ ID NO: 4043 - DNA, 1200 bp, Homo sapiens
actggctagattcaaagattaatgtgtttctaaatagagaataagttaatttaatgtgtttccaaataggaagaagataatttagattatatttctcaaaactgtttctagggttgaaacattggcccatttgattattctcactatgaacatttcagaactctgaagatctggacagctttctaacacctgttcaaaacaatcatctgtatgctgtctaaccagcactgaaacagaggaagaatttccttacttgttcagaacagaatattgccacagccccactattgttttagctttgggacagcctcattatatggttgatttattctgaccatcacacgcaggtttgtgaggcatgtagatgagatcaacatggtatgttctccctcaagcccctgctaaaactacgggcgaggctaacaccagggacagagtgctctgctgttaactccagtttgatccttctagttacatatgatccattcatccacaacgcaagggtgttgcttaattaactaaaagggcactcgaatgccctatatctgatcattcagctcacaatgtacctttggtttaacagagagatcatgagaatatttttcaagtgactcacaatagtgaagatactctgtgtctgccatactcctgtgaacctccagtctattcagttgtgggcaacaatgagattgccttgatatgattgttgttagcaaatgcaagctggctgatattaaccatcacttccttttctaagggttcataaaccatctgttaaataattaattcaagactttcactagaaattgacatctagcccattatcaataatttccataatatactccattcccattaaaagataaatattagtaaaaaaaaaatctatcaatagaatgttgttagttgataactggggcaagagactgcaactacacttaacgggaaagagcaacatagacaacagaaacagaaaagcaaagggtatgttcagtgtatggtcacactgagtggctcactgtggtgggagctgagagttcttaagtggtttaattaggactagaatggaaataaaggttgtgtggttctcatgatggttatggggaccttgctgatgtgtttgaactttatgagtgtgagtcctgatccaggacaggacagaaagaagtggaaacagaaagaaggtggcagatgctagtg

SEQ ID NO: 4044 - DNA, 1577 bp, Homo sapiens
tggtccttatttttgcctcataacaccgtgctttcttctgttatattgctttgtaattgtctatttactggtctgtgccctaccccaaattataagcttcttgagccggtgattgttaaaaaaacaaaaataaacaaaagactttgtaagttagaactgttctcacacctaaattatttgtaagtacatattaatattttacataaaattcctctagtgataaataacacaatagctagtcttcactgattgctcataatgtagaggcactatgtaagcacttaaataattcctctcattccaccatccactaacccggggatgtagatgcccttattgtccccctttacccagggagtcagtgctggtatctggtaattggacccatgaagtctgacaaatgatataacatgttttagcaaagttacattgtatctggaatccacatcacaaaacaacataaaatttttcccttgatttttttctactattttaggtgtatcagcaggcacagaaagttcaatcaaaaaagcaactttcagaacataccacagataaagtaaatgattacctcttgtgtactgcttttacacttcctgcttcaaagatgaaattgtgttgaatatagtcttgatattaagcttaaagtatgttttattgggaatctataattggcaatatacagcaataaaggatggtactccattaactagaactccccattagtttattattaataattaataactgtcatataatattaaaataccctaagaggtctcttggtatctagggcacacttttaagatgcccaacaccagggtcactttaggagcttgttgaaaacatagatacttgcgtactaccccagatctgctgcatcagaatgtcttgcagggagcgtggggtgggagggggctagtgattcttacaattttgagaaccgtgaactatagcgcaatggttctcaaccactgctgcataccagaatcagcaggggaggcttttaaaatcccaatgtccaggcctttctccttaccaattaaaccagaatctctggagatgagatccaaacacaggtattaaagtattaaaaaaaaaaaatcccataagtgtttccaaacttgagacgcactgctacagagagagggcagattctttggggcggtagatcttttctagggttttagggatagatggatgtattctagggaggtagaaagctttctaaacacaccctattcatgtcactagctctgtgtaaaggccatgctgctttgcttcagaagctgtaaatccatgtgtaccccaccctgaagattcaggctgggtggcatgattcttctctgcttttagggcaagcaaatgctcaagaggcaaaagctctctgctccctgcatggccccttctatggggacacctcaagaggtagagccccgagatggcggaaggttctaaagagctgcctgggtatgtgcagagtgagtttcactctcatcgagagcccataagcagatattcataggcagtgaagtgcaattataaaaagtgattctcccaattttccaggagactta

SEQ ID NO: 4045 - DNA, 416 bp, Homo sapiens
gatgctgagcatgaagacaaaagcctatcgaatggggtgtcagaaaagaaacatcaaaatatcgaggatggaaactagagtccatgttggccttacaagtcttctctgaatattccagaaactaatagttaagattctttcaaaaaggagtaaagcagagacattcaaagatgaacagcaattctgaatggaaagaggccagctgtaaaacgtcatagaagacctgcagtagagatacaatcctgagaagaatatttagcaagaatggggtttcagatttctggtatttccatatgggtggagattgaagaaaaaaaagaaaagagcaaaagttttctcataatgttttgcaacttctgcttccgggcccagtcagagcccaaaagcagcaagagaagtaaaatgaaaacactgaa

SEQ ID NO: 4046 - DNA, 392 bp, Homo sapiens
aagattcaaacaaccaaccctgatttcctgcttctccttttcatgagtgttcctgtggtctctgcacctcctttcttgtgtaatgtttaacagcagcaaaattaaaacatgtaagttccatgcggcagtcctcaaggccatgatagcaactgctgctggtggtgcccgatggggaaggggctgccaaactatgcatctgaccaaggactaatatccagaatctacaagaacacaaacaactcaacaagaaaaaacaatcccattaaaaagtgggtaaaggacataaacagacattttccaaaggaagacatacaagtggccaagaaacatatgaaaaatgctcaacatcactaatcaccagataaatgcaaattaaaaccacaatgagatac

SEQ ID NO: 4047 - DNA, 1876 bp, Homo sapiens
cgcctggtcaggccgggacggggcggctccgcccaggttacaggattgaaggaaggggggagacgggaagaggagcggcgagcgacggctggcagacaacctacccactcccagccccgcgcccacctcaggagcgtctcgagcgcgccctcgtgcttgtccagcggacgaccgactgcggcgcggcgcagcttgctgagctcctccgccgcgcggcagtactgggcctgctcttccccgccgcttgggtaagtctgctggatgaacttcaccagcggcttggccaggtccacctctgaggtctttttcagctgcaccgagatgaatgtcgccatgatcagcgcctccgccgccgttcgggccaaacagaccgcggacagcttacgagggccgaggagagagaggtactgggctggcggactggcggactgactggctgacagacttgcgctccgcctgcgttccgggtccggcaacttccgggagctccagcgcaggcgcactggatgcggggtccttaagctgtccgcggtcacgtgaaggtgtcgcggcggctacgcccacctggacccagtttaccctgtactgtgctgcaaaatattactttctccccatctggaattcttcccttcctccttcctgccgcagtggtgtactgagcactttcacgtaagagtattcctccactcgaacaaccccccggagaagtactggtgtcactgccacctgcgagagtttgcggctacctccccaagaggcagtcccagggttattgtgacctatgatgtttattcaactactgttgacgggctgctgtgcacagggaacctagtaggcaagacccctgccatcgtgcagcttactgtcaggttgacacagaccttaaggtaaacggaaaaagtatcaggaaaaaaacagggtgcttgggacttaggagatgttaagatcgcttggaggaccctaatttaaataagataaagtaggttttctccgagtaggttaactgaaaatgaacctgtgtctctggttgctgttttgtagaaagaacaaaattttaaataaattaaaaacgacacctgtaatttgagaagatgcttgatatcagaagaggagaagagtggagaggggtggagtggcaaaggagagcctccaaaccaaaagcctgcggcagaggccctaggaggcaagcacttaaccatgtttcaggactagaaacgaaacatgtgacaagacctttaaaaacaaatagaatgggatggaataaagttggatgagtaagcaggcatcaaatcattcagaaacttgttgtccaagttgaagaatttgtttagtattgtataataaatgcagaggaagctatatacacttataatttacattttttaaaggccacgttgtagctcaatcggatagtttgtcttttgatgggatgtagtatacagtatcatcatggtatattccaggcaaaaatatttaacttgaatctgtcaagcctttgcatctaacacagtttataaaaaatacaacagatagatgaacaaactaaatgatgccagaggaagtaactagacagatccagaaggtgaaacattctgcaggataactggcccatctcttcaacaatttgtcatgataaaagcaactgctttatgaaaagaaatttaagggacataacagtttgaattggatcctggtttgaacagactgtctataaaatgcattttcaggaccattaaagaaatatgaatgtagatggactgagtattggataaaatagaactgtattgccatggaaaagatcattaactgaaaagagcaagtcacgaaatagtatgttacagcatctcattttggtttaaaaatgcacatatatgta

SEQ ID NO: 4048 - DNA, 309 bp, Homo sapiens
aagatctggcaccacaccttctacaatgagctgcgtgtggctcccgaggagcaccccatcctgctgaccgaggcacccctgaaccccaaggccaaccgtgagaagatgacccagatcatgtttgagaccttcaacaccccagccatgtacgtggccatccaagccgtgctgtccttgtacacctctggccgtactactggcattgtgatggactctggtgacggggtcacccacactgtgcccatctatgaggggaatgccctcccccatgccaccctgcgcctagacctggatggccgggaactgact

SEQ ID NO: 4049 - DNA, 2913 bp, Homo sapiens
gagcctttgcaaatgcatgcagagcatggaaatgacccagctgccctgctgttgaaacagaatcctatttggaaggcagacatgtggcccatctctgtagccatcactgagaaatctggattttcaagggcctttctctctgttgcccaggctggagtttagcgactcaatcatggctcactgactgcagcatcgacctccggggctcaagtgatcctttcatctcagcctcctcagtagctgagactacaggctcctccagatctgcctcctgctgaccttgtacccagctgcagcgacaccgagctcctcacagcttcccaaagtgggctggcccctctcacgacagggtcatcgcacaggctccctctgtgggggaacacaacgggagtcatttcaacaccactttcttcaggaagcctattctgatccttggtactccaagcagctgttgtcaatgcctaccccaggctgctaggaaatgctttccactcggaactgagacctaaaactggaaactaggctgcaggaccacctgggtacgtgtgaattacagaggttcatgcatttccaaatgggggtgtcattttagaactggggcgtaagatgatgagcaacagaaaagacaacgccgagcccccgggtatgagctcagaactctttacatgtttgatgctccaaatggtctagggcaggggggcttcagagccttggcagcagaacgtggtcgcgtagatgtttatctgattttctgttgcgctgctgctcaaccgccactacggaagtgcacactgccaccttatggacgtcttgagaagttacacttacacgttattaattatattaaataaaattcaaatgtaataaataatgtcaggggtagtttttataaacatttgcaatgaaaattcatatgaggacttcagacagaatatattcaaatgaagagttgatttcgatttcactgatgaaattaaataacaggattaagatgaaattctcagctattttagcattttagtgtttttctgctactgagttgtgggaattccttatatgtttcggcttgtcataaatatggttgacaaatattttatctgattttatacgttttttcactctattgattatttccttggttgtacagaaactttttaattttatgtagtcccacttgtctattttttacttttgttgactgtgcttttggtgttgtattcaagaaatcactgccaagatcattatcatgaagctttctccctatgatttcttctagaagttttatagttggggtattacatttatttatttatttaaagacaagatattgttctgtcactcagctgcagtgcagtggcacaatcaaagctcactgcagccccaacctcctgggctcaagtgatcctcccatctcagcctcccaagtaactgcaggtaactacaagtgtgcactaccacaccaggctattttttgtggagacagggtttctctgtgtttcctgggctgatttcgaactcttgaactcaagtgatccttccaccttgccctcctaaagtgctgggattacaggtgtgagcctccaaccctggccaggtcttacatgtaagtcattaatctattttgagttgaatgttgtgtgtggtgtaatatacacatgtgaatatccagttttcctaacatttgttgaagaaactactgtgtattcttagcatctttgtcaaagatcaattaatcatatgtgtgtgtgtttatttctgcactctccattctattccattgatttatgtgtttatctttaagccaatacaatacagttttaattgcagtagctttgtaatatattttgaaatcaggaactatgatgcctccagctttctttttttttctagagattgttttggttcttctggatcttttatagtttaatatgaatcttaggattgtttttactatgtccgtaaaaaatgccattgggattttgatagaaattgcatttaaactgcagatcactttgaagaatatgattatttcaacaatattaagtcttccaatccatgaacatgggattttgtgaatattcttgtatggttttagcctaattagaatgtttctaatgttttgattttacatacaatgttagctgtaagtttcagacggaattatttctcaactcttagtttgttcagagctttctaaaattattattaatgaaagttaatcatttttggcatagacttggtttttaactttgattaagtccagttattacttttaaaattttatgatgactctttgtgttctaagaaatatttgattaccatcccaagattgtaaaaatattctatacttttggaaaagctttatagttgtaaacttttatgtgtaagtctgtgatccatctgaactacattgcatattttatgaaggtgaaggttcattattttccatatggagtttaaatttttccagcatcatttatttgaaagaatttcctttccctgttgaactaccttgatgtctttggagaaaataaattgacagtatgtgtgggactctttctgaactctgtatttttttcattgatctatacatggcattaccacaccattttaattgctgtagtttaatagtaaagtgcacgttttctaccttttttctttctgactcttctgggtacttgacatttccaaatcaattttagaatcagattgtcaagtgcaacaaaaaatggttgggatttttattatgattgcattgaatctatagaataatttcgattaaaagtgacatcttgggccgggtgcagtggctcgcacctgtaatcccagcacttcgggaggccaaggtgggcagatcacaaggtcaagagttcaagaccagcctggccaacatagtgaaaccccaccactgct

SEQ ID NO: 4050 - DNA, 586 bp, Homo sapiens
aaaaagcaactcactagctatacaactttttgacagattacactgttcttgaaaaaccgtttagaagaaagcagataagagttttcttaggtgcaaaagttgattaaactttaggaagcaagtgtttttgaccagtataaagaaaataagagtaatgtgtgggggtgtgtgtgtgtgtgtgtgtgtgtgcgcgcgcgtgcctgcggctaaagtttgggaagaaatgttggttcagagttaaggtttaagttggaaaggccagtggaggaggctccctgccttgcagaactgctgggtattgtcactgcttgcctcttcagcttttatatgcaggtgaagctcgtgtgtggagtgccacggtacaatcagacgacagatggacagtgtgacaaaagtgtcagaaaggattgggcctcgctgtgagagtcagcctggattcaaagtgttgacaagttgctgaaaaggaagccagtgagaggactgtggcacgcagaggaagtggagccctgtcttcggtcacaccattgatggaggacagatggacagccgtatggccagtcacctctcctcttaaacctttggagag

SEQ ID NO: 4051 - DNA, 1029 bp, Homo sapiens
gctccccgcacctggggcctgaggggccgcctctccgcgccggctccccggattcgagtgcgaaagcgggagctccttctcggcagtcccaggcgcgcacttaccacgtcccagcgggtatccaaaatctagaaatgggcatcacggccccccagcgctacagctcgagccccctccgcgacccctgctccgctatgaactctagattctttctcctttccggagaccgagaccctgttccttcagaaggacgcgtgcatcctggcctctgctccctccccacggcagaacccggtgagctggtcgccgcggttgcgcccccgcccctccttggcgctaacgcggccgccagctagcactcacttgaggagcagctggtcgtgttccgccttgcacttgcccagctcgatctgcagcttggcgcgctcgcgggccgtgtcgtcgagcgcgcgtcgcgcgtcggccagctcggtctcgtagagcgccttgaggccggtgagctcacggccgcgcacctcctcgcgctccgtcacctgcagctgcagcgcgctgttctccgtctccaggctgcgcaccttgtcgatgtacaccgccagccggtcattgagctcgcgcagctcctccttctcctggagccgcgacaggcgcgtggggctcagcggcgtggtggggccgccagcgcggctgcccatccgcggcggcacgggggtcgcagtcgccatggcgggcggcggagacagcggggcggcgaggccgcgagcgggaccgtgataaggaggggacggcagggggcgaagcggggaccgaaggcacaaaccggcgacctgcgctcacgtccagacgctggcgtttagaggaacggagaagcacctgggatggcgggagctcgattacagcacaaagggcaaaggcgcgcgggggggaactacgaatcaatcgatcgatcgcgaaataccctttgtaagaaaacacacacacccactcacacacgcacgcgggaaaatgcaagacgagggtgactggaggccc

SEQ ID NO: 4052 - DNA, 2638 bp, Homo sapiens
caaaaaaccaaatggatcttgttccgcatagggcagacaggacccagaggacacagcagtccacaacaaaggcactggattctgaatggcccctgtcttgtttggggagaggggaactgttggtccccgtctgtgttccgaggcttggtgacaaattctagcaaaccttagtggtttaaaacagcagtccacatagatggtctctcacagttcctgggaagcaggaccctgggctccatggcaacctggttctgctctaaggtctcaactgaggtgtcagtgcctgggtttacctcgaaggtattgtagtggggtaggttgggcaccccccttcacatccagctggagccttggagcaggacctcctgtagaaccagggtcttggcagacatcctcaatgagtgacgtcgagaccaggccatcctggattagggtgggccctggacccgtaacaggtgatcgtctaagagaaagaggagggggatctgagatgcacagatcgggaaccagccatgaagacaggccagagactggagtgtgtggccatgcgcctgaggcacctgagccaccaggagctggaggaggctgtgcagggtcctccccagaacctttggagggagcatgcccgggacacctcaatgtggggcttctggctgcagagttgcgaggaaatacctcccttgctgttgtgaaccacccaggttgtggtaacttgctgtggccaccctgtgatgccagtatacctccttccctcatgtctggtgccaaggccgggagagtcaaatacctggggctaaaagcattggggttcctcagatgatcctctttgcacccctgcatagggtgtctgcccacacggcctcagggtcatgagttttctgcaggcagccacctgacctgtccagccggacatgtgtctcccccatgggtcagtttgggcagcaggttgggtcccgtgtaaggctcagggctgctgggctctgatgtcacctgttgccacggtgactctggttgctaggatcagactactcccttcctgggcacactgtatcccgaatccccagaagaaccaaggggatcccccagcacaaggctcgttggggagggagtccttggcgctcagatttgagagagagagtcggggctggccagggggcgtggcttgggcagaggagagtgctcatggtgaccctggaggagaccctcccttccctcgttcattgctcccaaggccaggtgtctctaaaggaagccagttgtggagaatgttggtcctgcagtggcgattaatgcaaagatgccctgaacaaagcaggacacacgtgcctgcctgctacccctgcccagctgctgttcttggacgcatgtgctcttctggtgggacccgtgaatacgtggctcacggtcctggggcacaccccattgtgtgaggctgggggtcttgtggggagccaggcccctggtgtgggtccctgctcagaagccccacgcagcccctgttctgctgagtgcggctgaaagccccccatacccacagccctctgtcctcaaatttttctcattttaaaaattgtggtaaaatacccataacataggacttaccattttaaccttttaaaaataatttaaattttttaagagacagggtcttgctctgtcacccaggctggagtacagtggcgtgattttggctcattacagcctccgcctcctgggctcaagcaattctcccacctcagcctcttgagtacctgggatggtaggcacgcaccaccatgccagctaattaatatattttttcttgtactgactgggtctcagtatgttgcccaggctgatctcaaattcctggcctcaagcgatcctcccacctcagcctcctgagtagctgggattataggcgagagccactgcatccagtgacttttttttgtttgtttctctaatagctgccatcctgatggggtgagctggtgtctcatggtggttttgatttgcctgtcctgaaggactcgtgactttgagcgtctttccatgtgcttgctgctgtttatagatcttctccggagacatgtctgtcttccctctcattcttgcatgcgggcgtccacaggctgacccctcagctgctcagccaggcccctgctcctgtccacagagcccaccctccaggtgcactccctgcctgcctcctgcaggttcctttcctgggcatggtggcccagccctctctgtccctcacctcacctgctttcttcatggcatgtgcacatctgacatggttactagttgtgtgatttctgtctgcctttgcagtggacacaccacagacgctcagccaatgcttgaaccagcaggtgggtgggactatgccaggacgggatggtggctcagagaggggctgcctggtctggggcctgacaggcgggaggaggagaggcctgtagcacccattggaggtgtgtggtcgcccagcacaagaacaagggaggaggcagtcaggcgggggcgctcctgcccaggccacggagctttaattaaaacccgcccggagcatgaccccactctgccatgcattcttcacttaattggggcccttcaggaggggccggctgaggttaattaaaaagcccagctg

SEQ ID NO: 4053 - DNA, 1774 bp, Homo sapiens
ggaggtgtttctttacacacaagtgctcatcagttcatgtatatttgcagacctcagagttctctgcatgtgcaactgcctcctctttgatactcttccaactagactgtttttgttcatttctaaacaatttttgagatccctggaatcctactctaagaggcaggattccatgcagtagggtttcatgacatactgtcaggaaagaagtgtgggaggcgtgactgggaatgtgttacaactgactgctcagctagaaggcatttcaaggtcattctaaattaaaatatggctttgggattaaggcatcaggtagttattgctcctgaactacattctgaaggaggcacatctttgcatgaagccgttctttgcactcaaaggcattttttggtggggaattgctgtgtgaagctgggatgccaagggatgccacagtgctcactagaaaagactttcctgttcagaacatcaggatgcatggagctggggcttgagggtctcagttaaacatggggagttcagaccaataatccagggcatttgggccacaaagtacaggcattgtgttagatccagtcaccacacaagaggaactccagggatcatgaccactcaacagctgcccatctccttcttgtggtccttccattcaggtcatcttgaggcaaggcacactcagtctaaacaacagcagaacagcctggtccttcaagcctcacatcatcctgacccaccttctgcagagcctacctggaggaatggagggaaaggcagcctggaggtctcagatgcaggtgaactgggccagccctgtttatggctttgttcacagtcctgctggggctggagagagaggatgacacagatagtgaaggggtttctgtctcacttccccatctgtctgtgtcaatgtgagatggttaccactgctgtcccgggagttacagtaatagtcagcctcatcttccgcctgagccccagtgatggtcaaggaagctgtgtttcctgagctggagccagagaatcggtctgggatccctgagggccggttgtttttaccatagatgacaagtacaggggcctgtcctggcttctgctggtaccagcttgcataatagcttctgaggctgtctccttggcatgtgatcctgactgtctgtcccaaggccacagacacagcagggtcctgagtcagctcagaagaaaccacagaacctgcaaaagaggacagaagaggtgaggataagggtttcacgcctagagtcccacaccctacactactccctgtgttgagccgaagctcagggccaggttggcacagctagcatgataatatggggttgagccctgggaggcagcacctatgcaaagagtgaggagagtgagccagagaggggtccaggccatggtggagacaccccagaactctgcttctgagcccacagctaaggaggaacctccaggcctctcttatcataggaagggaagtctcttcatgcaaatctacttcctttattcttgtgtcgtcgttaggtggctctggtgagcagtggatgcaaatctgttctccattccctaaaacatttgtcctggttcttgtctgagccctgagcctgatggccttctctgagtaatttctcaagatcagaagaagggccaagtgcattttcagatttacccactagaaggggcctcataggaagcaacagtcaggctcttcgcccttgagcattactaggggcttggactcattaggggcctcagactaaac

SEQ ID NO: 4054 - DNA, 1919 bp, Homo sapiens
agaggctgtggccagagtacctaatgctcactgtgctcagcaggtcctgaccacgaccctgactcagagctgagggcctccttcctgccactagaggccccacacggccattaggccgtacccacaggaagaggctggagcggaaagtgggaagcgaacctcgaaggaagagcagccaggcccggggcactgtcacttgccgtcccctctgcagctccaggtgtgtggtttgtgtggctgtggtcagagcagcaccttggccagagtccagggcctgtggtttcacatgcccaacccagctcagcagcaggatgaggaccacagaggcaaagagcagccagaagagacccaagacatagaagcccagggggaggaggcagcaaaagtcggggtggagaaaagggtcatttctggagctctccaaatgcccttggagcaccccacggagctttggtggctgatcaagttcagggatggtttttttggtggattctaagagtgatacgggttttgtggtagttaaaaatgtgctttttggagtgatcaggcttgtggcagacaccaggatggtcgggcttgtggcgatggtcgggattggggtgggctccggggtggtcgggctgggggcgggctctgaggtgggctccggggtggtcgggctgggggcgggctctgaggtgggctctggggtggtcgggcttggagtgggctccagggtggtcatgtttggggcgggctccgggacgggctctgaggtggtcgggcttggggttggttcagtagtggattttggagttttggagaatgtgatggattccatgtgaagtgtgaaatttggggtccatctaggtgggaatgtggtctgctccttagtggattcttgtgttggatgcaaggaggagggcatttggctgtctagagaagcagtggaccatgagtagaatagaccccagggggttgtatgggctttggtggggaacttgaccacagtccttgtggcacgcaccttatcgccctcagtgtcctcttctgggtagtaatcatataggtctgtgtcaccttcatcaccaagggtggggcacccctttcctgggtatttgtagacgggaaacttgtctgaattgtcacactgcacactggccacgttagaggtcatggccttgacgtccacaccttgcttccatacgtagacattttcagcattgtcctgcagccagcgacgaaaatagaggatctcacagttgcataaccaggggttcccgtggagaaaagcaaaaggcaggaggtgggacccaaaaaagccctttggtattgtatacagcgagttctcttggaggagaagggtgtcgagattctccagcccattcaggagcccagcggggagctcagtcaagttgttgttagccagactgagcttctccagcttgggtgtgggcgtcaggagccctgggggcagggtcttcagctcattgcctttcaggtagagctcttggagttcgccaagaccacgcagggcaccaagaggcagcgaggtcagccggttgaaggagacgtccaggacggtgagagcaggcagtgtctgccctagcaagggcaggctttgcagctgattgtgggatagatccagggtccccagcactggcagcgtcccatcgacctggagcttggtgagctcgcacctatctaggttcagctgagtgaggcgagtgtaaggcatcagggttgccagggagaaggtgtacaggaggttctcactcaggtggaggatggttgtgtctttcggcaggtctggaggcagcgctgtcagattcctcttgtcacagttcacttctaggtggctggccactttggagacctcacagatggggtgggggtgtaaggggcttggcagcaggagcagcaagaggaggagaggcatg

SEQ ID NO: 4055 - DNA, 3552 bp, Homo sapiens
ggggcctgggcctggacaacatggccgcccccagggttagagccgcttgtcctccagccgcctggtctctcttgatgaggatttaacctctggtcattaggtcctgcctgctacctttgtttcaggttagctcaatcccaggcctaaccagcgttttcctggagcccaccccagggccaggccctctcagctagaacatctctctcaggtaaggcgactcctgagctctgagcccacagccccactgcctcctggctctgcccctcctccgtgggactccatcttttacacctaaaaagagtgtgggtggtgaaatctgagtcggggttagaaaacggaaaggggcaattgtggcccagctgctgccccatgggggctgggagctagtttcaatcccccacattcctccagccccgccctcctcctctctagaccaactctgcttttcctcctgctccattctccctcttctccttccccttatcccaccccagcagtaataaggctgtgtcctgtggcctttcactacaggtcagtgcccctttccctgacttttggcccctattgcagccccgcaaaaacacccaccataagcactctctgagggtaaggaagggagcctgcagtctccagatgggcaaaagcaagagtctggtgccatttaagccccgagaccaaacccctctttgccgccagcccgggcccctcaatcaccagccctctagaggccaggcccctgtgttgccctcggagccagctggcagggtcagggcctccgcagtcagagaagtgccgagtcctttcctgaaaggcattggagtcgattctgcaacctaaatcttcacctcctcatcatgggggcctctgtttatagaaatgtgagctaggcaggggctttttctgattttcattctttggagggatagaggacagagtgtttgttgatttttcgtttcggtttcagtttggttgtcattggtttttgttttttgctaattttgccccaccctataaaaagcagtgccacccagaggcaggggagggccctgaggagcacggggtcgccgtgcactcattcctacttccttctccacctgtcccagctgcttcctttggttaccatctccaaatctgagggtaaaggagggggtgagggagaagtttcttgttgcaccaagaggcactgcttccaggcctggagctctgaatgacctgtgtccccattctcaggtctgtgctagcacagccccctgggacggagggacactggcaggatacaggcctttccacgtctggccttttgcagctgcaccccaggatgtagaagccttgagttgggctctgaaggctcaatttctaccctgacttctccagtgagggtgtgagtaggcttcgtgtggaaatgcccacaaaacaaatgcaacactcaagtccgtcggtggaaagatatggccaacaggggcaggaccctcgaggatcacttctgcttgctgggagtggggctgcctccctggccagagcagcaaccaagacacacagagaagccctggaggctgggaggctttccctttgactctagggctctcaaacccagagataaaatgccagggctcttcgctcctccaagcagttgtctcccgtcctgctttgggtctggggacctctgcaggtggttcccgttctgctccacagggctcagctcctctctggctgagccacggtggctggtaagaagagctccaccctctgggtcctggttacgtgggccccctggtccctgtaaggtggatggggtgatgcggaagagcagaggggtgaaggcggatggggacaacagcagcagggtcagaagagggtggcagcatctcagaccacagccgaggaggaagatggggatgaggaggaggctgccgaggaagacggggaggatggactgttccagaagagccaacgccgtttgggctgccgcttgaggtggaggtagtcctccttctcacgctccttccgtgcccgctggtaatgatcttcctccttcaggtaccacacaggtggccaccgatgcttctcgaaatactcctggttttctggggacatggccttcatgtctcgggggaacttgcggcacacgttgttgtagttggtgcagatgtggtggagacaccagtcggccagctggtacgcacagtggaactgagaaggtgccttttgccaagcactccttaacccggttggtccggcggacgtggaaggccttggtgatctcctggttcatgaaggcctcattgttgagaatgttggccaccatcatgcgcagatcaaagacctcgagcagctcagcaatgtgggcaatgtgcatgaggtcacgctcgttctcatctagctcccccgtgtacaggtacttgaggacagcccggaagggccccggctggatggaactgtccatcttcaccaccaccatcagccgggatttgtaggtgagaggatcttctgccatctcttcctggatgctcacaaaagctcggctccaggaagacagcacacgacccctgcccggtaggtaccctgttccgttgccccgtaagatcccgtcgctggtggaagcacggaggccagcaggaccggagcccccagcctcatccacgctctcgcacacgtcaaagctggctgctcggagcaggaagtctcgcccatggtggtggtggtgatggtggtggtgttgatcagagtggccctggtggtcctctgggtgggtgccccctggctccgaggggccccccagctccccctcactcaggtccatgaggaacaggtcatagaacttggaggaagaggtggagaggtagatcttgtgggcaaagatgcgcacccgctcctgcagcaccaggatgacgtccgcgcagagcgggtcctccaggaggtgggcggggcactcctcgctgctggagggagggtcgggcaccacgatgatcgggggcggtggcttggggggtaggaagggtgcctgcagcagaggccgctgcacattgcggaggtgggacttccagaactgcaggtggcggcgggagatgagtgcagctcggatggcgttgtcaaagacgtccttgatgccgaactgggccaccacgctggtctcatagtaggggatgcccagctccttggccacctcccgacccttctctgggggcaggatttcattaggtttgatgggcctggtaggttcaagaaggaaaccaagcttgtgttggtggtggagggaggctgcctgttcttccacaggctggagggactctgctcaggatctgggtgccaatccccacccactcctgccctgctctgtctggccaaatcccatcaagctccttcaaggtccactccaagccctttttcttccagaaagctttccctactatgccaggccccagtgacctccccagtacaaagccgtgacagcactgcctctctggcaattagcaggcaatgcttcacatgggtatttaacatgctcacatatttagtttatccctcagcaaaattataggactttttcatgca

SEQ ID NO: 4056 - DNA, 828 bp, Homo sapiens
ggtgagagaagcagaggcccaaaggaatattgcaaatacccaaggtcaccctgtcaggagtggcagaatagggctggaacaaggactcttttctctggacagcttgcacctacaatcctttccatcttgcacctacaatccactcgaacactgcagcatggaggcagactccttgccaacgggtattgtcgagagcttcttcctaccatcatttgaagaaaaaaagcttggagatggggaagaatgattgatcaacatgtttcttccttagtttgttactgctgttgttttaaatcgagaaagcatttttaaacaggatggggggggactgataatatcagtcctccttaatttcattacagccgagtcatcagtattttagtatttcttgcaggttgatgattacaacaatataattttatttattttaattaaactctatttgcttcccacataatttgtgttgactcacaagaaaaacatgtatgtgtaaacccagggatattagactaaaattgagagatcagaaacgatgtagaacaaatagattgcgttgacgtgactacgaagtattataaaagaaaataaacaaaaatcatgattaggaaatatattatgactatgtttatatatattcagacagttactataattcaggttcagatacgattccaagctgtctggcaagaaagtcaaaatggaaaatgtgctcttactactcctagggggaaacattgttccttgcatgacttctgaaaggtaattctgatgtgtcctcgacattttcatagcaaacgtggcagcaaattttttaggtaaacagcttat

SEQ ID NO: 4057 - DNA, 706 bp, Homo sapiens
cccggccctcacctggaagaggcacgttcttttctttgttgccgttggggtgctggactttgcacaccacgtgttcgtctgtgccctgcatgacgtccttggaaggcagcagcacctgtgaggtggctgcgtacttgccccctctcaggactgatgggaagccccgggtgctgctgatgtcagagttgttcttgtatttccaggagaaagtgatggagtcgggaaggaagtcctgtgcgaggcagccaacggccacgctgctcgtatccgacggggaattctcacaggagacgagggggaaaagggttggggcggatgcactcctgaggagacggtgaccgtggtccctttgccccagacgtccatgtagtagtagtagtagtaatcacaatggcagaatgtccatcgtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaccagctgcacctcacactggacacctg

SEQ ID NO: 4058 - DNA, 1697 bp, Homo sapiens
aagatggtccaacctgtgggtatttttaaaaattctaacaggagaaatcatttaaaattttgctttttcacaatggcaaaaaggaaagaatttgaacataatatttaatttttaaaaaaattcagcctgactccgaccctgaagatttcagaaagaacatcgtcactattaaaatgatgacaggcccaaatgggggattgtttaaccagttttcctaagttaaaccaagaataagccacaagtattcaattgtgttacaacttagatctgagacatttacatcaaagcatacttccctgaacatgttcacatttaaaatgcttaaggtcttattattaaatccaaaataccaaaagtattagaggagctagttatacaatattggcacagcatttttaagcaataataaaagtttcattttgtcaccttaagtcaagatccatttatctattaataggttaagtctgaaattctgtaacatattctagaagcacctacatccattatttccaggagactagtttactactatcatgcaatcgctgaggtcatatgagtctaaaatgaagggaattgctgaacaggcccttttgctgttgagatatgaagcccaaatctttgcctctgaagacggaattcaatgtggtgtgtgtaatcacaagtaaaaacttgagctagggaggaaccttggatattcagtctacatctcaaacagcatagctgccaaaaatgaggcctgtccattaaagtggaggagatatccttgctgatggcaaaaactgctttttctttttgggacggaatcttgctctgtcgctcgggttggagtgcagtggcgccatctcagctcaccaaaacctccacctcctgagttcaagtaattctctgcctcagcctcacgagtagctgacaggcgcccacctccacgcccggctaatttttgtatttttagtagagatggggttgcaatgagccaaaatcacaccactgtacactccagcctgggtgacagagtgagactctgtctttaaaaaaaaaaaaaaaggaacattaactgcaatattcttgatgatgcaaatttttaaaaactaaatccagccagatttttcagccttaaaaactaagatccaaactattcaacatctctacaaattatatactcattgaattcaggaacaataacagaattcaacaatcagctcaacttaaactgtaagtaaacaaatatatttagcaactggagcccctattattagaaagcaaaggtgtaaccatgaagtaattgtggtagtgaggctactctgtcgccatttgtttatgtgtataattaaccacaagtgttaaatagtttttagttgccgagtaaatatttaattatgggaattgctttaaactcctcttcataaactttaagaacattaaaataaatgtaattttaaaatatgttaagaccatagaattcctgtggtctgtatgcctgtgactactataataacttttaagtagaggagatactctcttacatatttaaggttatttttatgcataatagaattgctttcttctgactaacctacatggcaaactttccccaaccctctttttctggaaatgaatacattcctttattcttttctcaaagaactgttctttatgaagtgatataaatagcctacaaataaacattaatagcaaaa

SEQ ID NO: 4059 - DNA, 5387 bp, Homo sapiens
tgagaaaaggaactgactgtgccttaaaaaaagtgaagttgccaaaagtgagtgattttattgtgaaatgatcggccagtcactcgtctccggggcctgaaggctgaccctctctgacttgaggcacagccaaggcctgggggtccggggaaggtgcccgactgtgtcccagggctgcggcatgcccccccacgcccggtcaccacttttcctaggagccaggctgcgtggactgggggcctgtttgtgcaccagtttgcacggcactttatcaattcattaaatgaatggattttggatgctggatgtgtgggcagaagaggggcaagagaagaggtggcaggtagactccctcctcctcacatttgacccaactagcaaacttaaaaaaaataaaataaaataaaagctgacccccctccccaggtcttagtttgctatctctgatgtaaaaatcaattattttttctctcttttttttttttttttttcaaataatccatctaacagccatgagaccactcaagtatttgaggtcatcagctgcgtccatcaagacatgatattgaacatggacaccatctggtctgttggtctgtttttgttggcaaaggactccaaaaggatgcagttgtatgtgtttcagctgaaccacataccatagctcctctcccctcacaaaagggtttctctggggggagaaaagtaactgattatacctctcatgtctcaaactgaaattctgagaagcaaatggtcagttgagggccccattccagatctgccgggacgtcctcagatgtccagagctggcaaaaggtggagcaggcagcagccttgggcaccagcctgtctctttctgttctgataaggccacacacatggctttttgtgataagcttccagcccatgccactgaaataacgtttaagaacctgctgcatttcacagaaatagcgtaatggaaatcattatgtaattaaacaaagcatgaagctcattatctttttctttttaacaaaaccttcaatttcacattttagtgtacactgtggtttccagagaaatatatggatctcctatattctgagtcagaccaaatttattgcctttattcttaccctagtctatggggtcaataaccgttttcctgaatgctgtcaaaatggtgcctgaaaatatctaaatcccagcaaaaacctaggcctcaactttggaacccagtcatagatctttctaggcagaaggcctctcaggggagtacatgccctgggcaaaggccatggactcggaagcaggaaggtcacgggatgatttaatggcatcgaataatcctttggtgagatggcctttgttgccctcagcacagtcgaggcaggttaatcatttatttgccacaacccttccttgctctgtaaagctgcagcacaactgggtggtccgtatagccttttctgccacagatgtttgtggacatttcacttccagactgtgacgtctgaagatgggcttgaatgacagcagccatcatcgctgccattagggaggtgcacacagccccctttgctcgatgcaaatatttggttggtaagaaattccagtgcagctaaacaagtcagcttggactgagttaagaaaagctgggccacttttaacatgagaagagcagatacttccccatgcttggcaatgccaatgccgtaaaaatgggaagtgttgagacaaacctcctgtggacgagaggttcccgtggacatttttaacaatcatgagccttcaggtggtggcatcagtcttcatgggtgacttctatggacagcataattttcttgcctctcctgaatctatactacttttctgaatgtgaaagaaggtctaaaaagtaatccctcgggatccctgcatcaggccaaccatgctaactgcagagggtgaggctggcagtccaggagatgggagctgaggacaaggctgcaggccctacatctggaggctggtgttttcattttaaaatggaggctgatttgctgttaccccctcaaacagctgaggagaccacaggaacctgctttgaaagctgcccagagccatggcatccataggtggtgagctgtgggcatgttctcctggtggcatctgcattttgaaaggccacactgttgaagaggtaccagctgttgaaggtggccagctttccccaggccccaggaagccccccaccaaaggccaggctgtcggtcaagccagtcttagctgggtgcattgggcttgctgtgttgaagcaatgaatctattttaaaactggagttcagtgagacatttcaaagacaggtgtggccactggatcaggaccaaaaaaccctccatcatgtatgcggctggtaagtagcagatgtgcgcagagatacagtggtttgaaaatgggagtttgaggtgggaagtgcttggaaccaaacacagagaggcccaggtgcaagttcagaggagacagaccttaggaagtcgcggtttcatcagggcttgctttggtgcatctgtttccatccgcatctggtagggtctctctgaggaagtggcttcctcgtggccagcaggaagaggtgaagaggagagggggtgctgggggcggtgcggggaggggggtttgtcactgcaggccgggaccatcggccgcttctcctaagcccaagacgtgcccaatgtcagtttcaccaaattggggtagcaccttttgcacgtatcttcaaggctccctttacacaaccgaagttccttccagacgtcatacgagatgctgctcccctgtgtgtgggcaggctcaggtgtgtgcactcaaggagtctccatcccacctgccctaactacagaggccacaggctgtgcgcctcagctctagcatggccttttgcagggcctgctgaggtatttgttacatggtccattgcggggaagtggtggctaagttgttgacttctcacggtatagcaaatctctcatttgtaccttgagctcttgctcggctctgggaggctgccctgtccctggaacctccagacaacgctccaggaaggctgtttccctgggggtctaaaatggcccagtgtaagaaacgtatcagcgcagcagaagggtgccttgtctgctctctaaatgcgaaacaaaacaaaacacagctctttaaaacagggacagctctcctgggcatccttgaatgctgagttctgggtttctgccccacttcacgtccattatgttcgtatagcaaacacacccgttaggaagatgctttatactcttctcatcggagctggaggaagggtcaagcggaaacaggcaagcgaggtgggaagaaaggcaccagcagccgtcagcccgtgctcccagtcccgctcctgccgctgtaactggaagcatcttgttttgacaattcatccaaacggccttaggccctgcacagttctccggtctctggaagtgtggtggggacggaatccaacatgtgggacacccagctggaagtgccaggaggtgggagaggagggatgcgccgccaggctcccctggacaatggagaggcctgcgtctgctcccgagccacagccagctggcacacaagaggcacgtctgggaggagtccctcgccgtgccttcaccctggtcagcacggtagaccaaggctgttaggtctctgaggactttggcactttttgctattaaaagttgagaaaatgaaaaaccgtgtttaaacaatgacttgttgaagagtgggtaaatttggcgacttcctacattcgctgccagagggagcgggtgccacacatgtgctccgacactcctggaatctgtcctgacatctcttttgttcttttggctgatgtctgttgaaacccagcaagcaagaaatgcactctgttaatagttcccatttgaactggggcataatcagcctatatttgagtattgatgccctgagaaatctatgattaggtgacccaaaatattccagcattgagtggcaattagtggttttgttatttaaagaaataggaatgcctgatttccttccctatcaacacaagagaccaatgtcgagtgactttcagcctgaggtcacgggtgtctccattctggcttcaccagagatgtccctggaagtcttgctgggccttaaggaaaccaaaatgctcaccatcgctgctgagtgtcccgggagctaacatcgaacttgccagtcagctcactgttactgctgaaagcctgagacggggagctattttaaacaggttttatgaaaatgtaaacagaacaatgacttctctgaaaaccatgaggctcactttcctggaccacatctccttgaatggcacagggtacatcagagcgagcagctgcagggtcgctggggacaacacaggcttggcattgggctccagcccctggatcttgttgacacaggggcttctcattttaggaaataatactgaaacggatgcaccatgacagacactcaaaggctagcttctttctgaattaggatggccacttggctggtggcatatatggaaacacttttatttgcttttggttcctaagacacttgggcagactgcccgccgctgctgctgccattgctggccaacagcccctttgattgcatcttttttttttttttttgccggggtgggagagggtggaatctaactctgtcacccaggctggaatgcagtggtgagatcacagctcactgcagcctcgacctcctgggttcaagcaatcctcccacctcagcctgcagagtagctgggactactgatgtgtgccaccccgatgaactaatttttaaattttgtgtacagacagggtcttgctatgttgcctaggctggtctcgaactcctgggctcaagtgatcctcccacctcggcctcccaaagtgctgggattccatgtgtgagccactgtgcctagcctgattacaaaaaccaaaacggactaaatttgtaatttttaaaaaaggatgtcctaaccctaactttcacttttttctagtggaagtctcacactgtgtccttcccactctcgcattttcataatgctggtcatgggacccttatcaatcctaatcattcttaaaataataatgacctcagaagagccaaattttctaaagatgggggagaggcatcgacgatacctccaggtgcccagcgactccctggaggcggtggtcctggcagttccagtccagatctaaaaattctcaacaggacaatttatctaccaggtggacagagagagaaagtgtttccaggtccatatattcttgacaaactaccataatcaacgctgccttcccagctggactgaggttggtaagttggttttgaa

SEQ ID NO: 4060 - DNA, 1894 bp, Homo sapiens
gagatggagtctcactctgtcacccaggctggagtgcagtggcgcaatcttggctcactgcaacctccacctcccgggttcaagcaattctcctgcctcagcctcatgagtagctgggattacaggcgcccaccaccacgcccagctaatttttgtgtttttagtagagacggggtttcaccatgttgcccaggctggtctcaaactcctgacctcaggtgagccacccgcctcccaaagtgctgggattacaggcgtgagccactgcacccagccaaaaaagtttatctttcatgtttcagataaagccattgctctaataataataaaatatgatatgcaaacaaagtgacattgtgaatctgtacccaccaaaaaatagcacttagaatatgttttgcataggtttttcagtgatctgatttcaagtatgatgaaagtaaatggaataggaaatttatgaagctataacatctcatataatatttaaaatgctatgctagatttttaaagttgcataaggagttattttagtgattcctacagtgatctgccaaatcagctgataattagctgagttgagtctaagaggtaagctttggaaaatctagcttgatctttgtgacagtcactgaaatagagaagaggaagattaactatgtttcacagtgcatcgaaaattcaagtgagaaatcattcatttttattcccggcctcatcagagtcaagctcgaaggaaggagaatgacagaataattgaactggaggatgctggatctcatttagtgcaacccacttattttggacatgagggagctgaagctgagagagaagtgacttgcccaagatcacagtcatggcaggattgaaacttaaacacgcatctctttaatttggtctgctgaattgtgaatgaatgaagcattatggcccatatcaatcacatatactcagtcatactttcgtgatcaccgcgacctcaaagtaataaatcaccctcatttaaatatctttcattaagagataaaagtctctggacttttaaagcaagttgtaatcaatcagggaaagtcatttgcaggctgggattgagtctcggttcaaacaagagttggacccttctgacccttgaagcataattaaggcagcccaagaagtgcacagcttagatcttctttcagagaacctcaaagaggacttgctccctcagagctcacaccaaagctgcgctctctgggacactccatgtggctgggacactagggccgagacttctctaatgggcaatctttagtgtcaggctccatcagcctggccacttgctcagagtggcactgtggtctgaggctctccctgagaatgctgcttctttccccttcacttttcacaggtggcacacctgtgtcacagtctgaagccttcccacctcatcctgctccctctcccctttgtctttcataggcatcccccaatatgtcacttgcacttctcattctctctggtgtctgtttcctagaggacctaaactgacacgtgactgtgtcatttgactttattggaagccatcccatgcacgcacagagcacatctggactcatgctctgacatcactgggtaccagtttggggttaattcatgtgatgacttcaatctatgaggctaagttgcatggcttgggccagctcacttatattacctctgccccctaaccttgcctctgttggcccagaaacacacactctctctaattgaatttctggatacattatgacagtatctagaggtgttttgtaaatgcaagttagctcagcagtgggacccacagtgtaaataaaatgcttccaggattgattgtgtaaactgcaaacttttatttttattttattttatttta

SEQ ID NO: 4061 - DNA, 8231 bp, Homo sapiens
cccgacatacacctgtggggcaaggggccttgttctcactacccctgctcagggctgagggcctgagccatgcagtattatataaagggttgactcggggccctcactctggggctggggcccagactactccagcatgcaagttccagagccagcctcttgctaagggccagtccctgcttctccccacgggctagacccaccccagagcagctcagatttggtgcctgcttctcttcttgccccctagtcctagctgttcctggcagagcttctgtcttgagcttggccatggatgtggacacagcctggcacataccctgagtgcggtctaaaggatcaagggacacaaagcctcacccagagagtgccaagcaaagctgatacttctattcatacgcatgcagtgctcagcctggcctccttcttcccaccaagaatgaagtggagccagcagaggggttgccctgcaatgtggtctctgccaacctgggcccaggcctagctggataggtggtaggagagagggctgctcaagtaggaaggaggtgagcatcaggaccctcccctcccctggacctgccttagccctgttttgattctgaccatccagtgctctggggaccctggaaaaggtcctggctccaaggtccacctgaccagccaagcctggcacatccatctctgtggtcccaggatctggccacaggagggctcctggacacgtaatacatgaatagatggagtgacataaagaattaatcagtgggtgacttaggcagtgagaactaggagcagaagaaatgaaagagaccaggttgggaggggggatgctggtagggccaggtttaggggagccttaaatgccaggctgagagggggtgtttgtcaggctcccccacacccagcttctgccctggccctgggacaatttccgtcttccagaggggccagtagggatcctggcagatgtggccctgatcacctgatcccctctcagagagacagagaccccagggcccatcccccagagcctggctcacctgggccctcgcagggcctgcctcaccggggccccgcagacctaactgcttctgcttcatggtctgtgggttttcccagtcgtccaattagtgctaattggaagcaggaagtgtgtgcatgtgtggggtgggcctggaactccgatgtccttgtcagaacttcgaagccctgtgcttcctgggacaggctcttccctagagctttgtggtctcccgcagggctgggtagggttgttgggagctccccgagcattgggtatactggctctgtgcacaacggggcctctgctctccagagggctcaggctctcaccggccacctcttaccccaggtgccagttgcccccagggcaaggcaagctcatccttttcactgccaaatcctcttcgcccggcacagagctgcggctcttcacagtttcactctaacaacgaagggaatgatgggctcagggcctggaagagaggcgcagagggggcctcctgaacccctcactgacccttggtccagcctcagcccgtggctccataaaggcaaggaaaggcctgctttatctgactggccacacacttgtgcttcccttgggggacaaagggtgcagaggcgcttccacagaggcgggacttccgcttactttccctcctccccgtttccccgccccctccacttgcggcacaggtgggggtgtccagaggcaaagccccttttgtgtcaagccccagcccaggttctctcctcacccacagatgctggtgcgcagtctgacggcagaggctgtaacgggggaagcatgggatgtgggcacatgggggaaggccccggaacccagcctgggcagaggccggtgccccaccaggctctctctctgcagtgttatgtcaatcattgcccacaggtgccctcgacctggacaccgtcaggcctccttcgcggtgggctgaaaccctgtggcacagcccaggaccacccagccccacgggctgggggctcacatctggaagcagggccccccaggactcaaaggtgctcggagatgaagattgctgggtgtcagctcatggggccagcctcggcttcacccccaggaaatgcctgcttgttgctgtgcggcaggcactagagcaggcagagagggcggtgggctcctctgaggtcgcgggcggagccctgtgaggagagacctggccgccggcagccactagagggcaggaccctcctgtgtgtttcctccaaagggttgttgagcagatgagcgggactgacaggaaacaatggagcagccgccccagggtgcagtcaccacaagcctgctagaagggctcagcggaggctgcgatgcgtccgaaagtccactggaccctagaccttaaatggcctccctgagcctttaggcttttacttcctgggagcccagccctgagccaacagagacagtgcctggctcctacattggcagagagtgacaagtcagtgtccccttcttacaacatcagtggtagaggagcaattaggagagcaggtcctccagcttcttccaggtgcagtgtggaaacagaggcagagaagaactcacctgaccgcacctacgaggtgggtagggacagatacttctgagagtgaaccatcagccaagcacgcccagcagccctggggggtcagtgcatgttgtcgggtgctacttttgcagttggggaaactgagggtcaagagaggctgtcatttgactgaagtcctacagcaagggtggaccagggttcccgcccgggcaggatgatgctgagcctgcatgcaggctcccacgcagccttatcacagcctcatgtagagacgacctcctgtgacctcgctgacatgagtgtgagtgtgtggggaccctggctgccgcagcaggaatgaggcagcctctctgcatcctgacactcccaggcagaggcctgtccttcatctggacctaccaacagtgacgccaggagcagctgcctctaggacacgtgttcccctgggccagaggaactatgtgaggaacccatggtgcatgccatgacaaccctcctttagggcctcttgaggccacagtggtgctaaacccaggaagtgggtgccaattcaggggaccattggcagccctgctgcccctcactgggctgtgcctgcagtcacgggaggcaaggacctgcttttgagtctttggcttcaccttgttcttacagccagacttggggctctctacctggggctggggataggtagttctcagcctgggcagccccaggagctgctaagtgtcatatccctggggaaggcctgagcagtttgaggctgattttggttgtcccaatactgctgggaaccactggggaatgagagtgtcttggggacctattcctggagcctgagtctaagctgagctgtggctcataagactaaattgcatggagacccaacatggctgctgggcccgtcaagggctggtgtctgctctgggaggtagccccatggctggatctttctctatgtcccaggtcggcccctgtgacctggggccagtgtgctgaaacctgtgaggatcaggcatagcgaggagggtggccccataggtaggcccatacaagggacttgggcagagtcctgtcctccagctaagtatctggggcaccaacctcacagactgcagagttcactctcattagcgcaggggtcctctcaacagcttcagtgaccatagggatcggtgtacccatttcacagatggggacacgccggctcaggtcttaccaccctttgccaacagcttcttcactggtctccttagcttccgttttcccttttccttccttgttttaagctttcaaaaaaaatttttaggctgggtgtagtgtctcctgcctgtaatcccagcactttgggtggattgcttgagcctaggggtttgagaccagcctgggcaacttagtgagaccccacctctacaaaaaattccagaattttctttctttactaatttaaacattttggctgggcttggtggctcatgcctgtaatcccagcactttgggaggccaaagtgggcggatcatctgaatcaggagttctagaccagcctggccaacatggtgaaaccctgtctctactaaaaatacaaattagccaggcgtggtggcatgtgcctgtaatcccagctccttggaaggctgagccgggctggtcttgaattcctaacctcaggtgatctgcccacctcagcctcccaaagtgctgggattacaggtgtgagccaccgcacctggccaaaaaaaaacttttaaaattatttagtggcttattatataagaaatacatgaatgcatttttactttaaaaacataatacacccagcagtttgggaggctgaggcaggtggatcacctgaggtcaggagttcgagaccagcctggccaacatggtggaaccttgtctctaactaaaaatacaaaaattagctgggtgtggtggcggatgcctgtaatcccagctactcgggaagctgaggcaggagaattgcttgaactcgggaggcggaggttgcgataagctgagatcgtgccactgcacttcagcctgggcgacagagtgagactccgtctcaaaaaaaaaaaaaaaaaaaaaaaaaaccataatacagggctggtcatggtggctcacacttgtaatcccagcatacttctgggctcaggcaatcctcccaccttgacctcccaaagtgctgggattacaggcgtcagccaccgcacccagcctgttttgatttttttcaagagacgaggtctcactatgttgtccacactggtcttgaactcctgggctcaagctatcctcctgcttgtgcttcccagagttttagattttcaggcatgagctatcacacccagacttattttctcctttatccccaaccactgcagttaggtttgggttgggatgggggcaggtgggagatgggggaagccaacctccaagcagggcaggaaacatctagccagccccatcttcctgaatccacagctagggtgcctcccagagagcctgctctgctgcagggcacagtggggagtagtctgtctccatagacacacagcatcccaaagccaaacatttccctcctcagtccttgtaattgccactaggctgtgcatatatgggaaacccacagggtttacctcatcccctattgctggacatccaggctgttttcagcggtgctgttacagctcactgcagtggccgccacagtgcaggtctctgccaggctctctacggggaggcgctgggaagtagaattgctgagctggggggcaggggctaagtcaccctccaaaaagcctgtgcccacccccagcataggcacttgttgtactaacactttgctaaaacctctctcttcaatgggaatttgtctcattgcttatgagtttgcttatcttttcttactgagtgatcatttttatttccttttttttctttttccccctcacctctctgaattttatttatttccttttaccatgaagaatctgcttatatcctttccccatttttccactatggtttttatcttttccttattcatttgtagatctttatacagatgctcttcaacctgctgtggagtttcatcccaataaaccctttacaagttaaaaatactgtaaaatgaaaatgtatttaatatgcctaacctactgaacatcatagcttagcccagcctgccttaaacatgcccacaacactgacattagcctacagttggtcaaagtcacctaacacagtctgggcacagtggctcacacctataatcccagcactttgggaggctgaggagggcggagcacttgaggtcagaagttcgagaccagtctcgccaacatggtgaaaccccgtttctactaaaaatacaaaaattagccacgcgtagtggcacatgcctgtagtcccagctactcaggaagctgaggcaggagaatcgcatgaacctgggaggcggaggttgcaatgagctgagattgtgccattgcactccagcctgggcaacaaaagtgaaactccatctcaaaaacaaaaacaaacaacaaaatgtcaccgaacacaaagcctgttttataataaagtgttgaatatctcatgtaattatcaaatattgtgctcaaagtgaaaaccagaatggtcgtatggatacttgaagtatgatttctactaaatgtgtatgacttttgcaccattgtaaagtaaaaaaaaatcccaagttgagccatataagtcagggaccatctgtacattctggatttaaatcctttgttgtattttctcgcttccctttgccccacctggagaggttgactctagagggagtgcaggggacagggccaggaccaggctttctgcctggctgcagctcttggatgttatgttggaaaatgtctaaccctggctaggtggagacacaatggccaggtgacttttctgaaagcctctgttctgtcacctgtaaagtggacagaatactgcctaccttgcagggttgtggtgaggattaaaggaacccacccatggacaggtcatctgatgagtgccacacacatgtgaggtggacagctgctgggcaggaggcaccgtgtcgagtaggtgcccaataaacggtgactgtggtctctgtgcccagtgagtgtatgtgggtaccttggtggggggggtctctcctgcagagccagtgctcagaagtttagcatggatggggggcagtctgagacagggctggtgcttggaggaagggagaagtggatgggctgagcttagggagaagacaccacaaggttggctcatattgggtgcagttgtgagggtctactaaggtcaagccctgtcccctcctgcatcaggatccccaaaggaaagtgttgggctgacttcctccagccaggttggctacagctgaccctctggtcccactcctgccaggcagtcctggggcctcagaaaagccctttggaggtgacatgtggtccagcccacttgagggcatgacttggccttggctgtaatctgctgaaactaaataggaggtatatttatgagttgccataaaaggcactgacatactggtgataaaagccaccaaaatcgccctgctgtaaactgccatttacatgtttatgaccttattccccagccagtgggttagatattcccattatcactgaccaggaggctcaattctcagccaggggcctgcagggtgagttgaaaaaaggaagcactaatatgcaggcccagggccactgcctgctcctccttgcagctgctccctcccaagagactcctcctatcgagcataccctggaggcttattctcttactgaggagtaacttacattcggtacactacagcaatcatgaatgcataatacagctcaatgaattttacataggtgcacacctgtgtaaccgtgaccccgagcaaacttcctcaccctaggagattcccttgtgccccttccccgccaatgtcccctagcccagaagtaaccaccgttctcacctccatcatcagagatcagttttgctggcctagaatttcacccaaatgtcgtcatacatgtgttttcttctgtgtgtggcctcctttcatcaatacaatgttttttatttttgtatattttttgagacagggtcttgctctgttctccttccgtagtgcagtggggcgccatcacggctcgctgcagcctccaactcccaggctcaagtgattctcccacctcagcctcccaagttgtagctgggactacagacatgctccaccgtgcccggctgattttttctatttttttgtttgtttgtttgtttttagagacagggtttcactatgttacccaggctggtctctaactcctaggctcaagcgctccgcccgcctcggcctcccaaagtgctgggattacaggcgtgagccactgcgcccagccaatataatgttttccagattcctccacgctgccctgtgtaacagttgttctttcttttttatcgttgagtagttgtctccattgtatggatggataggccacactggtttatttattctcctattgatggatatttgggttgtttccagtttttggctactatgaataaagatgctatgaataatcctg

SEQ ID NO: 4062 - DNA, 3269 bp, Homo sapiens
ccctctccccgcagccgccgccatgttagacgctctctccatgtgccccgagtcccagccatcctctccagtctccccaggacccagcccccaacgaatctaaatcgtggcagtcccccgccccttcacagtcccctaggaacaaaaagtcgctgcagaaaatcatctcgcgattgagctgagcctgaggctcggggggacacctaaacaattgaaacaaagagggaaacgcaggggagcccatcgcatgggcgcgggggtagcaaatcgaagacccattcaaaatgggcctgccggaaaggcagttctaccttaagattctaaacacacttctctcctacggaagaagaggggacgctcgacaggtctcgagtgcatggtaaccgagcggacagaccccaaggctgcaggacgcaggccgccccaactccacgaggcggtcggttgaacccggagccccccgcgcagggacctcttcattttgggccctcgtcagagaaatcgggcctcagagacggaaagaagggcaccatacagtgaagtcctgacgacaggcccccaccctcacatgtcccactcctaaaggccaaaaagccggacccacagcggaagagtaataaagaggcctggggtacagtgccgcgtccgagtcaggtgacaagtgcctcttccaagagcccgttttctgggcacgaagctcccgctgaacgtggagacggggcgtgtgggccagggggtgggaggaggggacctagtaacgctcccgagacgaaaagaagcgaaggctccagcgaccagggtcggaggggccgcagagcccggccgcagccacccctcccttccccgccaactcctggcacctttttcttctccaggttccgaagtttcttgtcgatcaccccgagaatctgcttcatggcctcggtctggacagcgccggtgccggttgcggggtgctgagaagccggcgcggcggccccggctcccgcggccgcctcactcccggaggaacccgacggcggtggcggtccggacgacttgctgccgctcccgctgtggctggtggccgagggcatcttcagaccgcaaggagagagaagaaaaagcgggaggaaggacaagagcggccagtcaggagacggacggggcgagacgcgggacaaaacgcgcagcgagcggtagcctacgcgagcgggtgggggagggggcgcggcgcgcctcgagggcaggaagagtgcgcgggcgcgcgcgcgacccgccagcggggcgcccggctgggcctcgcaccgccccccgacccgcccctcccccgcggagccgccggctcggcctaccagcccgggggctccgaggctcgcgccggaggcggggcatcgccgcgccggccgccaacggccactgcaacggtccctaccggggagggccggcttttgccggcttccggagaagggaggaaagagagaggtttacctaacactgtaaagagaacgttcaatgaaatacaaagaaaaagatgatttttttgctccaagagaattattccagccttggggtggagtgggtgtggacagtgagcagaaaaacaagaaaccaagttctgggaggaaataaaatgaatataatcagtggaaaattcagcaacgcaatattgtgtgacaacagtaaatgaccaatttataatttaaattctatgaaaaagagatttagaagagagttctaccaaacccactgttccctagggaataaaatgagtaacgctgactggcaacagtgcatcctgagggagcctggagaaacaacagcagcctccgacctcaagatatcctggtagtgctgtgacagtgtcttaagtagggcatgttgatagatggaaaaggacggcaaactcgaggtgctgattcaggaagaagcagattccaagatggaagagaaaatatcgagagaaatatgccgagagaagaatccaggcagaatggaatccaggcagaatggtgaatggaaggttcgggtgaccaagagaaaggaagggtgactcagcaagtctgtagtttcagctcttgtatagtacgttatacttgaaaagctgaagccttttctcggggaagagtcagaacggcctggagggcttgctaaagcgctgctggctgggccccgcccgctgaatgactaatggagactctgagggccggctggtaatttgagtttctaacaagccctgtttcgatgctggtacagccgatctagggaaaatattggaacaaggaaaaaactaagaagaaattttaaaaagtaatcaaaggcggccaagtgaggtggctcacgcctgtgatcctagcgctttgggaggccgaggcgggcagatatctgaggtcaggggtttgaagaccaacatggagaaaccacgtctctactagaaatacgaaaactagccaggcgtggtggctaatgcctgtaatcctaactagtcaggaggctgaggcagaggagtcgcttgaacccaggagggggaggttgcagtgagccgagatcgcgccactgcactccagcctgggcaacaaagactccatctcaaaaaaaaaaaaaaaagtaataaaaaatgacagtagtgtactgtaatatgtatgttttctgctgctactttttgttttgcattttcctcttaaagagaccagaagatggctgggctcagtggctcatgcctgtaatcccagcactttgggaggccgaggcaggtggatcacctgaggtcaggagtttgagaccagcctggccaatatgatgaaaccctgtctctaccaaaaatacaaaaattagccaggcgtggtggcaggcgcctgtaatcccagctactcgggaggctgaggcaggagaacggtttgaacccgggaggccaaggttgcagtaagccaagatcacgccatcacactccagcctgggggacaagagtgagacttcgtctcccaaaaaaaaaaaaccaaaaagagggcagaagagaaaaaatagaaggagatattggacatcctagtcataccccatttagactttgcctacagaggacaatgaaagaaggcagcaaccttttctctgggccctccttgtctaaaccaaatgcagatctggcagccctatagtattgcaagatcatattccttggcgttctttggagctagagctggtggtgtttctcctcgtgaatgctgtgctaacatccacctaaagcggaaagaagacagttctttaggatagctagggctgatttgatgtgagaa

SEQ ID NO: 4063 - DNA, 2233 bp, Homo sapiens
gttttttaattctaaattttgatctagggagccctcagacataaggagaaaccaatatgttgaatgatggggtattacatacagaaggaccaagaccttattttctcctacttaagatggaatcttgttaagatgaaaggacagctttttaaaaggagaaggtcataagacagtttgaggaaggcattggaagaggaagaggggcaatgtctcctttgttttattgttggtatataaacttaaaatctcagttctttttatggcacttgtggagccacttcctctcctcaccaaaaaatgcccagtaccctgaatccgatcaaattactctcctaaagtataaggcttagtttctgtgtgctgcttcgcgagacagttcccacaaatcgagagtgttaatcagacttttgtgttttcttttttggattgctgttgtttgttttcatttatcatttgtctttgcctaagccaggctcatcaagaattaacagccatcaggctgccgatgtgctgacagcagacccacttagagtcctgtgtttgtaattccatgcatttgttattttacctgttttgtccctgccccttctagtcctgtgcctcctgattgctgagtgttcacctggaccttctgactaccttccctgtgctattccatcagcctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccgtgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaaggtagaacctctatgcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagcttt

SEQ ID NO: 4064 - DNA, 1529 bp, Homo sapiens
aaagctgatagagatgatttcataacctgtgacctgttgataatgtgaaccagactcgagtgaggtcacaatgaaatagaacaaagtcttttatgcgggttaaagattcatggacaccgggaagttgttttgtgtatcatttttcatgtgaagtattaaagtacaaactttaacacaccctttgacacacttccaatgtccttaggatatgacaaggagatcagtttttaagtaagagaaggggtttgtaaatgagtcctggaaattatcgcatgctatcgagttaaagcctcggttatataatctcatcgattataactcacaccagtgttttgtgtaccactaagaaagaaagaatgctgccagttaaccgtgacatgctattaattgtgaaatacatcacctttctttcttttcttttctttctttctttcttttcttttctttcttttcctttctttttctttctctttctcttcctctttctttttctttctctctctttctttctctctctctctctctctctgcatttccatttatttccattatcagcaggtgaagaggcatctgccacctcacccagctaacttttgtatttttagtagaaatggggtttcaccatgttggccaggctggtctcgaactcctggccttgtgatccacccgccccttcctcccaaaatgctgggattacaggcataagccactgcgcctggctgagaaaacatttttaactgatgttaatgagcagcttctaaacacatgattaggacgcagaagtcgttccctctggtggaatctataatgattacattaattcattttgattaattagaaatattcgtatctaagagcatccatgttgagagttttttgtttctaagtggattatgatttatgtaagatagaaaagacaatgggattacaggcgtgagccaccgcgcccggctactattatttcttttaaggtggtagtttggtttcagggtcccccagcactgcaatggcagcctatcccttctgtcctttagttcatgctctgctcattgcacaggttaggataaactggtagtaacattgcttcctaatcatgtgttgagaagtcgtgaagatcagttagatgagatgtattttgtactttaaactttttagatacgagctttgtcaaagtacaaaattgatccctataaaatctatgacacagcacagccaaggccaactactgtggattctgttttgtaagaagagagttgaggactaaatttcaatgtgatgtagagttaatccgtagtaatgttcattgaccattggggataaatttttacatgcccacattacttattgtaaaccctgaagacctttagcgatgtatgattctgccctggaatatgtatttactcttttggatatttgcttatattatctagggaaacatagttgaaattatttcttccttggagctcttgttaacagcgctataaataagtgttctatggagttatttttgctctttgaaacaaacaggt

SEQ ID NO: 4065 - DNA, 4276 bp, Homo sapiens
catccttttccgccctcatggattggtggttggtatcagctgctccaccttttctaccatttactgaacgagttgaggaaaaagggaaggagtctcgtctttacatccttattttctttttttattggttggcacctatgccactcacgtggtggagaggcggggcaatagttggagatgattggttctgagaattggctgtgaaagcggcattgctgaccagtgagagagacctaatgaggagcaggccggggcaaccaatgaaatcggagaagagcgcttgggggcgtgtccgcctgctttcagcctttggcaagttggtgggaggtgaaagtgacttggcctcttaaaagcgtttttttcacctaaaatcagtcatcttcctgcgaaggcatgaggaggaaaagagaggaagtaactgagcgataatatgctgtatgagcctcctgctctgctgcccattacctgcgtcacctccacaagctactgaacctcaaggaacccatctcctcatcaggaaaaaaaataagctttatgtagcagggtctgaactctgtaggtcttcaccacggctcaggaggatgaggagcagtgacaggccaaactacgagaaaagacagagggaatcaaactcaacactgtgtctaaacctcctccaccactgttgaagggatcctggcatcagatggggaacagctctaaatcaaaataacctcactactgtgcttttctgtaaaaccaggtaaagatcagacaagcatgagttgaaaggctatgtctctctccaggctttattctgccatagcagtgaccaggcgcagccaacagaaacggaaagtcatggtgtccaacacgcctctctgttccccatgctgaggttaaaagatggtttttccttgccatggataatgtagaatttgacttttctcctatttatgagaacagaaataggctaaaaaagaaagtaaatgaagaccaattttggtacagaaattaaaaatcaggaaaaaataagaaaaaagcattacagtaagatattttgaattaagaaacaaggtgtaaactgtaggaaaatatacaaataaacacaactgaaataaacatggtataaagagaaactttccattaaaaagcacatctctatctggaaatacaaagtcttagacagaatgttaataaaaatctaaaaaataaaaagagagaaagggtaaacagatgtatacaccgtatctataattaaaattcagcaacatgctttagagtatgcaatatataaaaatggtcaggtgtggtggctcatgcctgtaatcccagcactatgggaggccaaggtgggtggatgacctgaggtcaggagtttgagaccagcctgatcaaaatggtgaaactccgtctctactaaaaatagaaaattagccaggcacggtggcacatgcctgtaatcccagctacttgggaggctgaggcaggagaattgttggaacccgggagctggaggttgcagtgagccaagatcgcaccattgcgctccagcctgggcaacacgagtgaaactccatctccaaaaaaaaaaaaaaaagtaacatataaaaatgtgttttatttagtggacagtaaaatcaggaaatgtagtctttggggcataggattaaaatatgggacgggcgtggtggctcatgcatgtaatcccagcactttgggaggccaaggcgggtggatcaagaggtcaggagatcgagatcatcctggctaacacggtgaaaccctgcctctactaaaaaatacaaaaaattagccaggcgtggtggcgggtgcctgtagtcccagctactcgggaggctgaggcaggagaatggcttgaacccaggaggcggagcttgcagtgagctgcgatcgcgccactgcactccagcctgggtgacagagcaagactctatctcaaaagaaaaaaaaaaatgaacagggggctggggatgggcatggtggctcatgcctgtaattccagcactttgggaggtggaggcagtactgcttgagtccaggagttcgagaccagccagagcaacatagtgagaccctgtttctgcaaaaaatataaaaatcaatcggaggctgggtgtggtggctcacacctgtaatcccagcactttgggaggctgaggcaggtggatcacgtgaggtcaggagccccggaccagcctggccaacatggcaaaaccctgtctctgctaaaaacacaaacattagcctggtatggtggcgggcacctgtaatcccagctacttgggggctgacgcaggagaactgcttgaacctgggaggcaggggttgcagtgagacaagatatcgccattgcactgcagcatgagtgacagagcaaggctctgtctcaaaaaaaaaaaagtcaatcaggcatggtggcacatgctactcaagaggctgaggtgggaggatcgctttgagtacagaaagttgaggctgcaatgagctgtgactgtgccactgcactgaagcctgggtgacagagtgagatcctgtctcaaaaaagaaaatacaaatagggacaagaaggtttaggttaaatgtatgactcatacctataaatggatcataaaaggaaggctggcagtactttgggattccattccaactttctagactcactcacttttccacaaaatttcccttcatggccggttgcagtagctcacacctgtaatcccaacactttgggaggtcgaggcaggctgatagcttgagctcaggagtttgagaccagcctggacaacatggcgaaaccccacctctacaaaaaatacacaaattagttgtgcgtggtggcatgtgcctgtagtcccatctacttgggaggctgaggtgggaggatggcttgagcccaggaggcagaggttgcagtgagccgagatcttgccactgcactctggcctgggtgacagagaagaccctgatttaaaaaaaaaaaatcccttttcatgttattctcagaaaaaaaatactactgcctttactaaaattaaaactaagagaccaaataacagaaaggcacattccggatcactccagaaccccagaggcactgtcacctcttcttcctctgatacactgacctttagagtcatgctttggtaggttttctggtgcaaaggagcaagaggccttgagaccactttttcatctctactgtacatagaatggcccttaatgagtaactactatgtaccaggcattatatcgaaccacttacaactgttatctcatttaagtaccaggacaactctatgaagtctacatcatcacctccatcttatagaccaggaaactgattcagcaatgtgatatcatctgtccaaggtcacaaagctagacagtagcagggaaggactaaaaattcatattctttatttcatattatgtttcccctaggaatctctgaatctttaaacttgatgcaaataaaatatgaaatggatgattctactattcatagtgttatgacagagactgctaattgcctaatatgccttcctacccattatcagaactcttatgtgtcatgacaatggcataaactaaaagatattttccagccttccctgcacttaggtgtggccatgtgacaatgtcctggctattaacagtaagtagaagtttctggttagaactcctggaaaaggtctcaataaggaagatggacagctggtccacatctttttgccctccacatccacctgtccttcttgatgtaaagctgaatcatgaattccacagccatcttggaccatgaggaataatgaacatggaagccactggtaagaatggcagaggaaaaaaagtgaaaaagcctggatccctgatgactctgtcgagctactaaatcaaatttatttcacactagacacataaaatcccattttgttgaaaacactgttatttctagccggttactaggagcttaatgtaactcttgactgaaagaagcctttttcccaagttgctagagatacagcagccattattttaatctataacgcaaattaagacatttcacaaagttcaaggagttaaaagggcaagatcaccttgttctggagcacagcagtgaggtgaggattggagagtgctggtgtagctgcactttgaggtaggttcattagctgtcgcaaaaggctggtgatactcactgatggaagatgatagagaaggagagagaagggactcagtaagcatggcagcacctacaaaaaacaaataaaag

SEQ ID NO: 4066 - DNA, 1380 bp, Homo sapiens
attagagggccagagccgggtcctgaaccaacaatagacggagatgtgctagacacactggaggtgctggggtataagggaccattgctagaggagcaagcccttatgaaggcagcagagtggactatatgtaggagcatatacggtataggattatatatataggcttttatacaggaagaaggtggtatatactgtaaaggaatagatatataaactatataaattcctatacaggatatggttaggctttcaaataaaatcattatgcaacttggaagaaagtatgacttctgctggaagagatgatctagagagcttccagcttgaggtaaatgatttttttaaaagaaatggcatgtccatattctgtactcatatcaggagatactaaagatcattttaaaaaaggaggactggctgggtacaatggctcacacctgttatcccagcactttgggagaccaaggtggacagattgcttgagtcccaggagttcaaggccagcctgggcaacatggtgaaccccatctctacaaaaaatacaaaaatcagctgggtgtagtggtgcatgcatgttgttccaactacttgggggcctgaggtggaagaattgcttaagtcaaggaggtcaagcccacagtgagctgagatcgcgccactgtaaataaaaaaatataaaaaggactgtttgaaactcctattatttttaagtacagaacttgaagcttcacagatattacagaacaagaaacattaaaattctcaattagataaaaataatgaaatttatcaggaagttcaagttctgtgtgataaccttggtgtacccaagtaaacaacttctgacattctggttatgctaaaccaagtggaatcaaaggtgaaagacaggcaggacgcagtggctcatgcctataatcccagcactttgtgaggcagagatgggaggatctcttgagcccaggagttggagaccaatttgggtgacatagcaagatcccatcttatttcaaatttttaaaaattgttaatttttttattaaaattaaagaaaaccactctgctgaaaattaatttaaatttgaaacaggcagaacaactggaaagagtcaatgatgctctttcctgtgaacatgagtgcctctagcgaatgttatgaaacaattagatgcggcaatacagtccgttgcacggtgtgatacagccaaggtaagaaaagatgacacagcaagaatttaccagcctcagtgttatgctttgtcacccaagacagcgattataatggtgcatctacttgctgctcatgataatctatccaagatcattaggacaagcagtggagccagccagatgatggcatgtgccattaataaggtg

SEQ ID NO: 4067 - DNA, 676 bp, Homo sapiens
gccgttatatgtctatatatgttttaatgacctcaagctcagagatctgctagtgatctcacctttagataacatctgagttgaatgtctgtggagtcccctgccactggtatatctcaaaagaaatagcattatttggtctgggcagtactgtctttgtctatttatctatcttcacctctataaagtgggaggttgcaactctgtgggcagtattcctcagggcactagaacaatgaatgaaatggtgttacgtattttcccctcaaggagaaatgacttcttaaaccccaagtggaagatttttcattccgtcattagtattctagtattctttttgaaattgaagtagcaacatgcctttgacctgtttcacaaagttgacaaacgactttttgagacatttagccaagagatggaaggagtggcagatgtggcttctgagcttactccttccgtccacccactagatgtctctcttttctgcccttatctgtaagtgaatatatttaaataaggcttgctattaaaatcaaattgaatctggactatggaaataatgcatttcattttcttatttaaagcatgccattttcagtaatatacccatgacttgagtaaaaccaaagatgttctttagggtatgacagtaatttgcagtgggatttatttatca

SEQ ID NO: 4068 - DNA, 14124 bp, Homo sapiens
agctgaggtggttgctgggagaggtggttgctgggagagctgttccggcgctcacgttccaattccaaattacaaattccgatctagagctcccacgcttgggggctgtggagcgctcgccagccgctccccgtttgctgctgggtcttacgaagttctcatatccatcatacagtttctttgtcacactgtccgcggcacgccagtccctatgacagaaagcacctgcggtctgtctggaggcggagttggtggcggagagaaaaagttctggagacacctggttgggagcaggctaaggaaacaaatggggaggaattagccacaaatcctcaaatagacagctactcaaaggcatcttcacggacaatttccaagcattggatgcagtggtgcattcttgcattgggcagtgattgtgtgcacacatctctttaagggagagtggaaatggggtgaggaggaaaatgggagtaggatagagtgtagcgttgacatttattttctttaaaggaagacccgagcatacctgagagctcagtgaagaaagtagttctggcgaatcggattaatatggtatgatcagcctttagcaagattctatcacttttcccactgatgatgtgagacggtgtccgcgtgtgtaagtgcacacacgtgtgtgtgtgtgtgtgttgcatcttctgagtatttttcaaggagaagctttttagtgatctgaaaaagtcaattcagttagccactagagttcaatcaaaaacttcggaagagtgcatcatcttaaagtacataagagagaatcatgacctccagctcagaattcaagaataggcaggtttgtgaaatagtaagctcagaaagttgagggccagtgaactcctatttcaagttcttgcgggtgtttgtacttttttcccagcaccactgaaacttgaccttcggccggcgcggtggctcacgcctgtaatcccagcactttgggaggccgagatgggcggatcacgaggtcagaagatcgagaccatcctggctaacacggtgaaaccccgtctctactaaaaatacaaaaaaattagccgagcgtggtggcgggctcctgtagtcccagctacttgggaggctgaggcaggagaatggcgtgaacccgggaggcggagcttgcggtaagccgagatcgcgccactgcactccagcctgggcgactgagcacgactccgtctcaaaaaaaaaaaaaaaaaaacaaaaaaaaaacttgaccttcattatatctcactgccctcatcccaaacatttcctctcccagttttccaggaaacggcatcgctgcccatctcttttcaggccccaaccctggagaagaacctaaatttctcatttcctcactacctacctccagtccttcagcaggtcccgttggttgggctgctaaactatgggctaaatcctttcagtactttccatgcccacagctaccactctggtccaagccaaattcttagttcccctggacttcttactgcagtagcctctcagcttccactcttggcaaaatcaattttataaaaccttgaaatcccttaataccactcgtctgcttaaacctcggcatcccacatttaccactatcaggaaggatcacgtttgtttgtttgctgtctcattcccccatttatatgtgaattccacgggtaagggcctgctcctacatcccacacctctacatccacagagcctagagaccgcaggcgcggggaaagcactccacgaccatcactggccaggccacaagagtgctggatctaaatttggaaccggactttcagagctgaaataaacctgaggttttccaggggcttttaacctccttttacagccaaggatgcgcctaagaaaggggagaggcttccgtgacttcctgcagtaacgcagccactagagattgagactacaacgacttgggagtctaaaagtctgcaaccttttccactccagagctcaatgtttcctcaatcccccgggatcggcatcagcaaaaacccggagaagcggagcctttctcaaagaaaatgacctccagactcatgctaccatctcgaccggtgcaagtatcacgcatgcgcagggccggccgcccggccgcacctcgccaactcctactcggacacgtcatctagtgcgttttgttcaattctttgttcaaaaccccaagaatctggacaacttgcactcaagaccctctacgggtttggcgagccagtctttcagtggctgttttctagtagctccttggcaattgaggggaactggctgggaccactctccagtgctgtctgaaggccaaggagtgaacagggatggctgccctgccttgaagagggaaggactcttttctatcctttccagctatagtccctgatccctacatgtgatgcggttggcagcggaagctcatcctgggcgaactcacacacttttcaggagacttaaaccttttcttatgctaagttcttcccttcccctactcatctggctaaaggacagactatgcaaaaaaggttatacaagtcagagggtctgagcatgtcggaggtggtctgtgtggggcatggggtggggggaaaattcatgaaaggcaatttattgcctaaatttaaagggttaaagggttgctttaagtgggatagaaaaaccttaaggaaagttcatagtaggtcctcagtggtggagtgttgtgggaagtcagggaccctgaatgaagggactggctgaagccatggcagaagaacataaactgtgaagatttcatggacatttattagttccccaaattaacacttttataatttcttacgcctgtctttactgcaatctctgaacataaattgtgaagattttatggacatttatcacttccccaatcaatactcttgtgatttcctatgcctgtctttactttaatctcttaatcccgtcatcttcgtaagctgaggaggatgtaagtcgcctcaggaccctgtgatgattgtgttaactgcacaaattgtttgtagagcatgtgtgtttgaacagtatcaaatctgggcaccttaagaacaggataacagcaacgttcaaggaacaagggagataatcttaacgtctggctgcctatgggccgggcagaacagagccatatttctcttctttctaaagcaaataggagaaatatcgctgaattctttttctcagcaaggaacagccctgagacagagaatgtgtgcctaggggtagtcctccaaaatggccactctggggacggctgtcttttatggtcgtagataagggaagaaataagccccggactcccatagtgctcccaggcttattaggacgaggaaattcccacctaataaattttggtcagactggttgtctgctctcaaaccctgtctcctgataagatgttatcaatgacaatgcgtgcccgaaacttcactcgcaattttaatttcgccctggtcatgtggtcccgtgatctcaccctgcctccatttgccttgtgatattttattaccttgtgaagcatgtgatctctgtgacccacaccctattcatacactccctccccttttggaaatcactaataaaaacttgctggttttacggcttagggggcatcacagaacctgccgacatatgatgtctcccctggacacccagctttaaaatttctctctttgtactctttccctttatttctcagaccagccaacacttagggaaaatagaaaaggacccacgtgaaatatcaggggctgaatttcccccgatagtggagggaaccatcccaaagcagtgccagcccccatctaaggtcagagacatctgacagactaaatcagggccctaaagtagggacgcccctggggaccccagtctgggttcagaattttttcagggggatgccctgggtaaagtttgggtcacctaatgggccctctacttttcaaagtcctcttctctgttccagaccactatgggcaactctctatctattcgacctgattccactatgggcaattctacacctgttccaccggattcctcacttggctacatcatccaccattggaatcaatttgaccctgacactctaaagggaaaatgtataatttttttctgtaatactgtttggccccattatgagctgcccagcccccagcaatgggcagtcagtggtagccttaattatgacaccatcctgcaattagacctactttgcaagaggctgggaagatggtcagaagtcccatatgtacaggcttttatcaaaatatcaaaaacctaacaatctgtgaaactcccagaacccaccccccaaaggaaagtactaaggcagaactagatattatagatgaccctcttttacaagggctagctgtctctcagggtgaacagcaaccatccccataaagccccttgccaagtgctcctgaggctaaaacccaggagcaaacaccagggaccctactaaatccccctcacacttggagaggaatgccatattcaattctctctccagccctgctacctcttagggaagtagcaggaaccaaggggccagtcctagtgcaggcccccttctctataatttatacatacaatataaggaaaagctaggaaactattctgagaatcctaagaaacttgcagatgggttccagcgtttgaccttagcctctgatctatcatggagagatgttcaattcattctagcaacctgttacacaccctcagaaaaggaatgaatctctgaggccgcccacctgcaagcaatgaattatttgcccaaaactctcagggcaatcatcccggcccagacacagttcccactattgatcataattgggactataacactcctgaggaaatgaacaaccgggctaaatttcttgaggctctccttggaggaatgagaaagggaataactaaaggcagtaaattatgataaagtaagggaggttacacaaggcaaggaggaaaatccagccatgttttatggcaggctggagggagactttaaaaaatatactaatctggacccttcctctcccgaaggcaaaatattaatagcacagcatttcattagccaatctgccccagacattagagataagctccaaaagctacagatggggccacaaactaatcaaaatcagcttacttatatcacatttatggtgtataacaatcgtgacctgaaggaaggaaaaagggaacagagtaaacaaaatggcaagccaaaagtatggcagccatcattgacgatgccctgaatgtacaaagagtgtctaagggaaacccgaagggccataaagataatgccagcaaaggctcttgcttcaaatgcaagaaaagaagacattgggcaaaggattgtgctaagtccccgccaggcccctgccgtcaatgcaagggcaccagtcatgacccctggcactggagaattgactgcccatgttcccactgaggggctcagtcagtcaaaactctagcagtgcaaaaggaggaattagatgaagactgaaggggcctgaggtcttcctcactgcccctgttcaggaacattgtaattactactgaggagccccaggtaactctggacgtcatgggcacccaaattcagtttctttttgatgcaggagcaaattactctgttcttactgcttatgcagtaaggcgttcctcccagtccacaagtgttatgggaatagaatggaagccacaaacgagtttttattttattttattttattttattttactttaagttctgggatacatatgcagaatgtgcaggtttgttacataggtatacatgtgccatggtggtttgctgcacctatcgacccatcatctaggttttaagtcccacatggattaggtatttgtcctaatgctcttcctccccttgcccccaaccccccaacaggccttggtgtgtgatgttcccctccctgtgtccatgtgttctcattgttcacctcccacttattagtgagaacatgcggtgtttggttttctgttcctgtgttagtttgctgagaatgatggtttccagcttcatccatgttcctgcaaaggacatgaactcattcttttttatggttgcgtagtattccatggtgtatatgtgccatattttctttatcccgtctatcactgatgggcatttgggttggttccaagtctttgccatggtaaatagtgttgcagtaaacatacatgtgcatgtatctttataatagaatgatttataatcctttgggtatatatccagtaatgggattgctgggtcaaatggtatttctggttctagatccctgaggaatcaccacactgtcttccacaatggttgaactaatttacactcccaccaacagtgtaaaaatgttcctacttctccacagcctcaccagcctgtttcctgactttttaatgatcaccattctaactggtgtgagatggtatctcactgtgattttgatttgcatttctctaacaacaagtgatgagcattttttcatatgtttgttggctgcataaatgtcttcttttgagaagtgtctgttcatatcctttgcctactttttgatggggttgacaaacaagattcattactcctcctttgatttgtcaatttgagaaacaactcttccaacaggatttcctagtagtaccaagctgcccaatccccctgttgggaagagatattatggttaaaatggaggcactactacaatttaagcatcacccattgaaattgctgatagtcaaaaatacagtgttccagaccacattaataaataggttaacccgctggcattggtatactggaaaaccagggaaggctaaaacagcagtgccagtcaaaatacattttaaagacctcagctagtttcccaattgaaaataatatccaattaagcaggaagcaagaaaaggcctagcacccataattgaggtattacttattacatgggctcttaaaatcctgtaattccccttgcaatacctgttctaaagcctttgggggaataccagttagtataggactggagaataccggttagtataggacctgagaataattaatgaggctgttatccccgtccacccactggtggcagatccatatacccttatggctcaggtacaaggggatgcaaaatggttctcagtcctggacctaaaagatgctttcttctccatccctctggccccagagtcccaatacctttttgcctttgaatgggaaaatcaatatgagggaaaaacagtaatatacctggacagtgcacccttagggcattcaggatagcccccattggattgcccgagccttagagagggatctgaaggatctgaaagtgaaaaatgggaatatactccagtatgtggatgactttcttgtgtgtagcccaaacccaggaggtttctgaccaaactactataaaaactttgaatttcctggcagacaggggatacaaagtgtccgacaagaaggcacagattatcctccaatgggtgcaatatttagggtatgtcttaacacccagagcctgacaaatatccccagaacgagagcaagccataggtggtttgccccctgccccctccccaacccccccacctgccacacctagtagcagctttgttcttttttgggaatggccaggttttgcagaatatgggtaccaaatttcagactcatagcaaagcccctatatgaagcaacaaaggggcctgaagacgagctaaaggaatgaaccccagaattgagaaaagcctttgccaagttaaaacaggctctcgctcttggcatcccagacctacctaagcccttctctttgtacgtagcagagaagaagggcatagctgtgggtgtactagcccagacattaggatcagaacccagactaaccactgactttccaaagaagttggatggagtggcctcgaggtgaccaagttgcctgcggccaacagcagccactgctatgttagtggaggaagccactgaaatcgctctgagccaaccactggaagttctcaccccctcatcaggttaagtctgtcttagagataaagggacacatctggatgacaggggaaagatgaaccaaataccaggccatgttcctagacaatccagatgtaacccttaaaacctgcaacactttgaatccagcttcagtgctgcccacaggcccaataactgatcattcctgcaagcaggtcattgcacatacacaatgttagccagcctgctttaaaagacaagcctctcccagattctgaggatgagtggttcacagatggcagtagttttgtgtcaaatggggtttgacacagcactgagctggatatgcagtagtaattatcgaagcccagccactgctccttggcacatcagcacaaaaggctgaaatcattgctcttacttgagcattaatgttggtacaaggaaaaaagcttaacatctatatcgattctaaatatgcattccttgtggttcatgttcatgctacagtctggaaagaaaagggatttctaactagaaaacagtcctctataaagcctgggcctgaaattcttcagctattggaagcaatacacttgccaaaggccgtagctctaattaattgttggggtatcaaagggacttaacccctatagcacaagggaacagaaaggctgataaagaaccaaagccgcatccctcagggtgccatcccaacagaccctagccctacttcctttctatgatttcccaacagaacctgagtacacagtacagaaagaacagttaatagaggaacaagggggacacaaaaaaaggatcctggtggcatatggggtcaaaaacatatctccctcagacagcccagtggaaagttataaaagccgtgcatgcctctttccatgtggggagggatgcaactctggccatttaaaccagctctttactgggtctaacttagcttcagtggctaagcaggtttgctaggcctgctccctgtgtgcacttaacaacctaggaaacaacatgcctcctctaatagaaccagtgcagaggagaggaacttatccagggggagactggcaattagacttcacccatatgccagcttgcagaggacatgagtttttgttagtactaatagatatctttactggttgggtcgaagtttatcctaccagaacagagaaggttaatgaggctataaaggttctcttaaaagaaataatccccgggtttgggttacctcagagcctccaaattgataatggcccgtcctttatctcccagctaactcaaggggttgctaagtctcctggaatcaagtactatctacattcagcatgaaggcctcgatccttggggaaagtagaaagggctaaccaaactttaaaacgagtgttagctaagctatgtaaggaaacatcagaaacttgggtcagcttactgcccatagccctcttaaggacccataatacccctacagcaaaaattaatataaacccatatgaaatattatgtggaaggccattcttaactaatgatttaattactgatccagaaacagttggtttagtaaaatacctagtcaatctaggacagtttcaacaggctttacaaacgtttggaatgcaaagtctccccacactgggaacaatcagcaacttaaaatcaggtcaggaaataaggtacttcttaaaacatggaaagagggatcacctgctcaacaattacaacccaaacggaagggactgttttcagtggcactggccatgccttctgcagtgaaagtactaggattagatagctggatacatctttcaaggatcaagagagtgataccagaagccctggaccaggaacccgaagttgccatctgcctctacacctgtgaacctgtggaagacttcatgaagtacctgtttagaagacagtcaaaagaaaagtaaatgcctaccaattttccttggtgtctttgttgcatagttactataggctggataatagtgccatttttaaaaatgttttatttttgcagtttcattgccttcttccaaatggatggaatcacttcctttgtagtaattaagcagaatgttttaatacatttctataacaaacattcctgacggcataggtatccacccccaaagttcccattaaatcttttaaccaaattcatttcctgttgcacagagaccatcaagcttcagatgatcatgtgacagggtttccagccagttccaggtgaagacaccacccctggccatcaagaagtcacccggtctccactagacagagtagggtgagagttccgtgatctccaaccggtagtgattatgccccaagtcagcataaagaagttacggaagaaaaaccatcagtccctctgtctcacataaagacttatggggatcacgtttctcagaggggagatgaggcaggagaatagggtctggaggcagggaacctaaggccgtttcacactgacttcttagaactaaattgaaaggaaaaccctaattttccatgcctaagtaacaaaaggaccagaggctactccctttgcaaacccccaccttttctgtgtggcatatgggaaattgaaagtacctctgattgattgttttctgcaaccaatcagatgtttgcattggagtgtaactttgtaatttcacttcagtctctgattggttgctgcagtctggaaattctgcaggccaagtcttcgtttgcatagaagtgcaactttgtaacttcatcttagcctctgattggttgctttctgcaaccaatcagatgtttgcataggcgtgtgacctttgtaacttcacttcagcttctgattggttgctttccacaaccaatcagactgattgtgggccaccacttcctttacgtgaggtgaacaccaagtggccaatggaaaacctcaagagggtatttggacctgagaagattctgtatctggggcccttgagctgctgctctgcccactctcacatggtggagtgtaatttcactttgaataaatctctgcttttgttgcttcattctttccttgctttgctgtgtattttgtccaattctttgttcaaaacgccaagaacctggacaacttgcagtcaagaccctctaccagtaacactagttgtatccctgtaaatgaatgggctttgaagattttctagaagaaaaagatcacctcattgtccttcattttttgacataaaactgtgatagcccaatagataaaatgtgagttatcgatcacccctggaaaggattaggatatgccactccaaaatatgccacgtttattttgcactgaaggcaattgagaaacagtagacacaggaagagctctctgcttttcccctttttacctaaaagcagagaataaatttccttttggaaagatgacatacattttcctttataaaggtgttcccttctcctctaccaggaagatctgagatggcaccaaaatgaatctgcctaacaaaccttactgcacaattcttagctaccatacatttcatagtcaccttcccataatttactgcccttaggagcccaagtccctttcctttgactatcacctctccacaatttattgccctttgttaaaatgatatataagctccttcatttaactacatctttgggttttcacttcttatctttgatgctacgatgcatgtaaaaatattaataaaatttgtgtgctttttctcctgttaattgtatgtcttttatcaacttaaattacaggccccaagtacataattaagagagtaaaaggctgggcacggtggctgatgcctgtagtcccagcactttgggaggccaaggcaggcagatcacaaggtcaggagatcgagaccatcctggctaacatggtgaaaccccgtctctactaaaaaataaaaaaaaatttagccaggcgtggtggcgggcgccggtagtctcagctactcgggaggctgaggcaggagaatggcgtgaactcgggaggcagagcttgcagtgagcggagatcttgccactgcactccagcctgggcaacagagcaaggctccatctcaaaaaaaaaaaaaaaaaagagagagagagagtaaaagtttttcctctcctacacctccttccctgttagtctaaatactatagcttggacataaaacttatcctgaacagtaggcttataaatgcaactagcggccggatacagtggctcacacctgtaatcctagcactttgggaggccgaggcgggtggatcacctgaggtcaggagttcaagaccagcctggccaacatggagaaaccctgtctctactaaaaatacaaaaattagctgggcatggtggcacacatgtgtaatcccagctactcaggaggctgagactggagaattgcttgaacccaggaggcagaggttgcagtaagccaagatcactccactgcacttcagcccgggcatcagagcaagactccaactcaaaaataaataaaataaaataattaaataaatgcaactcatggtagattggagccgaggtatgaaaaacgttaagctttaggataaataatggttctcaggacataacttagctaacatacaagctatttataagctaacatagaagttgcaaccagaagggggattcttttggccagcagaacctggaaaaatgaaagccacagaggcaaatactaaagtatcactcaggaaagacaagagtgtagctctgtgacatagatggatatattctaatcataaaactaattttacttcttccaaatttatgcccacaaaccaactttctgcttttttcttgtctcgtatgcattttttaacttaataatctttaaacacttttataagagtttttatattctgcatagaaacactttgttagctatatgaattgcaaatattgctttatcaaaagattcctagagtcatgaaagaaagcaaacaaagtgctaatattgtggttcattgcttcacttataagataaaatgcataccatttatcaatctataaacaatgtctcaatttgaggttgaatgttagagtttacccggtaatctagtatttctctagaaatgtcaaaaaaaagggcaaaattatatagtacagaggagtgagtggctggaggttgtctagacaaggtacccactggatgccattatcttggtgaaaaagagaaagagaaaagcagtcactgacatgaggagttggcctggttcttacagataggacttggcattctcctgtcaaatataagcaatttcacagaacatgaacattagacaacgccgtgttgtgatgttgatgtagcaagacgaaaacactgtaaccctctgtaatcatgtctcaacaatccactacaacccgaatgtggtccaaaccacaaaataaccaaacatcctctgtcttgcctaagagtagtgactgctgcctctttagcaatcacaacttaagcctcagactagtctgccctccttctagataagagttattagatatctaattttaagaattaccccctgcttcctgacagcatttgatccagagcaaagctccacctctttaaaacgctccccaaaccacaaaacacaagctcaattcttataaatttctttccaatcccctcttactgagatgtcccatcgttcctcatagtgtgcgttctcccttgctgcaacaaggaaataaacccaactatagttgtgttcctggtggtctttagctgaagagcattgacactgcagaatccaggagaatccaggacaattcaagagctggagacagcttacttgtcaggacactaaaaatagacctatctctcaagggtgaatttgtattagccacagacacagaaactgatggataagtaacattactaatttgttaattaataaaaatgaaataaagccctggaagagtcagaaaagacaaatgtatagagtgagaaagtagatgaatggtttcctgaaggtgggtgtggaaaggggaattaaatgttaaagggcatgagtggtcttattggggt

SEQ ID NO: 4069 - DNA, 2150 bp, Homo sapiens
agtagcataataaatacataagccagtaatcaagtttaaatcaaatgtttatcaagtactatgtacataattgtactatactttttttcctccagagcaggaatggaagtttatttaaaaaggctttagaacaggaaagaaaggaaagtatgcttggaagaaatctaaacaggacatgctatacttttatactactggcagcacaataggttaacaccagcatcaacataaacacatgagtaatgcattgtgctatgatgttaagatagctaggatgtcactatgcgataggaatttttcagttccattataatcttatgggaccaccttcctataatgagtctgttgttgaccaaaatgtcattatgcaggacctgttttcagttttggtaattggcagactgaattccctgctcaaatctatccccttccctaccctctggtagacagatccctagttttaactgggttctttcctctgtggccacgtactcggaagaatcagtactccagtccttagggtgattaatcttttctttttttttgagatgcagtttcgctcttgttgcccaggctggagagcaatggtgcgatctaggctcactgcaaaattcgcctccgaggttcaagcgattcccctgcctcagactcccaagtagctgtgattacaagcatgcaccaccacaaccggctaattttgtatttttagtagagacggggtttctccatgttgctcaggctgatctcgaactcccaacctcaggtgatccacccacctttgcctcccaatgtgatgggattacaggtgtgagccaccacgcccagcccagggtgatttatcttaaccagatggttcaggagggaatgtgatgcatttaggtacagtgacatgtaaagggaagtcaactgagccattactggaaaggagagatttacttaaaaagaaaagtgtgaggaaaatgagttttttctgcctttgaatgtgcctatgtttaaagaggttttgctagaagctgcttgcaaccatgaacatgaggataaaaatcccctgcattgaggatggcagagatgaaagacagaaagagctagggtccgtcatcatcagtaagcatctggaaccaccccatcgccagatgtttccttatgtgaatagggtaacacttttagttggcttttcctttacttgtagacagaagcatgctaacttatgcaagtgaccacattttaagcggaactttagcaaattggggcacatctaaatggcaaataatggtgaaggctttggaaaccatgtcttttgaggaataaaggattatggatgtaaagtctagaaaaaagaagacttggcatgagatataacagctcttctgtaatgtgaatgaaaaacctaggaccaagtgtggtaatggggagctacattaattcacaaataggagaaaaaaggtcaaactagaactacttaaaacagaaaggtttatggggtagtatgttttcttgttaagaacttcagctgtaatttggtgactccctgttgtgagcattctggatttgctttggtgtgaggctgagcaacagaacttctgtttccttccaacccttaagatgccataattttatctgacttcgtgacatgtactgcaataattgtacaagcagggaggaagagtacagttcacccttgcacaacattggcttgaactgcacaagttcactcacacgcaatttttttttcaattaatacagtcagccatgcatatccacgagttccatatccacaaccaaatgaagatatgaaatctgttgatccaaagaaccaactccctgacttaaagatgcttggattttggtatccaaggggaccctagaacaaatctcccatggacatggagggatgattggaagtataaaattgccagtgtatatattattcatgcttcaatctctaaaattggtggcactataatagcctctggacatatttatggaactaccccagaaaatcaaaattgaaggatactcagtaaagagtactaacaagaaactcaattgttcctgaaggcaaaaaaagaaaaaaaggagggggtagaagtattgatacacataaaaattgcaaagtgttaactgcgcccccaataagatttacagaaaag

SEQ ID NO: 4070 - DNA, 1802 bp, Homo sapiens
atgctcttattataccactattataaaaacactagttcccttaatcttaccaattattactaccttagccaacccctgcaaaaaagattgatacccatactacgtaaaaatatctattgcatgtgtctttattactagcctcatccctgtaacaatatacatattcatagatcaagaaataattatctcaaactgacagtaacaattcaaactcttcaactcccactaagcttcaaactagactacttttccacaatatttatcccagtggcactatttgttacctgatctattgtagagttctcaatatgatatataaactcagaccctaatactaatcaatttttcaaatatttactcattttcctcacgataatattaattctagttaccaccaataatctcttccaactttttattggatgagaaggtgtgggaattgtgtcttttttactaattggctgatgatatggccgagcagatgctaatacagcagccctccaaatggtcctgtataaacgattggcgatattggctttattttagctatagcatgattcctcttattttccaacacatgagagcgtcaacaaatatttattctaaatcttacccccaattcctttccactaattactgttctcctggcagcagcaggaaagtcagctcaatttggccttcatccctgacttccttccactgtagaaggcccaaccccagtttcagccctactccactctagcactatagttgtacagtttttctacttatctgcttctaccctttaatagaaaataatctatgaatccaaacctttacattatgtgtaggggcatcaccacattattaacagcaatttgtgctctaacacaaaatgacatcaaaaaaaaaatcgtagcattctccacctcaagccaactaggccttataatagtcacaattggtattaatcacacctagcatttctttatatctgcacccatgcctttttaaaagctatatatgttcaggatccatcatccataatctcagtgatgaacaagacatctgaaaaataggaggactattcaagactctactcctcacttcctcctcccttatcattggcagcctcacacttacaggtatgcctttcctcacaggcttttattctaaagacctcattattgaaactgcaaacacatcatacaccaacgcctgagccctttctattactcttatcgcaacctccctaacagctgtctatagtacccaaattattttcttcgctctgataggacaacctcgcttcacaactgattattattaacagaaataaccctttcctaattaacccaattaagcacctaataatcggcagtatcttcgctggattcctcattaccaataatattgttcccacttcatccccctaaacaactatgccacttcgcctaaaactcacagccctaggtgtgaccaccttaggcctcttactagcaatagaactaaattttataactaataaccttaagctaaagtatcaattacagacttttaaattctccaatatactaggtttttactcagccaccatccactgtacagctcccccaactcaagtctatttacaagccaaaatctggcctcacttctactagacataatttgattaggaaagtccataccaaaaaccatttcacaaactcatataatcagcctccattaccatacctgccccaaaaggcctaatgaaactctatttcctctccttttttattttacctcttctaactctaatcttaattacctaatcatcaccc

SEQ ID NO: 4071 - DNA, 254 bp, Homo sapiens
caaatcctgcctcaggtttatttgtacaaatagcacaggaggaccccagccccatgcagatggtagcccaggggcgggggtggggggtcgcaccagtccttctgtcctcatgttggcagagatatctactctgaagcctttgtaggggcctgggtacgtttgggagcctgagctggaactgaagctggggctgcagcctgggccttggtttgactggttgtgtgtggtgtggttcttggacttggccatgtctg

SEQ ID NO: 4072 - DNA, 1770 bp, Homo sapiens
ggaaaaaaagttaaggatacagttgaccgttcgataatgtagcccactgttgaccagaagccctacccacaacataaacaggcaataacacatattttgtatgtgtattatatagtatattcttaacaataaagtaaactagagaaaagaacatgtatcaagaaaatcataaggaagagaaaacacatttacagtactgtactgtatttattggtaccatacatttatgttgctgtttacaagatgaagcatctgtctgaaatggccagcagctacagctgtacctatctactgtacatatcaagcaagtcactttattcttataatgtctatgacttctttctttgaaagcgcttccatcatcactgttggcacttcatatgggtctcatggtgttaaggtttacggcattgcactagacacaatgaaaactacacaagagggccgggcacggtggctcacgcctgtaatcccagcactttgggaggccgaggcgggcggatcatgaggtcaggagattgagaccatcctggctaacacagtgaaaccctgtctctattaaaaataaaaaaattagccaggcatggtggcacgtgcctgtaatcccagctaatcgggaggctgaggcaggagaatcgctttttcccagaaggcgtaggttgcagtgagccgagatcgtgccactgcactccagcctggatgatagagggagactctgtcgcaaaaaaaaagaaaagaaaaagaaaagaaaagaaaaacacacaagagccgtgagagagatagcttttgattgcaatacacaatttactggagagatgagctgatcatacagagatgattagtgtcacacagtgttttaaacagattcttgcaaccctggagttcactgcagtagcaacagaagttagctatgagattttaacagtagtatagtatgtactacagttaatattaggtagctatgatttaatgctgcatctttgcatttgtttacatttatcttgactacaagtggtattatgtctggtcttaaggtttgtgtgcatatgttttgatgaattttaactttttataataggtttgtgtatattttatggcagtaaatgataaaacagactaatctacatatattttatgtagtcatgacataaacctaactttttcttaactttttgatatttctagtctatgtgtttcatctgcaggttttttcaaattgttgaaatctctgaaaaattttattgaaaaaaaatccatatatgtaagtggacccacacatttcaaacctgtgttcaagggtcagctgtgtaaataattttcctcaaaattaaagtggaaaaggagagttactactagtagaaagtagaactgtacccttgggcaggggtgtgtgtgtgtagttaaagatcaatttaacttaaaaggtcttggttagagaataaaaactggcccttattagctttaatttacatgaaaaatgaaaaattttaggccaggcacagtggctcaggcctgtaatcccttaactttgggagaccaaggggagtggatcacttgaggtcaggagttcaagacagcctggccaacatgctgactcacccttccctactgaaaatacaaaagttagccaggcgcagtggccatccctacagtgctagctactcgggaggctgaggcaggagaattgcttgaacccgggaggcaaggttgcggtgagctgagatcgcaccactgcactccagactgggtgacagagcgagactccatctc

SEQ ID NO: 4073 - DNA, 786 bp, Homo sapiens
cctaaatgaagtaagttttgattagaagttaccactgaatctcccttaaagagagttgtgactgggactccgtttgttccctaggggagacaataaaaaggtcaacacagctcccacctcgaagcagctgccagtttattacatgaagtgtcaggctgtggactgcaggcatgccattttgtcttcaagaacagaattcccgggcacacgaatgattccagggttcctccagcactttggtattacttgaaagcaatcttaagggatctagaatgaaccaacgcccaaaaaggatcccttagcagcggtgatatcaaagaaacacttttgaagaactaattttccacccagatttccccaattttaaaagcaatgggcaaagccttctccactcctaaacttcctggaactgtcttttggctatatcaggcccctgaagttagagtctttgaaagactccaaactccaaattctatgcttttattctcaggctcctcataattctacagcacaccagactgctgaccactctccgtaccacttttaaattatttcttcccacagctttcttaacaatgaacctttgaaatctttttagttttccatttattttgctacctttcctctgtcctagctctaaaatgaagatcctctaaggttctacagtttacttcttgtattctcctttgtaagtcatctccaagacgatgtccaaatccatcaccattaaaattaatagtttcctcacccacaacacttaatattttaaaaaaaatacttttcatt

SEQ ID NO: 4074 - DNA, 3686 bp, Homo sapiens
ggcggtcgttcccggggaagaactgctaaaacatgagaccaaggcacagaccttactgtatgagaagcaatgctcctcaaaccttctgcgtgctgacatagaccttcccaggtatccagatcttttcccaatcccacctgccccacccccacccccgctcatcttcagtaaactcagagcctccagctacacacgggagagctagaggcccaagccggggagtgggggtggcagacgcagctcgtcagtccgacagggaagagggggcggaggcaaaaaagggcagcaggaggcggacgggggtggggggtgatccagaaactaccccggcagggagtgggggagcagcggatattccggggtaggaacggccatcgcaacgctgacagaggttgttttttaagaagcaaaactgttggcggcgacctgagcgctggaagccgaaggggaagaggaaggagacgcgaagccagggcggccggcacaaaggcggcggactcgcggcggcagcgcctgcccggccgggagcacaacccacggccctactccagcgaagtcccgcaccggcttctaggaataaagtttacgttctcctgaggccgcaccccccacctcccacccaggacggcacatctccgtgtcctcctcccccaaactccactcgggaccccgagaaccaccccagccttccggccaccacaacaaagagccgcaccgaccggcgaggataaacagcggcggagggcgagagggcggcggggcgagcgcctccacgcagcaactccggagtcccccgcttgcccgagcgcagtttctccgctgctgtttccaccggctttgtaacactgggaatttacatcctcacccgcacccctcacgcccgaggattttaaactcacctttactctcgaactgagagttgcggtagatgggatttttgccttttccccagatggttgaaggttaagatttttggaaaccccaccacctccttatttctattattatttctgcaagaaaagtataaagagagttgtagtggaggtgagatttgtgatcgggaaagccttcgactccctccttctccgtcttccgcctctctctctctgattagttcctatccagcagcagattgaagcaggagatgattcttctcaaggtttgttcagcagcttcacttctaggcgaaggcttcatgaaccaagtgacgtcaaccaacaaggcttctctctctctcctctctctaacaatgaaagttgctgttaacaagggaaaaaaagagagagaattgtttataccatttcagttccaataataaatgacctatcagctcctaaaggagccaagggagggggttgcttcttctttccaagaatactgtagctttgagtttgcaccgttccttgtcccaggaaaaagttaagaaacttaaaatgttttgttttgcttttaaagaagacaggacagaaaacgggatttaaaacttagtttttaaaaaaacaaaagctacagagtagggagcataggtcaaccatctccacctaaattttttttgttcctaaactcagaattctacaacccaactaaattaatatgccaagattttgcggatgttaaaactcaaaaaaagcagtatgcaagacggtcccggggtaaaattctactgcctttccacggacaagttaaactggctgtaatgtttatgcactaagttaaaataaaatttaaataaaagacgttaaaatagtcgttttaaagttatatgcacacactgtaaaaggtaatctcgatagctttttttcaagtttctgagagattagaaaaaaagcatagcaaattgtaggcactgaacactttttaaaaatcaagttatgagtaagactggtagccctttgctcctttaaactacaaatgcagtcatatgctatggtctacccccagaatctcttccaactttgtttttacccttccactcccccaaccccaattcccaaatcctgcaaccaatcaagttaaactaaagatacaataggccccattccctcccgcaccccatcctatagattcctaaaaacaatttttttaaaagccttaatcttgataacactttattagccaagaagatacgtatttttttttttagaagttcgttgaggtaccgttttttccctccagaacacaagaaagtctcaaagttcatataattaaaaattgcataatttaattttcaggatgaagagtaagtaaaaattaagctatcggagaataatttgatcatctatgtatattttatacatatgtggataaatgtatcttaaaagatgctattgttttatgtttcctcttcagccactggctgtgattttaattgtgctggaggatcttcattagtattaacacatggggagatttcacaaagctgcttcattaggaaaaaaaaaaagcttggcagactcggtctttttgcatgcactgagaatgtcagccttacctcggtcatttgtaacataataagtgcaagtacaatgattgcaatgcaggagcactgggggaagggcagaaatactgcctgtctaatagggatatctgaaaagaaggctgctcattacagagtaaaatgtatgctaaaaattagtgaagatgatgtctcaggagactgatgctaaataaattaatgtgctgatatgtttttaattattatttttgtagtagtttatttcattctcaggattcacattgagcagcaaagctgtgctagcacttattgattttttttccctgccacattcccggaatacagattttaatcatttcactacaccacactcagtaatttcattaaaaactggaatcttccatccccagaaaagcatttaatttcaatgacatacaatttctcttttagcagcaaactgtctctacagtaaaaactggcctaaggttcaaatgcataatttaatcctgagttttccatgctctgcattcctttcaagctataatttgagtaactacctaataactgtaataaggacaataatttccttataatatattattaactcatatttaattaactcggaggccaagctctgtacatgtatgactgggtcaacagttctataatctcaaaatttactaataatgttccagaagaaaaatatagattaaaatataagtatgaatgcacttagtatctaagacttctatcccaagtcacatacaaaaaagttaatgcattgttctataatggtggtcattaaataaataatatttttaagtatgtggaactaaaaaatggaatacactgatatttctatgcgtaaagtattgaatattaatgttttaacaatctattactgacactttacctaatcattagcattactgttgaaaatatttaattttgaaaagataaggaaaaagtgctagattcaagttatcttgattttcataaagaattctcccaaaatatacctcgcttgaaataaagttaagtggcacactgtaactcgaataattaagaatacatcctttgcttaaatacttcaaacaatatactgcaaagcatggttcaatttttggttccaataatattttgaaatattgggattgcagatgccacactggtttcccaaacaatggtttcataatgatatgtaatttacattgcctggattttagaaaag

SEQ ID NO: 4075 - DNA, 1944 bp, Homo sapiens
gtgtgtatatatatatatatcccatctttttttttttttttttttttttttttttttttttttttgagatggagtctcactcggtcgcccaggctggagtgcagtggtgtgatctcggttcactgcaagctctgccctccgggttcacggcattcccctgcctcagcctcctgagtagctgggactacaggcacccgccacgacgcccagctaattaaaatatatatcccatcttaaaaaataaatggcattaaacaaacattaaaaaaatgatagaaggggaacacacaatcacacacagcatcactgactattgccagtcactatgtacctattattctgggtattgtttaattggaaacatcaccattttagaatctaagattaaggggaatctacctagaacagacaacagaaagcattccaactatgaaatatgataaatggcctatgtttaaaagatgctggagagtatccaagaaagactgctagcttagaaatttataaaggagatgaaatgaagaatgtgatattatctgtgcttatgtatctgttagaattcaatgatacctatttcttgttgaaaagtggactgccctccattctgagtgtagtacgaattaaaaagacttctttttttaaagagttaagttgaagaagggctgagctggcttccaaggcactaattaaggaatccaagcctgtactatataggattctttagggatctgcagatatttccattctaattttccagagacaaaaatgtaaccgggagaaaattagaaaaagaaagtgacctgtggcatttgactactactttgcaaactggcttattattaacagttttcaacatttaattgatcccccacttaaaaattctcaccttattgagttcaatggctgatcgtctatgatcataaggccatccccaacatatacacattatttgagtcactgtgagataatgtaataaaagcatctgaagcactagtttcatttaaacagagacatgccctcaacatcaagaatagaaagtcttgcgcttgagtttttctttagagatgcagaattagctcaaggaatggatggaaatgacattttttggtaactgattttaaggtctcgaatacttttatggaaataagtatcctgcgcattttatatgcccttgatcttgtgagtttttctagaggcataatattaatttcagttaacttgttaaaattattctttcagaatttctaagtgtctcaaaagttaaatgaattggggaaaaatgtttcttattctaaaaaagaggtatgcatgtatatatataaaaggaaggaaaaaggagaaaaatcctctttttgatatttgcaggaaatatctgaggtttagcttgggaggcgatggggcaatccagggcgagaaatgatgtcttgaataattaaggtgactactcctgaccttcaactaaacagactaccttcctgtctaccctgaaggtatcactttggtgttgctatccactgattcacttctgcaaacttccctgacagaagaaaggaggacttgcagctggacactgctccctggctcttcggagcggtttctttacactatgcatggaccacagatcatctgctgccatcctactcagggagagcttgctaaagatgcatggtcctggcccccacccaaaacctctgactttgaatccatgtcagaaatcgtttaatttatgtacttacttgtttatctgttttgttcactgctatatctttggctcctagaaaagtactaggaacatggtagatactcaataaatatgtactgaataaatgaaaaaaaaaaaaaccaacaaaagaaagggaaggaaaagggattgccttcatgtttctcccacctcctcaagttgttttttttttttttttgagacggagtctcgctctgtctccc

SEQ ID NO: 4076 - DNA, 1048 bp, Homo sapiens
actatgagccaggataaacacattactctcttctttaacaaaaagagcatggttaactccaaagacttctctagaccagcctggatggtacctaaactttaatcaaccaatgctcaagtaaaagagcagtatccagccccagcacacctaactgttttgcataacatagtgctcctgactggagagcccaggctgagatggtgttaaatgcttttaccacgtgggctcctggcaccaaatgagcaagatctcaccccacaggccttggaaacctgaggcagtattcttctgggatgtttccaactaggcttcccatgaggatgttagagccagcctggctggtgaattttacttctctcacctctcagaggtaagaggtctgagaggctcaggcccttccagcttttgaggattccagcatagtagaaacataaaaaggtccaaagggaattacaaaaataatctattttcagttcttatacttaacaagtcaattcttattaaaaaaataaatcaatcaaacttttgtttgatataattatagattccaaggaagttgtaaagatagtacaggaggtccctgtgcatctttcacccagtttcctccagttttatgccactagagtacaatatccaaaccaggacattgacattggagccatatgcatgtatatttccatgtcattttatctcatgtgtatgctcatgtacccatcacttcaatcaggttagagactagaccatccctcatgctgccctctgaactaccaaccctaacccgtggaggtcattaatctgttctttatcactacaatttggtcattttgagaatgaataaaatcacacagtaatgcaagccttttgagactagcattttttcactcagcataacatacttaagatccatcaataattcttccattttattgccgagcggtattctacagtatagatatactaaagtttaactcttcatctaaggtaggacattttggttgtttccagttttggctattacaaataaagcttctatgagtattcacctaca

SEQ ID NO: 4077 - DNA, 1113 bp, Homo sapiens
agagcaagactccatctcagaaaaaaaaaaaaaaaaaaaaaaaaaatcagaatcctaaaaacatattaagaaggttttatttctaaccttattattttgcaggtgaggaaactgaggcacaacaatgttaagtaatgaagccagatttgaacctggacaatctgactgcagaatcagtgctcttaaccattgtttcttatttagcttgctacatggcataaggctcttaaagatagtgacatgatgcagggtttctcaggatacaatctatagacagcattggaacagcagatgttgcaaatgagaaagtcaaactgagttaagcacacctccaaacctacaggtgaggcactaagctctgtggtttccaaatcatcgaatgctagagctgaagagggcctcagagagcaagactccagtcaaggaagaaaaagccagaccagaaacaataaaaagaaaacgagcaaacaaaggagtcacaaagaaacagaactgtggcaaatgacgcattagacgaagaccagcaattccacccacagaggagataccagcgggccaagtgtgagtcagaagggactggtgaggacttgcgcaccagtgagcctacagggaggggcctgccatgtggaaacaggagctgtgcctcagctcctgccatgtggaaacagaggcccaccattgccaggttcccaatttttcaaaaaaagccagatattcacattttgtgtgaaaattcctgttcttgaaagttggcaactaattcaaatctgagcttaggggtaaccccagccaggctagccctatcaggacaaggacaaaggtgttcctgtttttggctgtatccccatatgtctggcatatggactttcaataaatatctgttgaatgaattaactaaaatgattaaaatacaacttaaatgtagttcaaaagataaggcttcctgacagaatagcaaaatttgacagtcaccccaaaccctgggctttgtgaaatcccaaattgctgtggaacctggctgaagaaggaggacttcgtaaggagagatggagaaagaagtttaactggagcttaaaaataaaatggctcaggagccctcatatacaaccaaaa

SEQ ID NO: 4078 - DNA, 12350 bp, Homo sapiens
aggcctgctgggctcccgacgctcgcgggagcagcgggaaaccaggttccgggagtggggcgaggacgcccctgccaagccccttttacgtcccggcggtcgcgaggaggtcccccgggcgcgaagaagacgccagcccaccccagccgccggggagatcgcccaggccgcgctcagccccgcccctggctctgcccccgccgcggagcggaaccctccaagtcgcggcctgaggaggaaggaaaagggggcggcccgggagagccgctgcgaaatcagcaacgggcgggaaccaggttgcctccctgagtcccttctctccccggccggctgccaaccacagccaaggccagagaaacaggcccttctgccgcggccacctgggcgccttggacccgccctccggactcgcccccgcccctgccgcggagtggaacgtttggaaccctgaggggcacaggtaagggggcggccccgccccgcgccctggaacgacctcacggccccgcccacatccccgcccctggccccacctccgccgcagagcggaaccctcagagtcgcggcctcgggggggacgaaaaaggaggcggcccgtgggagtctaggggaacccggcttcgggcggcggacgagttggctttcctgcgtggtagtgtggagccccccgagacgggtgccagtcccactcgaggccggagaaagagggccgcctaccgcggccgcctgggcacccctctgagggccaagattgtagtcccacctctggccccgtctccgccgcctagcggaactggagtagcgggacccagcccggaagaaaaagggggaaggcccggagaggtgccccagcgacacctctggcgcctgtgaccccgcccctagccacttgggcgccgcttcctcgggcaggttcgcagttcatctcccacgggtctacagcttgaaacttggcattcattataatgtttcgtggctgctgataacctacagttcacaatcttcggcctggtattcattgtccaccaaaatctggcccacataggaatttactggacagctagactaatgcaatcaatttccgcaagctcttttccagtctccatgcatttactctatgcttgaccccttcggcccttcttcctcctccttgactaactgaagcctatctttcccttaacggccagctcagctcctctattagccttccccattttctgaatttctgtagccattggtttagtaagagcttaggacttagagtcagttcattttgagttcaaatgtcagttctgtcatttacaagtcgtatgacctttggcatcccgttttacatgtttgaacttaagtgttctcatctgtaaaatggagataatcatagcacctacctcacaggatgacttaagatcaagaggatgaatataaagcatttagcacaagcctggctagtagaaaaatacttaataaatcatagctaatttcgttgtcacttggccacaatgtattgcctcctgttgttatttatgttttcatgtgtggatgaggcatattttcctaattggaatgtacgttattcattgaaacagtcttttggtatctcctactatgcctggtacagtgttgagcatatagttggagctcaattaatgttgctcgcatgagtaaatgaaatcagtcctgcttagctgcgttcccttatgtttggtccttaaccaagtttatattagatattccagaacataaatctatggctttactctgtcactcaactaaagcaccaaaccccacatcagctcacatattacttcatataatactttgttttcttaatattggcttttgaattatgcagtgatccatgtgatgtgcctccatgaagaatttgctgtggtctaggggtgaataaaactagacattgttatcaccactaaatgttttggaatctgaatatgtactcttgctagaattttcatgtattcatctccatctaaaagctgggatcattgcttcttttcattgtggcttttgtttccattgggtccttccttaggagttgattttgcagccatatgggaaataactgatgatctttgctccttatctggcatttccacctagtatagaaacattttcagtttcctgacttcattcttcgctaattctgctgtgcacatttgcaccccttttggtgtataggcaatctacattcttcggctttggtctatgcgattgcatagcaatatataagctatgttcttcaataagctcaaaattctgggataaaaccaagaaggaaggctactccgttttagcttttaaatttttaaagcaaattttagtgattcattttggaccagaaagctgtactatataataaatcagtctcacattttagtatcctcatatccctgaggtgcaaaacctccatatcttggtccccatatccatgaagccattctctggttatcaccaatagaaacttgtctccaagtcatttctcaaatatttgtcaagaatcagatatagtataatgatagggaatgttattgtttctgaagctgattcatgatctccataaaaatgaagacccagaactggaccctggggtagcaccatgtatgatttttctgaccccagccagaggatctgccatcatcctgccacagagacttcagcccaggtagtttccagagagccccatgttaacatccaaggtggaaaccaataaatgtttctcttgtagggttcaggtctttggctctaaagaaaatcactccatctttgacccagaaggtcaattctgaatgaatttgctgaaaatgaccaattcaccaaatttagttatttctatgataatttagttgactggaaatcattttttcgttacattttaaagaatgttgaatttgtctctgctccagcttcctgtagctcgtttgaggctaagagataaagagaggaaacaccagggaacataagatttcttcacagtgaggaatatatttattaaatatatttaaaagaatatattctaaaagaacatatattccatttttgcctgctctgacttcttgatgctgtacctggagactaacatgaaaagaaagcagtatatactggccaggcgcagtggctcacacctgtaatcccagcactttggaaggctgaggctggtggatcacttgaggtcaggagttcaagaccagcctggccaatatggtgaaaccctatctctacaaaaaatacaaaaattagctgggcatggtggcaggtgcctgtaatctcagctactcgagaggctgaggcaggagaattgcttgaacccaggaagtggagagtgcagtgagccaagattgcaccattgcactccagcctgggtgatagagcgagactctgtctcaaaaaaaaaaaaaaaaaaagaaaaaaaaagtatacactgataagaattcttcaaattgaagattatgttcttatgtctacccagtctttcctttttcctttccttcggactccaactagaacagcaaggagcagagacaaagacaaactagtccttaaaatgctgttatggagacaaaatgacaccaaacaagtccactctgtgaattggttatgctgtaaattaatctttgtctaaatggcctttgacaaaccgactgactcctagctgacctccttagacatacccagtatcccaagtgaagctgtttcatcgttttttgtttgtttgttttaaagacaggaggtctttctgtgttgcccaggatggactccaatttcctggctcaagcgatcctcctgcctccgcctcccaagtagctgggactacagagtctcagaacatgggatcaatcttagacccaaaggaggatgcttctcagaaacactctctgtcctgccgtacgtctgtctaaactcctctagcaattccgatgtgaaaagaagatggatggagaagcactgattcagccatggctgacatgtcggagttggaatggacagtgcccggacctcacagtctcagagaactggagaagagtaaagctgaagagggcatcatctggttacaaatgacaagtccagggctccagaactcaggccatgtagagaggccacatgggaactgaggttcctagtcctcagcttccactgagctcccagccaacagccagcaataacttgccagatgtgtgcacaggccatcctggaagcagaggatccagccctcagccaagatgccccagttgattccatgtgaactaggaatgagccctcctgctgagctctgcccaaattacagatctgtgagcaaactaaatgacagttgtattaagctacacagaaatagataactggaataccacccatgtctttctttccaaacttagttaactgagtctgagctaaagagaattcacactgtatatcttatattgaatacccactatatctggggcatgattgctaataatcctcacaatagccctacaataggaaacgatcatcctcatttcacagatggagagtttaatggtaagcctgaactcagactcagacttgtttgacttgagagcccatacctctttcactaagccataccatctccattcactctatgctgtctggccacctgagaggctgtctgtaagtctatctccttattaacccatcattcctgctacttccatgataatcggcaaggctgaatgatagctctcagttctatggggtctttccaggagaagggccaaagaggagtggttgatcacaaagtcatcggcacaaaaagatggtggccaagctacagtcctgcatggcacatgagccagatgatcaagtaatgaaagctatgctaagaaatgtgggctttatcttgtggagaaggagatgcagtagaggctttttaaggtacatttcagaacaattattatttttatatttattatatattatttatatatataaaaccacaaattatatgctacatatatacatatgtttttatgtctatatataaacacatatatacgtttatatatatatacatatgtatatacaacacataaaatttaccatcttaaccttttttttttccaagatggagtctcattctgttgccctggctggagtgcagtgacacgatctcggctcactgcaacctacacctcccaggttcaaacaattctcatgcctcagcctccctagtagctgggattacaggcgcccaccaccatgctcagctcagctaatttttgtatttttagtagagacagggtttcaccatattggccaggctagtttcgaactcctgacctcaggtgatccgcttgcctcggcctcccaaagtgctgggattacaggcatgagccactgcacccggcctcatcttaaccatttttaagtgtacagtttggttgcattaagtatgtccacatgtttatgcaaccatcaccaccttctctttttagaacttctgcatcttcccaaaccaaaaccccatacctattaaacaataactccccattctcccttcccccttgcccctgttcctgacacagaacaatattttttgtataactatgaaataaatgaaggaaatctgaagtgggaaggccagagagtaagctacaggggtacattgggcaagacacgatgaggacttgaacccatgcttgggaagctggcatgaaaagagaggttcaacagatcctactaaggtaaaagtgagaggattttgcggggcggagggggggtcactgggatgtgggagtgaggaagaaacaggaatcggcctgccagcagttaatctatcgaactcccatagtccacgtgaccctgtcctgcacccctaaagaaggcagtgtggcaggtaggttaagagcctagactccaaagaccaggacggcctaggtccaaatcctggctctgccatttgctaactatgtaactttgaccacttacttaacccatctgcacttcagtttcccaggtgaaaaacaggcacgaagataagtgtaacaggacatacttcataggtactactgttaaagtattgagaagaatacacagtaaatactgctcaagtcagtagttaatacaatgactgtattagtccgttttcacgctctgataaagacatacccaagactgggtaatttataaaggaaagaggtttaatttactcacatttccacatggctggggaggcctcacaatcatggtggaagaggaaggaagagcaaagggatgtcttatatggcagcgggcaaaagagagagccaagtgaaagggggaaatctcttataaaaacatcagatctcatgaaacttatttgctaccacaagaacagtatgggggaaaccgctcccgttattcaattatctcccaccgggtccctcctacaacatgtaagaattatgggagctgcaattcaagatgagatttgggtgggaatacagccaaaccatatcaaggatgcgctctctattcttcactttcccagtgacttatctaaaaatgatttctcccttctacgtgcaagacttccactccagtttcttttctccttatattatttgcttccagtttctaaaatatccttgggatcactttgagaacatgggaggagagaagcagagggcttcaggaaatctgatgaccataacttacgttttataagttcttgtacaaagtcaagaacaggtgaaatttccaggaagaatgtagaagacacagttaatcatgatgttattgggttgcccttaagtgggatgcatggtctccctaggggtcacaggctggcttctaaaaagtaactaatttttttctgattacaatcataatgtgggtttatgtgggaagaattctaagccacagaaaaatataaggaaaaacttgaaaagtactcctaatcttaccactcaaagataacgttagctggctgcaaggatcttcagaattctctaggccagttgcagaactgaaacaacaaaacagagccttgggagatgttagcttcatgttttatttagaagtattagcagatagaaaattgagctcattagcatgctagcatgtgtggtggctccataatgcatcatcttcgttagaccaactacatttcccaaaattccctttcttgcatgtttctaattaacgtgggacagaagagagtttcctgtgggagatctgggcagatgtgggcagcagccatgttgtagctcacataggttggcaatgatcagttgcctcatcttattaggaccagggaggtgcggggcctgtaactgctccaccttctcctgggttttccttttcagcttcttcggctccttggccatgtgtgtactttatgatgaagcgcccagcttctgcaggatatccatactgccaaggtcaaaagcaacaataagcgacgtggggctcagtctgttctcgtgggctacaatgcatgcttctggtttccaggttgttcttgctctcccttattttacatttatccttccttcccaactgcctgtccgatagatgtcgagtcccaacatcagatgtgaagatgagagctttatagagactgcttaaccagctcccacagttgtattaggacaaatccctgtagcaaatccctttgtgtgtgtgtgtgtgtgtgtgtgtgtgtgtatgtgtgtgtgtgtgcgcgcgcacgcgcgtgcacgcaccttagtggttctcctgtgattgaatcctgacttacacagtttgagatagaaaccttctgaagcaattagattaaatggtctataactgtgctgtccaacatggtagccattagctacatgtggctatttaaatttaaattaattaaagttaaacataattagaatttagtaccccagtcaagtttcaagtgctcaatactgtggtcacatgtggctggtggccactgttttgggcagcacagatatagagcacttccgttattgcaaaaaaatgttctatgagcactggtctatagtgataattactagtatttactgagttctcaccatgtgtcagatgcagattccaagtttgctctggagagcacgatgcggcaggcaaacggggaaagagagagagtgatgggaatcaggtgggagatttttttttttttttttgagatggagtctctctcactctgtcacccaggctggagtgcagtggcacaatatcggatcactgcaacctccgcctcccaggttcaagtgattctcctgcctcagtctcccaagtagccaggattacagacttgtaccaccacgcctggctaagttttgtatttttagtagagacagggtttcaccatgttggccaggctggtctcgaacccctgacctcaggtgatccaccctccttgaccttccaaagtgctgagattacaggtgtgagccattgcacctggccaggtgggagatttttaatgaccaggcctggaggtggcacacatcacttatacccacatccattggccagcactcagttacacggccacttctaactacaagggaggttgggaaatgtagcctagctgtgtgctgaggaagaaaaagtaaaagctttggtgccagccagtctctgccacatcagatttaatttgagcgctgtgaagtaattaatgcccattaaactaagggtgggacaagattaatgctaaaatcactctccccagccaccattttctctcttgttctttgtcatgatattgacaaggtcaaaagtcaggcagtcagcatgaacccgaggaggagaagtccttgccactttgaggctgaatatgaacagccccttctttatgactcaccctatcagctttgctcctagcgaatgttcatatcgtggttctccgggacccttgaaagtgggactcctatgtgaggaactagttctataaacaactacatgctagtaaaaaaccattaagagggttggaattaggcatagtcctgctgcatagaaatcctacttagttggaaaaattgtatttttaagttgcctctgttttgaagccacgttaacccttaaccttcagaaaatccttagccagcctttatacattggtagctcctgttctaataatgtcttctcctcctattttctttggcttgtcatgagctttgaaagtttgatctgagatccctcacttttaataatctgtaactctgatttggtaatctcctacatatgaataaaatgtctgtgttcatttatttctaatgaataaatgaacatgcctgctgagccaagccttaaatgtgattaaggagactgacttgggttcagatcctggctctgccttgagtaagtttctaacattcctctgcttgtatttccttatctgtaaaatgggagtgatttctttgaatgaaattatattacatttatcaagcattttatcacagtttcaacaataaggtgtaattattattaattcagactatatgattctgtgcccttggataaagtttaccattatataataaactacttttctcacttaatgcaaacaatgtggtatcagtaatttgtagagggcattttaaaaaatcatgaagatggtttcttccaggatttacatgcatgagatttccattctgactataaaacattcttatttattcactaacactaggttagtgagaatgtctgttagaacactgtgctcatctaattcaagtttccatagtttaggatcatcataggaaggcacctcctacaaagatcatggggttccatcccttcgtattacacatcaggaaactgaagttcatagaaatccacttcagaggtaaaggagacttgaagatgacctagtgcaatactgtacgttttgcaaaggtagtcatttagacggtactttcatcatttcaaaaatcgcttatttatccacaataggctgcacacacaaaaattagagtgtgaggctgaggctgggtgcgatgactcacgcctgtaatcccagtgctttgggaggccgaggcaggtgcccaggagtttgagcccaggggtttgagaccagcctgggcaacatgaagagacttcatcgctactaaacatgttaaaattagctgggagtggtggtgcatgcctatagtccaagctacttgggaggctgaggtgggaggtgcgcttgagcccaggtgttagagactgcagtgagctatgattgcaccattgcattccagcctggtgacagagcaagaccctgtctctaaaaaataaaaataaaataaaaatagagtataatgtttgtaccgtttgggattatatcaatactggttttctactgctgatcacaaacactggatactgtcatatatgtttttactcaacaccaaaaatgagaacaatcttacttaaataaattgtgcaaaagcatcttttagggcttggagttcactggaagaaaagaattacaaaataggtcatgggtggggaaaataccagataccaaaatagtccaaccccttcagtccacaagtgaggaaacacaagctcagaaatgtgaagtcatttgccaaagtttattcttttaatcccatttttgaaggcctactgtgtgccaggcacgggggttatagcagggaataaaacaaagtccctggcctcaaagagagtttacattctagtcatattatgcaactcacttcaaagttttaaaactctactttgaaaacatcctgtaactgaaaacttctcactaattcaaacccatctccttctgcttgtgtacaccaaaacccagaattggttagacttcactgtgaatcccaatctgtgtaatatcaaatcatatttcaagttaggagcaaggcaaaaatgtctacataattgaaagacaacagagctatgtgttcaattcctgttcattcaattaatcagataattataagcaattctaatttacacactaaagcaaaattactgccattttatatctttgtttatctcttcttcaaattaaaaaactctatgctgtactaaatactatagcaacattagagtaacttttactttatgctctgttcacttctaaaagaaaagtaacaaaagggtataggtcacactggacacggatgttaaagactaacacacatcacatcacaaacatcattgcaaaagtatctctaacttaccttgatgttttttacagccctgtgatcttgtaaatgtgaggcctcttggcaagatcaatgtgtttcttgttatttcttgaactaaggaatgctattaaggtgcatttcaacagcgtgttctcttggaatatcaacttaaaccctaataggttaaatcagcagaactgttgcttttatgccttagatcactctttatctttatacagtgctttggggatataaattcatcccaggatgaacaaatcatgcaaagttgtgtaaaaaccattttcaagccaggcacggtggcatgcacctgtaatcccagctactcgggaggtcgagatgggaggatggcttgagcccaggagttcgaggctgcagtgagccatgattgttgcgcctgtgaataggcaccgcattccagcctgggcaacacagtgagacccaggctctaaaacaacaacagcaacaacaagaaaaccatttttaatgcttcaggactaaatattggggaagtggttaagaacacgagttctagaatctcaccacctccactttccagctgtgtgaatttggaaattacccaaactgtccaagccaaaaataagcactttctggatcttggtactgtttctttctgggtaacctagaaagtcactccattgctttgagcttcagttttctcttcagcaaagtgaggataacacaaacttttctactaacctcaaggggacaccgtgagatgatgtatgcgaaggtgcttcgtcaaccgcaaagacctacaggagtgtccagttgtgttgctgctgctgttgttaatctttagtaccagtactatgtatgaagtagtactaaagaatctgtctttagtaccagtactatgtagtagtactaaagaatctgtctttagtaccagtactatgtagtagtactaaagaatctgtctttagtaccagtactatgtagtagtgctaaagaatctgtctttagtaccagtactatgtagtagtactaaagaatctgtctttagtaccagtactatgtagtagtactaaagaatctgtcttagtatacacagtactggtactaaaggcactatgaagaaggccaggcatggtggctcatgcctgtaatcccagcactttgggaggccgaggtaggtggaccacctgaggtcaagagtttgagaccagcctggccaacgtggcaaaaccccgt

SEQ ID NO: 4079 - DNA, 817 bp, Homo sapiens
cacctagtttaaaaacagttaattaattctgtatttactccttttccttatttaataattattttgaaaggctacaacagcaccatgccaaatgatgacgtaaaacagtgaaccgattttaaaataaggatgtagaattaacatatgtaacaagatgttttaaacttgtatgtggtgtcttagataggtaagtaccagggtttttagttgatgatggttttaggcacatcacacttataaaagacatggttctccacactgtgagtagtttgatcttctgtgtttgtggtgccgcatcacttatgaatgcttctaatctcagtgtataaatggaaccagtttcatacaaggtaatggaagcagaaaaggatattcaccaagtattagtttctagtactgacaagaagcctccagaggctgacaccatggggttccatcaaactaaaatctgagggtgcagacagtgggagatataacagttgaccaccttatttggtcaagctcaagaaaattattcacagcacatattagcaaaatgtaatatttagtgggcatttcatcttggaattatattttggaatctttgaggcaagtgcacatttaatgattcatgttttaaagattgagtgtaaatttgtttattcttacctgccgacttgcatccagtgctcctgactggagagcccaggctgagatggtgttaaatgcttttaccacgtgggctcctggcaccaaatgagcaagatctcaccccacaggccttggaaacctgaggcagtattcttctgggatgtttccaactaggcttcccatgagg

SEQ ID NO: 4080 - DNA, 754 bp, Homo sapiens
atggctcgtggtgccaagaagcatctgaagcgggtagcagctccaaagcattggatgctggataaattgaccggtgtgtttgctcctcgtccgtccaccagtccccacaagttgagagagtgtcttcccctcatcattttcctaaggaacagacttaagaagatttgcatgcagcggttcattaagatcgatggcacggtccgaactgatataacataccctgctgggttcatggatgtcatcagcattgacaagacaggagagaatttccatctgatccgtgacaccaaaggttgctttgctgtacacctgaggagaccaagtacaagttgtgcaaagtgagaaaaatctttgtgggcacaaaaggaatccctcatctggtgactcatgatgctcgcaccatccgctaccctgacccctcatcaaggtgaatgacaccattcagattgatttggagactggcaagatgaccgatttcatcacgttcgacactggcaagccatatatggtgactggaggtgctcacctgggaagagttggtgtgatccccaacagagagaggtacccgggatcttctgacgtggttcatgtgaaagacaccagtggcaacagctttggcactcaagtttccaacattttcactattggcaagggcaacaaacgatggatttctcttccccgaggaaagggtatccgcctcaccattgctgaagagagagacaagagactggcggccaaacagagcagcgggtga

SEQ ID NO: 4081 - DNA, 12050 bp, Homo sapiens
gcgagcgtagcgtctgcacccactagagtcccaggctggtctctgggtcccaccaagtttgctcaccggcttctcctcgcctcccatcttccctgaaggactgctggccttctcctcaaacattggcgaacgacgaagcgatgagagaacccgaaagcgacggcctagaggagaggagccaagaggcgggtgggaggtgggctagcgcccgggacttggcctcggctggaccagctgatgcaatcgaaaggcgccctaaccccgcccccaacttgcggcggaacgagcagccaatggataacgggggaaggcgggccctccctcctctaagccagtggaaaatcttttcgggtgacagagcccttctaggaaatcaggtcgcggagggtgaggaggagcaactgcagaagctacatgcctactctccgctgaccttggtctggacgctttccagagtcaagtccccaatgcgcgtgcgcctttcctcccttctgactttatgtggaacaatcatggaccttcccggacaccgtagataataagtaggtcttggtttccgggaagttttcggcgacctggataccatcttcgacacggggacaaatcccgggatggagtccagggtttcccgcggcttcggcgcttcctgacctggcgtgactgccgacttgtcggcaccacccaggcctcaggctccctgtctgtagtggtgaatcgaccttcctcatggcagtccaggcttcccaagccccatgtcctgttgatccgggacaaactcttccttgaacgttcttcactacgagccgctgctgatctgtactgcctggaggagcatttccatagcgcccgcaaaaatacaataaagctcacccaaggaaataaccatggattctcacgcctgggtgccagtgtttggaatcgactgggcttttttatgttagtaggcaatttaaaacaattacttatttgaaatcagaagcgcaataggcataacttcaggtacgtgctccaccaccacgttttgtggatttttctttttaaacatcagttctgttctctacaactctccgccttcagggttatactttccaggaacaatagcttcccaattcggctttgtgcatccatttttcatacagcatcgttgtagtcttcaaatacaaatatgatcacggcaatctgctgaaaaatctttggtggctttcccttgctcttggacaatccctgattgtccaagttttcggcttcatctcgttcgcccaccatacactgaactataaactgtagtggctttttttcctcaggtcttcccacagactaagtaccaagatttttccaccctaccctcatccgtgctcattccgacacactttttgcctgtttgacacctcatttattgtcagatttcaagaatcgttttcttcggggaaccatttcttgactcccttactggatgaaacaagcctccctgttaaacagtgttggaggcgcagaaacatacccccaaataatggcgttttgacatctgaactgaagaagcctcaaggtcccactcccctaaatccccacgccatctctgccaaagcaaaggataaagtttagacacatcacaaggaacataattgtttttgttgcctccctgtaagaccaagaatgtagtaatcacacctgagcagaccctttcacaagatgttgtacaaattaatgtgttcctgatacattcattctcctttgtaatccctcaacagaattcctcttctccctatcataacctgtgtcgctgggattgtatccacaagcttctgaagccctctgaggggtgggtaatcacgctgtgattcttcctgtgtatacacgttaagtaaatttgtatgttttttctattaatgttcctcatgttagtgattttcagccaaacctcagagggccaaggagaaaggtccccttggcgcttacaatagtgtctgctggtagtttcatgtggttcttggtagaacttaccggttcaacttgttctttcactatgtgtgtatttagagctaagcaagtttactatatatgtgtatatatatatatatatacacacacacacacatatacacatacgtatatgtatatacatatattatatatatatatatgcacagtaatggttctgatcagttggcctaagagtacaccctatgtggggcttcacgtactgctacactcacaggcagaattgggggttgtttttctgtccagagtgattgatcctgattacaaggggacaagcgggtttcttctacataaaggagaattttgtcaagaacccaggagattcactgagaccttttttagtacttccttgtctaatgtttcgctgttggaaaactctgggaacccaacaaagacaaggaaggaaggaaggtttgggctatccttctaggtaaagaatctagtctagcgaggtcctgacaaaggctaagggtaacttgaaaaggtgctaggagaacagagttatgcaatattagctacctaatttgcagattacatatatatgtatacacatatacatatgtgtgtgtgtgtgtgtgtgtgtgtatatatatataactgctctttagctgacaccttgattttaataatagtccttttcttttcttttttctttgagatgaggtcttgctccattacccaggctggagtgcagtggcacaatcatagctcactacagactcaaactgctgtactcaagcagtccttctgcctcagcttcccaagtaggtaggactgcaggcacacaccaccacacccagttaattttttcttattttttattctatctatctatccatttatttatttttgagacagagtcttgctctgttgcccaggctggagtgcagtggtgtgatcacagctcactgcagccttgatctcccaggctcaattgatcccctcgccacagtctcctgaacagctgggactacaggtgcacaccaccacgctcggctaatatatatattttttaatttttagtagacatgaggtctcactatgttacccagacttgtctcaaactcctgagcttaagctcttctcctaccttgcaagtttatagtttttttaaaatatattttatctccttgattgaaaacttcacgaaagcacactttgtgtatttttgccagcatctggaagatgtaaacctatcgcacagcagatgttcaataaatgttgagtgttgagacaaaacttgcttaatttttcaagcaaggtttggaaaattacctctttatttgtattataaaagaagtcaaaacccctttactaactagatctagaagaaagtttatgatgagagtagattattagtagtgcttgatattccaggagttatgtacaattttaataggcttaaatagaccaaactaactccccacatttaaattagaatgagaatcaataggatctaatcttaccttttaatgtaaaacaatttaattatgctcattagacacatttgcctgaattgtatcttaattttaactaagtataatgaaaaccagagagatcaagattcctgaatttgctggatgcagaaaatgataggctaacaattatatttaactgctatataacattgtttctagcagcttctcttaactctttgttctctttcaactttaaaaacagtcctcatttaagtatggcaaaaagaaaaagcagaaggcgtttctttttttaaatatatttttattatactttaagttctagggtacatgtgcacaacgtgcaggtttgttacatatgtatacatgtgccatgttggtgtgctgcacccattaactcgtcatttacattagttatatctcctaatgctatccctcccccgtcccccaaccccacaacaggccccggtgtgtgatgttccccttccagtgtccaggtgttcccattgttcaattcccacctatgagtgaggacatgcggtgtttggttttttgtccttatgatagtttgctgagaatgatggtttccagcttcatccatgtccctacaaaggacatgaactcatcattttttatggctgcatagtattccatggtgtatatgtgccatattttcttaatccagtctatcattgttggacatttgggttggttccaagtctttgctattgtgaatagtgctgcaataaacatacgtgtgcatgtgtctttatagcagcatgatttataatcctttgagtatatacccagtaatgggatggctgggtcaaatggtatttctagttctagatccctgaggaatcgccacactgtcttccacaatggttgaactagtttacagtcccaccagcagtataaaagtgttcctgtttctccacgtcctctccagcacctgatctttgacaaacctgacaaaaacaagaaatggggaaaggatttcctatttaacaaatggtgctgggaaaactggctagccatatgtagaaagctgaaactggatcccttccttacaccttatacaacaattaattcaagatggattaaagacttaaatattagacctaaaaccataaaaaccctagaagaaaacctaggcaataccatttaggacataggcatgggcaaggacttcatgtctaaaaacaccaaaagcaatggcaacaaaagccaaaattgacaaatgggatctcattaaactaaagagcttctgcacagcaaaagaaactaccatcagagtgaacaggcaacctacagaatgggagaaaatttttgcaatctactcatctggcaaagggctaatatccagaatctacaaagaactcaaacaaatttacaagaagaaaacaaccccatcaacaaatgggcgaaggatatgaacagacacttcttaaaagaagacatttttgcagccaacagacacatgaaaaaatgctcatcatcacttgccatcagagaaatgcaaatcgaaaccacaatgagataccatctgacaccagttagaatggtgatcattaaaaagtcaggaaacaacaggtgcagaaggcatttctaacaggttgactgtggtgcaggaacataggggaagaatgtaatgagttgctagtgtgggaacctcgcagaggtatccctgtggcacagtgccctctggtgttaggaaggtgttctttcactatgtgtttagagctaagcaaagatcacgggagcgtccaacacatctcagacctaaagcacaaaacactgttatacaacttttgtgtatttgccaacaaaaaaaaacttctgatttactcccagtgttataatttatgcccactgtattaacccgttctctgctatgaagaaatacctgagactgggtaatttataaaggaaagaagttgaattgactcacagttctgcatggctggggaagcattaggaaatttccaatcatggcagaaggtacctcttcacagagcagcaggagagaaaatgagtgccagcaggggaaatgtcagacacttataaaaccatccgatctcatgagactcactcgttatcaggagaacagcatgggggaaactgccccgtgatgcaattacctacacctggtcccacccttgacacatggggattatggtgattacaattcaagatgagattttgggtggggacacagccaaaccatatcaccaactaccctacatgctttaaaaattttttacattattttattttttttattttattttattttttagagacaaggtcttgctttgttgcccagctagtctcaaactcctggcctcaaatgatcctctcaccttggcctctcatgctgggattataggtgtgaaccaccacactggcctcctacatactttttaggaaagtggctgtcaatagctctgccttgagaagtgaagcaaaattatgtgatatgctacaaataatgttacaaataatagaagtttgtacataaccatctctctatgggtttggggcaaaagagtcttcttcattatcaatccttaattactcatttgaataatttttgcttctggttcctacaaccttgggctggatgattttgaagaaactaatccctgagggaagaatgcttctatcaggggcatagtcatggttctgatcaactggcctaagagtacaccctatgtggggcttcacgtactgctacactcacaggcagaattgggattgtttttctggccagagtgattgatcctgattacaagaggacaaatgggtttcttctacataaaggagagttttgtcaagaacccaggagattcgttgagacattttttagtacttccttgtctaatattctgctgttggaaaactctgggaacccaacaaagacaaggaaggaaggaaggtttgggctatccttctaggtaaagaacccagtctagcgaggtcctgacaaaggctaagggtaacttgaataggtgctagaagaacagagttatacaatattagctacataatttgcagaacccaatgcaaaataaaaatgtagggctccttgttaatttcaatctatttaataggcacagtggagcagcaactaagtgtagagcgcgcttctaagtattgagtcctgtgtgactccccaggttgtgcatccatggagctggtgctagtgctatgattgctaaattagccctcatgaccagaaagaagtatggcctgtagaagttatgttttttgttacttttttttccactcccccaacttttccttatatatgtatcatatataaagaatactaggagtggctaactttttacttctcgtgagggaatatgattgaatcaagatcactccatgatgatacacattctgaagggacttcatgtgtcccttgtgttggaggcacacacttttcatgtggatgaaaagctatagaggatgttgaaggggaaaaggtgtggcctgtaccaatggactgctgggccattggcctccagttgcttccagccagtgagaccctcagcaggagttgggagggaagaaaacaaaatcaggacatgtatacccctggctcttcccaggaggaggttgccttgtgctgctgatgtttcacaaccaaaggtcactgctgatctcatagcaataactacagaacacttcccttctaggttccagcaaatgctggctaccctcaccctgcctggcctacatgtggttacagatttcccacaattactatttgtaggatcctgactccctatacttctcatctgttttaaataaaccctctttaaattactctaacccgagtgtgccctctgttctctgttggagccccgtgtgatataatcatgttcctcagctataaaatggtgatagaagtaataaacctgattccagaacttgttgggaggataaaatgaaagtacaagtatacaaagtactttgcaaattctaaagggctataaaagttaattatgtttggggaaatgaatgctctagccggttaccctctctggtttactctagatttatttggaaccattatggataatattcctcaatttgttttcatttttgtcatatctcttctttgctgagagcttttgctatgatttaactgtgtcccctaaagttcatgtgttgaaaactgaatccccaatacaactgttggggtgtggagcctagtaagaggtgattatgtcgtgacagctctgccatcatgattggagtgatgtcattatcttgggagtgggttagttattgtgagagtgggcatgctataaaagtgagtttggccccctcttgctcttttgctctcttgagctctcttgcccttctgctttccaccataggatgatgcagcaagaaagctttccctgggtataggccccttgaccttggatttgccagcctccagaatttaagaaataagttcattctctttgtaaatctcctagctgtggtattctgttatagcaatacaaaatggactaagacagatttaaaatagctttgagaggcctagcgtatgaggaatacattctggatagcttttaggaggttctgaacctcatctccaaagggcatgctttcctccaaagtaagttgtaaatgtgtagaattgtgcatttgcctttggcgtccctcccttctcatttctttgcagagtatctgtgccattccctgaaggtatctgagcacctcacacttttcttcatccttcctacctctattaaaaacagtttccaggaaaggctgtgagttcatttttactaaataaatggctgctggactttgatatgtggccttacccggatatcaaaagcattgtctgaagcaggatttttcacaaactcagcactattgacattttggggctaaataattatttgttgagggaagccactgttctgtgtactataggtgcttagcaggatccttgacctctacccactgaatatcaatagcactcttctcccagttgtcatgaccaaaactgctttcagacattgccaaatgtcctatgggggcaaaattacttacagttaggaatactggtctaaaaaaatgaaaattcttctgtacaatcttttgggcctcatcaaataaaaaaaaaatgcatataagggcagtaactggaaggtctttctaaaaatacggaacttgagtgcttgctggtaaagaatcacttggttctctgagttgtatagtctgatagtttttcctccaaacaaatctgcacatatccatgttgtttctgagtacttcccacccaatgattcaattatggtgatgtgattatgaataaaaacattttttcaagtcctgtttcttatagcaatatatgagtaatttgtgtatacataaaaaatattctgaatattagccaaagttcttcagagaaacaaaatcatctatctactatctatctatctgccatctatttatctacctacctacctacctatctgaagagagagaaagaggggaggagagagagagagagacagacacagagacagagaaagagacagagagagatttcttagaaggaattggctcacaagattatagaggctaagaagtcccaagttctgcaattggaaagctggagacccaggagagcccatggtaaaagttccagtccaaaagccagcaggctcaagatccaagaagtgcccatttttcagtcaagtttgaaggcacaatgttccagctcaagcaatcaggcaggaggagttccctattactcagcctttttgttctacccaggtctttaattgttggatgaggcccacctgcattaaggaaggcactctttactcagtccacccattcaaatgttcatctcatccagaaaatctcacagatacaagcagaataatgcttaaccaaatgtctgggcatccctggtccagtcaagttgacatgtaaattaatcatcatatcttcccattgacctgttggactattttaaattatctctcaagaactgagtttgggaatgttgataccaatatttcaatctgagacactatgctagttcaaggatatacatagccagctgaatttttcagtgagaagcagcttggaagcttaataaaattggagtcctctgctggtacaacctacttgggagccaacaagaccatggtgccacattcatgctttcccctagccatcataagcccctatttctagcaatcagatagaagaaaacagaaatccaattcataagatacaatagttacagtaaatgctaaacagaggtagaagagaggctccaaaatacaatgacagtaaactagatgattacttatttttctgttacagctatgtagggccccaagttccttttatctttttgctctagtgcagtggttggtaaactttttctgaaaacactagatagcaaatatttaaggcttgcagcccaacacggtctttgttgcaattacttaagttctctgtcattgtggtgcagaggcagctatatatactttgtaaacaaatggacatagctgtgttccaataaaactttatttacaaaaccaagtggctgctctatgggtgatagcttgttaaccctttctctagagggttctcatctgcatggttgtacttgggttgctggcatttctgcatttcaatttgcaaaaaaaagagtggaattgcttattccaagtgttttaaggcccagacccagaagtggcacatagttacttctactcatatctcactggtccaaactgagttgcatagcttctagggaggctgaggaatctggtctctagctaaagagtcatgtacctcacttaatttctgttattgaggggaagaaaatattttggtggaaaattagtaactactgccacatgacaccaccacttgggggtaattctgcaaattacatgattctctctctctatcttttttttaaatgtaattttattttaagttctgggatacatgtgcaggagtgcaggtttgttacataggtaaacacgtgccatggtggtttgctgaacctatcaacccatcacttaggtattaagccccacatgcattagctatttatcttgatgctctccctccataccccccgccccgacagaccccagtgtgtgttgttcccctccctgtgtccatgtgttctcattgtttgactcacacttataagcgagaacatgtggtgtttggttttctgtccttgcattagtttgctgagaataatggcttccagcttcatccatgtccctgcagaggatgtgatttcattcctttttatggctgcatagtactccatggtgtatatgcaccacattttctttatccagtctatcattgatgggcatttgggttgattcaatgtctctgctattgtgaatagtgctgcaatgaacatatgcatgcatctatctttataatggaattatttatattccttttggtatatacctggtaatgggattgctgggtcaaatggtatttccggttctaagtctttgaggaatcgtcacactgtcttccacgatggttgaactaatttacattcccacccaccaacagtgtaaaagcattcctatttctctacagcctcgtcagcatctgttgtttcttgactttttaataattgtcattctgactggtgtgagatgatatctcattttggttttgatttacatttctccaatggtcagggatgtcgggatttttttttttcatgtttgttggccacataaatgtcatgtttgttggccacataaatgagaagtatctgttcatgtcctttgcccaattttaatgggttgttgggtttttttgttttgtttttgagacagagactcactctgtcacccaggctggagtgtagtggcacgatctccgctcactgcaagctctgcctcctgggttcatgccattctcctgcctcagcctcccgagtagctgggactacaggcacccaccaccacgccctgctaattttttgtatttttaatagagacggggtttcactatgttagccaggatggtcttgatctcctgaccttgtgatccacctgcctcggcctcccaaggtgctgggattacaggcatgagccaccatgcctggccttttaatggttttcttctcttcttcttcttcttctttttttttttttttgtaaatttgtttaagttccttaatcttaagcaaaaagaacaaagcaagaggcatcatgctacctgacttcaaactatactaaaaagctacaataatcaaaacagcatggccctggtacaaaaacagacacaaagaccaacagaacagaatagagagctcagaaataagaccacacatctacaaccatctgatcttcaacaaacctgaaaaaacaagcaatgaggaaagaattctcagtttaataaatggtgctggaaaaactggctagccatatgtagaaaacagaaactggaccccttccttactcctatacaaaaattaactcaagatggatgaaagacttaaatgtaaaacccaaaactataaaaaccctagaagaaaatctaggcaataccattcaggacataggcaca

SEQ ID NO: 4082 - DNA, 345 bp, Homo sapiens
atggcctccgtctccaagctcgcctgcatctactcggccctcattctgcacgacgatgaggtgacagtcacggaggataagatcaatgccctcattaaagcagccggtgtaaatgttgaacctttttggcctggcttgtttgcaaaggccctggccaacgtcaacattgggagcctcatctgcaatgtaggggctggtggacctgctccagcagctggtgctgcaccagcaggacgtcctgccccctccactgctgctgctccagctgaggagaagaaagtggaagcaaagaaagaagaatccaaggagtctgatgatgacatgggccttggtctttttgactaa

SEQ ID NO: 4083 - DNA, 1343 bp, Homo sapiens
ccagcaatgtctccaccactgctgctgctacccttgctgctgctgctgcctctgctgaatgtggagcctgctggggccacactgatccggatccctcttcgtcaagtccaccctggacgcaggaccctgaacctactgaggggatggggaaaaccagcagagctccccaagttgggggccccatcccctggggacaagcctgcctcggtacctctctccaaattcctggatgcccagtattttggggaaattgggctgggaacgcctccacaaaacttcactgttgcctttgacactggctcctccaatctctgggtcccgtccaggagatgccacttcttcagtgtgccctgctggttccaccaccgcttcaatcccaatgcctccagctccttcaagcccagtgggaccaagtttgccattcagtatggaactgggcgggtagatggaatcctgagtgaggacaagctgactattggtggaatcaagggtgcatccgtgattttcggggaagctctgtgggaatccagcctggtcttcactgtttcccgccccgatgggatattgggcctcggttttcccattctgtctgtggaaggagttcggcccccgctggatgtactggtggagcaggggctattggataagcctgtcttctccttttacttcaacagggaccctgaagtggctgatggaggagagctggtcctggggggctcagacccggcacactacatcccacccctcaccttcgtgccagtcacagtccccgcctactggcagatccacatggagcgtgtgaaggtgggctcacggctgactctctgtgcccagggctgtgctgccatcctggatacaggcacacctgtcatcgtaggacccactgaggagatccgggccctgcatgcagccattgggggaatccccttgctggctggggagtacatcatccggtgctcagaaatcccaaagctccccgcagtctcactcctcattgggggggtctggtttaatctcacggcccaggattacgtcatccagtttgctcagggtgacgtccgcctctgcttgtccggcttccgggccttggacatcgcttcgcctccagtacctgtgtggatcctcggcgacgttttcttgggggcgtatgtgaccgtcttcgaccgcggggacatgaagagcggcgcacgagtgggactggcgcgcgctcgccctcgcggagcggacctgggaaggcgcgagaccgcgcaggcgcagtaccgcgggtgccgcccaggtgatgcgcatgcgcaccgggtagcagagctagcgctactcagtaaaaatccaatatttccattgaa

SEQ ID NO: 4084 - DNA, 376 bp, Homo sapiens
agtgtggttttagctgtagtagccagattgggcggccgggagtggtgggggtgccgggtggaaggctctgggcggggtctcaggaccctccttttcttggcggggatcgggcttgtggtgccgctccccgtaatgtacggaggaagagggaaagggctctggccccctcggcgtcatgtcttcggtgctggcggcttcccatccgctggttctatcctcaaacgccgggacaccgggaatctcggagaaggacaaccgagatccagctggctcctccatcggggtgctcacactttctcatttgatttcaggtctgcggacgctgtataccctcctccacttcccgctgcagccaataaaggccgttcctaccata

SEQ ID NO: 4085 - DNA, 379 bp, Homo sapiens
ggagggggcgccgggaggctgcaagtgggtctgagaggccaacttgaggaggcctggcctctgcctcccgcattgcccagctgttcctcctggctgcatctcccacctcccagcaaacaagctcttttggctcagctcccgcctgcgtttgtagaccccgaagtttctgcaaccaagctcttcagacccacatcccttctcccagtgactgaacagtcccagctccggctggagaagggcgtctgcagaccccgctgttgcctcccaggggagtctccaggcccagctctcgccccaccgcgacctcccaggcccaagtccctgcctacctcccagcagcccgagtgcgatcctgttcctccctcacggtggcctgttg

SEQ ID NO: 4086 - DNA, 1661 bp, Homo sapiens
gaaagcttgtcaacttagctgttacacagcttggcatatttcaacttcttcccaatcgatcttcggtctctttctctgaaacttgtaaaattgtggtaagatctatataacattaaaactggccattttaacctttttctttatttctttgagacggagtctcgctctgtcgcccaggctggatggagtgcaatggcgtgcgtgatctcggctcactgcaacctccgccccccagggtcgagtgattctcttgcttcaggctcgagagtagctgggattacaggcgtgcgccatcacgcccggctaattttggtatttttagtagagacggggtttcgacatgttagccaggctagtctcaaactcttgaccacagatgatccgtccgcctcggcctcccaaagtgctgggattacagtcatgagccacagcgcctggcctcattttaaccttttatttttttgagacggagttttgctttgtggcccaggctggagtgcagtggcgccatcttgtctcactgcaagctccgcctcccgggttcacgccattctcctgcctcagcctcccgagtaactgggactacaggcgcccgccaccacgcctggctaattttttgtatgtttttttctttttttaaaaaatagggacggggtttcaccgttgttagccaggatggtctcgatcttctgacctcgtgatctgcccgcctcggcttcctaaagtgctgggattacaggtgtgagccaccgcgccccgcctattttaaccatttttaagtgtacaattcagtgacaaattagttacatttcctgttgtgcaactatcacttctgtttccaaaactgtttcatcatcataaacagaaactttgtactcattaagcagtaactcctcatttctcctccctctagcccctgctcacatctaagctactttctgtatctgagtttgcctgttctagatatttcatataactggaatcgttcaatgtttgtccctttgtgcctggtttctttcacttagcatagtgttttcaaagttcattcatgttgtagcatgtgtcagaactttattccttttatggggctgaatgatattccattgggtggatgtgccacattttttttgtttgttttgttttgagatggagtcttgctctgttgccaggctggagtgtagtggcatgatcttggctcactgcaacctctgccccctgggttcaagtgattctcctgcctcagcctcccaagtagctgggactacaggcatgcaccaccacacccaggtaatttttgtatttttagtagagacgggttttcaccatgttggccaggatggtctcgatctcttgaccttgtgatctgcccacctcggcctccggaagtgttgggattacaggcgtgagccaccgcacccagcctcactgtgattttgatctggatttccttaatgactaatgatgttgcccatcttttcttgtgcttgttggtcatttatagatcttcattgcagaaatgtctattcaagtcctttgaccattttaaaattgggttgtttatctttttgttgttgagttttagagattccttctatattctggatatcaaattagatatgactcacagatatattataaaatatatattctcccattctaag

SEQ ID NO: 4087 - DNA, 891 bp, Homo sapiens
atgagtcatttcaagtttatcgatattgttatcaacttgactgacaccatgttcagaggaatttataggggggttcaaaagcatcaagatgatttacaggatgtaacagggagagctgtcgagattggtgttaaaaagtttatgattacaggtggaaatctacaagacagtaaagatgcactgcatttggcacaaacaaatcatatgtttttcagtacagctggatgtcatcctacaagatgtggtaaatttgaaaagaataaccctgatctttacttaaaggagttgctaaatcttgatgaaaacaataaagggaaagttgtggcagtaggagaatgtggacttgattttgactgactgcacttttgtcccaaagatactcaactcaaatactgtgaaaaacagtttgaactgtcagaacaaacaaaattaccaatgtttcttcattgtcgaaactcacatgctgaatttttggacataattaaaagaaatagagatcggtgtgtagagggagtggtgcattcatttgatggtaccaaagaagcagcagctgctttgattgacttggatctttatataggatttaatggttgctcactgaaaactgaaactaatttggaagttttgaagtcaattcctagtgaaaaattaatgattgagacagatgcaccttggtgtggagtcaaaagtacacatgctggatcaaaatatataaaaactgcatttcctaccaaaaagaagtgggaaagtgggcactgcttaaaagacagaaatgaaccctgccatataattcaaatattggagataatgtcagcagtgagagacgaggatccactggaatcagccaatacactatataacaatactattaaagtattttttcctggaata

SEQ ID NO: 4088 - DNA, 2623 bp, Homo sapiens
tctaatcagcaagtaggattgcaaataagaacgcctttatgaaggccccagtttttacagtaagtccctcactgcccgcacacaacgatgccaagttccaacctgatttgcgtcaccacagttgtgggtttgcgccaaggttagttatcaagcgtagtgagaggataaattcacaaaatgagggacaaaaataagacgagagctgggtacaacggaagtgaaacctgggtggaggtcatctccaaatcacagtggaaggacgatgtcagggatttgtcccaacactcttttgatgaaagaatttgattagtggactattgcactcttaaaggcaaagaaaacaaagcacggcagtgccccgctcggtcgggattcaaaagcagtgaaagctgccttgctctgtttaaagcgacaggactgctctgctattcaggaaagactaaggaggcagcggtatctgcgaagtcctgcgagctcccggcgacaggagtagcgcgagcagctgacgggggaaatccactggcagcgagtcggatgagtcagcgctgagtcacgctcggcgctacgtgccggcctgggcggccgcagcccggggcccgcagccgcggagtcagcagagatccgccgcttcctggaagaccctccctgcgcctgagggagggggcggcgtcgcctcctcgcgccgccaaggccccctgcagtcacacactcgcccgcacgcacgacctcctcgctccatcctggggacatccaggattcacccccgaggggaagagtcccatgtgacaaatggttagagcttgggcggatgctttcatcccatgtgtttcctcaaagctgagattccagcgctcttgctcttttcgtgttgttgttaggtttttaacttttttttcccgtttcctggcagaggattaacacgctgatctttttatagtttccaatattttaaatgaagcacaagaagaatggattaataaaacgtgttgaaacttaagcatcaaatcgtcacactgctctgggttctaaaatgactagaaagtgactgcactagaagctttgaatgttgggtaactgggaaggattaactcggttctgatgtgccctttgttaatgaaaatcaaatctttgctatttgtccaaccacccttataataactaaatttgtctaaagactggagacatgtgtggtaataattagatatggagtcaccaaagaacagggtagccatgcctttgtgttttctgtgccttaactaacattctgttgtcctaatgtgcaaatgatacattgttggttttaaaaaatattatggcaatgtttatatccatgctgagagttaatagcaggtattgtgtcatgaagtgcagctagtcagtgagatagtcctgatacaggtggggtaattattatttagggacaatttgcggctgtttttcaagacagactgggtctttagaagttgtgccagctgttaccggtggttctgcttcattgggagaattatttccctccttatccctgtgtacgtgtgaaatgatgcaaaacaatagagtgttcgtgtagtttgactgcttttcttgcaggcaaggagactgaagtaattagaggttgaactgactcaccaaggttactggagaagcatgactacccaattttgtaaaggagagaaaagccccaaacaaatacaaataggaaacatgaaaatacgagagaggatcagagcccaagaaagcaaaatgagtaatatggaccagaaatggaatctcatatacttgaactagttgtaatgggaggtatacttaatgcgctagccttaaaaaaaaagtcaaattattgcataaaaatttaagattttaagtaattacatacatcatttgatgttttaaaaactgtgcctgattctgattcattattcttagcatatccatatggatattgccttggcatttaccaagtcagacttcagttcaaaaacccaaattcatcttatgacggtgtgaacttggacttgatacttagcttctctaagcctataatggagattataatcaccatttcacctgtttgcaaagcaggcaggattaaatgagatgatgcctataaaaggtttagcacatttccatgcaaaaaatttctcagtaaacgaagcttgtattgtgttatcagtattattgaacttgactaaactattgatcagatcacaaagaggtagtacaggtactttgtccagatcctagaactaataaaagctttgggaatgtacatcacaaacgtagtggttcagtgactgatatggtttggctctgtgtccccacccaaatctcatctcgatttgtaatccccacgtgtcaagggagggacctgtaatccccatgtatcgagggagggaggggattggaccatggagtcagtttcccccatgctgttctcgtgatagtgagttctcatgagatctgatggttttataagtgtttggtagcccctccttcattcttctctttcgttccactttctgaaaaaggtcctcgcttccccttcactttctgccatgattgtaagtttcctgaggccccccacccagccatgtgaaactgtgagtcaattaaacctctttttttt

SEQ ID NO: 4089 - DNA, 2281 bp, Homo sapiens
aatttccatgtatttgcatggttttgaagattccctttggagttgatttccagttttattccactgtggtccgatagtgtgtttgatataattttaattttcttaaatttattgaggctcattttatggcctatcatgtggtccattttggagaaagttccatgcacggttgaatagaatgtgtattgtgaggttgttggaagaaattttctgtatgtatctgttaagtccatttgttccaaagtatagttaatccattgtttatttgttgattttctgtcttaatgacctgtctagtgttgtcagtggagtattgaagtcctccagcattattgtattgcagtctatctcatttcttaggtctattagtaattattttataaatttgggagctccagtgttaggtgcatatatgtttaggattgtgatattttcctgttggacaagccttttatcattatataatgtccctctttgtctcttttaaccactgttgctttaaagtttgttttgtctgatataagaatagttacctctggtcgcttttggtgtccatttgcatgaaatggctttttccacccatttactttaactttatgtgagtccttatgtgttcggtgagtctcctgaagacagtggatagttgattggtgagttcttatctgttctgcagttctgtatcttttaagtggagcatttaggtgatttacattcaatgttagtattgaaatgtgaggtaatccttgcgttcatcgtactctttgttgcctgtgtactttgttatttttttgtttttgttttttgcttttgctttttaccttgtatttttgttttgtaggtcctgtatgatttatgctttaaagaggttctgttttggtgtgtttccaggcttcgtttcaagatttagacctccttttagcagttcttatagtggtggcttggtaatggtgaattctctcagcaattttgtctgaaaatgactgtttctttcctttacgtttgatgcttagttttgctggaaacagaattcttggctgataattgttttgtttgaagaggctaaagatagggccgcattgccttctggcttgtacggtttctgctgagaaatctgctaggttagtctgatatgttttcctttataggttacctggtgcttctgtctcacagctcttaagatttttttccttcatcttaactttggataacctgatgacaatgtgcctaggtgaagatctttttgtgatgaatttcccaggtattctttgtgcttcttatatttgcatgtgtaggtctctagctaggttggggaagttttcctcaattattcccccaaatatgttttccaagcttttagaattctcttcttccccaggaacacccattattcttaggtttggtcatttaacatgatcccagacttcttggaggatttgttcatattttcgtattcttttttctttgtctttgttggattgggttaattcaaagaccttgtctttgagctctgaatttctttcttgtacttgttcaattctgttgctgagactttccaaagcattttgcatttctaaaagcgtgtccaaagtttcctgaattgtggattgttttcctttaagctgtctatttcattgaatatttatcccttcacttcttgtatcatttttttggatttccttgcattgggcttcacctttctctggtccttccctgattagcttagtaactaacctcctgaattctttttcagataaatcgggatttcttcttggtttggatccattgctggtgaaccaggatgatttttggggggtgttgaagggccttgttttgtcatataaccagagttggttttctggttccttctcatttgggtaggctctgtcagagagaaggtctaaggctgaaggctgttgttcagattcttttgtcccatggggtgttcccctgatgtagtactctcccccttttcctatgggtatggcttcctgtgagccaaactgcagtgattgtcgtctctcttctgagtctagccagccagtgtgtctgcccagctctgggctggtattgggggttttctgtacagagtcctgtgatgtggaccatctatgggtctctgagccatggatactaagggaagaaaacacccctcatattgtcttatgcccaatttctgcctccaaagaaagaagaagtaaaaattaaaaggcagaaatgaaatccacaagcagacagttcagcgccacaccctgggcctggtaattaaagattgacccctgac

SEQ ID NO: 4090 - DNA, 1117 bp, Homo sapiens
aggacgtcattctccagcccccgccaatgagcagcgggacggggggcggggcaataggcggacccactgccctagaaaagaaacaagctgcggtacaactgtcctcaccagccctcgcctcccgagtcactgcagccaacccttcagcaaggagttgagggagaactgtaggaacaccttgggaagcctttactggttgtcctcttaagaagagctggataatgtactgagaatacctgtcctttcttggtcctggagggcagacagcagctacagcaggactggtggaaccagcttcctggcaggaattaccctcccccaaagctagggacccaggaagatgccctgtccagcatagactttaaagagagtcaaactctacggaagaggattgtaacggaccatttctgaataaagtgatgatcagccacaatgacattagtaaaatttgaagtgccgcttatctttgtgcgtgctgttataatttgatgtggttggtatatgaactctaggactaaagtacgttgtgtgcgtatgcactaacttcataaaacaactctattataaagtgttttgtcataaggtatcgtgaaaattgcaaagtgctatccaagtgtaaaggattattattattgcagaattttttttttcttttgtaactgaacaggccttaaggtactcagttgtttctcataattcctttaattaccaggtgtccttgaatgcttatcatggaatgtgagatactataattaacatattttggttttggaatatccactccacctgttatactagtgttcttgtgggaattttatcagttatatttggggaaagcacatccagttttccgtttggacattgttaataaatctgaggtgggtttttcccatactcctcatgctaactttgtggtatacttttggttttaaaaaatgtatcttagtgttttttttgttaaaatagctttcttttattagggaacttttgagaagttaaaaattctgcttctgaattgtatttgaatagtatgggcttacaacaaaaaccagataattcttgcttctattctttttgaatatttttcccctctaataaagtacttgattcgaataca

SEQ ID NO: 4091 - DNA, 2237 bp, Homo sapiens
gaaaaaaacaaaacactttattttccacaaggaagagcaataggaaaaattaaatcatttcccacatattgttttcttaaaacagagcctacaaggacatattcagcaccaaataaaaaaggaaaaaaagagaaattacaaacagccatagaatataatctataaagcaaacatttaatattgcactttgttttgctaacattttggattttacttttcctaattgaaaaatcaggaatctatcttgaatactggaatacaactgtgaacctcacatcttatgtcaggaattgaccaatatttttaaaaaagtaatgcctctaaagaaatacattttaaaggggaaaataaaactttatttgataaagttttatacatttaaagttttatcacattttgtgatccagtgccaattatcagaatattggtcattcttgcttcatgtgttatttgtaagagtatataatgacaagtattccaatgctatgcatatcaacaattgttccctagtcagttagacgtaagagagaaaagggattttctgacaatccccctcaaacaaaaataaaaccaccaaatgccctttatgccaaatattccattagctttttttgagggggacattcacaaaatgattcaacaataaaaaaatatttcacccccatttccttattatctagtattagtttgctacgggagcccaaactctttaaccgaatcacttaaaacgcgattcatttttacactgggctttcttcaccctgtcagcatttgtcaaacatgaattgtcttccatgttttcttaaaggccacttatggaaaagcctatttgttttgtatgagctttaagacagtatttaaccaggtcaagcaccaagccagagctactattattttcagccactttattaactgtggggttaaatggcaggatagatgtaacacccattttacacgtatgttgcaacatcagagatgctggttttctttaaaaacatcagagctgaattccttctaaaatacaacaacaacaacaacaacaaaataagtacacttggtaccttggaaaatgctgaaatgctatcatgaatgctggtatatttgttatgagccaacagaaaattacctttaatataaactataacttactgatgtgattgttcttcctatgtaatctatacataatcaaagtgagtgatttctcatgtttagcaaattgttctttaggtaatgaaaaacagtattctcattagaaaaacacaaaaatccaaaagatttatcgcagcaaacgttctagtattttaaattttgaagttacttttggaataaagtcgagttttcatgccataccaagcttgagcaagacagcaaaggtacaaattgagctctctattcataacctcaatgtatgtattcctgctcattaatatactttgcaccagcaaaagcgatttccaacatatgtgttttggaggtaattaagtaactctgtataaaaataaatgcacttttccctcctttccccagtgaatggaaaacttccatactttcaaaataataataaaaaaaataatttttaagagcaacagccctcaactctttgctggtgcctgccatactgcctttcttcactccattcttagctctgctagtttcttcttgtatgtcatgataaaaagggaatgtgggtgtgtaacttttgtgtatgtcccgtttccaaatttccctctccaaaaagccaaccaaataaacaaacaaacaaacgaaaaaaacagtgcaacaaaacacaaatagcattccaacagtttggcaagtgatgcgttcacctgagattaagtgattttaggcagtcagtaacaaaatgctgctttgctgtaatagtagaaaggcaacaaattcttaaaagaaaccaagaaggtatacaatcttgacagtctcttattagcttcctcctcttatctctttttttcccacattatctgttgcgtatctactacagtaggctgcaaaacatacagcaaaaaggattggcttgaaggcatttgatgtttgtaaataaatccacaattggatccaagctgaagaggtgatacatagtcagcctagtagacaattctgagcatgtgcatacgcaggtaaagtccaggctatattaaataaaaaaaaatgtcagtgcgttttttcatgttaaagttttttcaaagctttgttttgttccttgttgtgctgaccacaaa

SEQ ID NO: 4092 - DNA, 3103 bp, Homo sapiens
cctcatcgtcaaactcatcgtccccttcctcgtcttcctccaggggctcggcggccgcgccgctgctgggctgcccgagcaacagcccgtgctccgcctcctcctcctccgaggccagctggccctcgtccaccatcgcctccgccgacgccggggcgcgagacgctcgcggtcggagctgcaccatggcccacgcagcgctagaccgtctgacctctgacccggaagcagctacaagcggagcgcaagcctactttcatcgccccctgcaggcgcaggccgccttggagccggatggaccccacggaaaatgctctgccggcgaaagcggctggcaatggggttgatttcaaggcagggaagagccatcgcgctgccctcctcggctgggatggcgagacagggctggcacggctcacgctgtccggtgctcagaaaaccggtaatcgcgggcccgaggcgctgctcgccgccgttttttggccctgggttccgtcgagtggatccagcttgtcagtctttgtgtagatttggctgcgttcgctccgcacttcggaggaggtggcgtttcatgggaagaaatgcgctctagcagatggccgccgtggccagtcagccctgctgccaccgacgaagacgcgggcgacagacctggactctaaagaaatctgcacagacgtgcccggcgccctcggccttcccagctccgcggccgcagcgacgccggttaggatgtcggccctgtgggaggggcgcccttcctggtgccgggccctaacccacgacctggaacagcagctggcccgtggcaaatgctgagcatatctcctgaaagaatggcttcgccggtccctagagaatgcacccgagttttgtggtatatacacatacgtactttttttccaagtatattttatttcttggcaaacatggccctttgtgatcgctgtgtttctctcctcccatccattatacaacactaagtgattcatcattctttgaacaaatcaaactgtttcacacctgccatgcatttgtaccgaccgtgctcttccctctactgccgcagccccccaggtagaagtcctttttatacttcaaaaattcccacccaggcaaatttcaagcaccttacccctaccccatcccactctgcccatctctaattgcgctggtctgaacccgcacaaatgtctgtgtagtttctgcacttcataacagcttatatgacagttgctccagccattctgtgaacccctgaggggaagggccaggtcttgctagtcattttatttctaatgtctatcatctggtagatgtttaataaatgctaagttgaataattctatcttacacatatattgtatttttaattctcttttcatgtcttctgttttagaagcaattctcaatttaaaaacgacaaaaccaaataggaacaaaaatgataaaacttgaaaacaacaacaacaaaaaaagctgctgaaccagaggttcagtatgagaggaattgcaaagaacagttttgaaatctctaggccttagtcagatagaaattacaaatcaaaaatataatcagactccctgagacactaacactaggaaaatgaataaagttaacttggagcagcccaagaacaaacttataagtgcatgatggtattttatgtgcaaaactgctttataagtactataagactattacaggtattaccagtgccctcagtgtaaactccttggcccacccatgtaaagtgtacatcgagccctcagggtccctgactggttctccagccgccccataggctatgagcatccccgttccctacacaaaggaccactgggatttattaaaggttatgccttgcaatgcagtacaaagttttatatgatagtgtcttgttgcctgtttctacaaaagccaagggtgtaacattaaatgcaattttgcaaggggctgaggtgatgtggtccaagtatgtaatcacttcagggagccatatgtgaccttcatacactgttgataatggccatgcctcccagtcaggcctgtgacacctgctggacagcaggcattccaaggcccctaagcactgagttagctggtaaaggttaaggaaaaagctgtattcttactactttactccaaggtagtaaagtgtatggaagatgtacctgacagaaataacttaagcatcccctgagaatgaccctgtatggcagatgcatctgacagcaataacttaagaagtgagggttgccacgtggaggctgctgaggggagggtgctgagtgaaagtgctatgtaaactgcatgctttttataagtggttgcagttctgtccagcccgcggccactggaccaccctgtaaggttccccaaataaaccctatgtttccttcactagctccaggtctcttctttggcctcttgaacctggtgccatccctactgaagttaacagaggtctggcccaacctaagggcatcattttttaaagtcccatggaaaaaactcccagcagagttcagcatctgggaacggttggcaggccccacaggaaccacagcttctgcctttatgatgctgagaaacacttcactgttgacttcccccatctaagggggccagagctaaattttgggcagctgtgtttatcctgggggtccacatatttgcatcattctttcttctcatcgtgatgttctaccttgttggtactgttctcttccttctttgtgtgagttcctgttgtgagcttccccttgttcactgaggtaatgtagccaaacaaggttaaaaagcccccagtaagccgggtgcggtggctcatgcccgtaatctcagcactttgggaggccgaggcgggcagatcacctgaggtcgagagtttaagaccagcctgaccaacatggagaaaccccgtctctactaaaaatacaaaattagctgggtgtggtggtacatacctgtaatcccagctactcatgaggctgaggcaggagaatctcttgaacccgggaggcggaggttgctgtgagctgagatcgcaccactgcactccagcctgggcaacaagagtgaaactctgtctcaaaaaaa

SEQ ID NO: 4093 - DNA, 592 bp, Homo sapiens
gctcttcttccttccttctccagtcccttccactgtgcgtcttctgtcccccgttcttccccagcggacccctctttcgagactccctagtggggtccccagctcccgggcgatcctgcccttgccgagcgcgttttctggagtcacctgggggaggggagtcctgggcagggccgggctggggaagacgcctggggcactgcccggcgttaacaaagggagccgataccgaccggcgtgggcgcggagcgggcggccgccaccgagcgtgctgagcaaccgcagcctccgcggccgagagtgcagcgacctcagctccagccagcctcagttccggaggagccccctcaaattcatggcccacaaaggagagagaagacctccgatctcttgtgccatgctcactatgctatgtgaaatttgctatgttagaccttgacatcctggatggtggggatgatgactggtttctctgcacagccctgggcccagtatcctgcccagcccttaggagtcctcatggaatgagctcagctcccgcgatgctcctgtttgtccactgaggcaaggggagagccagttgcgcagagcc

SEQ ID NO: 4094 - DNA, 270 bp, Homo sapiens
gacacaaaatttaatttaatagaaattttgtttgtagttcttacattctcagtgtgagccaatctgggacccactgccccacccagaagtggcccagtcctgggggcaggggagaaagggaggggtgaaatgagaagagccccgttcttcctcagtgctggggggttggaggggagctaagagatgagagaaggggacagaggcaagaaaagatgttgatcaagaaagatgagaaccaggggtgagggctgaaggagaatcaaagataaa

SEQ ID NO: 4095 - DNA, 252 bp, Homo sapiens
aggactccccagccgtactcaccgagactgccggcgaaaccgtccatcttgcggggaaagcgccgggctccgggcttagaggggcgggcacttcattcagcggaccgacagagtggccgacgctgagcctgacccgctcgttctctaggtcgcccggctcggctaccggctcccgcctccgtcgtccgtccgttcgccctggggtagtaagccgcggccgcccgaaccacttccccgtcacgttgagagccg

SEQ ID NO: 4096 - DNA, 1332 bp, Homo sapiens
atagttggcaatgaaatacagtggatggctcaatactgaaacttcacaggagtattactagaaataatcagctgtttacgaagtgcttcagagttcaggtgtccttgccaaatgagcattggttcagttctagttagcttcacattatttggctgcagaataacccccgccaactgccccacgaatgtgtgatgttttaaaaggagactagaactgggtgacagttgcagatagaactgcagaatcactaccagttcaggaaaaattagttaaatggtggcaataccatttaaattctcctccataaaacggagcgagtttcgacagagtctttttaagcaggctagcgtaactccgtatttcagccataaaatttatgtaggcaagtatcagaaatttggcatcttgaattcttttttttttttttttttgagatggagtctctctctgtcaccagactagagtgcagtggcgcgatctcagctcactgcaacctccgactccctggtttaagcgattcttctgcctcagccttctgagtagctgggatttcaggcacgcgccgccacgcccagctaatttttgtatttttagtagagacggggtttcaccatgttggccaggatggtctcgatctcctgacctcgtgatccccccgcctggcctcccaaagtgctgggattacaggcgtgagccagcgtgcccggcggacaccttgaattcttaaaccatttgagtcttgaaagatctaatttccagcatagttgtttattggaaggtaacagtagaacagacgttgacggttacttgaatgagtaccaattacaggcctctggcactcagaattgtcactcacagttttataagatgaggtttttgaaaattcagactttttttttttttttttttcttttttgagacggagtctcgctttgtcacccaggctagagtgcagtggtgcgatctgggctcactgcagcctccacctcccgggttcaagcagttctctgcctcagcctcctgagtagctgggattacaggcatgcaccaccctgcccggctatgaaaattctgacattcttttatgtcagtgaacacctaacttagtatctagttgactcaagatgagagttctcaatgctataatttgaatgtctttgaaaattccactagtattatacaagctttttctttttctatactcagagagttactaatgcaataagctttgtcaaatgacgtcgtagtgtagtccaaattcattgtataaggacttatcacagtacatggatttgtaatcatgtgtcctcagagcatcctcggaacttagta

SEQ ID NO: 4097 - DNA, 14048 bp, Homo sapiens
gccttgtatccgcgtctccgcagggaaaactgcggctggcggtgcgggaagtgctattagtagttgtttatttgtttgtttgcagaaataattgcttgggtacgaaggtcaaacgagaatgaagcaagtatattatctagtttgtatgtctttaaatagtttctcctccacacgtctaaacatacgcacctgctagtaggtgcgcaaatgttaaaacctctttgggaaagcaatgtggcaaaatctagtaaaagttttcaattactaaaccccagcactctgctcctacctatatgtcttgtagaaactttgaggcttcctaagagaagtgatgcccaagacattaaaacatgaatgggcgttagatgaagacaaaagagcattccatcgtagaagacaatgtagcatgtgacggtaaagatttcccaagaccaaaaagcttaggagcactgccccattccactgttctgctgctggttttgctttgactctcccagaggaaaaccggggttgtcactggaagttcctgaagtaatctccttttttagcaaacttttcattattacactatttgggtcatggtacaactttgctgaattgccttgaactgaagtattggatttttactttaatttatcctgtgattatgctgattttgcttcactgatattctgtcatgtccttagatttctaatgaaactgctcagaaatcaaccagacaggatctggctctgtcacccaggctggagtgcagtggtgctgtgtccggaattggtgggttcttggtctcactgacttcaagaatgaagccacggacccttgccatgagtgttactgttcttaaagatggtgtgtctggagtttgttccttcagatgttcagatgtgtctggagttttttccttctggtgggttcgtggtcttgctgacttcaggagtgaagctgcagaccttcgcggtgagtgttacagttcataaaggtggcggtccagagttgttcgttcctcccatccagagttgttcgtcccccctggtgggtttatggtctcactggcttcaggagtgaagctgcagaccttcacagtgagtgttacagctcataaaggtggcatggacccaaagagtgagcagcagcaagatttattgcaaagagcgacagaacaaagcttccatagcatggaagggcacccaagcgggttgccactgctggctcgggtggcctgcttttattcccttatctggccccacccacatcctactgattggttcattttacagagaggtgattggcccgttttacagagagctgattggtccgttatgacagagtgctgattggtgcatttacaaacctttagctagacacagagcactgattggtgcatttacaatcctttagctagacacaaaagttctccaagtcccctacccgattagctagacacagtgcactgagtggtgcatttacaaacctttagctagacacagaatgctgattggtgcatttacaaacctttagctagacaaagagtactgatcagtgtgtttacaaacctctccctccacacctccccacaagcagagagagctggctccggcctcagccagccccagagaggggcccccacagcacagcggcaggttgaagggttcctcaagcgtggccagagcagatgctgaggccgaggaggcaccgagagcgagcaagggctgctagcacgttgtcacctctcaatcccccctctaaacaggacaccccaactgctgttgggaatttggctgatgaccactgtagctacttcctgctggataggggcgaagaagcggccctgcagttgtagtctcctccagaagggaactctttaggctagtggaagggcccagcaggtcagtccaggggtccttggtagaagctgttaattgagctcatttggggttccatttgtaagaccatctgtagcttgatggcctcgattctagaggaaacaaatttgacaagtaggttaaaaatacagagtccaaaggtgagtaacagcaagatggctgccacgggacctagaaaggggagaagccatgttgctcaactccagaggttgttataagagtttgaaaggcattgtctgatttcagaagcctttttctgtaaacactggatggcatctcatactatccctgactggctagtgtaaaaacaacactcttcccctaagaagctgcagagttctcctttctcagcagtgaggaggtctaggcctcagtggttttggagagtcactgctgctaaagagtctatttgggattgtagagtaaggatagatttcgtcacttcctgcaaactgtctgagaaattctttgagagtgtgtggcagtaagataatgcatgttacactgttaacttttagcaaactttactttagttgaaaaccttgtaagtttgggattttaatttttctttgctattaataaaaccttgttcagtccatattaacttagaattggtatagatgtctccctcctgattctgtaagtactttaagatttggctgagtgcaaacaactcgcacatttgagcagaccaattattaggcaattttcctaactctgcttctataagaatttccttatcacttactgaatgcccattgtgtctttttccataatcgctcaggaggaaccatctatcatcctctcctgaagggagttcctactaggtctggtcagaccttcaaatttagatcccctgttaggaaacctgctgggttaaggatatttgataggaaggctacgggttgtcagtggcctcagtgctttttggctatgcccttgtttgcgctgacaacaaagtggtattggagtgttatagggtcatggagaagaccttcaattatcaattataggttttaaatttatcctggcttttaaaggaatagggtacactgttttttctttactacttccatctctctttctctttgactcctttgtctctctctttctgactccctctttgtctgtctcttcctctctttctccttctttgacttttgtctctctgtttctgtctctctgtctcttcctctctgtctccttctttttgtctgtttcttcctctctttctttttctctgacttcctatctctttctctctttcctttctgctggtctttccctgtctctgctagctgcttatgctactgttctcccctctccttcccctttttgatggcttcagcagtgtaagactgccacctccttgggtttttgcactgtgtgcaataactccataatttccttgtggtatttaacaggggttcccccagaggttaggaactccctttctttccatattgcagcatgggcatgtaggattagataagcatacttgctatctgtatacacattttttctttttccctttcccagttctaaggctcgggtaagtgccactagttctgctaactcggtgctggtccctgggggaagaggcttactttcaagtacagttacatcactaactatggcataaccttcccttcatatcccattctccacaaatgaacttccatcggtatataggttaaggtcaggattagctaaggggatgtctcagagatcatctcgggtggcataagtctcgactgtaatttgttggcagtcatgctcgattggttccccatcctctgggagaaaagtggcagggttgagggccatgcatgtacatatttgaagcaccagtccctcaaggagtagcgcctgatatctaagtaagtgatgtctgatagccataaacttcttttggcacctagtgtgccatttacatcatgagtagtccagacagtgagatcctttccttgtattattttgatagcctcgacactaagaccgccactgccgcaactgtctgtaaacagtgaggccagccttttgctactacatcagtttccttacttaggtatgccattggttgtgaggttgtcccacgagtctgagtaaggactccaagagctatccctgctctctctgtgatgtataaagagaagttttgtcctgtgggaaagcttaaacctggagcatgtattagggcctgctttaaggttttgaaggctgtttctgcctctggttcccattctactagatgagtatttgctctctgggtctccttgattagaggatagaggggcctggctatcttgctgtatctggggatccatagtcggcaaaagccagtgattccaaggaacccccgcaactgttttaatgtcttagggtgaggataagccagtataggctgtattcgttccttgctgagggccctggtccctttggcaaagattaggcctagatatttgatctgatgtaggcaaagcttggcctttgacctagacaccttgtacccttgatcagctaaaaagttcaagagatctacagtagcctgctggcacaaggcttccgaactggtagccaaaagtaagtcatccacatactgaaggaccagagtgcctggacttgagaagtgaccaagatcttgggccagggcctgaccaaacaggtgagggctatccctaaaccgttggggcaagaccatccacgtaagttggacgtgtggtctgtgggatcctcaaaggcaaagagaaactgggagtcagagtgcaggggaatacagaagaaggcatccttgaggtccaaaacagtgaaccattctgcttcctctggtatttgagagagcaatgtataggggttgggtacaactggatatagaggaattactgcctcattgatgagtctaagatcttgcattagtctccactgaccgttcagtttttgtgctcctagaattggggtgttgcagggactgctgcatttccttactaagccttgagcttttaaatgtttaacaatatcctgtaatcctttatgaacttcaggccttaagggatattgcctttgataaggaaagtggtggggtcttttagcctgatttggactgggtgggcattttttgcctttccaaattgtccttccaatgcccagacttcagggttgattccctcctcaagtaggggacaacaaatgggtaacttcttccccatattcatgtagataatagctccagccttggctaatatatccctccctaataagggtgtgggactttcaggcataacaagaaagtcatgtgaaaagagcaaagtctcccaattacaactgaggaggtggaagaaatacctggttacaggctgtcccaggattccttggatggtaatggaccttgaggacagtcgtccaggacaggagattaacactgagaaggtcgcaccagtatccgggaggaagtcaatttcctgaccctcaatggttaaacatacccagggctcaatgaggttgatgacatgagctggcgcttgccccaggcaccctcagtcctgttgttggatcatttggttgggggcttctgactcagagaatctttgtcctctggggcagtgcaccttccagcgattgcctgggcatagtggacatggacgagggggcagcttgtttctcattggacaatctttttcaaagtgtccttgcaaaccacactggtaacaggccctacagggtgattggcctgctccattttctgtcctctctgaactaccaaggtttgtctgtctgagggccatgactaaggctgtggcctttccctgatcttgcttttccttttgggcctgttcctctttgtccctattatagaacactgaggttgccaggtttaataatgcctccaaattttgctcagggcccagggcttgcttttggagctttctcctcatatctgtggctgattgggtaataaacttatcttttagaatcaattgaccctcgagtgattcaagtgacagggagtatatttccttaaggcctcccgtagctgctcgaggaaggcagaaggattttcttcctttccctgagttatggtggacatcattgaataattcatgggcctttttcctaattctccttagtccttctagaacacaggtcaacagatgtttatgactccagtccccatgatctgagtcaaggccccagtgggaatacatacgggggacggcttgctgaccggtagggaatttatccctctctttggctatcattctatcatttacttgactaagataccaggtatctccaaactctcgggctgcagctaaagccacattcttttcattaaaggccagggtttgatctaatagtagcatgacatctctccaagcaaggttgaaggtttgccctagaccctgtaggacatctatgtacctatcaggatcttctgaaaacttcccaaggtctgccttgatctgctttaaatcatagagggagaaggggacatgtacctaggttgggccaaattcccctccccctacagcttgaaggggacataaccaatagcctaggggtttttgtggtcctttggagatttctttgcttatttccttcttggtaggggagattagaggaggattatcattaatgggaaggggagctatagggaggctaggatatgggggtaagctgagaggtcctcctgtgggatgtaaattgcaggctttgcatagttgtgtattctccttcagtgaaaagaaagcttggacataggcatttcactccatttgccttcccttttagagaaaaggtcaagctgcaggatagtattgtaatttatacttccctcaggtggccatttttccccatcagagagagaatattggggccaggccatagtgcagaaaaaattagccacctctttttcagggtttgtgggtcaaattggtcccaatgatttaggatgcatttcaagggtgagcctgttgatacctgagtgtttctcatctgaaagacaaaactgcccatggttttgttttgttttgttttgttttgttctgttctgttctgtttctccccctgcccaagaacccgcaatggtctttggaccctgctgactggaatagttgcgctcaccaatgcagcagcaaaaacaacccctgcccaagaacccacaacagtccctggaccctgctgatcagaatagttgtgctcaccaacgcagcagcagaaacactagttttcctcccagaccacaaggaggactgagaaaggtcggatttagtggcccttactgatgcattctcaaaaacctgtacccttgcctgtcctcctagaccacaaggaggactgagaaaaatcggatttaatggccctgactgatgcattcttcaaaactttttagagtcctaagcattctcatgttagtattgggaccttacccatgtcctatagagatgtcatgccccaaaaatgaagtggaggcccataccctgagggagggaagggatctccagagttggaagagtgacaccttttgtcctcacttatatgaataggaaggatacaatttctgaggcttcccatatcctagcttcaggaatagcttttgttaggcctgctagtctgaggagggatcctaaaattccaggtagtccccccatgatggggctttgggcaaaaattatgtctttctgattggtgaccccaggtgctgaaagaaggtaacagagtcctggagtttatactagaaatcattcttataagagaaactagaaaagcaccagagacagggagtgacttttagaagcgggactagcttcggagaagagaggcaagaggaagtttgtctagcaggcattaggacccaggaggcaagggtcagggtagatagaatagatgggcgagtctcgcttgggtgacatgacttgagagttccgctcatggctacagggtcaaccagcttgctgttgggaccccagagctgaatggctttcctctctgtcaaccctcagctcagcccagaagtacaggaaaagtggaagctggttccaggcaaaccaatgctcccaactccgaagagtcaggggttgttagagagccctttcccagaaagcctgacacccgtgtctttagtccggcagccgcgctagtcgctattaactagccaacaggtgcccgttatttagcccccaaattctaaggaataataggacagaatagcaagtgaaaggggttcaatagtactcaccgcttggcgataggcagtggtctcactgcttggtgatagtcttactgcttggtgataggcgatagtcccttcgtggtcaccaaaatgtgtccggaattactgggttcttggtctcgctgacttcaagaatgaagccgtggaccctcgcagtgagtgttacagttcttaaagatggtgtgtccagagtttgttccttcatatgttcagatgtgtccagagtttcttccttctggtgggttcgtggtctcgctgacttcaggaattaagctgcagacctttgcggtgagtgttacagctcttaaaggcggtgcgtttggggttgtttgttccttccggtgagtttgtggtcttgctggcctcaggagtgaagctgcagaccttcgtggtgagtgttatagctcataaaggtggtgcagagccaaagagtgagcagcagcaagatttattgtgaagagtgaaagaacaaagcttccacaacatggaaggggacccaagcggcttgccgctgctggcttgggtagcctgctttttattcccttatctggtcccacccacatcctactgattggttcattttacagagagctgactggtccattttacagagagctgattggtctgttttacagagagctgattggtccgttttgacagaaggctgattgctgcatttacaaacctttagctagacacaaaagttctccaagtcccctacccaattagctagacgcagagtgctgagtggtgcatttacaaacctttagctagacacagtgctgattggtgtgtttttacaaacctttagctagacagaaaagttctccaggtccccacccaacccagaagcccagccgggttcacctctcagtggcacttcccatgggactttgcggcacctagcccaggcattccggcagcccagagggagctcgtcccagatgaagcccagtaggtgccggccactaggagtgcagggcccgccaagcccatgcccacccagaacctgcgcctgcagccctggctcccacccacgcctctccctgaaatctccccaggagcagagggagccagctctggctttggccagactccaaggggggccctcacagtgcagcggtgggctgatgggctcctcaagcgtggccagagcggacgccgaggccaaggaggtgccaagagtgagcaagggctgccagcacgttgtcacctctcagtgcaatctcagctcactgcagcttctgactcactgcagcttctgactcactgcagcctctgcctcccaggttcaagcaatccttccacatcagcttcccgagtagctgggactacagatatgcaccaccaggcctggctaatttttgtatatttttgtagagacagggtttcgccatgttgcccaggctggtctcgaactcctgggctcaagtgatctacctgcctcagccttccaggattacagacatgagacactgcacccagctgaattttaactcttgttatggctgaataatattccattatatggacatactacttttatttatccacttatcagttaatgggcatttgggttatttctacattttggctattgtgaataatactgctaagaatatgacaatattcttagtattatgacagaatatgacaatattcttagtatttttgagtttgagttcctattttcaattcttttgggtaaacacctaggagcggaattgctaactcttgtgtgtaattctttgtttaactttttgaggaaccaccaaactgttttccacagcagctgcaccattttacattctcatcagcaatgtacaagagttgcagttttctccatccttgccaacacttattttctggtttaaaaaatgttttagtctgggcacaatggctcatggcttatgcctgtaatcccagagctttgggaggctgaggcaggtggatcacttgaacctaggagttcaagaccagcccgggcaatatggagaaaccccatctgtacaaaaaatccaaaatatctaggcatcgcagtgcatacctgtagttccagatacctgggtgtctgagatggcaggatcaccctcctgagcccaggaggtcaaggctgcagtgagctgtgatcatggcactgcactccagcctgggcaacagagcaagaccctgtctcaaaaaaaaatgtttttgactgggcatggtagttcatgcctataatcccagcactttgggaggcagaggcaggtggatcatgaggtcaggagaccgaaaccatcttggctaacaccctgtctctactaaaaattcaaaaaattagctgggcatggtgacacatgcctgtagtcccaactactcgggagactgaggcaggagaatctctagaacccgggaggcagaggttgcagtgaactgagatcacgccactgcactccagcctgggcgatagagcaagattctgtctcaaaaaaaataaaataaaataaaaccatcatcaaaaacaaaaacacaaaaaacaacagcagaaaattataaccatcctaataggtataaaatgatatcttgtgattttgatttgcatctcccttgtgatgaatgatgagcatatttttatgtgtttattggccattagaatatcttatttgaagaactattcatatcccttgcctattttttatttggcttgcttgtcttttttcttgttgaattataagggttcttcatgtattatagatactagacttagcagatacatgatttgccaataatttctcctattccgtaggttgtcttttcactttcttgatagggtctttagatgcacaaaagtttttattttgatgaagctcaatttatctactttttcttccttccttttttttttttttattttgagacgaagttttgctctatcacccaggctggagtgcagcggcacaagcttggctcactgcaacctccgcctcccaagttcaagcaattctcctgcctcagcctcctgagtagctgggatacaagcgtgcaccaccactcctggctaatttttgtatttttagtagagacggggtttcaccgtgttggccaggctggtctagaacacctgacctcaagtgatcgccctaagttggcctcctaaattgctgggattacaggcatgagccaccattcccagacaattttatctattttttcttttgttgcttgaggtttttatgtcaaactaaaaaactgttgccagatccaaggtcatgtagctttatctctatgttttagaggtgggggttcactttcttgcccagccagagtgaagtggctattcacaggtgtgatcaaagctaactgctcaaatcctggcctcaaaggatcctcccgcctcagcctcccaagtaactgggactacaggcactgctgcctgactctactttatattttttagttattttcttagtgattaccctgaggattacagttaacattataatttataacaatcaagtttgaatttataccaggttagtttaaatagcatacagaactttgctcttacatagctccatccctcctttatgttgctattgctgcaaactacatcttcatgcatcgtgtgctgattaacatatatttataactattgtttatgcacttgtcttttaaatcatataaaaaacaaggagttataaagcaaaaatatagtaatactgttttttgtagttataatacctttacctatgtagttgtaatacctttactgaagttctttcttcacatggccgcaagttactgtatattgcctttcatgtcagcctgaaggactccttttagcatttcctgtagggctggtctactagtgacaaatttctccagtttttgttaatctgggagtgtcttaatttctacttcattactgaatatagttttgccagataaaattttttggccaggcttgctggctcatgcttgtaatcccagcactttgggaggctgaggggggaggattgttttgagctcaggagttcaagaccaacctgggcaacatgacaaaatcccaactctacaaaaaatacaaaaattagcccggcattggtggcttgtgcctgtagtccctgctactcacgaggctgaggctggagagtcacttgagccttggaagcggaggttgcagtgagttgaaatcatgccactgcactccagtctatactcccctgtctcaaaagaaagaatttttttttttggttgacattttttctctttcagtactttaaatgtgtcatccactaactgtggctttcatagtttctaatgaggaatcaattgttaattttatttagaatttcttgtaaataatgagttgcctctctcttgctgctttcaagatgctctctttggcttttgacagcttggttataatgcgtctctgtctggttctctatacttgaaatttgttgagcttcttgggtgtgaagagtcatgtctttcattacatttgagaagttttggccattaattcttcaaatattgtctctgcccctttctctttctcctcctcttttaaaactctctctctttttttttttttgtttttgtttttgatacaaagtgtcactctgtcacccaggctggagtgcagtggtgtgatctcagctcactgcaacctctgcctcccaggttcaagtgattctcatgcctcagccttctgagtagctgggattacaggcgtgtgccaccatacccacctaatttttgtattttgtatttttttaaattttgtttatatatttatttatttattttgagatgaagtctcattctgttgcctaggctggagtacagtggcacaatcttggctcactgcaacctctgcctcccaggttcaagcaattctctcagcctcccaagtagctgggattataggcatatgccaccatgccaggctaatttttgtattttttgtagacacagggttttgccatgttggccaggctggtctcaaactcctgaccagccctccttgaccttccaaagtgctgggattataggcgtgagccattgcacctggcccagttccctgggatacatgtgttttaattcattttctgttgctagtaacagaatacctgaaactgggtaatttataaggaaaagaaatttatttcttacagtgatggaggttgagaagtccaacttcaaggcaccacatctggtgagagccttcattccgatgacagccttcatgctggtaagattttcttcagagttccaaggtggtgcacggcatcacatggcgaaggaaatgagcgtgctagctcaggtgtctcttcctcttcttataaagccaccagtcccactcctgtgctagtaactctttaatccatcaacccattaatccatgaatagattaacccatgaggcctctgccctcaggacccaatcacctcttaaaggcctgacctgtcaatattgccatactggggactcagtttcaacatgagttttgaaagggacaaacattcaatccatagtaacatgagagcttttcaaagcccttctttgttgaagtatgtccttctccagcctcttttttcccaggctttttgttttttctattgcttgtgcagctgttatcctttgctacaggtggcaatagctaatacatttgcctttaaatttgtttgacaaacaccaccctggaagtagcctcaactctggggaagctccaagacaggtaaaatacaggtaagcccttgagcagatccttcaggaagctaccatatgggtcaaaacacagaaccacaattctttaattctttgagaataaggtctgtattgttccctctgttaccagcaacctgcagcaggaaaatgggcttcagttttcaagtctgcagctgagttgggaagttgcggacagtaaccagtaatacacaatattggcaaca

SEQ ID NO: 4098 - DNA, 3880 bp, Homo sapiens
agagcgccgtcgaccccacgccacgcagaggtgaagatacgcaggacgtcctctaaagcaacttccgtgggtgccaggttgtgggctgggggcggtgctgaccttgagagagcggaggaggcgcaggcgcagcacaggtacgtgggcgggcggatcgtggtggctgcgcttgcgaggaccctgaggtagattgggtggtttcaacaggaacgcatccactgtctgagaggtggcaattgaagccggaagaacatctaccaagagcagagaacccaggaagaaaattctgcctctttaatacgttccaatatggacgttttccatatagatacctatctatatagatagatgctctgggatctgacggtcctggacacctgtatggctgtgtgctgtggtctttgcctagcctgcggttcacttttgctctggccaccacctcccctcatgtacaaaccgcgtctctgctctgccagtcttggcccccgtcaggcagcggttcactccctcaccagggaagtctagatagatagatatagatagatatcgatcgatagatatagatatatatatagatagatagataggtagatatatggatagatatagatatttggatagatatgtagacgtctatctataaatatatcgatatatcggggttctcagccatcccaaagaagcttgcacagggccagttgctttatgtcaggaaaagggacacagactgagtgtatgagggttttttttttctatagatgtatagatatttatatcagatgcaaataagtgaaactctcatacaacttttaattttgtgttttttccaaactctattccattcaactttttctgcctttttatttgattataatgagacatcgtactggaggcaggcttgaaatggatatacagagcactttcaacccagaaatttgtctcacgacttggggtccttacttaagttgtagctgttagtaatttcatccatgaattcactttgtgccatagtgtgatgttttgttatgaagttggaattgggaagggaaactaggaagttttgggagaagttaagaaggttgagtaggcaggcgttgttatagatattaaatttcaccctgcttatcaaagtacctggagcgtatggtatccaagctgtaaatggcccaaaggaatcggggttctcagccatccaaaagaagcatgcacagggccagttattttatgtcaggaaaggggacacagactgagtgtatgagggtttttttttttgttttttttttttagtttaaacttgattttgtgaggggacgaacagcgtgacaattaaaagaagatctgggaatcggacaaggttgtaaatagacaagccacaggcacctgcaaatggtaagtgtggtagagaggggctggaattgcctgttggtgtatctgtgggaagcagctgctatccttgaggaagaaaagatggagaaggtaagtggctatcaacctgtcagagacaacacattctgtgaagttgtactctttcatttctgacactgtggttcttaatatctgtcctaaacctggcagtcattgaggttcgcaaagtatctccttctatgtgacagtaaaactggaattactatcagaatggaatccattcctgctagagtaaaaccatgaaaagaaatcgcagttttgattatctgcttatcatttttaatagatcacagagtgcagtgttccttatttgttgtatggcaagttgatgaataactcttgattaatatcttttaatgttctgtttcacacagttctctcaattacatgtgaaaaatctgttatataagtaatgctatttaatgattaaaatggatatatgttttaaggtagtgccacccagtcttttttttttggtagaataatattattatctattggttgcctgccttgaagtacagtaatttctctgtttccattatttaaaataggtgagtgtctttgacaaagatacaaagaaaggggacagttatgaaagggaagaaaagatagatggagatgaaaagaaattcagtagtttcagcaagggaattaggagcataatctttgagaaaagtcttggttgcttaccattcgggctttgtgatgagttgaaatgtcctgaatgagaactgttctcaaatgctttcaagaccaacaaaaagtacgatacccacactgacctggaactctttaaaccattaagatatatcactttttcgcagttcagtccatattttttgcaaaatgttctgcttagtttttctgctaagaaattactgtttctgaacaaggttaagtgtcgtatgctttcattgtagttttttttcccctaacatatactgttttcctaattagactataaattcctccacagctgggaccttgttttgttttctcgccttccccataacaaatatcatttaagtgaatgttgtaaacagttacttcatttaaattgcccttaaaatgctttatgacaaagacgttatttgtagtaatacctataatggtaaaaagtttgttgcagtcttacagacgataagattgatcaattgttatatatgcttagtggaattttatctagctgttctaaagagccattagactagtctttctaatggaaaatgtttattgtctaagttaaaacagcatttgaggccaggcacagtggctcactcctgttattgcagcactatgggaggctgaggtgggaggatcactagagcacaagagttggagactagcctaggcaatatagtgagacctcttctctacaaaaaatttaaaaattagctgagtgtgatggggtgtgcccgtagttccagctactcaggagactgaggtgggaggatcacttgggtccaagaggtagatgttgcagtaaaccaagatcatgccactgcactgcagcctgggcaacagagcaagatcctgtctcaaaaaattaaaaagcattttatagactgcatgtttgtgtcccccctccctccgcaccagaattcatatattgaagccttaatctccaatgacatgatattagtaggtggggcctttggggggtgattaaataataagggtgaagccctgcatgggattagtgcctttacaacaagagaccctagacagcttgcttccactctttctttgctcttcaccatgtgaggacacagcaagaaaacagacaactacaaatcaggaagagggcctaatttgtgccaaccatgctggcactcttctctaacttcccagcctccagaactgtgagaaataaatttctgttgtttaagtcacccagtttatggtagtttggttatagttgcccatattaagacagcaggatgcaaaattgtggccagtatgattgctttgacatgaaacaaattttaagcacaaattgcaaaaagtaaccaaaatatatcaatccccactgctggcattaacactctaaaacaaactttgtatattgggggattttatttatttatttatttattttttttgctgaccatagtgactcatgcctataatcccagcactttgggaggccgagttgggcagatcacttgaggccaggaattcaagaccagcctggccaacatggcaaaaccccctctttacaaaaatataaaaattaaccaggcatggtggcacacccctgtagccccacctacttgggaggctgaggtgggaggatcgcttgggcctgtgaagcagaggttgcggagagctgtgatggcaccactgcactccagcctgtgtgacagagcgagactatctcaagaaaaaaaaaaaaggatgaggattttttttgttttcaacatgctttttaacatccactatattactctcatct

SEQ ID NO: 4099 - DNA, 3384 bp, Homo sapiens
caaagagaatgcaggatcttcactccagatcatgcatgctcaccacaattggtaggaccagagtgagtatctgacccacaaacagctctccatggccactgttttcaaactttaagatccatagaaatcacttgggaataaaatcatctggggagtttgggtaagatgtctcaggagccacccacgggaattctgctccatcaagtctgaagggcgcctcaggaatctgcccagatggtttctcagcctcccttggggaaacttatctcaggtctaaccaggggccaatgactgtagaagttctgccctacgtggagactcagtgctggagggtgatcagctgaaccaattgctgcactgaaggggaacagactgaagagtgctgatttgcctcttctggggagcatggacagagacacactcatgttactcacttactagaagtttattttaaaaattcacagagaagtaaggaaaccatctgagctgcagaaaccatctgagctgcagagtcaagccccatggagtacacgatattgttccaccactggaacgtttttcactcttgtctaatctgtccataagccttggacttctgtgtttctgcctcttctgattatgaacactattcttatgccttaccctatcttactgctctccaagagaaaaggtctgattggttcagccaatcacctgccagagcacagtgttcctatggacagagcatcaacacctcagaggctgctgaccagcccatagctagtaggctttgggttaagttattctgtattgcatcagctgtggccaggattccaaggtcaggtgatgcgaaacatcccaagccgtgggtcaggaacctcgcagagtaaggctagaggatggtaggctcctggcatggccaactgctacgatatcggggtgaagaaaggtaaccaaaatagccaaagagaaagaagccccatgaatatgaagagacaaatgtcccaataggagcatgatactttggctggtgacagatgctagacatggagaacagaccagcctagtgggtgagtctgcaggtcctgagttcttatcccagctccaccattctctggctgtgtgatcttgggtaaattactcggcctctctgaacttgagcttcccagtctttcaacaaaaatgattataatgtctcacaaaggggttttgagagttaaatgaaatactgaggataaagtctttagcacaaagcctggagtaaaataaaagacaatatttagtttaaaagagaaaaaaagaaacttacagtgagtttcttttctcagaatacaaccttggagaagaacagaacaacattgcaagaggaaacccaaattctgcggaaacatgagctattgttgttattctccaaaatgaaatgtgtcaacatttggaagacctgcgtaactaatattttccctatgattaatgtatgatgttacaaaatcatgcaggggtaaaagatcctttgaaagtgtaagttggaccaatggattatatgtaatcaactaaggaaaagttcattgataaggttccagattttgcattgaaactaacctttcagaaactgccacaagtttttgtgtaatatcaaagaagaatatccatgactacctgagatggccattaaaatattccccctttttccaactatgcctctgagtgaggtcagattttatttatatacttcaacaaaacatcacattgtaatagattaaatgaagaatcagatgagaatcaagctatcctctattaagccagatgttgaagagataagcaaacataaaataatgccattttctgaatatatttttttaattttgaaacattttcataaggaaatgtcaattatgttcccatgtcatgggtgtatttttgttactttcatatgaattaaagcgataactttaaattttatgttttaacttcttatttggtaaatatcactagatggaatctacatgaatgaaatctatgtgtagttctcaatcatctttttaagagggtaaagaggtctaagaccaagaagctttagaaccactgctgtaaatgtttgagagagagatggagagcaaaagagggtaaagagaagttcccgtgctaagcataggaagtgacaggcctgttgtgtgctctgttcctcagctcacaccaggaacactctggagttccctgtccaacacagagccccacatcttagcagggatactgacaaactgaacattattccaaaaagggtaactggaggataaaaattatgtccccggaggaacaatggaaataagtagataaacaccctgaggccgggcgcggtagctaacgcctgtaatcccagcactttgggaggccaaggcaggcagatcacttggggtcaggagtcccagaccagcctgatcaacatggagaaaccctatctctactaaaaaatacaaaaattagccaggggtgatggcatgcacctgtaatcccagatactagggaggctgaggcagcagaatcgcttaaacctgggaggcggaggttgatgtgagccaatatcatgccactgcactccagtctgggtgacagagtgagactctgtctcaaaaaataaataagtaggcctggcgcagtggctcatgcctgtaatcccagcactttggaaggctgaggtgggcggagcacgaggtcaggagatcgagaccatcctggctaacacagtgaaaccccatctctactaaaaatacaaaatgttagctgggtgtggtggtgggtgcctgtaatcccagctattcgggaggctgaagcaggaaaatcgcttgtacatgggaggtggaggttgcagtgagccgagatcacgccactgcactccaggctgggcaacagagcaagactctgtctcaaataaataaataaataaatgaaaataaataaataggcacatatgtaccatggaatactatgtagccataaaaaaagaataagttgatgtcctttgcagggacacgaatgaagccggaaatcatcattctcagcaaactaacagaggaacagaaaaccaaacaccgcatgctctcactcataagtgggagttgaacagtgagaacacatggacacaggaagaggaacatcacacaccagggcctgtcggggagtgagcggaaaggggaaggagagcattaggacaaatacctaatgcatttggggcttaaaacttagatgatgggtttataggtgcagcaaaccaccatggcacatgtatacctatgtaacaaacctgtatgttctgcacatgtatcccagaaattaaggtaaaatttaaaaataaataaataaataaacttactctgggaacaaaaaggcaaaactaaaaataaaataaaa

SEQ ID NO: 4100 - DNA, 2025 bp, Homo sapiens
agataggagtcagggcgcctggcccgcaggacactagagatctgcggaggagaagggatgagtctgccaggcccaccagcctggcccccagaccctccccaccccacacacgcagacacgtcttacaagtcctgtgagataggggctgccagcgtctcccaggatgtggcccaccgtgatctgaagtgcctctgccgtcccccggcatctgggcaccaccacagactgcaaaacataggcacagcaggggggcaccccaagtgagggcacccttgcctgctgttccccacctgccaaggacctgcctggaggagtgacaggccattcagaaaccccccgagaggcaggggctgcccgaggtatgcagaacgagctccccattggaggcgtatgtcaacaaggggatggctagaatttggcaaagcatttatggactggggagcttgcggcgtgagaccagtgttctcaaagcgtgctctacggaatgctacggcaggatcacttgggaagttcatcagaaatgcaggtccctggaccccagcacggacccactgaatcagactcagaggacacagggcctggaatctgggtttgtcacaagctccctcaaatctgactctcatgcacaatgacgtctccaagccaccggaccggagagcccctgaggtcccttctccagagataacctggattctccccattgtggagatggcatcaaagagaacagtgtcctggacaggcgcagtggctcacacctataatcccagcattctgggaggccaaggggggcggatcatgaggtcaagagatcgagaccatcctggccaacatggtgaaccccgtctctactaaaaatacaaaaattagctgggcgtggtggcgcatgcctgtagtcccagctattcaggaggctgaggcaggagaatcgcttgaacccaggaggcagaggtcgcagtgagctgagatcgcaccactgcactccagcctggcgacagtgcgagactccgtctcaaaagtaaaaaaaaaaaaaaagagagagagagagcagtgtcccaaggaagggatgatctggaagtcagtggggcccacacgcccactcaggaatctgcaggacgcaggtgtgagttcattctatccttatagcctggggtgtcaatggtggttgccaccgctctacctactggacaggtgagcaaaccaagacccagagaggttcagtcacttggccagggtcacacagctagtgaggagccaggctgggagtgggagcagatgggctgctgcagagtcctcgagcctgggctctgctgccctctgccctctgacctaacccacaggctccaaccacccagacacctgcagtttccacccattttcctatcagctcctcgtggctttcttggccgcccaaagctgttcacgtgaacgtgccctgcccttagcttcctgctcccttgttctgtggaccctgttcacacacaccctaaggcctcctccctccctgggcccctgctgaaagagaagccgatctcctgtctcaggagccagtgccggccggcaaaggggaccttcctctacttcctgccacagaccctgtccccacacacttcctgcccctgctctgctgggaggccacttcctcccccagtgctggattccacccccagctcaccctcaaacatggccccctctctcctcctgcttgcccctctctgctccctggaggctgttctgtcctcccctcttgaaaagcaatgccagcttcctgggatcttctgccaactccagctaccatgccctttgctcctgtcagctcagctcctcaagggaattgtctaccctcggtgtcctgcttcccctccctcaccctcctcaccctgctccaagctggcaggccagggaagctgtgggggcaggtgcagctctgtttggaccacctcagagagaaccagctatgctggggggatgttaatctccctgagcctaaaagtggacaatcccatgaataaaacatttgccaatgcc

SEQ ID NO: 4101 - DNA, 654 bp, Homo sapiens
agctgtatttaagactcgcgtatccagtgttttgtcgcagagagttttcgctcttaaatcctgggggtttcttagaaagcaacttagaactcgagattcacctttcgtttccctttccccaaaagtagcgtaaccaacatttaagcttgcttaaaaacgaaaaccaaccgccttgcatccagtgttcccgatttactaaaataggtaaccaggcgtctcacagtcgccgtcctgtcaagagcgctaatgaacgttctcattaacacgcaggagtaccgggagccctgaaccgcccgctgctcggcggatcccagctgcggtggcgacggcgggaaggcgctttccgctgttcctcagcgggccgggcccttgaccagcgcggcccgcaggtcttccttctcgccgtcttgcagttgaagagctacatacgtagtcagtttcgatttgttacagacgttaacaaattcctttacccaaggttatgctatgacctttccgcagtttactttgattttctatgtttaaggttttggttgttggtagtagccgaatttaactggcactttattttacttctaaccttgtttcctgacggtgtacagaatcaacaaaataaaacatttaaagtctgattttttacattttttgtctgat

SEQ ID NO: 4102 - DNA, 2162 bp, Homo sapiens
acagctttaaaaatttttattttttagagggaatttacttgggagtaacagcagtaatagttaacggagccagaatgcttgagtcatataattgcaaagcagagttgggagcaacagatgctaaagagtagttgctgtagttcctctttgggtcgtaggagcagttgtcatattcctatatagctactgcatgaagaagagttcttagtgaggcctgggtgaacagctcttcttagtattctgtgtgaccccatttgaccttttaacaaatccctaagtaaataaatagcccctcaggaaaactaagtttttctctgctgtttttttgcttgagagagctataactgtaatagacttatatttctgaacattttagtgcttgccaatatttggtaatatttatgtttcctatatttgtaatgaacattcttcttccggtacattttttgttaaattattgtttgatggataaaagttcaccttttattgtataaaattgactgagattaatttatacacattgacaatgggtaaatacaatttttcagattattaaaagctgaaggatgcccacgtaagcaaaaaaaaaaaagaaaaaaccaacaaaaataaacccaaacccctcaaacaatttcgaacacgaaacattcttctgatgccggcatccctgcttgcaggtgtgaagggggcaggaatcagcgaggtgtcctgggctgagtccccggagtgggaagaggtggcaggaaggggatctgaggaggagaacaggggtcctggtggtctgtgcttcttcccagacatgggagctgtagaggagacctctgcagcagatgctaggggggccagtaggcccaggcagtcttgggacttgggtctgtcctgctgtgcatccatagtgggtgctttagaaacgggaggcccacccgaagcccctgttgcaagtgaggacaaagtgtgggaaggccgtgagggtctgcagtccgagatggccttgtcctcaacgtgcagtgcactgttgatgcgctggaatgccttctctttttccaggtgcaggtcttcagccgtgacccggtaccccagctctaagggaggtggcagcatcaaaggctcccctcgcctgcgtggcagcaggggaatcttgcgtctacggggcctagagtcctgggatctgggggagccacccgttggggcgattgtctgccctggtgctgtatctgcccccttttcacaccgtgtgtgacccgaagagacagcctgaggcctgtcctcactcactgtctttgagtaactgagggtcagctggcagcgggatgaggctggccccctcctctgctttagccccggcaagcctcccgtggagctgtaggagctggagatggcatttcgtttggtgctcgagctcgtccaggatgtctgggatgtgtggttatatctgatttctgagctctgggcgtggaggtctgtctgcagaggcccgggcctgggcacaaagggagaggggcctccattgtcccgcaggggccaaaatgcagaccgtgcatccccggtgacctcggggaccgttctctgatcatcaggattttcttggactctggggtccttgtgctgctcaggcatccctgccccgctctccttgagggccctcaacactatcttccctggacacaagtctggggacagccgggtgttgtggaccccaaaggggtgactacctgctcctgggccccacagagtccttgtgctcagtgtagtggctgagctgggggatgccctggaactcagagcacacagcactggcttactgtggtacctgtgcagtgaagttgaagacagaatcaccaggatggaacacaggtcttgcaggatcacggaaaaccttcttagagttgtcttgacaccactgatgtcgagtgtgcgggtgtttgtaggatggcctgccactcagtccaggggcaggagcaacggggagatcccacaagcaaagtgaactgggggatgggctgaaggggctccaggcaactgagccctactcgcaggtcctcggccttggcccaaacaggaatgaggggcacagagtgcccgggtaaccgctcctgggagcagtggggaactgtcggatacttgaactctcaagagctgggctctgagcgtcctcgtccagc

SEQ ID NO: 4103 - DNA, 3556 bp, Homo sapiens
agactcgtccctaaccccagcccggagactttcactttgtcccatgcctcccgagcacccctccccgccccggtgggggcagctcctggctccgagcccccacctcggggctcccagcctggtcccgggcggccgaccccagcagccacaggcatcctacgctgtgtgcacacagcatatcaccgggagagacggcacggaaagatggccctgccctcaaggagctgcagtctgcccaggaaggcagacagataaactgctatagttttccactattgagctgaatttcgtatcaccatcaaaagttacctacctacaagtccctagtagagaaaatttaacttctggctttaaaaaagggacagaaaagcaggcagatctgctagtaagcaaactacagctcccccgaggagacacacaggcagtgggtaagaggaacagacccatggctccactgaagacacagagcagcagacgaaaaagacatgtcctaaatgttaaatggtaaggaggggtagggtgaaaaaagggaacatggatgccaggcagaagaaataaaagcctttccaaacatttgtattacatgatgctggctctcactgataaaccactggatgagaactgtacttcatccatatcatcctgttggttgcagatcccgtcaccccatatctaaaacatatttccttctggagctttactgttgatactgctttgagatgtatcatttggttttggttttacatatttaacattttaatgaaagggtgacttgagtaaggcactactttttcaataaatagcaacagaaccaatttgcctgggaggagacctgccagcaagccatgaggggcatttccaaaatttccagtataggctgctcccaatttctgcctccactttaaaaacactttgcacttactagtgttattccaggagagccagttaatagtttaatgaaactagttagagtttaaaggcagcaaatgggataatttaaaataatcatcccatttttattgatggttctcaaatctctctccagatctgacattttgccctagctcagacttgtacctacactttctattcagactaacgtcctccatagttttaggacatcaccatcccaacttgggcactgacagcccacaggccacatcctcctcaagtagcaactcatgaacccagagaactgactgaaatagttcagtgtttcttgagctccccaaggccttcaggcttctgtgcagagtggaagtggtagtggtagtggcacaagtatgctaattgccacagtacactctccaaggtaagtgtaaccgggcccattctacagataaactaaaggttaggtaaattaaatctcctggcccatccacatctaatcatcatcagggccaggattcaagtccagttctaacaacaaaagccatgccaatggtaacagagtgcgtgtgagctgctaagtacttctgtgtattaactcatgccattaaagtccgtagatgccatagggtgacccagagccacactgggtaggcccctccaggcattcctttgtcttccaaataccaactgaggtgcaggcttattacccttacgttactactggcacaagtaaaacttcttcctgcatataccttaagacgggggtctccagtccccagggtacaaaccactaccagcctgttaggaactgggccacaaagcaggaagtgagcggcaggcaagtgagcaaagcttcatctgtatttacagatgctccccctggcttgcattaccgcctgagctctacctcctgtcacatcagcagcggcattagattttcataggaccacgaatcctattgtgaactgcgcatgtgagggatctgggttgcgtgcttcttttgagaatctaatgtctgatgatctgtcactgttttccatcaccctcaggtgggactgtccagttgcaggaaaacaagctcagggctcctactgattctacattatagggagttgtataattaattcattacatattacaatgtaataataatagaaataaagtgcacaataaatgtaatgcgcttgaatcatcctgaaaccatccttcccctcagcccatggaaaagctgtcttccacaaagctggtccctggttccaaaaaggttggggacctctgctgtataccactgtagtcttataaacactgtttacttaattaacctaaacatttaaaatgtttcctttcttcaataataaattaaccttagcttactgtaacttttttcactttataaagtttaaaattaacctcatgggcctagcacctcaaatctcccccgcttctctctccccaagccagcttgccctctcttagctccctgtggccctatttctgtcagctgcagcagagttctagaagaagtgcctggcgtgctctctgtccattcccactccttccatcagtcaccatgccctctagattcattcttcacttcatggagtttcctgttcggcatgctcctcggtttttgcaagggctctgccaactacagggccacgtcatgccagtgactgcactggtctcctccctggcctcagtgtgtctccacacccctccccccaacattccagttctgggcattctgtatattaatgtgttctcttatttgaagacctgtgacaattcctagtacgtccaaactatcggtctgctagttagttaacagcctccacaattgggttcccaatcacctacaccaccatgtagtgaagttagttactgcagtaccccatcctgattcctttccctgggtttttaccaatgcctttctctcttacccaatctagaatgtcccctcttcacttctgcttattcaaacacatcaactcaactaacattcattgagccctcattctagtgaacacactgtgcaaagagcacagcacgaggcactgagtgaacaaggagcacagcacgaggcactgagtgaacaaggagcacagcacgaggcactgtgcgaagcatgttccagtttcaactctatccctacacagagtccgctctgctctctctcccttctctgaaaaacaacaattcctgtttatgactagaattaataagcacttctgccattaaaaggtctatagatcttccaccaaattgtggattcctttccagcaagagaatgtgacagaatgataccaggtgacttctaagactacatcatacaaagcaacacagcttctgctgggctctccctctctggacacgtgtctttgaagccctgagctgccagattaaacagtccggcttgcctaaagtcaccacgctggagagaccatcagggatggagaggtgctacagaaaccctagctattctagtccccagccatttgagtcttcctagcccagactcataagtgaagaaaccttcaagatgattccaatacctcctatcacttgactgcaacctcgtgaaagcctaagccagacctgcacggtggagccattcctaaattctggtcccacagaaactgtgaaagataataaatgatcatcattg

SEQ ID NO: 4104 - DNA, 2524 bp, Homo sapiens
gagacaaaaaaccaggactatattcgtacatggaactgggatgtaacatcctacccatgacttaatttataagcattgtttattctctttggagcaaatgaaatgcttttccaagggacagctgcaaaggccaaggatttgaaaagaagaaaattatgataaacccctcttaatgcaggaaagattagatagcttgctaccagaaatcaagaaatatttataataatcacattcaaccctagactttcctctaagaatctaaacagaaaactttaatcctccagaatgtaaactgatgccatggctatatatggtcacagaaatcctaaggggaagaaaaagaaaagaagagggggagaaaaaataaacacccagttgctgtgtctcttaaattggtgtatgtgtgttctaccacagagatctgttaaccttggcaaaatttacaagtaagaagcattaatcaactttacacaagtacacgtgacactttcctttttaagtggaagccacaaactcctctccctttgggaaatctcactgtcatgctgaggatttttcttcatagataatactaccatggcaaacatcaaaaacaactggattccatattctgtgggcttgaccgccccatgaaggcaagcaatattaacttttcttgtggttgacttcttttctttttttctcctttctctacttcttttggcctttaggctagaaagactgtttcttgaaagtattcaactattcttggaaattgcaacattttcctgcattctttctatgttgaagacacttccagactaagtttgggttctagggaatcttgcagaagatacttcctcccctgtagttaataagccatcgcttataccacggtattttgttgtttgactcacgtctccagtgtaacagtggaaagtcattatctctggctttggtgttaacatagggagggatagcaaattgcctcactctactagtgaatgaatagaagagaaatccttgatggtttatcaagagaggtattatgggaacacaaaggaaaaaaataaattcttacaaaataccaacagcagccttgcaatccccgtcaaaatgtacccaaccaacttaagggggaaaaaaaaattcaaactatgtcctagccataaattgaagaaagaagtccagaaatgttaaaaatgtttataatcatcaaaattagtattttttgccttgaaggatgtctctttaaaaggctattcttaccaggttttgtgttgtaatattaaaagtggcttacaaaagagtgaatgtcaattgcaaaattaaatttatctctgggtatgtgattctatctctttactaatatacaaagctgtcttgaatgatttacacctactttccacccacaggtcctctgccagggtcaatctcagcagaaacatgactcttcaaaaatagatcatcacagttgtgattaaatctcccatgttcaaaatttacagcctataattcaatgccgatatgaataatgacttaaataaaaagttacagtcaccctctttccccttccccctaaaatgaccccaagactaatttacagttgtgggaggtggggactaagagctcttgagtatctattttaagctaggcatttttcaagtttttttacttacataaccctatttagcctgccgaacaatccagtggaatagtactaatttatctaatttacacataaggaaatgaaggctgagagaacttgagtaacttagccaaatagtacagttggatccgaggctcagaattcccactttttccttcctacaaacaaacagtagataaacaaaatattcatgtaaggcttaatggcaggtggcatgagagtactgaatttcattgtatgtatctgcaccctccattcccccatcttttgccatttgtgctccatattccctgacagtgcaccaaaaacaataggtttaggtattctctttcagatatcttccaaacaagtgtgcataaaatggactagaaggcaacttgatagagcaaataaattcacgtgctcttctcaagaaatctgagaagaggtatcagatacactccttgcctgacccagtgtgaaacacaggacgcagtgaggtaaagtttggacttttccatcctcagagcacacacaaatccactgaggattaaaaccacacaaccaggaaaaaatgttaagttacagaaagagctctttaaagccaaaagtcatacagctcatgagaagagagaagtcactttgtgctcaggtgaacaggaaaactttaaagaaaagatggaataaggccaggcacagcggctcatctctgtaatcacagcactttggaaggccaaggcaggtgggttccttgagcccaggagttccagaccagcccgggaaatatggggagaccctgtctctgtatttatatatatatttatattaaaaacaaaaacaaaaacaaaatttaaaaaagaaaagatgaaatgaataaaaataatttatatatggaaa

SEQ ID NO: 4105 - DNA, 2071 bp, Homo sapiens
tgatggtacaaatccatggcagggctcagctttaaacaagtcttttctgagattccttctatggaataaagttccatcaaagtcaatttaaaagcctgtgtaaaaaaataattattcttgctgcactgtatacaaataatcaggccaagtataataaaggaaatcagtcgtaccatgatttgtctttagtaaaaatgagaaactggagagagaaaaactatgttttaaaaactatagtacacctgttgttagattctagtcttgcccaatgtttttcaatttttattattttctacagtttggaccaaattctagtttttcttggctacaagtcttcaatataacgttttcaattttttccctttcttttttctatttttcctaatttggagtcactgaaagctaagctgtgctttgtgaagccctgtgaactgaagctagacaacttaaacttcagaagaaaataacagcaacctgtttacatatataagctactttcatacctgcctactgatgtatggacttcagagtagtgtggcctatatcgattttctaggatcattattttgtttgttgtttttctcccttcctccacctattttctcttcataggacatgaggattctcaacctgataaaaatgagctttcctaataactcaagacccatctgcctaggaataaaccatcccagctgtgagagaccagacgaaacctgagaccagagactcgttttcttctaaaatgctttctccaaaagatttttaaacagaaaaagggggaaatgtgaaaggaaaagaaaacttgaggcccccaaaatcactaagctaaaaggaaaagtcaagctgggaatggcttagggcaaacctgcctcccattctatgcaaagtcatccctccgtgcactgagataaatgcttatctaattgcctcctttggagaggctcatcagaaactcaaaataatgcaaccatttgactctcacctacctgtgacctggaagatccctctctgcttgagttgtcctgcttttctggatggaaccaatgttcatcttacatatattgattgatgtctcatgtctccctaaaatgtataaaaccaagctgtgccctgaccaccttgggcacatgtcgtcaggacctcctgaggctgtgccacaggcatgcagcctcaaccttggcaaaataaactttctaaattgactgagaccagtctcagatattcagggttcacagtatccaaaaatccaatcacatctgaaaccgcctttgcaaaaattatcacagtgagaaaataatggcagtgaaagaaagctgatctagccaacctccctcttgcctttagctttcaagctgcttttacttattcctgggtttaagccaagctacatgtgggagtcatttagttgatagtttaaattataataacccttccccgaaactcaaccacccttgtaatactgagagaccaccaggctaggaggaggagaggagcctaaattctgctaaggtgtagacaaaaacaattgtgaggcgttattccagaagccacaagatatgcaacttcctcagttacccctgcagataatgttacttttgtagaacctaggattggccttctgagatatcttctcaggattttgcatgtctgatgaccgatggctccaccgggaccagccaacggcttctgtgtccccacccagaagcgactcagagaaagaggacagcttcgacaccctatgatttcatctctgacccaaccaatcagcactccccataccctagcctgctacctaccaaattacctttgaaaaatccctaacctccaagccttagatgagtttgatttgagtaataactctgcctcccacatggtgtggctggcatcatgtcaattaacctctttctttactgcagtgccatggtctccatgaactgatttttttgtgcagtgggcaggaagaacccatcgggcagctacacatcttgaaagagaagctcttcctgtgagggaacgcagaacgctctggcaccttcaacagacttgccccttggggagctctggagacagc

SEQ ID NO: 4106 - DNA, 1449 bp, Homo sapiens
tttagaacccttaacccataaggaccacctgtaaagctgctctgtggggggtggggaagatgtcctcagcgagacgccgagataggagggctggttgtctgggccacagcagtggcgtcgatttttagggacctgatctcagggacaagaaattgtctcagaacccccgggaggaggttcagatgagggtcaggtcgtggctcaagagagctggacccaggcctgctgtgcaggaaggtgggaaagaagacaaagggcccattgtttccgcctctcaggacactgggcctcgagtctgctctcccgtttcatgggcatgaccctgggaaggatgcccagcaggaggagtggcccagactggccccaactcttgtttccagcacagtgtgctcagtgggacagcggacccagcccagtctgtgacccggagccgctggcggctgggctgggcagggagagtgcagcccaaagccgagaagccagacctgctcaccccattcagaagagctgcctctcccacccccagcccactgcccccagagggctactgggaacccggagggtcacctgggctttccaggggtagacaaaaagtagaatttcccagtgctgttatgtgaataattggggatgattgaattcttagggctgttcttactgcccttcacccacctcctcttaccccatgatgggccctgggagcaaaaaggagataaccacagtgtcccttgcccctctgccacgccccacaccaccacggcctggctgctcacctgtcccctttatctaggccctcagggacaggcacgcccagaatggccgatctcagcatcacatagtcgcggatgtctgaggggatgaagatatactgcaggtcctgtcagaatagagacaatgagcccagaggggaaccaggacatgtttagctcctcagtgtggacagccctccacccaaccttgccccctgagccgactggagaatttcccttaaatacctttcattcccacccagaggtgctgtactggtttcagtgtaggtccacaaatcctctaatgctccttcaggaggtggcacccaattgccatcccctggagtatgggctggacttagcgactcatgcacaggatttttctgataaagaggaaagtgatggtgtgtggcttagagactaggtcataaaaggcactgtggcttcctttacgttctcagatcactcactctggatgaagttagctgccatgtcgtgaggacactcaaatagcctacagagggcccaagtggcaagggcccgtgagacgccatcttgatgtcagctccagtcaagcttttgggtctctcagatgatgcagcccatcatctgcacctgggccaaaacctcccactaagctccccacaaattcctgacccattgaaaccacaagatagtcaatatttgttgtttaaagcca

SEQ ID NO: 4107 - DNA, 3485 bp, Homo sapiens
taaaaagcattaggcatataaatgtataaatatattttatcatgtacagtacaaaaatggaaccttatgcatgggccttaggaatacaggctagtatttcagcacagacttccctgcttgagttcttgctgatgcttgcaccgtgacagtgggcaccaacacagacgtgccacccaaccccctgcacacaccaccggccaccaggggcccccttgtgcgccttggctttataactcctctgggggtgatattggtggtgatcacagctcctagcataatgagagttccatttggtattgtcacacgtctcctgcctcgcttgggttgccatgtttgagcgatggccctgttgatttcaccctgccttttactgaatctgtaaattgttgtgcaattgtggttatagtagactgtagcacattgccttttctaaactgctacatgtttataatcttcatttttaaagtatgtgtaatttttttaagtatgtattctattcatatggtctgcttgtcagtgagccagacttgcttactatattcctttataataatgctagccacttcctggattctttagtaatgtgctgtatgcaagaactttccagtagcagtgaaggagggttgcctctccaagcttcctaagggatgctgccctgtgtggggatgcattgcagaggcactagtagcatgggggctagagtggggagcgagatgtaaaagggtggggggataggagaattccagagtgcttccagcattagggtcctgagaacttctgagttcagagaaacatgcaaagtgactaacaaaatagctacttacctttgcagttttacagaccctgggagctgctttgggagtgagaaaggcaaccctccaatgtgtttcaactttaaaatgttgaattcttttcagacatggtatctcatttattctccttttctagcgtttgttgaatttcaggcagaatgtcttacagaatgtcctagaaccagattatcatttaatctgaaacagctgaggaagggacagagaaggtacaagggcaaggcagcacaaaacagatcaggagaatgaagagggaatgctttggttttttgttttgttttgttttttctttttcaagtaactaaaacagcatctacatgtagagtgttgtggagagctgagaccagggtaaagtcaagtgcagcatcagtactgcgagacccaccagcccctggagagggtcagccgagaatctggtagtgaagcctgtctagggtcccggcaccctcaccctcagccacctgcagagaggccagggccccagagactagcctggttctgaagtgggcaggggtgctgccagagccctctgccccttatgttgagaccctgctttcaggacaggccagccgttggccaccatgtcacattctgagtgagtgtcacaggtccctaacaataattttctgatctggagcatatcagcagaatgcttagcctcaaggggcctggcagctgtaatgtttgatttatgatgagaactatccgaggccacccttggcctctaaataagctgctctagggagccgcctactttttgatgagaaattagaagagtacctaatgttgaaaacatgacatgcgctcttgggatctgctgttctctccagggctccagaacctgatacctgttaccaaagctaggaaagagctttatcacaagccttcactgtcctggcatgagaactggctgccaggctcagtgtaccccattaactgtgaatgaatctgagcttggtttcctttattgcttcctctgcaatatgattgctgaaacacattttaaaaattcagaagcttgtcactcctgttaatgggaggatcagtcacacatgtgtagtacaaggcggactttgtgtttgtttttggtgttaatttttagcattgtgtgtgttgcttccccaccctgaggagaggacaccatggcttactactcaggacaagtatgccccgctcagggtgtgatttcaggtggcttccaaacttgtacgcagtttaaagatggtggggacagactttgcctctacctagtgaaccccacttaaagaataaggagcatttgaatctcttggaaaaggccatgaagaataaagcagtcaaaaagaagtcctccatgttggtgccaaggacttgcgaggggaaataaaaatgttatccagcctgaccaacatggagaaaccccgtctccattaaaaatacaaaattagcctggcatggtggcgcatgcctgtaatcccagctactctggaggctgaggcaggagaatcgcttgaacccaggaggcggaggtcgcagtgagccgagatcatgccagtgcactccagcctgggtaacaagagtgaaactccgtgtcaaaaaaaaaaaaaaaatgttactcatcctctctgaaagcaaaaaggaaaccctaacagctctgaactctggttttatttttcttgctgtatttgggtgaacattgtatgattaggcataatgttaaaaaaaaaaatttttttttggtagaaatgcaatcaccagtaaagaggtacgaaaaagctagcctctctcagagaccggggaggcagagtactactagaggaagtgaagttctgatggaatcatgcctgtcaaatgaggtcttgaagcggatgcccaaataaaagagtatattttatctaaatcttaagtgggtaacattttatgcagtttaaatgaatggaatattttcctcttgtttagttgtatctgtttgtatttttctttgatgaatgattggtcatgaggcctcttgccacactccagaaatacgtgtgcggctgcttttaagaactatgtgtctggtcacttatttctctaaaattatctcattgcctggcaatcagtcttctcttgtatacttgtcctagcacattatgtacatgggaaatgtaaacaaatgtgaaggaggaccagaaaaattagttaatatttaaaaaaatgtattgtgcattttggcttcacatgtttaactttttttaagaaaaaagttgcatgaatggaaaaaaaaatctgtatacagtatctgtaaaaactatcttatctgtttcaattccttgctcatatcccatataatctagaactaaatatggtgtgtggccatatttaaacacctgagagtcaagcagttgagactttgatttgaagcacctcatccttctttcaatgcgaacactatcatatggcattcttactgaggattttgtctaaccatatgttgccatgaattaactctgccgcctttcttaaggatcaaaaccagtttgatttgggaatcttcccctttccaaatgaaatagagatgcagtacttaactttccttggtgtttgtagatattgccttgtgtattccacttaaaaccgtaatctagtttgtaaaagagatggtgacgcatgtaaataaagcatcagtgacactct

SEQ ID NO: 4108 - DNA, 2051 bp, Homo sapiens
tgtcctccattgtaagataaaaagagctacctaagagatctgtggctcagttccttttgttcagtatatatacctcagggtaaaggacctaaggctctggcacttcctacataatttgttcataaaaataattttctgtacctgtaggtgcagggattcatagtgatttttctgttttaaaaaatatctttctacactgtctgatttttaaaaatgagattatcagtataaaagaaatacagctattttgtaaaagaaaaatacaggagaaaaaggataaagctactttgttttaaaacgcagtatcattaaaacaaaaacaaaccaaatttgttctaagtttgactttagagtcaggaaacttaagcttacatttttggtctgccatctattacttttaaagcttgggcaaattattcatttgaagtctaaatttattaatctgttaatgggaacagattagaaatcttcagagaagctctagcctttgtaacattgtgactataatgctgagaactgcttcactcatcccattcatattttaaaaatactaatattttgtgtttgagcattttaataggctcagaaacttaaaaatgatgtttcttttctaacaacatactcttttcaatgggatattatggttgttattatttaacatgacatttagggactcaacatacattaaggtgatggcactaagataaatgtagaaataaccagtaccatgtaattttcataagtgcttaaattgttggtaaacaattttatgagttggaggtgttgaagcaaatattattaatatttgaacataaaagctgatcaaaggggcctggtccacagaagatgtttatttgatgtaacaaaacaatacagttagtgttagatccaaccacaaagagcaaaaggaatgaaaaatttgtacaatgtacatagaaaaaacaagatatttactgtgacaactatatattcctaaaataatgcttctaaaattactcaattattgaaatctacatgaaaaaaaggatgttaatagcgacaaagtgcataaaatcaaacattgtattttgagcaaattaacatactaggcaattttgctaagaatgcatgattttttttttcttgtttacagtctgctcaaaatatctttataccaacagggtaggcagaacatttaggtttaatatcagttacacaatattagcataaacttccacaactacatagggtattgttttcttttgagctggcaaagtgactatagaaacatcagatgatttctctgaattgagaattttatccaaataaatgccacataccttctagatatatgcatatctttctatattatgtaaatggctttacccatttaaataataaaccatacagcatttaagaatcattattatatgattaacaatgtcatgttccaggtttaacaatttcataggccaaaaaaaatttcttcttaaaaactagttttataaacgcagaatatattccatgagtaactgctggtattttttaagaaaatatattgtgcaattgtggctaccacgtactgctggcaaagcattattatttatgtaaaatgtgaaaaaaaaggtgtaaaaatttttcaactgcctatgatcatgatgaaaggttactgccttcttacaaaaattatattggcatcttcttaaaaataattcgaaaaagggataaactccctagccaaaaataaataaataaaaaggtgcattttttaaaatgatgctactgcaatgcaatggtttaaataccaaaaaactgagaaaatgagctgtctgtgatccagcattaaagaacatactaaaaaagagcattaatgtaaattaagtagaaaggggatcaaaattgaactaaccaagtttgtgcagtattgtagccaggcttctaaaattagatgtagaaaatataaatagactgctttaggtaatgagccaccagtgtccaaaaaaaggaatgaaattaagaaaaagctcagttaacttgatccaaagctctgagtaattcttcaccctgcagta

SEQ ID NO: 4109 - DNA, 1015 bp, Homo sapiens
attgctcccagcgccaagctctgtgtcgccgccgtcgcctaggcggttgggggtcggtggggcggcgcgggcgggggtcgctgcgcggggcggcgagcctctgttttgtctccttctctccctgtggagcggctcgggctgctggggaggccccggctccctccggacgctcggccaacggcggcggctagtccgcggccctgctgagagggaaaaggacgccgcggtcttcccaggcgtcgcggagagcagagaccgggtttcactgtgttagccaggatggtctcgatgtcttgacctcgtgatccacccacctcggcctcccaaagtgctgggatgacaggcgtgagccactgcgcccggccctgatacttcttatatatggtgtttgacaagtctttcaggaaaatctgaatttttttccccatatgaccttttttctgatgtgtaatagttggaaaataaaggcaggatttagaataattactgagaatgaaaaacttcttttgaagaggaaaccaagaacttggttcaagaggagaaagaaattaaaaggtggtaatttctttttgagacatttactttcttgaataaacttgacatcccccccttttttttttttatctttttctttagggacattggtctatagttagtatctaggtttacaacattaagcttttttcattttgtttggaaaaacaaggctggcagaattacatttgtttttaattccattgctaatattacatacttaggaggctatcaggtgcaagttatttacttgagacaagaagcactgattattttggctaggcttcatctgaaggcctatgttctgggaagggaggcctccataaaaaaggaagaacctttagtgacctttatccttgggaataaaagtaaagatcagaagccagtgcattcagtttaccgtcttacaaaaggagtcaagtattgtataggtcagagaccactattgtaagatcatataaatcctgtgtctaattttgtt

SEQ ID NO: 4110 - DNA, 785 bp, Homo sapiens
gttggaaataatgaaggctgagactcatttctaaactcttccataaccatcaccagaagagcagccactgtgttgtgtgatgtaggctaatgcctcccagatagaggtaaagtcacaaggactattagaattccagtggattgtggaactggttttggattatccttatattttcattctgattactgaggcagttctgaaaactcctaccattgaaatagtggtgtgtcttttccttgtttaaggattttacatcatttttatgcacttgaattccaaaatcagaatctctcttttacctatcaacctttattggctattggcttttggcaatgacctttctgttcaaatgtagtcctgtctctttgtttccttagggagtagaacctgtcctttttctcatctttcatttttttgacgtgtcctttctaagagaaggctctctgccgcctgttctgggtgataagtgatattttcatctaatcgttatgtggttgggatgatcatggtgaaatactaggaagacatactctgttgatggactttttctctccaaataatcccaaatagattattttctagtgaatggtttatatctttctcgtcacaaaaatgttcctttgatttctagcacaaggtacagcaggatgcaaatgattctcagataaaatgatgttgacagtatttccttaacaatttatgtaaaactatgcataattttcattctaacttttgacatttttctccataaataaaagtaatgcctgatgtttagttaaagtaga

SEQ ID NO: 4111 - DNA, 1181 bp, Homo sapiens
agtctggaatggcctcgtcctgcctcccccaccttgaagcctctgcttttctcttccagcatctgcgctgcctgtgagtgtggtatattttctgtctatctgtcatctgtctgtctgccttcctgttgtctgtcttccttgctggaatgtcaaccccatgagagcagagacatcgcctgacattgtctgtttgggtcacagctgcttccccagctcgcggagcggggcctggcatgttggaggaagtaataaatgtttgtcaagtaaatgaatgaacgaaggaaggaatgaagaaaacatttattggtctctgctatatactgggttaggttaggacaagctacgatgggttaggactaaggggaaatgaatgaaattaaaaactcccagaccaggaaaaatgaatgccaaagacaactttagaggaggaaatgaattctttcataatggcttaggtgtgagttgcgtatgtgtgtatatatgtgtggggtgggtagagggggcgttttctgccatggtaataataatcatataggtgggtaacagcaaataattgtatgtgtaaaacttaaatcctctgacaataacaaaagtcataatgaccatgaatcgagtacttatatgtgggacacagtactttagatacattaactctttacacaagcccccgtgagaacaggacttggctgttcttttcactgctgtatccgcagtgcctgggacatagcaggggcccaatatacatttacacaatgaatgaatctccattttatatttgaggcctttgatcagaaagggcaagtgacttgtccaaggacacacagctggaaagtgacagagccaattgaaaccaggtccgtttggctctgtccatcttgcaaaagaagctcttctctctacgttcattggcctctttgagtcactgcccaccaccaccaccactcccctgaagaaatgactccccacccccttccctcactaaccctcacaacatgcctaaaactctgcttagctcaaagtctgaaagatcttgggctagatgggaatggaaaacaggccgagcagttttagctaccaacattgcaaacacagcctgggccctgttgtctctgaagcctcctggctcattgtcatctttcactatgcctgacgaggctggtgtgggaggaccagggaacaat

SEQ ID NO: 4112 - DNA, 3665 bp, Homo sapiens
agtgtacagcagaatgagcctcctgtcaccagcccagagctctcagacagaattgagttcctgtacagtaggactttccactcatgtctgtggtctaggaggagattgggttgggcaaacaccaggcacgatggagcaaccattaaccctggagttgtgaagacaggaccacaagctgagagagggcagcaatggaaacccagccaaactattaatggaaggctgggtcccattctttattatccttctgtggtctcgtcaccagcagggtgagccaaagccgagggcaagaacacgctgggtgaccttccacaccccaaatgcaagatcaagtgctgtggagaaggagataacaagtttttaatgtaataaagatcaacgtatcagttattctttttatggattatgcctttgatgttgtatctgtagagtcatcttcaaactggagagctgaaacctaatatttctggaggctggaagtctgagatccacatgctcccaaaggacccacttcctaaaatcattactttggagtctaggatctcaacatatgaactttgggggatggggacagaaacattcggtccattgcagaggaagagcctgtgttaatatgaaagagtcagaaaaacttctttgaaaagccaatcctttgctttctgagggtgagtgaagattaagcagaaggagcagtttaaggcagcaggaaatgctagggtgaagactcttgaaggaaaaaatgaaggccagtcagtgtggctggagtgaaaaaatccaggaagatactgcacaagttgacgctagtgaggaggcatggccatggtgagggttttggcctttattgtaaggatgaagggaagacactgagaggtttaagaaggggcagaatggaacagacaacaggactgtcagggaacatccattttaacaatatcaccttgctgccatgtggagaattgattgaaagagggccacggtgtgtgggagactcactgcgagcacctcacattaatccagacatgatggcagcttgaactaggatattagctgaagaaagggagaaaaatagatgacttgagtgatgtagagatataaaggccataggagctggtgattgatttcatatgagcagtgtggcatcacaggcatcttccaggtttatggctggagctctggatggactgtggtgctgttgaagccagaaccagaccacgtttgtgggaaagacaataaatcgagccaattaggatggggaggggtgttcaatagtgcagagacaaaccttgattgaggaaaatatgagaaggctacatttaggaggcaggatttgaaccaggccttcaatacatccagaaatcagagccaggcatagtggggaaattgcaggggaagtgaggttcccaacagagggagcacccagagccttatgggggatcttggcatttttattccatttttgttttaagtaaactttgcattgaagttcagcatacctatagaaaagtgcacaatttataaaaatacaaatctataaaaatttaagaaaacatatcatccagtttctttgggaaggggttcatttttttcccctaattttctattttaactgcatctagttttctgattgaaagtgacattgaattcctggaagtaagctgggaagaaaaactcattctatgagtgaatacacttggcaagaagtagtggggctgtaattgtgatagtaacagtgttactagaaaacatcggtgactgctattgttatgtgttatgctgactataatttgtactgcattagaggaacgtaatcagagaagacttggagatatcaagtcttggagtattactgataaataaatagaagtaattctagactgtacaagaaagagttcagttttagaaattttaagtttcgagtgtttactcaaaactcatacagaagtggaaatgtctggaagaacaaaaggacagaagaatgcatgggtgaaaaatcaaaggagggatcttggctccaggagacatgtgtgagttctgctgtggggctacatttaatcatgtcagagttgaggttcttgctttaggagcagttacttagaatgagatgtccgggatttgtctttttcttttattttacccagaaagaaatggaagtaactagagtgtctgttatactgttgcaaatgcggttctggagcaacaaagattgatcaaagctggaagcagggctttgggtattgtctgttttcagagagtaattgaagccacaggtcggacaaaatggtctggggaatggacagggagcaaggtgaccccagtgtgttggagggtgccagagctcagggcaggagtcccagctgtgcatggtggtggcagctgccccgcttgccaagcccaggtggatgaggtgggcagtgggtggggggcactcatgcaccatccacagagagggttagaagctagagtactttgcagatgtcaacagtcgattgcagacaattaggaggctgccttttttctccttctcccaggacccctaagacaaactgtctgaaccataacagttgagtctgaggatatcaaataagtaaggcaaagagagaccccgtggaataattgtggttagtggcttgcggggctgcggatgggctgtggggggcgggttgctcaagagaaagaaacttgcttttaatcaatgtgctaatccaggacataaggtctcctttctctccctcccttgtttcatttcccagggctcagtccccattcccaccccctgctccctccccatactggttgaatggaaatttggtccagtttttttttttttttaatatagatacattaaaaaacagacactgatcttcaaagaaggctgcaatttcactggcgacggaatgtttatagccacaatttgtttggttctgataaaatgcacatgccccgttattccattttattttgcatcccaagccaggcttgcttcttacattggcctgtgcctctcctagtcagcaagacagagggagacagagagacggagagagacagagagaccttcctcgagctgtggctacatctgcctgtgggtgtcctggactccatgggcccagaggtcattgaatgtggcggaaggagacacagtccaggagtgaggatgaccagccagagggaatttcaggcactcccagagatacgttatgccccatcaagagaaacaccagccttcccaggtctcgctgaagctagaaaataatgcccccagttcttcttgggagatggtgcaagggaggtgaaagagtcttgaaactaaaaaatgtggacttaaatcttagcttagtcactttcctgcggtatgatttgaacacaattttctccgaattggcttccccgtttgaaaaccaacagcgtctgccctacagaactggtgtgagagtaaacagattaggaccaggtcagcaggacggagcatgcccagaagagagtagaaagtgcagttttgccaaggagagggaattgagaggagtattctagccgggagggcggtgggcaccccagcacacaggcatgaggaaacagcattgcttgggggagaagtctgaagtgactgggtgtttagttcagagatagagcaacaggaaatgaagctggcagaacaagaggtcagg

SEQ ID NO: 4113 - DNA, 1553 bp, Homo sapiens
ccgcgtttgaatggccctgagtgggactcggcccagaagccgagggactctctaggctgccgggcgctggtcgtcagcgccgaggctgggctgaggcgccgcggtaccatgaggcgccggtaagtgactgccgagccggtgcgagccccgcgcccgcagctgccctgccctggcagggctactccagccgggcttggccgcgccctgggcccacctgcaggccccgcggcggcctcggctcggccgggctcgcggcagcgctgccgggtcccggggcggggcggcaaggccggggcggagcccctctgccggtccctgcggggagagtcgggcagcgggcgctggggggctccaggggactgggccgggagaggcgtggaccgaacctgttgtcacttatttatcttcgggtggagtcgacagctgcacctggggaaggggaaggacagaacgagtgtggggcgagcatttttgaggacaggttttccgcagagcgcctaggcccggcccaggcatttccttattttccgacgggtcctcggattcctgacggatgagcttttgtttcgcaggacaaaaacttgacataactgcataagaattgtcgattgcaactttaaaaaccttactgtattttctgaaaagttgttctgtaaagtatctaggcttttactacgctcttatattgcttaaatatggagataacaaagagttggtttgttttcttgtggcttataaagttccttgaaaacagagatacctatgtcagtttctttgctgatttaaaaaaaattgtaagagaaattaggtgtgtaataatcatcagttcagcacttgcgagaattatgagaaactagtccacctaatagcttaaatctgctgggttttttggagtttctttggatagccagcttcagacttgaattgaaacgtcatccattgaggcttttacttggctaataactaatattagccaataataatattagccagtgtgatcataatgatgggcaatatttattttgtgctttctatgcgctgggcgtattaagagctttactttgggatatatactgttgtccccattttgacagtgaagaaactaaggcacaggaaattttagtattgtaacttttgtaccgtacagggttacacagctaatataattaacacccgagcaggctggctccacgcttttaactctgttgctctactacctcctttatctgtggctctttttagtttacaaagccctttcatttcatttacttaaacttcggagacctgagtgtgcttttgtgtacacatacattcattcacacaccattcattcaagttttctgctcttgatgattatacttaaggtttgtgcctgagcaaaaaatccattgactattttaagataaatggagttcataagctttatgtgtgttataatttatgttttcaattcctttatatcctttcctgaaagttttgaaagtgttagtcttagcaacttatgtattactttaaaataaaaaattacatgttaaatgttttcatccctaaaa

SEQ ID NO: 4114 - DNA, 2176 bp, Homo sapiens
gtactggaacttgacagtcctcctgtccaccagccctacctccaccccatcattccccttctcccaaagtactactgctgttgcataacaaccccaaatatgttctgtcaacacaaacctgcttttggtctataaacagggcgttacagaatggtacacccagtctatttcttctcagtatccattcgccagttcttcatttataaatatcgtcttcctctgttctgctgctgaatgccacacatccatccagtctgagaaagtaagatagggaatcctgccgaggaacaagccagcaaagctctttcactggatgtagactgcacctgctgccttccctctggcgagtctgccagcatgcttctccatcctttttatatgtcctttgcttcccacttctgtgtacattcaacatactgttcacgtagtcatgcagtctttctgctttttgtgaagcctcagaatctcctctgttctacttggcaccccaagctatgcctggtattgtatttctgacttggctcgatagttcggtggtctggcagtttttatctaccttcattattaaaaggccctctggagctgggcgtggtggctcacgcctgtaatcccagcactgtgggaggctgaggtgggcagatcacgaggtcaggagatcgagaccatcctggctaacacggtgaaaccccgtctttactaaaaatacaaaaaattagccgggcgtggtggcgggtgcctgtagtcccagctactcgggaggctgaggcaggagaatggcgtgaacctgggaggcagagcttgcagtgagccaagatcgtgccactacactccagcctgggcgacagagcgagactccatctcaaaaaaaaaaaaaaaaaaaggccctctgggatgttgcctctccaggagctttttggtaaccaacacttctctcgggagtatgagatcatcctctgcactcttctctgtcatcaaagggctgctgggtggagatattcttgaaaggtggccttggtgagaggtgtggagtcaagtcttttaggttgcttgcccacgtcactctacctctggcctctgattctcaactttgtacctatggggcgtctcttgttagtgcagtgttgactattcaaaaagtagcaatatgcctgcagatttgcttagtcttgggacacggttaccaccagaacggctgctcagacaatatgcttggggactttctcatggctttttgaacaaggaggctgcgcaccctgtgaagcctcctgcattcacacctctgctgcatggtttatgcctcagtgttatgtgcactggaatgcttttcactatacgtttccaagttagaaagattagtgttatggaagtgcctaatgtatcctagtccaaaatatttaaagattgttctctgtgtcttgaagttttgcacaaaattctttatgaattttacacttggcaaatgttaatgctagaagccatagtccgcttcttatacaagtccaaagcgttgactgttgtatcattagctccctggttacactggtttcccagctccttgtgtagaccactgctaatcccttagaaacaagaggtctggcactagtagcacaacctaaggtggcattccaagtctttaagcaagtcacagcaacttttctgccaaagtcagcttagtttagacttcagtgaatcaggctgttgccatcctaatgtatgtctctgtgagtctgttcattcacatatctgccgttggctgactttcttgactcgctgcttgcttgcttgtttccttgctttggaaagctattgaagatgtgtacataattctttaggaaggggattgctaaaaaatacactgcaaagcgatggaaaacagtggagaacaggggagtagccaggctggatggctcaaatataaatgaatgaggaattctttatgaagtgtcagttggactttgtgattgagtgatgtaatacaggaattatatagaaagggaagaatatctgatactgatctgttagatacttcagaggctccttgatttgcatatttaaagttcctaaaattgtagcttttcccttcttttggctgtacagcagactgttttaatccacggttgtgccttattgttccattaaaattgtgtcttcagtccatcaataaatactcgtggtt

SEQ ID NO: 4115 - DNA, 1251 bp, Homo sapiens
ctcagaaaaggaccaaaaaaaatctaaatgtttagaacaatttaggttggtagcttaaagacagaatgtttcagtttttaggagattcatcgaaacacaattcacgtagctgcaaccaaaacagccttcgaaatacatcagaacaatgaagaacaacttcagacagcattgaaagacacttcggataaaaattccaatcttcagggaaacacagagctgctttcacaagaagctgaagagtggaaaagggaagagggagcaaacatactaagcagaataaaatgctagaaaattctaaaatgtgtaggaaacaagttctaaaatatgacaagtctgatcaagcttctgtgtgaacacaagttaaaggtgagagactgggctactgttcttggagacgacgacatggatgctaagaacttggatataaaaatgcaacagaaacggagacatcttagaagatgaatcaaaattttgaagaatcttactaatggagctgagttatttagaaaatcttgattcaaaaaacatgaatgctcactaaattaactgaaagaggggaggtcatattaaaagtctgcaaactgggaaagcttcaccgcactcagaaacaaactaacaggaaaacgcacacagaaaggagaggcaaaattgctggtggaaatttcaagtccttcttgaactgaatcaaagaaatgaaatatattttcacaaaatatcctatttagactgtgtttaccccataaagatagaggagaatcttcccaagggaggtgaaaagatcagtcatgcatgtgaagagatggacacctataaaatataagcctaaaagtttttagaaaaaaaaaggtcattggcctattatcaaagccagattattttcaatgagcaaaatactcaaataacaggttgacagttctgttgtgtgagtgaaaccttaatcatgtaagaaaacaaaatgcctgcacataagacaaattattaacaatttacatgtttcaaaaaatatcctaatatccttgatattccaagtgaaacatttagcagagacttctgaggaccaccagggcacactctggctaaccagatctctgatgaaggaggagtatcaagttgtgaaggtgtgcaaatgcaaggcctcatgcgtgatatggaccggatgccacccactacccagcccaggctcaggactgcataagcagggtccttccaacagaccactccctcctgacataggaggtcctccataagcgc

SEQ ID NO: 4116 - DNA, 3371 bp, Homo sapiens
cctcaggtgatctgactgccttggcttcccaaagtgctggcattacagacattagctactgtgcctggcctcaagtcctttctcattttaaaactgcgttattttattttatttttctgagatggaatctcactctgtcgcccaggttggagtgcagtggtgcaatctcggctcactgcaacctccacctcctgagttcaagcgactctcctgcctcggcctccctagtaactgggattacaggcacccaccatcacgcctggctaatttttgtatttttagtagagacagggtttcgccatgttggccaggctggtcttgaactcctgaactcaggtgatctgcctgcctcggcctcccaaaatgctaggattacaggcgtgagccaccacacccggtgggttgtctttttattgttgagttgtaagcattctttttaatattctggatactagtttcttatcaggtacaatctttgtgaatatattctcccattccatggattgtcttctcactttctggatactatacagtacaagttttaaattttgatgaagttcacttgatttctgttttttatgttattgcttatgcttttggtgtcatacctaaaaaaccattgtctaaatcaattgcctatgaggtgttacccctatgttttcttctaaagttttatgattttagctctttgacccattttgagttatttttgtgtatgcagtgcgagataagcatccagcctcattcttttgcacataaatgttcacttgtcttagcattacttattgaaaatactattttttccctatagaattattttatacttatcacaaatcaactaactataagggtttatttctggactcaattctgttgctctatcttatggtagtaccacactgtcttgattattgtaacttcgtagtaagttttggaatccagaaatgtagtcctctaactttgttgttgttgttgttcttcttttttcttttgtagagatgaggccttgctatgttgcccaggctggtctcaaactcctggcctcaaacaatcctcccacctccacctcccaaagtgctgaggggtgagccactgcaactggcctgttctttttcaaaattgttagggctgtattgggtttacctttccctaaattttcatataactgttaggattcacttgcaaatttatgtaaaaagggcctctggaattttgatagtgattacactgaatgagaggagtttggcaggactggtttcccaagaccacaagaccctgtaagaccctgctgataagacaggatgtggtagaaaggccaacccaaaccagccaaaaccatgatggtgacagaagagacctctggttacctttgctgcccattctatggtaattataatacattagcacgctaaaagaaacttctacagcaccatgatagtttacaactgccatagcaactttcagaagttaccctgtatggtctaaaaggtccagacctccccacttctttcctggaaaactcatgaataagccacctcttgtttagcgtatagtcaagaagcaaccataaatatagccagtcagcagcccatcagggctactcttcctatggggtagccattcttttattcctttactttcttaatgaacttgctttcactttattctgtcagcatgctcttgaattctttcctgaacccacttgacctcttgggctgagccttaaccttggggtacttttgcctataacaaacatacaaagataagtttggctgggcgcagtggctcatgcctgtaatcccaggactttgggaggctgaggatggtggatcgcttgagccaaggaatttgaggccaccttgggcaacacggcaaaaccctgtctctactaaaaatacaaaaattagctgggtatggtagcatgcgcctgtagtaccagctactcggaaggctgaggtgggaggatcacttgagcccgggaggtggaggtttcagtgagctgagattgtgccactgtactccagcctggggaacagagtgagaccctgtctcaaaataaaaataaatttgaggtgtattgccatcttaacggaagttgttactggtggacggtatccaagttactggtggtaaatctgcagcaacctcaattctttcctcctcagaagaaagaatttgactgaggggcataaggcagaaggagggaccgaggcaagtttcagagcaacagtgaaagtttattacgctttaggctgggcatgagccaccacacccagcctacattactcaatttaaccacgtccacctagttccctagacaaactattgctaatttaacttttaggaactactgccatcttgcggaactttgaggttttgccaccccagaatttcctagctgctctgttcttctattatgtggcatagcaaacacaaaatgggtcactttttttctttggagatgggatctttctatgttgcccaggctggtctccaactcctaggctcaagtgatcttcctacctcagcctcctcaatagctggtactataggagacagcaccacactgcccgggcctggttgcattttacttgtctagctatcgtctctttcctgttgactatctggaaatctctgatggggtctttaacagaaaaagtctactccttcagaccttagtttcatgccatataccacatatgacaggtctgggaaggtctggaatgtgtggataaaggcgatggcagtggctgctgccatcatgctggctgcagcagggaggcatggctctgggtgcacactccacggagctggtgggtgccccccaccttctgagttggagcgggagctcctcgggtgctgctgcagctgcccaaacccagccacccagactgcggctgtggatctgagcccccctgtgctcttggaggagggctgggagcaggcaggatctgccttcctgggtgcagagaccagcttggtcacggacaccctaacccagtggtgctagaggaattagacacacatacagaaatatagagtgtggagtgggaaatcagggggctgacagcctttagagctgacagctccgaacagagagttacccacatatttattgacatcaagccagtgataagcattgtttctatagattatagattaattaaaagtatcccttatgggaaacaaagggatgggccgaaacaaagggatgggttctggctagttatctgcagcaggaacatatccttaaggcacatatcactcatgctattgtttgtggtttaggaatgcctttttgcagttttccgccctgggtgggccaggtgttccttgccctcattccggtaaaacaacagccttcagcgtgg

SEQ ID NO: 4117 - DNA, 1251 bp, Homo sapiens
gatgtcccggcctttccttgaaccagtagaccctaatgatgcaccagattattatggtgttattaaggaacctatggattgacctttgtaaagaagaaaaacatgttagaagaaaaatggaaaagaactctgcatgccctcagctcagatgccatctcctctgggagctcctctggcccctgccaaggctggatcagatgccctcagggcacacacgatgctgatccagggccatctgtggcccagactctgggtccctcatgcagccctcaccactgctcaggaggccacaggaacagaggaatcactggcccattttacagacgggaaagctggacccggagaagtgaagcaactttcctgactcacagtggaggcagccttccaagttttctacccccgactacacagtggagctgaagagcaccactctctgctgggcccctaaaacaaatccagtaagaagaacgtgctggaggctgcttccagcagatcggcttctttgtacgacccaagctctgtgccttctctggcctctattactgtgacatctgccaccaagatgatgcctcagtgattctggccaggatcatccacagctgggacctcaccaagcacctggtttgttggtggaccaaagtaagatctacagcagggccttctactcctgcgcagctggcatggccctggctgctgtgtgcctcgccctggtgagaccgtgtaagatgggactgtgccagcatcatcactcaggtgaaacaaaggtagtgagccatcgtgggaagactttacaggacatacctgaagactttctggaaatggatcttgcaaaaaatgagcacagagttcacgtgcaaatggagccggtatgacacactttcttacaacaacagccactgtgttggctggagagggatggggtgggcccaacggagacacaaggaggtagaggagctaacccctctactccactttcaaaactacattttaaagggaatgtgtatgtgaagagcactaccaacatcgcttttgttttaagttttcctttttgcttgtttttaaagccaaaacaaaaaacaaccaagcactcttccatatataaatctggctgtattcagtagcaatacaaaagatatgtagaaagactctttggttcacattccaatattaaaatagtgacacgaactggcaaagtggttttaaaagctttcacatgggataaatgattttctttctttcttttctttcttc

SEQ ID NO: 4118 - DNA, 497 bp, Homo sapiens
agtcctccatcacgttgcttcctgatgcatcattttcttaagaggacatctgtccttcctcttcaggagacttggggggcctcttggatcgcgaccttgacttggatttcctcttggatacccggggaggactcctggtcatagatgaagacctggaccgcgagcgagacctggagaccgaggaggacttggatcgtcgcgcagagctcgatttggaggttgatgcagagcgagagctagtggaggacccagacttcgagtgagaccggctgctgtgatatcggctgtagcgagagttactgtaaccagatgagctgtagtgagatccgccgtagcgagattccctgtagcgagatctgctgtagggagagcggctgtagcgcgaccggctgtaaggagatcggctgtagggagaccggctatagcgagaacccctatagcgagatcggctgcgggacctggagcagctgggaccccgggatcggctgcggtgtcgc

SEQ ID NO: 4119 - DNA, 508 bp, Homo sapiens
gaaagcagaaggcggagttccaacctctcggctcgggaagggactaacgcgcagctggcaccgggtcggaccgggccgctccccagccaagccccctctcgctagcacggggagggagggacagctcttccatagcaaatacctgtcgctgagccaggagtaaagtctggccgggaggaggacagacgcagaagaccaggggctccagcgcacagagccagtttcgccagcgatcaggtctgaggcctggattccacgaggccggtgcaagccaggagccagccccactccctcgcccagctccctccggcctggccctctgcagaagcctgatgcccacccagctgtctcaccatgggaccccaggcggtgagggtgggtagccgaggactacaggctgctgggtagctgacttccccaagaagggctgctgccatgtgatcaggacccacgcccctgacatcaacccctcccccgtgttccagagcacggagcagcccggaactct

SEQ ID NO: 4120 - DNA, 461 bp, Homo sapiens
tcccacagctcttgggcgtcatttattttttgcataggcataaattaggatctggagataaaaaacttaagaaccaatagtgcagcatttgtgacaggagagcgcaaaacaaaccctggctgcctcgggatggagcggggcggcctcaccaccactgcatccagcctcatgctccagagcggatttgaggctcagtgctgcagtgaaggcctgcccgccttcttgccccttccccgcagccagaccaccagacacagccggaaccagtgccccaggcccctctccacggccaggaacaagaaactgagtatcacccatgctgttgggtgacaaggccttgggcacatgctctaaggtaacggctgtggggcggatgcgggcagagaggcggaccacggcgaagccttgtggcccctggaaggcccagcagttgcctgggtgcacatctggctggaggagca

SEQ ID NO: 4121 - DNA, 8071 bp, Homo sapiens
ctctgcgtgcgccggaggctgccgtggcgggtgggccgcctgacttctcctcccggccagttctcgagcgcctcaccgggcctcgccctgcagcctcgctctcgctggcgctgcgcggcctaggggactgggctgctggcctccgggtgcggggtgggggcaggctccgacctggggcgtcctggccgcgcgagccgcgggatgggggcccgggccgcggaggaggcgccgctggtgtgtcccttggtggagagggcgctgccggccctgcgcggtttccagccaggaagcttcgggaagcctggtgagagctgagtgcgcgaattcggatcttagagaaaggcaccccgttcacccacgacccttccgctcctgccgctgcttccctgagtcgctcaggctgtgggaagatgtttgtcggcatctttgaaaaattgatttcttatgctgcgtcaggtggtttccttgtcactgtggctgctcagcgggaggctgttctggcgggaggaggactgctcggttgtctggtgggcattccgcctcgtggtcctggtcccttgatacctgcaggggatcagcagcccgcgtttcgtggccactgtgttgtaactccaacttcccctcccgcaaattaagcgtagagtaaggggagagagtaacatgggtcggatttttctagaacggcccttgtgacagtgagctttttggtggcagggagcttctttggtccgccttcctggagaccagatgcagcaaaacgcagtctttttcttttcgagacagagtctcagttgcccaggctggagtgcagtggcgcgatctcagctcactaccacctctgcctcctgggttcaagcgactttcctgcttcagcctccagagtagctgggattacaggcgccagccactaggccagctaactttttttttttttttttttagagagacgggtttcaccgtgttggccaggctggttttgaactcctgacctcaagtgatctgcccgcctcggcctcccaaaaaacgcagtgtttatgtgatgctcctctgtggtgtttgcaagatttatacaaaattgcggtttctttttttctctaggacgtctgctcactggagatgacacgtgcgtggggtgttgggtaagttggtgcattggagctggaacagggtcaatcctccaatgtaactaagccctcctgtgcaacatcttaagtgactggagggaccagtcggtcttgtgttcacattgaggctagaagctgtctccaggggagtaaaaacggattatttagtcttcaacaggacactgcccctagaggcgttgcagctgtggctgccgtgtcacatctgtgtcattaggtggcagagattagagaggctatgtctacgctcagcgttctgccccgtgaacgtttgaatgtttgatagtctcacactcctgttttgtggacaggcatctgttttccttcgctggtatctgggagagagggtgggccctgtgagtgggctttctaactctcgcgctgggctaggctggcctctaggggtctgaagggatagtgggaaggtggagggtgccttcaccaggagcagccttcatgagtgagttttaagaacctgtgaggatcggtcaggtcaggtgaggtacgcgctggatcatgccgtacaccgtgtcaggatcacgcaggacaggactggggaagggtttgctggcgtctcggttaatagcagtaacggcagccgcttgtgttcttgattctttgccaagcattcttgttatttaacacgggaaggaggtgacttcgcctgtgatggacttccagtgtgagcactggccagagtgaccaggctgaccagcaccagccctgatccaggtaagaggtgaggcggaggcttgccctccttccctgcctgccgggtgcgtgtgagcggctgccctgcggatgctgtcctggacctgttggcaccacagacagttgctctgctgtgcctgtggcctcggggcaaagagaaagtggcgatttctacactcagtgctcgggaaccagtgggcactgagaatggtttatggcctgacattacttgcaaccaaagccaggcagcatttggattttcgcttttggaaaccaccttacctggtttgctccatgagggaggggcagcaacatcgctgggaaccctgaggtgtagatatgtataaatgagctgtgtgtgtatctgaagctcgggcacttgtggggttaccaggagtgtgcgtctcactcccaggcctcgttctggaaacgattctgtaggtctgtctgggaggccttaggcaagtttgattaagaacagtcgagctggataaacaggctgttccttgtccagcactagtcatcccaggggggcgggggcggggctgcaactcctgtgcacaaaggaagggccctgggtaggggtcaggagctgccttgcccagagatgtgtctgggtcactttggaaacaggaatcctctccccaaaatgggtagcaatgggggtacagaggccaaagacgcagctgcatgtcctgcagtgcctgggacgccccgtagtgaagagtgatgtggcccaaatgtcagcagtgccagtgtcagactcctgctaagagacagtatcaagaaagataacttcaaaatacactttctggaggcctggcgcggtggctcaggcctgtaatcccagcactctgggaggccaatgcatgtggatcacctgaggtcaggagttcgagaccagcctggccaactgcctgaaaccccatctctactaaaaatacaaaaattagccaggtgtggtggcgcaagcctgtaatcccagctatttgggaggctgaggcaggagaatcgcttgaacccgggaggcagaggttgcagtgagccgagatcgcaccactgcactccagcctggacaacagagtgggactctgtctcaaaaaaaaaaaaaaaaaaaaaagtacagtttcgggatttcataaattgggttccctgagggtcatttggtgaatccgggttaaagaaccctggtctgcatcactgtccttgtttgtttttcagatgcagaggccaggatgtgggcccagccctgtgccaggaggctggctggaataaaggtacagatagaggcctcaccccctctgggaccactggcactcagggtgtttgcagcctcagagcccacctgcccccagggccacagctgcatctcctgccctgctgtcattacagggatgggcaggctggcatgggggcagccgctgcccctgcctgggtgttgctgtgtattcctgccggccaggggccactgccaggaccacgcctcccttttcatatcccgattcttaagttctgctattgtggtattctggtggagaaaaaagaaccgcgtggctgtttttgaactgcctggaacctaagaccctgaattcttttcccccccaaggggaaaatctatatggaaaacatttattttaaaatacaggatgaagtgaattaaaagatttaaatgcacatttctttaaggataatatttctgtgttggcaaaatttgagagtaaattggtcttgaatggaatggattgtcttgactcacacattgcggagcagagcccgccctgaagaaaggtgttgctgtggtgggatcttcccacgagggtccttgcctgttctcctaggggatggttgctgggtgccctgggctactggggagagcgtacggggctggagaagatggccattcctgggctgtttcctagggaatgagttgtacatctcatggctggattttgtaaaatcagtttttaaaataccgcatatatctgttttcttactggaacacctttttcttggtctgttgtgcacagcccaggtttggggggtactggtcattgactgtttcagaagccgctgtgtttggggaactgccctggcggcttcagaggtgtgtgtgggttgaagggcaggcagctctgcaatagacctcaccttggactaacacctgagggctgcctcgccaggaaggattcaggggctcaaccccagcctgagtgcctgggctgggtggatccacagcggggcgaagggtcccacacacagcatcgatgggggctcagggtgctcagccctgggcattacataaaagctgtttattgacattacgttcttcagagtaacaaacccccttggaggactctcctgccgggatgtccatgtccgcctttgctccgagctggggtctcatgtctgtggtgctggaatccagagccctgacggtaggggagtgattttgcaacacagttgcatttcacatcttctgacaggattccttgagggagggttggaccctggcacctggccagctccaggaagggtggccaggcccctcactgccccatcaagagtacttggtgttggagatcttcttccagagcagagtcttgaggtggctgagcaccagcgagtgatgggcctccacctggctggccagcccgctcagcgtggtacaggtgcgcagctgtgtgcccagctcctcgcggaggtcggcgggcgcgccaggcagcaggtagccccgtagcagtgcgcacaccttggccaggttgggctggatgaggtcgcccttgcactgcctcatgagcctgtcacacggggccctgcagtcgcgcccgtaggtgcagtcggtgctgtgctcgcagcggcggccctgcaggaagcggcgcacggtggcctcgggtgccacctgctgcaggtcggccatcttgaagtcgtaggtggctgtgtagcccacgttggccagtgtggtctcacacatgtagaaagtcccgtaagagccgtggaagagctcctccacgaactccagcaggccgatggcgatcttggcccgccaaggccacgcaggccccagccactgctggagagcaccctgcagggcaggcggcagcagtgggcgcaacaggggtggaagggcggccgcgtgccaggcgccatgcggcacgccctcggtgaggtagaggtccccacagtagcccagcagtctggaggcgtgctccttctcctgcagggacagcagcagcaggaactcgttacgctgcagcagggcccacacggacttggcttccgccagggacacccggttgtccttgttgaagtcagccatgagcaggacctggccaaccagcgccggcagggaaggcaggtctcccaggttcgcctggcgtttgggaccaaaagaaaggaaaagccagctgatttgatgtctgggagcacgacctggcctttacctggtcctcctggcggggtggtctgccggccagaccagcacatctgccaggttaggggtcccagcccacagctacacgggtggaggacgcagccagcaatgtgtcagctcactctgctggcctgtgtggctgctgccagacagacctcccgcctcctggcagccttgggtgcacctggggagctcgggggtgggcacctgggcagagaagcctcagagcttccctgaggatgagaatcggcacagggcagagggcacgcactggctgaagccctgggaagcggcccctttccacaagccctggtctccattcggggcacctgccctgctggacacacggcccttgactgcaggagcctcccctcgacctcagctgccagcccaccggcgcccccaacccttgcccccagccctggagaggctccttccctggcagggctcatgcccaggggctgggggatgggaggtctgcccagggtccacttgggcccatctgtgcctttgcgctgggcatgttggtgccagggccgcctgctgggcatatgaccgtggtgtggactcctgccctgccccctaggagagctgcctgaccttgaggaagctgagggtcatctcccggaattccttgatggaggtgccccgggtgggcttgtcaaacagtaccagctcccgccggggggccgcatccgaccgggccttggagtcgagggtctcctcaatgccacacttgatggttacatccttgtcccgccagagcccgctgtacacctggacagggccacagaggtcctccgtgcagacatccccctcccactgcacgggcagtatcagccccaggcccacccgccctgccagtggctatacctgctggcccggggccaccgagaggcaggtcctccactccaccatatgcagctcacacaggtcctggcagacggagcccgagatgatccccttgcggtactggtcacactgaggagacaggtgcaggcgtgccgggcggggcagccacacccctgccccactgagcccctgcccacaggcccgaagctggcaggggcctccacttgctgcagttggaaagctgccagcccctcacacaggcagtgccggggccctgggtcatgccattggtggctgcaggatggggctgtcggctgcaggggcagccccgccaaccctccggtccggtcccgtccccaccatcctggctcctgtaacaggacggcacagcaaaggccactgcctggacatgagacacacaccacacccagtgtcgaccccacgccagggccagaggcaggaacctggaggcagctctccgcccagccgacccagctctggaccatccaggcattggccggtgaactagaattcacactagtccctaatatctacaccaccagctgccacacgcgcgctctctgcctgactcttcattcctgcctcgggtgacgccaggagggaggatgcaccccctgactcatggcgccctccctgcccggaatagtaagtgagacatttctgaacttgtttcctatgatggtgctgactggactgcgtcttccatctgaagggccaggagctgccccacccaggcagggctttccctgggacgccaggaagaacaaaagggtgggctcttggtgccagagcgatggatggtcaggctggcagaacctggacaggagtcagacacgagccatagggcctctgtcagagaagcaaccccctggacacagggcaaacagctgggtgtcatcccgtgaagggcaccgcgtccagcccctctgctccccgtcagggcgggctgccagccattctgcactgggcactcatgggggctctcacgacagatcctgatgcccagagccacacctgcatggcagcttctggctgggtttccactaatctcaggtgtgggtctcctcctgtcccaaggacttggcctccctctttggcccggcccagccttccccaggctgaggcaggaggacaggctgcggcctcactgtttgcctcaagtgcagccaggacagggctcaccaccagagctgacagtctcaagggtacccctggggtggagccggcaacggagccccagcctctacctcctctcccagccctccgaggccagtgcccaggctcaagcgctccgttgtcagagctgtttgtcaaggctgagaaaacggacccctggggccccacaatgactccgggcctgtccttccctgtcccacaggccccctccttagccagacccccagggagactttgttagcagtaattacatcaggcctggggctggctgccgcccctcctcagcccccaccctagctccaggggcctggcagcccctcaatcccagcgccccacgggaggtgatggagggatggagctggcccgcccctctgggggggggagaattcctggatgtacagcctcagttgccatggagcctggccaagcaggcttggagggagctggggaagggagctgcggaacaccccgccctccagggttggggaggagggagggtccccgccccccacacaccaaggatggggacagaagtgagatgggccaactggaggccgaggaccccgccacgtgagtcatgaaggcagcgtctgtcccggcagcaagaaaacgccggctcttcgtcaagacagaaaaggaaaatgaaggaaaactgcacacttgtccaaccctccaccttgcaggcaggccctttgccaccggagtccactcccgtccccagaccagccagctccctgca

SEQ ID NO: 4122 - DNA, 958 bp, Homo sapiens
cgatggggtcatggcgccccgaaccctcctcctgctgctctcggggaccctggccctggccgagacctgggcggaccccccccaagacacacgtgacccacccccctctctgaacatgaggcataacgaggtcctgggttctgggcttctaccctgcggagatcacattgacctggcagcgggatggggaggaccagacccaggacatggagctcgtggagaccaggcccacaggggatggaaccttccagaagtgggcggttgtggtagtgccttctggagaggaacagagatacacatgccatgtgcagcacaaggggctgcccaagcccctcatcctgagatgggtcacacatttctggaaacttctcaaggttccaagactaggaggttcctctaggacctcatggccctgctaccttcctggcctctcacaggacgttttcttcccgcagatagaaaaggagggagctactctcaggctgcaagcagccaaagtgcccagggctctgatgtgtctctcacggcttgtaaagtgtgagacagctgccttgtgtgggactgagaggcaagatttgttcatgccttccctttgtgacttcaagaaccctgacttctctttctgcaaaggcatctgaatgtgtctgtgtccctataggcataatgtgaggtggtggggagaccagcccacacccgtgtccaccatgaccctgttccccacactgacctacattccttccccgatcacctttcctgttccagagaagtggtgctgggatgtctccatctctgtctcaacttcatggtgcactgagctgtaacttcttacttccctattaaaattagaatctgagtataaatttacttttttcaaattatttccatgacgggttgatgggttaattaaaggagaagattcctaaaatttgagagacaaaataaatggaagacatgagaa

SEQ ID NO: 4123 - DNA, 1472 bp, Homo sapiens
gcggaaggtggggtgtggggccggaagaccctccccccgcgtcttcagaggagcgctgtttctggaggagttaggggaaggaggctgcctggtaagccaggaaaggggcttctggccgttctgttggagcgcctctgactgacttcccccatgtgtccgtgtggccacaccgtgctactttcagaggcagtgggcttttcgctaagggataaaaagaagtaaaaccttgcctttagcgcagctctccttcactgggcagattgctctccctccccactctcccaggcccaaattggatctcagcgcctgggagctccaactttagcaagtgcgaaatcctgtcttcggttttggaattttcatccgcacagactatatcagccacggataggatatgtgagaataccagcatgtcaaggctgggaatcatccttaggcatcacctagccagtcctgcctctcattttaaggtgaggattccttcatctctgtgactggcttgcttgatggttagggtctgatcgctgcctgagacaccatatcggtactcctcagagttgatgcagagtgttcatatgaggagagactttcccttgtctccgtcatctgtgatttcacttccctgacagaagacgaagcttccatctcagatgttttcttaaatgatgaaacagcatacgcctctgttcttgtcagctcagggaaaacagatctggggacctcttcatctctgcgttgggaagcataggtggtataatcccctcctgtcacgtccaacgttgcatagtcagaagcttcgcccttgtagttggtgcacacagcacggtgatcacaggatctggtttgccactgaaaggaatcttgatgctgaccacttcacctcggagagcatgaactgctcccatgccttcaagagttttagtgggtaaccaggatggaactgcggtgttgcttgcaggagaagcttactactggtttctacttctccaacctcattggtggctatgcaggcactgtctccagactgtctatattcaacccagtatccaagaatttctttaccaccatcacattcaggtttctcccactgtagagtgacactatctttggatattgaaagaatctcaagttctcctggttggcttggtttatctgaaatattttaaaataatgaaaagggagtcagctttactggtgaaataaaaggaccaaacatggcttgcttctttaatttaaccccttcttctgaattccttaccaaatggatctttgcaaacaactggttcagaagcagggctggtctcactcaggccaacatcattctgtgcgatgatgcggaactgatactcagcatcgggaacaagccctgtgacagtgtacattgtggtggtgatctgagtcttgttgtgtctgacccacttgtcagtggatgtctctttgcgttcgatgtagtagcctgtgactctagaacc

SEQ ID NO: 4124 - DNA, 4025 bp, Homo sapiens
tatattttttgccctgggctttgagatactgcttcaacttgagcttttggggaactaattagtgtttcaacaggctgctgtgtggattcaatggcttatctatggtgttcttcacaaggtttccaagtttcctaaagaacagatgtcctgaaggtttgactgttggtccaggtcctttggtttctccatattctttacacagtgcttctgcctttgcatacactgcatgtgaaagagatttaaagtcttttgattataattaacactgcctatttatccctacaaggctttaaactggaggtgataagacatttactgctctttacctaatataatagcaataccaataataatactgtaagtagaaggtgtgtattttctacaggttctaggtttctgaaacatttttttcttttctccaattatgtcacccattcccatttccctttcatgaactcagccaaaatctctttaagcatatattcccttttatgataaagtcatttgttttttaaaggggagttaatattctggcaggaaaacttacatttttctgcttcttggagagacctgattgcttcaccgcatttatcactagccaataaagtctcaccatggtaacagtaagcctgatgaaataaacaaattttttattcattctctcccttcaagatgctttcccctattgttttatgtatctatcagataaattagtaccttcatacactgaagtatcaatgcaatcccttacattttagctcttccccaacctttgttcatagaaaaggtggaaatatgtcaagtcttgagcccaaacagccttctaaccatgtactgagaaaaagttatttgctgaaatctgtatttaaaattaggaaatagtagataaaggaggaaattattgtgctaatgcataggaagaaggaggtataagaaatattatctactcagacctgaaaaaggtttctgatgatctctcatatgatattctaattaacaaaacaattaagtttggtgggtataacagactgatacgtaacttccaaaatgatgtttattgatggttcttcactaagctaggtgatatattgtgtgatatgccttaatattagaattagtaaatatgtttctcaatgcacaggatgaaacaattgaaagaatttcattaagtatgctgcaagtgggttttcaatcaaacaataattctattgctataatccacttctacaatcctacatcatctctttccacccactttagttcacaatggttgcactgactctcagtgaacatttactgagagttagctgtccattatttgtaaaatgctaatgaaagactctggtgagatgagagacctggcactccaagggctggagaaacaataatttacattgtttttagcgttgtgaatacttacataagctgtgtagaaacacatcttcaagtgaagatattttctccatttggcagaatatgcaggctccaaactggataaagtatgatctaaagttacattttaaaaagcaaaatataatttcgccctgattcactagaagacttttagttcatgtgttctgatgataaaagcagaaagaatgccattcaagtctaaaactcaagaatttaatttttttttaaaaacacctttacttgattttaccaaatctatactttaagttacataagattggttaaatactatggcagctctttgatttgatggttaatacaactttaagttaaagataatgataaaaacagattgtgaccaagaacttcaaggtgaatactgtttataccgttatattagctaatttaaaaaacttatataatatagcaaaacaaatagtagtctagtcactcaaatcagaaataggatactctcctctctacccccatcactgaattttatgtgaaacacacacacattcactcacatatccttctaccaaacatctctcaaatctattttttcctatttgctacgttgctgtatttgccaaagctttcatcatttccttcataaactttaagaatttcttaagtgctaagttaagttagcctattactccttcatgtagcaagcctatctctaatactgcaactatagggacctttcttaaattcaaatccaatcaagtcaggcttttaatgtagatacattcccaagtatctacagaatggcttacaaaccagtgtttgattccaagcatgcatactttttcaaactcttctcctaccactcatcctgtgtttcaggtcactgtctgaagtttccagaatgtgctaagttctttcttatgtctgtacttactatagaattctacacccaaactctaaagcttcctagggaacataagacttttatttacacttcacaataaggctaaagcatcttcttctagagtccttctttagcatgcccagcttgttaaggttcctaattcgccgctgtgatgtcttacttcaggatataataacggggttacatgtttgtcttcttccctaaactgcagatcttttctatttacctctccttagcaacaaaaacagtaactatcccataaataaaaacacatgcatgtttcctaaataagtaaatgaagagtaataggcttatcacaggagctgtgttctacgcccaatctcccactttctagcagttgaattatgggtcatgttaactctctggattttggattcttgtctaaagcatagtaactataaggttgttataaacactaaaaaaaaattttaagcaaaaaagctgtataattttatgagacatcactggttttcccctccattagaagttatgcagcatactaaacatgaacagctctattttaaatgcaataaataaaatattactccagttttgcaaataatgacagaatctgagaacccttttgttttgttccctattcaagatcaaataaatctgaaaatctaaagactaaaaatgtaacgacagaattagaagcttaccagctttttgatagaaattggctgtttcatacgccagtgcagcaattagtccaggagcatgttttagttcaattgctcgagcaattgttactgtaaccaaacacaataaagtgaatctataattaagctcactttattcatcctaaattcaattataatagcaaaagacagtctgataatctctctgggattttaatacagtttgttaaacgttttaacgtgcaaacttatagaaaatgcaaacattaacaaaaaaacactgagtttgttggttccaatgccatttctttaaataaatcatcagcaaattaccagctaatcatagagaatcacttgaaccgggaggcagaggttgcagtgagccaagatcgcatcactgcactccagcccgggcgacagtgcaagactctgtctcaaagaaaaaaaaccccactacaattctacatctaattcaggatcagagctttctaatcactataaaagcatcttatattttaatatgaaaaaaatcaacactggcctctaggaggccttcaataaagtgatttaattagaatgacgtagggggacattgtttaaaagacacaatattctttctcctaattcccatcacatctcctggcaatttaatacaattagagtgcactgattgtcactctaaagtttttagtgagatacagagcatacactcagaagttcagttttgcagaatcaggactgctcctggtaacttctgtggagagcaatgaggtaggtaagaaccatcaatacttctactttcttttctcctgtcttttcaaagacacagaaaaataagcagagcactaaaacttaagttttctaattgtaaaagtcactggtgattttaaaacaaaaatggagacatttaatatttagtaactggctgcactcatcaataacatacttaacataaggaaaacagaacacatagtaccttttttaatataatgaaacaattctttccccatatcctcccaaaagaaaaattattcaagaattaaagcattaagaac

SEQ ID NO: 4125 - DNA, 7725 bp, Homo sapiens
ctctgaactccatgtgcttcagttaaccctttcccaatgcggttctccgatcattttgttttaaaaactaatgttttcatgatggagactgctaggtcacattccccaggtaaagatattcaaattatagaaaccagccaaaggtttccatgaggaaggatatactgattttggacttagactttttcaaatccttttttttaacttgatataacaagagaggagatcacacttctgagaggcaggctcacatgcttcatgtgaaagcactttgtacacagtaagttgctacccagtgtcagctattatgcatggtacaggaccatacttctcaactacagtgtgtacacccctgggacatgaagccaccaaatcaattgtctgcattttctttgggtatacattttaccctatagcaaatactttaaaatatgttttaagtaaacagatatcatggagtaaaatgtaaattttatatttatgtgataaaaggtgtcttaattttcttatatataaattgttattgatatgtgaatgttagcacgtaatagggttgtaggagggttgcattcttatagataagtagggaaacatgctgagttgactgtgtttagcatataatagatgctcaggaaatgcaaatttccttcttttctttcactggtaagacaggggcgttcatgtagtttaatcattttaagtatttgaaatgtgttccttattttgaaaatgtcccttaaaatactttataaatactttcaatttttgcttataaattctacatgtataaatagggtttctctagctatcacctgtctataggaaaaaataataagttcatattaaaagtaataactcagaattcattaacattgtctctatcaatgggagcctcccctaaaagtcacagttggttatcttcagctcataaacatcctttcttgttcttggctcaagtcctctaccatataggttgctacttttaaagtaaaattactaaatactggtaattttgagcacctgttcatatgtgtgttggacatttgagtaacgtggttattcatacctattgtccatttttcacatgggctgtacaaatgggacaatatgtagttctacacacattctgaattatatacattgcctatgttttctttcaggatttggaagtattatgtttaatttttcttttttataaagaaatttagagtttacatgcaatcaaatttaataaactttcccttcctgacttgcaccttttgtgcttaagacaccttcccctacctcaacatattgagattatcctgttttcttctaatgggttactggtcacattaggtcttcaatgtgctacacactttaaataatcagatctctgtgactcagaggagaactcactcatcaaccaggggatggcactgagccattcatgagggatccacccccatgagccaagcacttcccgtcaagccccacctccaacactgggaatcacatttcagcatgagatttggggaaaataaatatccaaaccatatgattccaaaaacatgatccatgaaagaagaaattgaaaaattgagctttatctactgtatacatgtcaaaaaatttaaattgcacatgtgaaatatgtgcattgtgttgtatgtcagttatgcctgaataactctgttttaaaaataacaggaaaatggatcccattttctaagaattctggaggtggttgtataccctctgaagatgtctttcccaggaagaaggactatcttgcttaaaaagttatttcttatatttcaccaaaatctcttttactgtactgtaaacattttattttccctttaaaaaatagtaacagctcaccttgcttcattttgaatgttgaatcacttttggtggtataatcttacatagtttggatcccttataagctgaaaagtcgtgagatggagagtaaatataaggagatactcttgctaaccagcctggataacatcaccgatgaggaactggataggtttaagtgctttcttccagatgagtttaatattgccacaggcaaactgcatactctaaacagcacgagtagccaacttgatttaaaacgctggcatggtgtctgcagtgaggaagaccgtatttttcagaagctgaattatatgcttgtggcaaaatgtcttcgggaagagcaggaaacaggtatatgtgggagtccctcatctgcccggtccgtttctcagtcaagacttggtctttcctttcatggcatttctgggaatgcatgttgatgagggaaacgggatgacactaagctattcatgagggatccaccccccgtgatccagacacctcccatcaggccccacctccaacactagggattgcatttcagcatgaaagtcccccagggaaggctgctggaatttgtttgctaacttactacaccagcctcgttgcccccttttactgagaaatcactcctaggaagtgtttgttacaaattccacaaatccatcccagcctttgtttgcatctcttgttccagcccttagggctgccacttccatttgtcatattttcacttctccagttcaattgcagcgaacatgaacatggaatttcaatcttaacttctcaaaacctcatttacatgtttaccaaagattttaagataaaggaaagaaatcatagcactggaaaaaaaataaactgggatactaggtcgttttgttcttccacacagcctgctcattcttctccctgtccccggcctgctgtggtcccagacgatcctttcttcttcaagggagtcttgtattcatacatccgctctttcaaattcaaatattatttatccttctctctatttccttccactaatgacaacaaactacccgcacacaaaaactgtttttatattattggacaaatcattgaatgtctccatcttatctgcattttgtttacatttctgatctttttctctataattaatatatcctttatttatgtctgtataattaaaattgaccaacaaaggagcatctcacactaggatcccccaaaatgagagcctccaaatgtaacaatttagagatttttaagttcaactctaacagcaaaacttatacgacatcttttactccgtgtgtgtgtgcgcgcgcacgcacgcaggcacgcaacatggataacatggtttctatgtttacatgatttctatgaagtcgagatgaaaccatgtaagtgataatataagccacagatctatacagatataaactgttaggcaatatttaaggcgctttagcgaaagggcttgttgtcttatgcattatatttttctaggttattcaaagtcagaaagtgtagtgcttaggtattgccacaaggtggcagtaacttcacataatgtgcggaagcaactaaccgacctgcagaaatcaattaagttcctttacagctctaaatttctattctagatcacgcctaggcctactttgaaagtagcaaatttatttatttgtgccccatgctacccttaactgtccctggaggaaaccagttttttgttgtgttttctgtaggtttcaattttcattccttcttgaaagttctttctgcataaccagtgctatgcctgcatgtggagcactatacagtattctacccacgatctcacctcatggaagatagaggagatctggagaaatctttaatgaagacggttaataatcattttatgggaaagatcagtagatggaaagagagatgacaaagtatgaggacacttaagcctggaaaaaggaagctgagagagcttgtgatcaaattctgtaaaagtcctgcaagattaaaatagaaagttgaaaatgataaatgaaataataagtgagaattctgcatctgattattaatgaaaaagagatttacagtgggcagacatactcgtccacaaatatcggtaccactgtgtgggagatgaaatatgactgatgtgatgtggtagaatgataggctgattcccttggcctcccttcactctgttttttctcgtatactctcaacacagaagggaaactttatcttcatacctctctgaaaccagtttcatgaaactaagctacctttgaaagttagttttactacttcttagagtagacattcctttacactaaccctgacagagtccatgactttctattgtttgaaatgtagtgacatattgttagatatatagtttacaaatattttatcccattctgtaagctgtcccttcattctgttgattgtatactgtgcagaagtttttaagtttgatgtaatctcatttatccatttgtgcttttgctgcctgtgctttcgaggtcttattcaaacaattcttacacataccaatgtcctaaggcattttctctgtgttttcttctagtagtttcatagttctggatcttacctttaagtctttaattcattttgagtgactttcacatgttgtgaaacataagagtctaattttattcttcttcatgtgattattcaaaacatataaggaattcaaagaactcaatacttggtataaaataaacaaaaacaaaataaaataacctgattacaaagtagataaaagcctgaatagacatttctgaaacgaagtcatacaaatggccaccaggtatatgaaaaattctccacatcaccaaacattgagtaatgcaaagcaaggccataatgagatttcacctcatcccagtttgaacggctattatcaaaaagacaagagataacaaatgtcagcaaggatgtggagaaaaaggagctccttacactgttggtgagaatgtaaactcataaagccattatgggaaatagtatggaggcgcctcaaaaaattaaaaagagaaataccatatgatgtagcagtcccacttcttatagtaagaagaatgaaatgagtatgttgaagagctctctacactctcgtatttattgcagcacgattcacggttatgaatggcactattcacaattcacattgattgatgtggattcagcctaagtgtccactagtggatgaatggataaagaaaatgtgaaggcacatgctgacaaacatacagatgcacttaaatttatactaaaaatcactggactgcgttgctaacttccattagggaagaatgtagaacagaccatgggattctttcattgccaggttcatgtgaccctttccatatggtcaacaccagaccagaaatttaatcagttccagcccaagtgccatcaccaaaatgtgagaaggctgcccactgctcaaaggttttcaattaagataggtactcctggctgggtgcggtggctgaggcctgtaatcccagaactttgggaggccaaggcgggtgatcacgaggtcaggagatcgagaccatcctggctaacacagtgaaaccccgtctctactaaaaatacaaaaaaaaaaaaaaaaaaaaaaaaattagccggccatggtggccggtgcctgtagtcccagctactcgggaggctgaggcagcagaatggcgtgaacccaggaggtggagcttgcagtgagctgagatcgcaccactgcactccagcctgggcgacagagcgagactctgtctcaaacaaacaaacaaacaaaaagataggtactctttttttgaacatgtgacatgggtgtagacaactgtgtttcagtttgactgggaagataaaagtgttttctttatagaggaagaaagcccaggtctgtgccctcagggcaggctggggaaattgaaagtgtggtttgggtaagacggtacctggtagaaaggacatccatgcagaatcagtgcacattgagtgcaaaaggtggctttggtggctagacaaatggccctttgtaaggaaggctatgcacactggtgtcagcagctctggccagttctagttgaatctacagaacctgacagggcatgattgatgaacccctaagttagaaacacctgggtccaggtaactgaggactgttccacacatacaaaaagcatggagaaagacgtgtggcttatcaatgaaaagtaaaatgttaagcccttcactgactgaacagatcccttcttggccaaggggaccccaggaaaaccttaaaactgagtttctggccatgatgggtgggaggtcagacacacttcactataccctacctcccttttatggtttagacacaacaactgatcaggattgttaaaacagagatcataaaactgacagaacagactcttcatggccaaaaaataccaaattatacacaggacctagggccatgccaggcaaagattaagtcgtgcactccaacacttaaagaataaataatgttctagtacttccagtccaggccagaggaattaggcaagagaaaaaacaataaagggcaagagtaagtcaaactatccttttttgcagataacatgattctatatctaaaaaaccatagtctcagccccaaagctctatcagctgataaacaacttcagcaaagttttaggatacaaaatcaatgtacaaaaataagtagtattcctatacactaacaactgccaaccggagcgccaaaacaggaattcaatcccattcacaactgccaataaaagaataaaatacccaggaatacagctaaccaggaaggtgaaagatttctacattgagggttatagaacacttctcaaagaaatctgagatgacacaaacaaattgaaaaacatttcacgctcatggataagaagaattaatttcactaaaatgtccatactgcccaaagcaatttacagattcaatgctattcctatcaaattaccattgacattcttcacagaactagaaaaatctactctaaaattaatatggaatcaaaaaagagcccgaatagccaagacaatcctaagcaaaaggaataaagctggaggcatcatgttacctgactgcaaacatactacagggctacagtaaccaaagcagcatggcattggtacaaaaacagatacacagaccagtggaacagaatagatagctcagaaataaggccgtacacctacaaccatctgatctttggcaaagctgacagaagcaagcaatggggaaaggactcccttttcaataaatggtgctaggagaactggctacccatacgaacaagattgaaactagacctcttccttataccatatacaaaaatcaactcaagctggattaaagacttaaatgtaaaacccaaaactataaaaatcctgacgacaacttaggcaataccatctggacataggaacggtcaaagatttcataacaaagatgccaaaagcaatcataacaaaagcaaaaattgaaaaatggaatctaattaaacgtaagagcttctgtacagcaaaagaaactatcaacagagtaaacagacaatctatagaataaaagaaaattttgcaaactatgcatctgacaaatgtctaatatccagcatctataaggaacttaaacaaatttacaagaaaaaaacaaacaaccttgttgaaaagcgggcaaagaatgtgaacagatgtttttcaaagaagacatatgtgtggccaaaaagcacatgagtaaaagctcaataggactgatcatgagaaaaatgcaaatcaaaaccacaatgagatatatctcacaccagtcagaatggctattattttattt

SEQ ID NO: 4126 - DNA, 591 bp, Homo sapiens
cctgccttggcctcccaaagtgctgggattacaggcatgagccaccacacccggccatctcctgcctttttttttttggatggagtttcactcttgttgccgaggctggaatgtggaatgcaatggcgcgatctcggctcactgcaacctccacctcctgggtgcaagcaattctcctgcctcagcctcctgagtaattgggactacaggcaaacatcaccatgtccagctgtccccagctttctaatctggtctttctcttgccccagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaa

SEQ ID NO: 4127 - DNA, 2188 bp, Homo sapiens
gggcaggagaagagactcgagcggcacccgagccgcatccacgccgcccgcccgcccctggggtctgggtaggtaacgggcccggcgggaaggaggggctcccaggccgtccctcccagcgctcacctcagctcctcgtcgacattcccgcggggctgttcggccgacgccaccatagaggaagtcgtagaggtcttgttcttcaagatccccttgatgggccggtgcgaggccgtcgaggccgccattgccgggcgctccggctgtcggctcagggtcgctgcttggcgtggggtccgcgaagagaagggtcggcacagcagagactcgcaggcagccgcagatcccgctcagggctaaagcggccgcaactgctgcctcggaaacggctaccgcagcggttgtcacgacacaacgaccccgacgccagagccaacgccgaacgggtggcggctactcgcgcacccttagccactggcacttgacccgcggctcgcggagagacgccggcctagagctccagcgcaggagcgacgcgacgccgaagccaagcggacccgccctctcgcgatatctagggaggaggcggggagagggcggggcgagaacaaagccgacctcctcgccccgccccctccgtcccgcccgggctgctcgccccgcccccgcgcggcgctgggaggcgggagctgtctctgagaacctgcgggagagcgcccgggcttgctgcttcccggacccgcgcgtctctcgagcaccctcgtcccaccaccttgtgaggccgtagtgttatttttattttttagatcagcagactgagactcgaggtgacgtcactccgcagagaggttagctgacttgaagaaaacgggtatctcctctttccatttcgcccgtgtaaacagccgaactgcctattataaaagcatggactgccagcattggagtggtccttagaggcctattatgaaatcatagaatgtctgcattggaatcgcctcacctccttttaccgctggagaagccgacggacagacgggcagcgacccccgccgtcgcacaacccgtctaggcagagagcgcaggagacgggagggcggcagggacacatctcccagccaaggacctcctgggcccgcagaggccgcgacaggttccccccacagagggaaccaactctgccgcaggttgatgtggacttcaagcctgcagaacggagagcccatttccattgcttaaagccacctcgtgtgtggtatttgttatggtccctgtacactcccttccctccctctcccaagtccagtccgcagctcgctcatcaccaggctcttttccatgactctttcttgatcaggcctttttatcgtcctcaccacaggtaatccctccccggaaagagaagatcacagattttgtcatattaaatacattgtagaaattcatggtagcaggggcaagatcatttaaacaaaacagaaagtttcagagagagaaaaagccaaggacaaagattaatcatttttctgcttaaaaaaaatggctttgatttgcaaccatggaatgctccactgtttctcttctcttcaaagacatctactgaaaggattccttaaccttaccaagtggccaaaatacttttctgagaagagtcacagagcataggcccccctagggtacacagagatttcattagtccctagatgtttcctgatccttttaaaaactggttaaattcagagactctaggcaattacttctttcagaacctgtgaggcaaaaacgaaagaagaaggcaggacacgcagtgtaacaaaccttggaatggacttcgccagacttcatcagaagaaagcagtgcaagaggggactgcagaggaaagctggggcttgggaaaccagcagcaggggccacgtgggcaggtggtttctgtgtgaacctctgatctgtgcaacataaacaggaaatgttgaaggcttccagtgctcttttttgatgtcgagaacattctacggcacaaaagagtttgcctctcactgtttctcatatatggaggttttctaatcagcatcctgaacagaattgaattaaaaataaaaaccaaagtaaaactagctttatctctagattttaaaattttcattttttttagggtggcacctatactgttaccttgtaggtaccaac

SEQ ID NO: 4128 - DNA, 7805 bp, Homo sapiens
ctctgaactccatgtgcttcagttaaccctttcccaatgcggttctccgatcattttgttttaaaaactaatgttttcatgatggagactgctaggtcacattccccaggtaaagatattcaaattatagaaaccagccaaaggtttccatgaggaaggatatactgattttggacttagactttttcaaatccttttttttaacttgatataacaagagaggagatcacacttctgagaggcaggctcacatatttcagagtctccctatggacagagtgtcactgctcttgacctcttaacacctgtacacttccatgatgacagtgcaaggcttcatgtgaaagcactttgtacacagtaagttgctacccagtgtcagctattatgcatggtacaggaccatacttctcaactacagtgtgtacacccctgggacatgaagccaccaaatcaattgtctgcattttctttgggtatacattttaccctatagcaaatactttaaaatatgttttaagtaaacagatatcatggagtaaaatgtaaattttatatttatgtgataaaaggtgtcttaattttcttatatataaattgttattgatatgtgaatgttagcacgtaatagggttgtaggagggttgcattcttatagataagtagggaaacatgctgagttgactgtgtttagcatataatagatgctcaggaaatgcaaatttccttcttttctttcactggtaagacaggggcgttcatgtagtttaatcattttaagtatttgaaatgtgttccttattttgaaaatgtcccttaaaatactttataaatactttcaatttttgcttataaattctacatgtataaatagggtttctctagctatcacctgtctataggaaaaaataataagttcatattaaaagtaataactcagaattcattaacattgtctctatcaatgggagcctcccctaaaagtcacagttggttatcttcagctcataaacatcctttcttgttcttggctcaagtcctctaccatataggttgctacttttaaagtaaaattactaaatactggtaattttgagcacctgttcatatgtgtgttggacatttgagtaacgtggttattcatacctattgtccatttttcacatgggctgtacaaatgggacaatatgtagttctacacacattctgaattatatacattgcctatgttttctttcaggatttggaagtattatgtttaatttttcttttttataaagaaatttagagtttacatgcaatcaaatttaataaactttcccttcctgacttgcaccttttgtgcttaagacaccttcccctacctcaacatattgagattatcctgttttcttctaatgggttactggtcacattaggtcttcaatgtgctacacactttaaataatcagatctctgtgactcagaggagaactcactcatcaaccaggggatggcactgagccattcatgagggatccacccccatgagccaagcacttcccgtcaagccccacctccaacactgggaatcacatttcagcatgagatttggggaaaataaatatccaaaccatatgattccaaaaacatgatccatgaaagaagaaattgaaaaattgagctttatctactgtatacatgtcaaaaaatttaaattgcacatgtgaaatatgtgcattgtgttgtatgtcagttatgcctgaataactctgttttaaaaataacaggaaaatggatcccattttctaagaattctggaggtggttgtataccctctgaagatgtctttcccaggaagaaggactatcttgcttaaaaagttatttcttatatttcaccaaaatctcttttactgtactgtaaacattttattttccctttaaaaaatagtaacagctcaccttgcttcattttgaatgttgaatcacttttggtggtataatcttacatagtttggatcccttataagctgaaaagtcgtgagatggagagtaaatataaggagatactcttgctaaccagcctggataacatcaccgatgaggaactggataggtttaagtgctttcttccagatgagtttaatattgccacaggcaaactgcatactctaaacagcacgagtagccaacttgatttaaaacgctggcatggtgtctgcagtgaggaagaccgtatttttcagaagctgaattatatgcttgtggcaaaatgtcttcgggaagagcaggaaacaggtatatgtgggagtccctcatctgcccggtccgtttctcagtcaagacttggtctttcctttcatggcatttctgggaatgcatgttgatgagggaaacgggatgacactaagctattcatgagggatccaccccccgtgatccagacacctcccatcaggccccacctccaacactagggattgcatttcagcatgaaagtcccccagggaaggctgctggaatttgtttgctaacttactacaccagcctcgttgcccccttttactgagaaatcactcctaggaagtgtttgttacaaattccacaaatccatcccagcctttgtttgcatctcttgttccagcccttagggctgccacttccatttgtcatattttcacttctccagttcaattgcagcgaacatgaacatggaatttcaatcttaacttctcaaaacctcatttacatgtttaccaaagattttaagataaaggaaagaaatcatagcactggaaaaaaaataaactgggatactaggtcgttttgttcttccacacagcctgctcattcttctccctgtccccggcctgctgtggtcccagacgatcctttcttcttcaagggagtcttgtattcatacatccgctctttcaaattcaaatattatttatccttctctctatttccttccactaatgacaacaaactacccgcacacaaaaactgtttttatattattggacaaatcattgaatgtctccatcttatctgcattttgtttacatttctgatctttttctctataattaatatatcctttatttatgtctgtataattaaaattgaccaacaaaggagcatctcacactaggatcccccaaaatgagagcctccaaatgtaacaatttagagatttttaagttcaactctaacagcaaaacttatacgacatcttttactccgtgtgtgtgtgcgcgcgcacgcacgcaggcacgcaacatggataacatggtttctatgtttacatgatttctatgaagtcgagatgaaaccatgtaagtgataatataagccacagatctatacagatataaactgttaggcaatatttaaggcgctttagcgaaagggcttgttgtcttatgcattatatttttctaggttattcaaagtcagaaagtgtagtgcttaggtattgccacaaggtggcagtaacttcacataatgtgcggaagcaactaaccgacctgcagaaatcaattaagttcctttacagctctaaatttctattctagatcacgcctaggcctactttgaaagtagcaaatttatttatttgtgccccatgctacccttaactgtccctggaggaaaccagttttttgttgtgttttctgtaggtttcaattttcattccttcttgaaagttctttctgcataaccagtgctatgcctgcatgtggagcactatacagtattctacccacgatctcacctcatggaagatagaggagatctggagaaatctttaatgaagacggttaataatcattttatgggaaagatcagtagatggaaagagagatgacaaagtatgaggacacttaagcctggaaaaaggaagctgagagagcttgtgatcaaattctgtaaaagtcctgcaagattaaaatagaaagttgaaaatgataaatgaaataataagtgagaattctgcatctgattattaatgaaaaagagatttacagtgggcagacatactcgtccacaaatatcggtaccactgtgtgggagatgaaatatgactgatgtgatgtggtagaatgataggctgattcccttggcctcccttcactctgttttttctcgtatactctcaacacagaagggaaactttatcttcatacctctctgaaaccagtttcatgaaactaagctacctttgaaagttagttttactacttcttagagtagacattcctttacactaaccctgacagagtccatgactttctattgtttgaaatgtagtgacatattgttagatatatagtttacaaatattttatcccattctgtaagctgtcccttcattctgttgattgtatactgtgcagaagtttttaagtttgatgtaatctcatttatccatttgtgcttttgctgcctgtgctttcgaggtcttattcaaacaattcttacacataccaatgtcctaaggcattttctctgtgttttcttctagtagtttcatagttctggatcttacctttaagtctttaattcattttgagtgactttcacatgttgtgaaacataagagtctaattttattcttcttcatgtgattattcaaaacatataaggaattcaaagaactcaatacttggtataaaataaacaaaaacaaaataaaataacctgattacaaagtagataaaagcctgaatagacatttctgaaacgaagtcatacaaatggccaccaggtatatgaaaaattctccacatcaccaaacattgagtaatgcaaagcaaggccataatgagatttcacctcatcccagtttgaacggctattatcaaaaagacaagagataacaaatgtcagcaaggatgtggagaaaaaggagctccttacactgttggtgagaatgtaaactcataaagccattatgggaaatagtatggaggcgcctcaaaaaattaaaaagagaaataccatatgatgtagcagtcccacttcttatagtaagaagaatgaaatgagtatgttgaagagctctctacactctcgtatttattgcagcacgattcacggttatgaatggcactattcacaattcacattgattgatgtggattcagcctaagtgtccactagtggatgaatggataaagaaaatgtgaaggcacatgctgacaaacatacagatgcacttaaatttatactaaaaatcactggactgcgttgctaacttccattagggaagaatgtagaacagaccatgggattctttcattgccaggttcatgtgaccctttccatatggtcaacaccagaccagaaatttaatcagttccagcccaagtgccatcaccaaaatgtgagaaggctgcccactgctcaaaggttttcaattaagataggtactcctggctgggtgcggtggctgaggcctgtaatcccagaactttgggaggccaaggcgggtgatcacgaggtcaggagatcgagaccatcctggctaacacagtgaaaccccgtctctactaaaaatacaaaaaaaaaaaaaaaaaaaaaaaaattagccggccatggtggccggtgcctgtagtcccagctactcgggaggctgaggcagcagaatggcgtgaacccaggaggtggagcttgcagtgagctgagatcgcaccactgcactccagcctgggcgacagagcgagactctgtctcaaacaaacaaacaaacaaaaagataggtactctttttttgaacatgtgacatgggtgtagacaactgtgtttcagtttgactgggaagataaaagtgttttctttatagaggaagaaagcccaggtctgtgccctcagggcaggctggggaaattgaaagtgtggtttgggtaagacggtacctggtagaaaggacatccatgcagaatcagtgcacattgagtgcaaaaggtggctttggtggctagacaaatggccctttgtaaggaaggctatgcacactggtgtcagcagctctggccagttctagttgaatctacagaacctgacagggcatgattgatgaacccctaagttagaaacacctgggtccaggtaactgaggactgttccacacatacaaaaagcatggagaaagacgtgtggcttatcaatgaaaagtaaaatgttaagcccttcactgactgaacagatcccttcttggccaaggggaccccaggaaaaccttaaaactgagtttctggccatgatgggtgggaggtcagacacacttcactataccctacctcccttttatggtttagacacaacaactgatcaggattgttaaaacagagatcataaaactgacagaacagactcttcatggccaaaaaataccaaattatacacaggacctagggccatgccaggcaaagattaagtcgtgcactccaacacttaaagaataaataatgttctagtacttccagtccaggccagaggaattaggcaagagaaaaaacaataaagggcaagagtaagtcaaactatccttttttgcagataacatgattctatatctaaaaaaccatagtctcagccccaaagctctatcagctgataaacaacttcagcaaagttttaggatacaaaatcaatgtacaaaaataagtagtattcctatacactaacaactgccaaccggagcgccaaaacaggaattcaatcccattcacaactgccaataaaagaataaaatacccaggaatacagctaaccaggaaggtgaaagatttctacattgagggttatagaacacttctcaaagaaatctgagatgacacaaacaaattgaaaaacatttcacgctcatggataagaagaattaatttcactaaaatgtccatactgcccaaagcaatttacagattcaatgctattcctatcaaattaccattgacattcttcacagaactagaaaaatctactctaaaattaatatggaatcaaaaaagagcccgaatagccaagacaatcctaagcaaaaggaataaagctggaggcatcatgttacctgactgcaaacatactacagggctacagtaaccaaagcagcatggcattggtacaaaaacagatacacagaccagtggaacagaatagatagctcagaaataaggccgtacacctacaaccatctgatctttggcaaagctgacagaagcaagcaatggggaaaggactcccttttcaataaatggtgctaggagaactggctacccatacgaacaagattgaaactagacctcttccttataccatatacaaaaatcaactcaagctggattaaagacttaaatgtaaaacccaaaactataaaaatcctgacgacaacttaggcaataccatctggacataggaacggtcaaagatttcataacaaagatgccaaaagcaatcataacaaaagcaaaaattgaaaaatggaatctaattaaacgtaagagcttctgtacagcaaaagaaactatcaacagagtaaacagacaatctatagaataaaagaaaattttgcaaactatgcatctgacaaatgtctaatatccagcatctataaggaacttaaacaaatttacaagaaaaaaacaaacaaccttgttgaaaagcgggcaaagaatgtgaacagatgtttttcaaagaagacatatgtgtggccaaaaagcacatgagtaaaagctcaataggactgatcatgagaaaaatgcaaatcaaaaccacaatgagatatatctcacaccagtcagaatggctattattttattt

SEQ ID NO: 4129 - DNA, 2422 bp, Homo sapiens
ccctctggttggcgagcgcctttctgcgccttcaggcatttttgctgaggcttttgtctgcgcatgtgcggcgttccttcaccgggatcttcattgtcccatgttgggcgccaggaatgctggggtgatcagacccagcaccaggccatgggggctacaaagtctggcagagtcaaaggaatgagaaaagacaagttaaaagtgcataagcagtgagatctcagccaggccagaaaaagctgccatgccaaaagcggccgacactaactccacgcggtgctcctggaaacgtcgggctcccagctcccatgaggcagaaaacgggcatctattcttttaacataccaaatatttgagcacttaccacgcgtcgggcactgatttacagcacagagtgaaactaagtccctgcccttgccttgctgagcttgcattccatcttggaaggaggaacagacaataattagcaaaagtacaatgactgaggtatactgcgttgatcacgaccttcactctttcggcctgcaacacctcccctcttcctgggtccaggccccagaccccgccacgcctcctcttaacctacatgatcagggccaggcagaggaaaagaagagccgtgatgccgattcccagaaacgctccgttggagaatgccgttgagatgagtcccttcttatctgcacacggagagggcaagatgccacgggtctgctgtgtccctccaagctcctgctccaaccacaggaccctactctttgccccagtcagcttctcctccaagaaccttggcatccaggcggccccctaacctggcagctgcaggatggatccactctgggccccatggacgttccaggcctcacagcggagcctgaggccggagctgagccctccatggaggctcagggagctgttggcccagggcccggctgagctgggggtgacctcgaaggagtcctggctgctgttcccctccagcagctcctccccaagccaccagcgcagagagggggccgggctggcctgggaggagcagctgcagtgcagaccctcagcctcccaggagcaggaggggcccagcagcttcggggagtctgaggggagggaggacaggactcagcagggtccccttcctgggacccaggtgtcccctttcccccactcacagtgcacggagaggctgagagagacgtgctgggagcccagtgggtgccgagcgtggcaggtgaactctccttcgtgctccacttgaacccgaggcagctccaggaccccggggtctgagggctgggaggggctcagaacctgtcccctctgggtccagctcagcctggctggggggctgctgtgtgtgacacagaccaggcacaggctttggccctccagtactgggagagacgtgccgttcccaaggttttccaggactagggaaggaagaggcagaatcgatgagcagctcagggctcagggaccctcctgcgtggggaccctccagactcctgggcccccaattcggcactgagaggccttggctcctctgtcccctttcctacctgtcctgtttgcttgggaaaccatcactctcaggttctctggaggatctgaaatggagacaggggaccggctctagacggaccaggggcttccctctgggtaaagggaaccatcctggacactgaggtgggggaagtgggtgggatagaagggcagggcagaatcacccactgagtcccagacacaaactgcatgagggtctacacaggtaagaaggtcggtctccgaggcctggggctccaggccccctcagctctgggaccctgagcccagcccctgtatccctctgccctcccaatggactccaggcccctgctgggcacactcacactgcacagagaggtccagggctcgctgctgggagccaagcctgttctccgctcggcaggtgtagcgccctgaatccccagccttcaccccgggcagctccagccccaggggtctagggccccagggatgggacgaggagaggactctgttctgcaggacccagctcagtgtggcagggggctggctgtcagcagcacagaggagccgcaggaactggcctttttgggcttccagggaaaagaaagtgggactatcccgggaagacaagtgacaaccagcgccagggctcacgtgtgtggaccagacgccattcccatccccctcccagggctgcggcggcatcctgggaccccacagcttcctctccctggatgctcctgagctgggagccgctcactgtcccactgggctcctccacctccccacccaccggggctgtctgcacaccccaccctcccaggccacactcacaggccacacggagtcggacggtcctctgtgcgctcacaccctttctggagaagtccacatggca

SEQ ID NO: 4130 - DNA, 1669 bp, Homo sapiens
ctctgaactccatgtgcttcagttaaccctttcccaatgcggttctccgatcattttgttttaaaaactaatgttttcatgatggagactgctaggtcacattccccaggtaaagatattcaaattatagaaaccagccaaaggtttccatgaggaaggatatactgattttggacttagactttttcaaatccttttttttaacttgatataacaagagaggagatcacacttctgagaggcaggctcacatatttcagagtctccctatggacagagtgtcactgctcttgacctcttaacacctgtacacttccatgatgacagtgcaaggggctattaattgggccaggcgcagtggctcacgcctgtaattccagcatgttgggaggccgaggtggtcgaatcacaagttccggagatcaaaagcatcctggctaacacagtgagacctcgtttccactaaaaataccaaaaattagccaggtgtggtggcaagcgcttgcagtcccagctactcgggaggctgaggcaggagaattgcttgaacccaggagacggaggttgcagtgagcggagatcgtgccactacactccagcctgggtgacagagtgagactccgtcaaaaaaaaaaaaaaaaaaaaaaaaaagcttccttcttacgagaacatgaggatccttggactgaaaaggtccagagaatgaagggaaaatctatacaaaaacacattatagtgaaactgaagaatataatgaacaaaaatactctgtaagccttcggtaatgaggaatagatcacctacaaagattcaagaatcaaattgaaagtgaatctctatatcaaaactgcctgaagcaggacaatggagttatttttatataatgttggtccaaagttccatatcaattgcaaaaccaaaaaaaattttcaatggaaagttttgacttattttgtgagtgtgctagaaacaataagttcgtcttcaaactttcctgttctttcctgttctgtaaacaacccttccttcctttgccgccccagacatgccttcccgcctaattggtacaggacagtgtcttccttcccgcctaattacccctatagaatttaaagcagtagccaatccggtcagcttagaatgtgcattgtgactgacgcaggcagcacccttctgtagaagcaaatatgctttgctgagaaatttcctgtttaagtgctggtttttctttgtggcactgagcacttgtttccaacaagtgtgacagcacaatttatttgcaaaataaaaccagatttgggatgacagtaggctatgtataatctttatttcactgaaatgtgaacactcacatgttttgttttgcaatattagtgcttttgattttggagtaattatttatatcccaatggagtttctagtaagacactatttagaatatatacactaaatagcctttctgaagcctccagattcttaacttcaaaatgtatctagctccacagcacagaagaggtgctttcatcttgtcttaagggaaaatataattttacattttagagttttaatttaggcaaaatgatatttaaatagaagagtctcaaaaactattttgtgatactcagggcctcagtctttttgcaagacaaagactcataccacaagaaaa

SEQ ID NO: 4131 - DNA, 935 bp, Homo sapiens
gtaattatccagttgatatttatcttgttccagtcacctttagaaagctgtttggcaagggcagtgactggaagctgggagagagggtcaacagctgaatctcagcctgatggaggccaccatttaataagtaaatacatgcacggctatttagatcctgcatcagacaggtcatcagaaaacatgaagctaaatgcagtaaagaattactctcttgaactcttgaaaatatcaaaaacatgaagctaaatgcagtaaagaattagtctcttgaactcttgaaaatatcattttcttatagaaatggtttaaaaatttcttttttattatttctaattttccttcagaaaattgtgagttttaacctacaacacatacactccaaggtaatgccactctaatgctgtctagttgatctgaataactaactggtcaattatcagatccaccaaactgtctctctggagattaacttctgccagcatattggtttctgttcattttcacaagattgacaggctcattacagcaatattaacatcttcctttgagcactcacactgtgcaattgtaattttgcatatgttgatgagcaggcaattacatcaaagagtgaacactgggctgatgtgcaaggcactatttaattataaaaacagtataggattgagccctgtcactgagtcttccattccttctatctcgcctgtttctaatttatttctctatttcttcatttcttccttgactgtcttcattctttgctttttatttctttctccttaaatgacagaccttttcttagatgccatttctctatgtctgcgcttaagacaagaatttttttcctcctagttgttggttaatgtctgcaaatgtgagagcatgttaacatgacaaacaacaaggaatttgaaataaacttaaatgaaaca

SEQ ID NO: 4132 - DNA, 2052 bp, Homo sapiens
agtctccaggctttgaagtattcacaggaaactcagcaaagagaaatccagttactttgagttactttgggtcggtggatatattgtttgtttggtttggttttacagcagctggtggtgaagcccaagccccatgtgctggcaccaccggaaattaaaatgccttctttcttcttctacctgagacaagagatttttaacattgcattttgtaattcaagggaacgaaacatagaagcacacatgttgagttttccccatgttctaatgaaaattcagagctttgcatgcttttcgcatataagtgtatctttctgaatttatagcactttcaatatatgaggcatttaagagtttacaaaatgtgtttgtgtgcattagctcatgtaatctttctaacaaatcaaggcagtgagctggttacctctggtttgcagatgagttggccgagagaaaggtgcagagacttgcccagcatcacttagctggtcggtgagtggcagaccacagccctgtgtgattccagagggaatacttccagctaagagacgcttctttcaatttattggtggaaactttttataattcctgcctgtgagagaaacagaagaacacagcttgtttgggggatcccagatggagtttgcaggatggatattagaaaaaaatcatctcttttgagtggtagactgagaaatttaaattggaacagcgatgaaaaaccatacacgtcgggagatggagtgggggtgaggcaacccatgaagtcagttttgcatctgtaaaaagtcattttggagagtcgatctgcactttaagaattcctaatgggtacagtcagttcagacccagctgaatgtgttggagtctctgatagtgttcttctaattaaaggggggtggggagggaaacaataacagacacacaaaaacacacactcaaccaaagatgggggaaatgtgagcaccagacatgctcgtgctgatttggggatgacagttgaagagacaagaacattttatttctaacttcgtcattttgtcccacttaagcagaccctggtagaaggatgcctgcatttgggaagtgacaccaggaaacagtggtagagtagtggaaaagtgagtaaggctagggaagtcaatgaattatcaagcttgctaccttgtggataactgggaagaccacttaggaaccctgggcagcagaatagaatgtgtgcttcagaatgactccccccgaccctcgtgatgcccctgtcccctgggggctgggggagctgcagtacatatctaccaaatctttctttctttcttttttttttctttttgagatggagtctcactctgttgcccaggctggagtgcaatggcacaatcacggctcactgcagcatcaacctcccaggctcaagtgatcctcccacctaagcctcctgagtagctgggactacaggcatggtgggctcttcaaagtagaggatgctctatacacaaaggagtttgttctttgaattatcttttatttattgacagctggggtgatgcagggctgtttcctgtgttaagagagtgtcagttacttagctaatcatatttatcacccaggattctttatttgttgatagcactggagtatattggagtttttgtgtgctacgtgtatatttccctagctgcagtgaatgtggtttttatatttatgtgaaactgctaatgtgttgctcgctagatcatgagcaatgggcttctgacagctctgttcattagtcagcttgggggaaaaaataaaagaaaacacattgatatagaaacagagtgtgagccagcaattatcatcagagagcacaaaattacttgaagtcagaagtttgagaccagcctgggcaacatggtgaaaccccatctctattaaaaatacaaaaattagctgggtatggtggcaggagcctgtaatcccagctactcgggaggctgaggcaggagacttgattgaaccagggaggcggaggttgcagtgagctgagatcgcaccactgcactccagcctggg

SEQ ID NO: 4133 - DNA, 774 bp, Homo sapiens
atgacccaccaaacacatgcttgccatatagtcaaacccagcccctgaccactaacagaagctctctcagctctactaataacatctggcctggccatgtgatttcactttaattctactactcttttaaccctaggcctattaatcaacacactaactgtataccaatgatgatgtgatattatctgagaaagtaaatttcaaggccaccatacaacagttgtccaaaaaggcctccaatatggaataattctatttattatctgagaagtattcttctttgctggtttcttctgggcattctatcactctagtctagccccaatgccagaattaggaggacactgaccccccaacaggcatttttcccctcaaacgcttagaagtacctttctgaatacatctgtattatttgcatcaggagtttcagttacttcggctcatcacagcctgatagaaggaaatcgaaagcaaataattctagcactatccatcacgattaccttaggtatttacttcaccctcctacaaatctcagtactttgaggccccttttactatctctgatgggatctatggctcaacattctttacagccacaggctttcatggatttcatgttattactggatcaacatttctcactatctgcttcctccgccaattaaaatatcactttacaagatgtctgaataggaatagctccagtctgcagctcccagcatgatcgacgcagaagatggtgatttccgcatttccaactgaggtacctgg

SEQ ID NO: 4134 - DNA, 735 bp, Homo sapiens
ttcctgtcacaaggacatactgttttagtgaactccttagttttttttggttgaggtaatgaatgtgaagcccctttgatttttctgcccgatctaactgaactcctgctacatttgtagcaacataagttctgtaggcatacatcagtcatgacaaaaacagtacatctgtatacagtggcaagtggatgcaccctgaaaaatctgtagttaataattctctgctaagaaacagtatttttatctaattctggaaactcattaattgctaggaatctttaaaacaaagacaaagctaataaaatgtcaatatatagccaattaaatgttttcaatagttacagcacattattggcctgccattttcccccaatgttatagccccttcaaatatttctacagctagctttcatgaatctaagtgggtgttaatcattttaattaatggtttaaatataatggtttaataccttagtacaggttaaaagcttcattaattgtgttagttttgatgaaaaatgtaagttataatcttatttaaaaaacagacaaaccacagacttgcacttttatttgccctgggctgaaaatgtgccaaagtcccacttaaaattttttttttaatgcttgaagcttttctgaccatttgatcttgtgttggattgtgttttgtaataatctaagcaagattgctttatgctcttccccaattaaaaacaagaatgatgaccttca

SEQ ID NO: 4135 - DNA, 5767 bp, Homo sapiens
gccccggcccgcatacaacgctgtctgcaccgctcccctgccttcttccgggctcccagagcaccgctatggagatgctctcccggcatttgaggaagaattgattgtcctcatcctgcaactgtacttgcccaaccgatatttattgatgcctgcagtgtcctgggtgcctaccaaggggcacagaactggatccgacgcagaccctgcctgccttcaggttgcttgaagatgaacagagagatcggacctctgctaagtcgccgatagtggatactgctgccacttcaaacccaacgggactcaatttgccctccttcccgccttgtcaaagtctactctaggaattccatcccccatagaacactgcctcttctatgacctcgttcagattagagaccaaagtattgaataatgaaagcaaacaaaagcaaatgcttgtcaccaaatatgtccgagaaatctagaggaatttttatttttgataatcaggctctagaactggaagtttgagaagaggatcctcttaaagcacagccctatacactttttaaagtacaggagtgggggtgctcccagccctccaaggagactgacttcttgattatgaaggaaaaattcgcacatgcgggcaggtctgggactttggttttgtctgaacccagaagttagaggtaggatacacccttagaggtcatctagcccaacctctcacctaaaacgaaccaactctatagtgtctaatagacatgcagaatgcacttaaatagttcgaaggtaaaagagctcaccatctcgaaaggcagccaactccactgtggtaaacctttgtttaaaaattgttaaagccggccgcgcggtggctcacgcttgtaatcccagcactttgggaggcagaggcgggcggatcatgaggtcaggagatcgagaccatcctggctaacatggtgaaaccccatctctacttaaaaaaatacaaaaaattagccgggcgtggtggcgggcgcctgtagtcccagctactcgggaggctgaggcaggagaatggcttgaacccaggaggcggagcttgcagtgagccgagatcgcgccaccgcactccagccttggcgacagagcgagactccgtctcaaaaaaaaaaaaaagtcttaaagccaaaccacactccctgaagcctataatagaataaaataggaatagtcttcacctttttcatgacagcccttcaaataccagattgcagtattcattacccactaagtcttctctgttccttgctgaacatcctcagtttcaaccattcctatcgtgctgttcaatacaactgatatacatgatagacatgttctttatctgcactgtcaaacatgtagccgctagtcctatgaggaataagcacttgaattgttgctagtgtaactgaggaatttttttttttttttttttttttttttttgagatggagtctcgctctgtcgccaggctggagtgcagtggcgcgatctcagctcactgcaacctctacctcccgggttcaagcgattctcctgcctcagcctcctgagtagctgggactacaggtgcccaccaccacacccggctaatttttttatttttagtacagacggggttccaccatgttggccaggatggtttctatctcttgacctcaagatccaccctccatggcctcccaaaatgctgagattacaggtgtgagccacggcaccccaccaggaacttaaatttttaactgccacttgcagctagtgtgtaccaaatcggagagcccagccttatatattcaaatcctctattggtcactctttatatgcattccagcttgtcaatatccatcaaacatctgactcctacaaagcaatactaaacagtacaactttcagaatgaccatttaacacctagacagtatttctattcctgctttccagaatgtaattttttttaagcatccatagggtgggtcacattgataatcactgtaactaatactttgtcagcaatcctagtgcctaaatgtgtataactgcattttttaacctaaatgtaagacttgatacttcaactttttggtttaggcccagcagtttgggtattccacgtggttaatcattttaaagcttgtttcaatatagtcttccaaccagactttccaatttgtgtcacttacagatttggcactaccaccatctggtctgtatgtaatcctttacagtttgcaaggcacttttacatccattatatttaatttgattcttacaaccaacttgtgagataggcaagatgtgaagtcgatattttatagacaaagcagctgaagcataataggagcttaactggtgggatccatttatccattttctcttccatggagcatcttgttgtattcatccaaatccttgacagaaatgttgaagaggacctctagaggctaagcttatcctgaattcttaaatagcactgactgttacagtttaagcaagtcagtttcacctaaaagtgtgattatccaacccacatgttgcctttctgttcaaaaaggatggtaccaaagacagtcacagtcacctggcttactgacataaatattaatactaatcaaatgagtaaaaagcccatgaggattggctgccacaaaaaattttcaacctgtatctaccaagaaactatcataccaactaaggaagccaagtctctctctctttcaaaaccctcacggggccatgctttattataatggtctgccacaggtcctaacccacactgtatttgattatatacagtctcataattaagtcattcctctttatcacacccagcacttagtccactgctgcccatgtaggaggcactcaaattggtaaaagagaaatctatgcaagggaatgatcttctggaccccctccaaaaacaaacttgtgactagaagaggcaccagccatagccacattcctactaacagggctgatttaaatgccctttttattggcttggtcatagtctccaacaggtgccaaggcttttgctagttaaaccagttttcattggatcattttgttttctatgtgtgttttgaccaaaaacaaagataggttctctaacaacagggagagaatatatgaaataggaatatgtctataaaacgacagtctaccagtaaggaaaataagtgatccataaaacaaaacatctgactgtaggtctacccaaagaaaggaaaaaggactaacaaacaagaatatagtgctttaccatttacaaatctttcacatacattctcatttgaccctcacaacaaccctgtgaggtaggcatcacggacattctactcattaaacagatgaagacagtaaatctcagagtagttcactgataatgcccaaggctctacagttagtgagtgatttgtattaatatcagtctttggcctaaaaattcagcacccctcttccccttatacttgtcccacctacttcacagggataatgaagataaaatgaattcaaggctagaaaaatactttgagggagaaaagcactatataattatacctacaaactatgattttccccaatatatggctcattcctcttctcatctcagcttgtgtgtgaacccagagttgtatattgcctctgtcctgtgctcagtaagcaaataaggcaggcagggggtacagtgtgatcctgtttaaagttacataaattacaatcagggtaactgctattattaggcaaattgaaaaacagcacagaaaggccagtgtgcaactaggacccactaaagctcagaggaaagcaatgcaagattatcagacaggcatgattgcatagaaggaaaatgtggtgtcagagttcaaactggcacacacacacacagttatctaaggcaaagtggtggcaaagaagttatttgttccatgtcacacaaacaagagcagaagattcatgggaacccgtacaaaagcatcttgtgtcacacagatctctccagctgcctatagggaatatacagaacagtgtcaccttcaaagaatgactgtacctgtgttcatatcctgaactgcaccaaggaatagctccatgctaaactgtcttggctaaaatacaaccagtgccatcattcctaatcagactaataaacagaatgtcttttaaggtaatgagttagatggctgtgtttaggttttgttcaggatttactttggattctcctgctttaagacccaaagaaagttatattgagtttttattgatgattctatgtgtttttaacagagtgtgataggtgaattaaacatattaaaagagttctatagcatctgttcagaaaagattatatactatacaaactattcaagtcatacaaaaccatttttcattgtctttcaaactgagaagaatcctattcagcacgcttctcctcctgaggtggttcatactgagcaagctatggggcaaagacagaggaatttaggtgaattttattctaaattgagtaaaaaatagtaaaacaaggtaactgttatattcaacttagttactgtcagtaaattgtattaatatcagtttctataactatccattttaaatcattcagtgatttaagatttaatacaatcaaatctaatgaaagccctttttatataaacctttaaaattgctttgaaactaaaatttcattccagttcatgactgcactgttcaaatacttgatatgcaataaactatatcttcccaaagattcatttgcttataaggaactttcttcctctccagcaaaagtttactgaaaatacccactgaaaagtagataaagagttaagtgacatgtcttaacttaaccagccaataaacaactactaatgtctttgagttaaaaggttccaaagagttaactagcactacacattgtggaatcttggataatttaaaataactgcattttcttttatgctaagtgtggttccttgcaagaacactaggctaacattagggttctgccaactacctgttggagttgagaagcttattagacttcactgtgctttcgtttcctcacctataaagtggcttgtgtacttgtttcacttatctcacaaagttgttgagaagataaaatatattatgagaaatacttagagtaatgtaaaatacattatgtgattaagaatgtggtaagacctgaaagacttaagagttgactaatttgaagttcatgaaaattctcacaggactttgaaaaaagaaaaaactggctgggtgaggtggctcatgcctataatcccaacacttcgggaggccaggccaggaggaacgtttgagtcatgagtttgagaccagccagggcaacataatgggaccccatttctacaaaaagtttaaaaattagccgagcatggtggcaaatgcctgcagtcccagctactcaggaggcagaggtggggggattacttgagcctgggaagtcaaggctgcagtgagacatgactgcaccactgcacacaagcctgggtaacagagaacctgtctcaaaaaaagaaagaaaaaactttagcactagataaaattaagtcctaacaaatttacagagggccgctacatatggccttgcaaactatgaaccatacaaattctaagaagtgccatttacaaagcagtcgccccatattggcctacttaaaatcaactgcttaagaacctcagaactgaccatttacttataaagaacattaaccaatattctca

SEQ ID NO: 4136 - DNA, 744 bp, Homo sapiens
atggggctgagccacgtgcaggccattttctttgacctggacaacacactcatcaacacaggtgtgacaagcaggagaggcatgttggaggcaataaagctcttacaatcaaaataccagtataaacaggaggctgaattcacctgtgataaagctcaagttaaactcaagaaggaatgttttcaccattacaatacatgcattactgatctaaggacttcacaatgggaggaagcaatccaggaaacaaaacatggtgtagccaataggaaactggctgaagaacgttacctcctttggaaaaccacacatttacagcacatgacactaaggtcagtgagatgtcaaagctatgctcattgaaatcagaaaggaggtctgcctacttttagtaatgaatggggtcagacagacccagagggagaagatgaggcttgtgtctgtcagtcctatgtccaagttgttgtaggtgaacagcagagggaggagaagccagcaccttccatattttattaatgctgcaatctccttggagtacaacctgtggactgtgtgatggttggtgacatgttagaaagtgacacacaagggggtctcaaagcagggttgaaagcaacagtatggatcaataaaattggaatagtgccactgaagtcctccccagttccatattacagtttcttttgtgctagagttacctgctctcttacaaagtatagaccacaaagtcagtatgccctctta

SEQ ID NO: 4137 - DNA, 2154 bp, Homo sapiens
gggatttcccccgcacgccccggggagagacacgaaaaccacttctccagcctctcttgccatccccggctgtcccccgccgacctgtcattgctcttaaagggttctccactcgtgcacacctcccaagtgataacctcattccgcctgcttcctccgtgccctggcatcctttttgtaacgggctgttggattcctattattgcctcctcttcgccgcctacgggatgataaactcctggcaaggatgcactgaggttgctggcaaagagaaactgggatgtgcggagtgaggaaggggacaggctgtggttgatcactctgtcgcacgggaatctatcggcctccttgtattcctaggtgtagtgggggaggaaccatcctatgaatcctggaaggctgaggcaacagagcagaaccacttggattaagtagtatctcacattcctgggggtcaggacaccaagcaaagcagagatgggcatgagctgtgcggggagcgggcctctgaaattggaaacagcactggctggtgtaatgtgtgtgtgttgtgtgtagaacagagatggtatctaatgtggccagagcatgcaactagagtgcaaggcaatcaagtcgtttgcaccatgagcacttaaaagtgaagtaacccagcagcccaaagaccatgatacacaagtccctctggggtttcagaaatgattctttctccttagaggtttactcagtttttaaagtaatttttctgtgtgagtggtggtggtgatgggggaaattacgttcccttttttcagaaagaacaaaatatcttcttttgttttggttttactggaatcattcctgcttcagcttcggtgcaggattcatatacccatgaaaataatgaggaaatagctctgcaaaaatgattcgaaatagggctgcagagagatgcacagctattttatttttcctgcaggcatggattttcatggaaacagtccattcacatttatttgagagagctgtgttttgcatgaaaggcttctgttgacattttcaaaaattgagaccctttgcagaaatatcagagaatgacaattatctccttaatgtgtgaagtttagatgtagctccaatctaggttaagatcaaaacaatgtaaagcttataattcaaatgatactagtgaacgtgttggcaattaaaaaaacacttgtgcacacataaggtcacattccctgttttaaatcataggatgtggattcttaatgtaggtgtaaagtcatcaggtgaacatgtaaaaataaatgtttatactttctggcttagtttctctactgcttaaaatggaagagcccactcaaccattccaaggctactttgccttgctttttttcaatactgtaccattataaatgacttttcattttaggtacacacactcacccataatttaaaaaattttattcacatactatgtggatagtagactcaaaataggaaaagttaattttgcatttgttttgatagagatcctgatgtgagatgtgaaatgtgaaattttgtttatagaagttttgttgatgaatcctgattttaaggtggatacactgttattgtttatcctgttttcttgtagaatattattggcatgaaaggcattatacaaggttggattcaaccttttgtcatacataagatttttattattagttatttgagataatctattttgattattagctttctgtgaaataatatttccccttgagtatgtatacacgtactgaatgaatggaaagtacgcgtatgctggatgtgaaacatattaacaagtgatttaatttgcaaaaattagataatatggagtttagaaaccattatttacttgaaattttgttagaacttcatctcaatggctatttaactcattctttaatacagaaaagaaattatctttgaggaagtatttgtgctccataagttttctcttttttacgaagtatgtgtagtattatttactatatatacatacaaaaataaatattcagattgttattaccatggcatgccatggcatttgcttacagttatatttattagtgtcatctggcttttgttgtataagaaattgctatttacaaataaagatgtgcttgtggtttgtagtaa

SEQ ID NO: 4138 - DNA, 744 bp, Homo sapiens
tgaacagttgaaaaatggaattgactttcactcctccaggtccagaaggattctaatacacaaaccataagcaagagttgtttctgttattttgtccacagaacagaagctgaaaaagcatattgcttgcatttcagccagtccccttaatactttgagaacactgggatgtgatgtctccgtctgccacctcagaatcatttgttcctacgagaaggccaagagtggtacttgctttgatcactgtttttaaatagaagacacattggtagaaatctttcatataatatgttgctgcttttgggggggtgttggggagtaccagagaggtctgcatgcatctgcagtgtacactggcaaacaaaaggtttgtcattcccgttgtcctgttgtgcttcctttccacctctccctggctgttcccccacccccttgttccttttgtaaaggatgcaggtgtagtcttgtgccagtctgtgacataacacctgaacaatttctatggtatcctacccatttgctcagattcaaaccaggccttaatcgataacaagcaaagagaaaaaaaggtgggatttgtaaataacaattacagcaaaaaaaaaaaaaaaaaaaaaaaacactgagaactctgctattctgcttaaaatagatatattgccataaggagaggtttttagaatgtgtgttttataaagtcctaaaaaaattgtgatggtcattataataggcaaagatgaaaaa

SEQ ID NO: 4139 - DNA, 2338 bp, Homo sapiens
tttgagaaggggctgagtagttctatttttaacaagctcttccacaggcacttttgacctgtaggtcaattatacatgtctataatttgtgagttcacaaatttgtgattttttttacaattagggagcattacattgctatctgatagtcacttagacacatctttttctcttttttaaagtacaactttatacaatattccctttttttcagtctaatgttactcagtttttagcagccattctcaactgggatttcactagaaaagtaggccttaatccccccctaaggtatccattgtagctaataaattagtaagatctagaatggtactatccttgggagaattgaggattaaagttactcaaattattttctggacagtggctcagatgaggagctgcaattgagaaagacactgccagaatgtcagaaagactggggctggctgtacagcacctttagcattcagtttctccaaagcctctaaaagtcgtctgtcacattattttctgctagtttgttggttaaaattctttttcatgtgctgcttcatccatgtttgcttacagaaagcatactaagcaaattcacagatatctattataggaaattgtaaacatacaaaagtagagaagcataatgcatcctcacatacctattcctctacttcagcatgtttggccagccttgtttgatttatactctgattcacttccattccccagattattttaaaacaaatcccagacatattttatcatgacacttgttatttttattctttaaagtaataaatgttttgggggttttaatgaaaatcagtgttctttattatcaacagatgtaccttcacaagtgtttttcattttttttttttttttaattaacaatagaaatggggttgcactatgttgtccaagctggtcttgaattcctgggctcaagcaatcctcctgctttggcctcctaatgtgctgggaacaggcatgagccactgcacctggccacaaaatcttaagcatctgaagaaagctttccttcaattctttttctagccccctttctgccttcctaagagtctggtctgcatttgctatctctgcagtctcccatttgcttgaatatttcttacactgtttactgtatacattgttaattgtgtataagcaatgctaccataatttatttttcaacaagtcataccagtgcactgacactgctctgtcaagtatcactaatgatcagtcttcatcttaactgatcttgtatagtatttgataattattttctcatagtagtctaaatgttagtacgttatagattggttctagacataagctacttcttgctttgtaatattctcccccttcttgctttgtaatattctccccgtaagtttcagctatcacctattacgtcaagatgacaaatctttctccaaccaagagtctaataatcgctatcattttactggacagactcccaattctgtgctagaaatacctacagtcggataaaactgttcctctgaaaaaatccctcatactcccttgtcagcctatcccaaaccaccactgatgttcttgtccaatagttttgccttttccacaatgtcacagaaatggaatcataagtagcctactgaatccagtgtctttcacttaagcattgatgcatttgagatttatctacattgaatatatcagttcctttttattgcaaagtagcagtcgattgtctggatgcaccacagcttatttatatgcattcaccagctgaaggacgtttgggttgtttcccactttttggcaattaggaagaaagtcactataaacagtcatgtacgtgattttgtctaaacataagtttccatttcatttgtgtaaatacctaggaatgagattgctggttgtataatggtatgtttaagaaacaactttccacagtggcgatgccattttgcgttcacaccagcaatatgtaaaattgttccacattgttgtcagaacttacgatttgtcactttttggattttagccattctaacaggcatgtaatgggtgaagtgtgttcaaatcttttgcccacttttacatttggtggttttcctactgaattttgagaattctttagatactgtagatatacaaatgcttcatcagatatggaacgtgtacagattttctaatagtctatggctggttttttaattctcttaacagtgtctcaaatagcagaaattattcattttgataaaatccattttaacagtattttacggattgtgcttttgatgttgtatataaaattttcccataaaacatgttcactaag

SEQ ID NO: 4140 - DNA, 819 bp, Homo sapiens
ttttccccaataggtggcgcttctgaaacacagtatttgtttttatttttattttatttgagaaacccccaaatttgctctgatggcctttcttctccatttgtcatctctgggaaccttgagtctagatttagggctgaaagtctctctgctaggagctttccaaaatgcattgctttgattctgggaactgaataggaggagaacacctggactactctgagtcctgagttcaattcctcctcaactggtttccttgaaggtggctgtactggtcatcttctcgatccttgaggggctggtagagctggtcattgggcaacagagtctgcttgtctgaagctctcgactggcgaactccatcctgtccagcaatgaagtagaccccaacagcaaggacgaaaatgctgacgatttcagcaaagagaaagccagatatggtggctgcatttagttcaatgcagttctgacacattctgtaatacacttggagtggttttgacttgttctgtgatcctttacactgatacatccctcgagggtccttggcattacttcccagattccatttttttttatcttcagttaggaagccgatcatcttcccatctttaaaccatgtgatatttttggcttctgcatcacaagtcagaagtaccgaaccatcttcttgatagtcatacaccttaaccaagtggtttcctttgattgactgggccaaagtaccttgaagaagaatgatagccaggatgaggacagccaggcccttcccctgttccatgtcagtctctgtcctccggcaaaagcgtggagcagccc

SEQ ID NO: 4141 - DNA, 3967 bp, Homo sapiens
gttttctccacgtggaccccagtgaaggagggagaagtgtgcttgttctgtctagctttgattttgtggaacagataattgaagaggatcagggtgctacataaactacaagcaatgatggaatcagggagaccagttaaatgactaatgcagagactgggtctcactacattggccaggccggatttgaattcctgggctcagcctcccgagtagctgggactacaagcatgtaccaccatgcccagttttctgcagcagtttttataaaccaaattttccaaattagaaagactgaccaaagaagcacttttatacgaggaataacttacgtatggagaatctcaacttggaccagtcaagaccaactccagcgatgaagccagaatgtaatatatctcaaaaggctaaagaagtccattttcccagatgtaaattataattaaaaaatagtgagccaaactctaatatcccaatgtgataatctttcaaataaaaatatgggctgtagttcaggaaaaaagtggcttctctataattaaaaattttacatatgttccacgttcactcaaaactatacataaaagtatataatgcatgtgcaggaatcaatttagatagaattgattaatgattaagaattcttcattagcttttggttttaatattatggaaaaatatacaacgatatttaaaagaagcttctcttgacttctcttaaaactaaggctcttgaaagtataaacattaaggttaaataacgctggcaagaatacaaggaaatgacattggtgtattgctaatggtactaggaaagtattctgcaagtatctactaaattaaaaatacagtagtgcccccttatccatgatgagtaagtacattccaagatccctggtagatgcctgaaaccttggatagtactggaccctgtatatatatgttttttcaaagaaacccatgataaaatttaatttataaattaggcacaatgaaagataagcaacaatagcaataaaatagaacaattataacaatatgccagtaacactactcttgcactttggggccattattaagtaaaattagggtttcttgaacacaagcactgtgatacctcaacagtcaatctgataactgagggctactaagtggatacaccagacaaaaggaggattcatgtcccaggtgggacagaaaaggacggcgcaaaatttcatcacactactcagaacggcatgcaacatgaaacttatgaattgtttatttctggaattttccatttaatattttcagaccatagggaaagcaaaaccacaaataaagggactactatatgttgacccacatgaaggaacttatttcataaaaataaaaggagcaaaatatttaaaaaatatgtataagggtgtttattacaatattatttgtcgtgacaaaaaactggaaacaaacttattatggactattctgcagttatttaaaatcactatcaaatgacaatatccatcagttactaagagaggggaaagcaagtattagagtaatatgtttgcatgattctgttttttaaaaaaagtacaccatcacaatcagtgtgaacatttattcattcaacaaatatttattgagtgcctactatatgccagacactattttatgttctagtaatagagacaaacaagataattaagtattttgaatgaatacaatatttagaatgttgaaaagtgaaaaataaagcagagaagagcagaaaagtgcttgtgaagaggaaactaaaacatgaggacatctaagggacattcatggaagatgctgctgacagcacaaacaaaaagaggatggtcagtatggatagagcaaggtgactaagagaaagagtaataaaaaacaaggccagagaggtttaagaagtggtgtgggtaggcagatcattacaggatcttaaaaggccttataggtaattgcagaggtaaagattttaaaacaaccattatcacatttctaacttcagttatcttaaaatgatggcagctgttcttgtctttgtttcacagtttaaactgagcacactgttataataaaaaaacaaaaatttaaagaatcaaatatatattctatcacacaaactggctcaattatactgccttgtatttagcaggcattaaataaatgttaggtagtgaatataaaaacaggtcaagtaatagttatagtggtcattatatctcttaatgcactcatattcttttaacatttttaaatggccaaaacagctacttttaatttgctcagaatataaaccacaaatttttaaaaatgaagagcttccaaaataaaatacattttttcagaaaatagtattttcaaatttaaattagaataaagtacttcaaatgattcatattaatgtaggacaaaatgtagaacttaataaagaaagcaagtatagtaaaaaagaatgtagctaacaagtcaaaaaacgcatatgcataattatcactgcatctcctttataaatttaaatagtagatgttaaattttatagcattttgacctttttaaaaaaattttatttattttttgagacggagtctcactctgttgcccaggctggagtgcagtggcgtgatcttggctcactgcaacctccgcctcccaggttcaagtgattctcctgcctcagcctccagagtaaatgggattacaggcatgcaccaccacgtccggctaattttcgtatttttggtagagacggtgttttgccatgttggccaggctggtctcaagctcctgacctcaggtgatgtgcccgcctcggcctcccaaagtgctgggaatacaggcgtgagctactgcgcccagccactgacctttttataaaagatgagatatggcagttccataatattcaatgccaaaccaattattttcctatgattactattcagttaagttctagagtacagaattataggggaaaatgtggcagaaaagggaagtgaagaagctataagactgtccaaactatatgctgttttggtgtattttactccccatgggaatagatgggaatgatgttgtagtctgcctgaaagagaaaagtacaagagaagtcacccatttaaaaagtgtactcatttgacattccaagatttgtatttcactagttggttatgccttggtagtgcatttggtacttgtgataaacctgttggcaataaattacaaggtctaaaacaataaattataagatcaaaaaacaacagatgtggttgaggattaagagatcattagctgagataagactaaaatccagaactagaagctaagttttctgacttccagatcaatgtaattcctataacaaaattttgttagttacaaagaagctttcaatgatgttcaatgtactcataattctctccacgatttgagccaaatgtagaaagaaatcatgtacgtaatttaaagcaaacaaaacaaaacaaaaagacggattacaaatcaaaagaagagaaaacaagatggaaaaaagtgggtagttttcatgtgtaaagattattgttaccttttccaagtctaactcctctaacaaaatgctggcgtttttgtttgcttcagcagcctgtctatctttggcttgtactattgactccatacaaagatgacacttcttcagcatctcctataatgaaaaattaagatttttccaggctcacagaacaattctcacttagagaaattcctaaaaacacgaagatctttagtaaggtactcaaacctaagcaataaagatccatgaaagggggaaaaaaggtgtgcaaataaaaacgtaattgacatggtatatttaggaatatatacaaatgaagaatcaaagagtagcttttgctattcttcaaaataatatccatttagcaggcacttcagaaactaaagtcatttatcctctaatttaaat

SEQ ID NO: 4142 - DNA, 1078 bp, Homo sapiens
cccaaggacctgttgtgtgcccagcttggaagacagtggccactcacatccaggtctctgcctggctatttgctccatgaacccatctcagatgcccctgcccccagggagccaggtgacagggtgaggtcaagtgacaagcagtaggtgtgggagaggtttggtggggtcaggcccacatgggcccagccatccactccccttccatctggagttgggggagtctgagctgctcctggccaccccatctgccccaccccatcttttcctggccaccccagctcccaccccatcttctcctggccaccccatctcccaccccatcttctcttgacaccccatctcccaccccatcttctcctggccaccccatctcccaccccatcttctcctggccaccccatcttctcctggccaccccatctcccccaccccatcttctcctggacacccccatctcccaccccatcttttgctacagccagggttagctcagcaggtgaaaaccccgagggtgggtgaaacccctctggggctcagacatgcaaaccttgggcatctctctgtcccagctggccccgccagccggtaggaagtttcccctgagttctcagttttttcttctgaaaaatgaggggttgtatgcaaggttctcctcctggcctgtggtccccagagaagggcaggaaggaaccttagataattctcatatgcatttaacagacgaggaaactgagacccagagccgtcacatcaatacctcatttgatcttcataagagcacctggaggaggggggtggggtgtttgtgtttgtttaaatttttttttgtgaaaaaaatgaagataggcattttgtagacaatctggaagttctggaccggaatccatgatgtagtcagggaagaaatgacccgtgtccagtaaccccaggcctcgagtgtgtggtgtatttttctacataattgtaatcattctatacatacaaattcatgtcttgaccatcatattaatatttggtaagtttctctctctttagagactccacaataaagttttcaacatggtaaggttttcca

SEQ ID NO: 4143 - DNA, 6022 bp, Homo sapiens
agatcaaagccaaggaccagcaagccaagcaaagatgggttccagcggctggcttctcacaggcagcttcgggtctaccgctttctgcaccctgcccacccactcccagcagaactggaacccctctccctgaggacaggacattttgaaccattcacgtaaaagtctcaaccacggagcgtcagcaccaacccacccttcaggcgttggcagcaaggacaactgtgttcaggtgaacttctagccctttcagacttcactggatgcttggcatttgctacactagttcccattttagtgttctgcttgtctcgtagactggactgtaaacaacttgagcaccagggacctgaagcccccggattccacagcagggcactttacatgtgaagagccattagccaggaaatgcttatggttgttaatgatgataagctactccaaacatagtttcttttatctgcctacatcagaagcttggcttcttgagacaagagactcagacttctcatttatactcttgacagactgtggaaatcaataatggcttgcacccatcagtgtcctggaagtaggattgagagagaagattctcttgagaaccgatttctcctcaaaataagattaggcttgaaaaaaaaaaaatcaacctccccactgcttagctcacaggtatggtgctaatggcagcaacttagtcatgaaatggggaacaacaatgtaaaaaatccttgttaatttgcttataattatccagaactaactacaggtacactgaagaactgtatacttgatgggagggagatctacaccgctaagtcaataagaccaatttccgatttttccctgtgagcatttatttgcagagccacatattggcaacataagaaactagcgttgaacaaacctaagaagtgatgaatcctccccgggaggagagctgcagccctgaaatccaaagcagaatgggctgggggcagcttgaggtctgtgggcgaaactcagcactcccagtctagggtgctgctcacccattaacttggcctcctcttgccactgttgttttagcccttagtgagcatctgtgtggctcagatttaaccagaccaaaggggctgtggtggtgagagggcagagaaagctggaggaagaaatggctttttttctggagaggagtgaggactaagtcacttcaaggatgatcatattcccaggaggagccatgatatgatattatttgaatatctagctccacgcagctctatttttcccttctcactactagaagattgtaatcacccggtatcagcacattcaagatactaccgaggacctaacagcatgcccaaaacctctcatctctgcacataactgcgtacaaatgactaaaatcactttgcttcaaaaacagagtagctgtgtgaaaggcattttagagcatgtgggattccacacacaggcaagttccagggatctcagaagcttggctatttcgttcagtgccaaggaggcaaagatgaggacaggcagtcgtgtgggtgggaggcagtccttggatgattagcacaggtgtccaggagggaggggagggtatggaaatggtacaaacatgagaggaagctgtgccagtgggtcatcatgccccatttgtacagaacattgagtggactgtaactgtggacaactgaaataccgaaaagaaaatgtgcacacactgtttaaattctaaacagtgggagaatcgttgtttaaagaagaacagataattgctcattccaccctccccagtctttgaaagatagacacaggagtgtcacacagtacaagagtttgtattacacagaaagagggacttacagacagaaacaaaatttaaaaacaaacaaaccaccagcatttatcaccgtttatccagccagtggttttctttatccccttggctattactttagatatttttgcttggaacttctcccccactttttctgacagctcattgatcttgggttggatcatcacagttcgtgggaaacaatacaggctacttttctagcttattccttcttagatgcctcttggatattgtccatttaatatgtttgagaaatatagagagacaaaacacacagtgttttaatctcagagtatatgtagtgtgtccctggagaagaagtctcatatatccaagggaatcattccattattttaaagtaaggcttgtatttcagattgatccacctggaacatgtaatcaaaactcatgaactttaatataaattccagattctggtttcttatctatatttttgggaacataacattggtagataaactaattgaaaaaaatattttcaatgttgatttagaaatggcttttaactatttctacacattccatcactccatctcagaagaagcggagtagaaaactgcagcaaatgggactttatattaaagtcctaggaaatatattctggctgatgtgatggttcttgtgtgtttcagtaggcatgtaacatgtgaatcgctttgtggaactgggttcgtgaggctagtatttatgaagctgtatatttccttctgtgtagtaacacagagagtgattcaggagaatgagaaaatcctgtttcctggaaataccatccatcctgaaggagttacgagaaccagaacagatatgtattttgctatttatctcacacttaaagattatacaatccattttcctagggcaagcacaaatggtcagttttataaatcttgatggactaagtcaagtaaaaaagcccactagttaagagtccagatatcgagagacacaaatctgaggaacgatcaattaggacaccgtggtagcttgtctccaagatgtccatcatcagctctttccttccctgcatgtttgtgctgttctctagttgaacggtggcgtctattcactcccttaaaactggactggactgtgacttctctgaacaacagtgacgtgatgtttcattcccagtgtttgagaggataggaaatttctaatttcttttccttggaacatttgctcaggaaaaagccagtaactatgtaagaaggctaactactgcgagaccaccatgctatgagaaagcgcaagccatgtggagtgactgcacgggctctcagagatgcccagccaagccccaccctccatccacccgagccgaggctctgcagcctacagatgatttcaattccagccataatctaactccaacttcacaggagacctgaagcaagaactagccagttaagtctaatcaactcattaaactgtgagagataggcatacattgttgtagcctactaagttttgagatggttggttatgcactgtggattcctattaccaatcggctataattataaaatatccactggcaaatataagttccagaggcaaagactgtgttccttttgctcatcattgtattcataacatgcagcacagtgcctagaacacagaaagccctaaactaataatacgtaaaagtttgaaaaagtttatctgtactagtatgaaagaaagacccatagtcaaacggctgacattttttagcaagtttgatgggcacaataaccttatggtggtggtattactacctctgtctttgagatgagggaacctcagcttttttttttttttttgaggaagtaagcttcccaagctcagaaaggtaggggagagggccaggcatggtggctcacacctgtaatcctaacactttgggaggccaaggcgggcagatcacctgaggtcgggagatcggggccatcctggccaacatggagaaaccctgtctctactaaaaatacaagaaattagccgggcatggtggcacatgcctgtaatcccagctacttgggaggctgagccaggagaatcgcttgaactcaggaagcagaggttgtggtgagccgagatcacaccattgcactctagcctgggcaacaagagcgaaactctgtctcaaaaagagaaaaaaaaaaaaagaaagaaaggtaggggagagatttgaactcagatttgtgcaattctaaagccagcctgtttattatagtctcccaggagactacaacagaaacaatgagaaaacaatttgaaagagatgcaaaacccaccccttgaatcttacccaggactatggagctccattaattgctgtcaacacgctggaacctatttcacatgaagctcagaccaattacaattaatgccacagtcatgactacaaactagaaaccaatgccagaggaagcttaagttaaagaaagcaacgatcacgcacatatattatgttagcaattaggcttaatcctagaatcgtgaagccaaagagaatatattaaagagagaacagtgccctcctgggaagaagagcaatttcaaatagactttttagtggctttctacattacttacttgaatatattatgctcccctagaattactatattacaattactcacgccacattttatttatttcagcaaggaaatgggatggtgcaatgagctcagtgggcagacggtttggttatttcaatgaataatttgaatgtcaacaagttggtggatgctaagatgaaaggggaagtagtaaatagcaaaggtctcaatgcctgactctgagatggagtaaggatgagctatcaggactggcacttcacttctaaatgttgagcactcaggttttgctaaatttataaaagcacatgaactaactaacatcgcatatttccttaacgagaagaccagtttatctctgtttaaaacagttctgatctactcaaatacacatttttaattttcactgaaaaatgttataaataaatcaaaatttaaataaaaaaactgggagggaaaggtagatctacttctcaattcagaagattaataaaaggattaaggaattaaataatcacattctctagcctcagctcacgactttttcaaggctcagtttctcaataaatggaaaagcaaattctcattattctcccaatctgtttgaaagcagagctggggtgttacagtgattaacagttatcaaggcccattaaagttgttaattatagtggcgttcactatctttttccatcatttttagctattgagacagggtctttgtggatcccaaggatcatgtgtttgcagttcaattcagcagccactaggtggtaatattgttgattttggtagccatgaagtgtgatctatcagacctgccctcttaaatggaattatgtacatcccttatatcatcaagatgtaattatagaaataattatactttaaaatatgtaaaatattttaattgtgaaaaatataatcccttataaaagttccatgcatatctggtaccttttaaacttatgctaattctacttaccttttattctaattatacacatgactatcttcaaattatacatataacaaaaataaagtgtctggtcttaacagaaatccagcttatattcattgcttctggcttatttttagaagagatgaaaaagatgcacataactttccttctaaaattatggccgtcctctgtagtaaataattatttgccacttgaacttggaaccactgctattcgcaccattggggtcctgggactcaaaagaaaccaagtggttctctaagttagtaggatggcacagtaacaacgctgggattgagctcaccctgaccctgagatccctgccatgtttatgggaacttttaatgtgagcatcacagttttgaaggccatatcattatgaccatgtttgatctgagggtgggaaagcaggagctcacaaaatgcctgcacaaggttattctgaactgagctataaaccagcttcaacaagagcctagtgtggaaaagaaaaaagacacgtaagaaaaaaggcatggatatcatggagtttgcaaccccgccaagtggtgccattaaaattacattcaattcttctcagaaaatgaaattaagaaaaagtaccac

SEQ ID NO: 4144 - DNA, 716 bp, Homo sapiens
aacagtgtgtttcagagaggctgtaccagaattaactctgctcagagttagatttgctggtcttaaagtacttttcctctttaagataaaagaagttcttctaaatcaggaatggattgaaatctaatgaaccgaaactttggctccccagtcctggtctcctgccctacacagtccaagcaagtgggccaagagattgcagcaaaggagaggggccagagaggaatcttatcttctgtcctggcttctccagttttcctcctgcctgcacattaaacacacagggactgacgtgctgagacctggtaaattcagacagtggggttcacggttcatcgtatcctttgaaggactcctccaccacttcattcaagatatctgatgtcatttctcttgacttcgttttaactagaaaaccttgattttgattattttttaatttttggtgaaatcagtaaatgccattttgaagaaagaaagaagtagactatgaaggagagtgttttggggaaagatctctgtgtcgtcttagagttcacctgctttgtgactagtgaatgcactacagaaactggcagacagcaacaccctcagcctgcctcggaagagacaaaagtaaatacccgtctcaaagagaatgcactgaaatatgatatcagctgcaagagagggccatctcctccggtcaaatgagaaaaatcatattatcctcgctg

SEQ ID NO: 4145 - DNA, 18799 bp, Homo sapiens
gttagactttgagacttgtaggaaaacactccaaacaaaggccttaagacaaatctaccagttgaggtaggaaatccactgagatatttagtagacagaacttgataatttctttcctttcatattttcattttagatcttcagaacttttattcaggggagaaaggcccaggtagctgctgctgttcagcttaaggctaatctgaccttctataacaggagttcaagtcccagaaatccctagtcctccatcagagatacacatgttggaattcatcaagaaaacaacctgacccatggagaatggagaaaagcagggcaggacaaccgcccacacgggagaaacatggagccaggggaacctccccatccagggaagccgctctgaaaagtcctctgtgagtaccaggggctggtccagacccccagcacagagcgcccaccttagaaaagcggtcagactgttccccacaagtcccagtcctcactgcatagggctgcccgacctgagactccagcaccaccatcctgtttccgcctgaccacttcaatcagaggcacccccgcatttcttcgaagaggaaataaataccagagtgaacccacaaaccttcgcctctgcagttgcagtggtactgccctaacagacctcaggctggggaaggaacaaaggtcccagtcactacactggtatctttagtgcaccgcagccaccatatggaaaggagttcagtttctctttcctgggaatccccacccgctactcttcaccaggcagggcccctggttcatgaccacagaacagtcacgtcacccacagctgagcaaacccaccggtagtggcctggagtttccctggggaaaagctctcagaggtatatgacagtctctccaccacagtgaccacatggagaggagaccattatctcctctcagtgagcccttgaacccctgctccccaacaagtggagcctccaactcacaccagcagtgcagccacccacctcactggctgaacattcccagtaacagtgactctgcatttcttggggttggagccctcaggggcaaccaaaagcctctctgccactgcctctgtagtagtactacccctactacctttagactaattaaacagcaaagaccctaagtgcctcatccacacccccaacaagctgcagttaacccaaggagaggagaccagtccatctcccacaggtcccatccacccctgctgcttgtcaccagggaaccccccagcttggacccacagtacagatcacccatcttgggcctatcacactgagcaattgctgacctgcatctctgtggagtggagcccccaggagacaagtaaaagacccccagccacaaccactgctaaggtccttctctctgctgcctccaagctggggaggaaacataaaccctgagatctccccagagctgtggtgggcagcctaggagtgccaagtctcaatctgtagccagcactcaaatgggagaggagtccacactttcagagcattgagaggtagcccagctgcaaccatgaggaaatatagaggagtcacatgactgggaaagagtctacctactgaccactacttcacaaaacccctcatttccttctgtcctccctaaagcctctcagttttgaatctcatgtcttcaaattgtatcacccactggcctccatgaagcgcctaagcaccacctactggatcacaccccgcagcttcaacaccaaaaagttagaaagacttcaaattaacaacctaacatcacaactaaaagaactacagaaccaagagcaaaccaatcccaaagctagcagaagacaaaaaaacacatgcttatctcaacagatgtatctcactaacatacccgccctgtaaaaccaaagataagaagtcagctgcaaataaagacctcgcacaaagcctcagccctgtgaaaatattcaggaaaaaagtcttctgactgtactcaatctatgctgcagttaaaggaacacccatacacagagatgagaaagaaccaatgtaagaactctggcaactcaaatgaccagtgtcttatgtactccaaacaatagcaccagttctccaatgagggttcttaaacaggctgagttggctgaaatgacagaaatagaattcagagtatagataggaatgaagatcattgagatttaggagaagaggaaaacacaatccaaggaaactaagaatcacaataaaatgataaaggagctgacaggcaaaatcgccagtattaaaaagaaacctaactgatctgatagagctgaaaagcacactgcaagaatttcacaatgcaatcgcaagtattaacagcagaatagaccaagctggggaaagaatctcagaacttgaagactggctctctgaaacaagacagccagacaaaaataaagaaaaaaagaatgaaaatgaatgaacagaaactccagaaaatataggattatgtaaggaggccaaatctataaatcactggcatcactgaaagagatggggagaaagcaaaccacttggaaaacacattttaggatatcactcatgaaaacttccctcaccttgccagagaggccaacagtcaaattcagtaaatacagagaacctgtacaatattctactcaagaagatcatccccaggacatgtaattgtcagattttccaaaattgaaatgagagaatgttaaaggcagctagagagaaaaggcagggcatctaaaagggaatcccatcaggctaacagtagacctctcagcagaaactctacaagccagaagagattgggggcctatattcaacattcttaaagaaaaacatcttcaaccaataatttcatatccagccaaactaagcttcttaagtgtattagttcattctcacactgctagcatactacctgagattgggtaatttataaagaaagaggtttaattggctcatacttatgcatggctaagaggcctcaggaaacttaaaaccatggcagaaggtaaaggggaagcaaggcacatcttacatagcagcaggagagagagagtgtgtgtgcatgggaaactgccacttttaagccatcagatctcatgagaactccctcactattatgagaacagcactggtgggggggaactgcctctatgatccaatcacctcccaccaggtccctccctcgacatgtggagataagatttgggtagggacatggagccaaactctattaataagcaaaggagaaatagccaaataagcaaatgccaagggagttcagacccaccttacaacagatcctgaaaggaacattaaatatggaaaggaaagactgttaccagccaatacaaaaacatgtttaggtacacagaccagtgacactataaatcaaccacacaagcaagtcagcataataaccagctaacaacacagtgacaggattaaatccacatgtatcaatactaaccttgaatataaatgggatcaatgcccctcttaaaaggcacagaggccaggcatggtggctcatgcctgtaatctcagcaatttggaaggtcgaggcaggtggatcacctgaggtcaggagtttgagaccagcctggccaacttgaggaaaccctgtctctactaaaaatacaaaaaattagccaggcatggtggcaggtgcctgtaatcccagctacttgggaggctgaggcaggagaatttcttaaacccaggaggcagaggttgcagtgtgctgagattgcactactgcactccagcctgggcaacaagaacgaaactctgtctaaaaaataaataaataagtaggccaggcacagtggctcacgcctgtaatcccagcactttgggaggccgagttgggcggaccatgaggtcaggagatggagaccatgctggctaacatggtgaaaccccgtctctactaaaaatacaaaaaaattagcctggcgtggtggtgggtacctgtagtcccagctactttggaggctgaggcaggagaatggcatgaacctaggaggcagagcatgcagtgagctgagatcatgccactgcaatccaacctgggtgacagagcgagactccgtctcaaaaaataaataaataaataaataagtaaaaataaaaaataaaaggtacacagtggcaaactggataaaaaagcaatactcagtggtatgttgtcttcaagagacccatctcacatgcaatgacacaaataggcttgaaacaaagagatggaggaaaatctatgaagcaaatggaaatgaggaaaaagcaggggttgcaatcctagtttcagacaaaacagactttaaaccaacaaagatttttaaaaaaaggcaaagaagggtgttacataatgatcaaggttttaattcaacaagaagacctaactttcctaaatgtatacacacccaatgcaggagcatccaaatttataaagcaagttcttagagaccttcaaagagacttagactcccagacgagaatagtgggagactttaacactccactgatagtactagacagaacactcaggcagaaaattaacaaagatattcaggacccgaactcaacattgggccaaatgaatttcatagatctctacagaactttccatcccaaaacaacagaacatccatcttctcatcaccacagggcacatactctaaaatcaaccacactattggacataaaacaatcctcagcaaatgcaaaaggaccaaatcataccaaaaacactcttggaccacagaacaataaaaatagaaatcaagactaaaaagatagcccaagccatgcaattacatgaaaattaaacaacgtgctcctgaatgactttcaggtaaataataagattaaggcaaaaatcaagaagttatttgcaactaatgagaaaaatgataaaacatatcagaatctctgggacacagctaaggcggtgttaagagagaaatttatagcactaaacacccacccaaaaagttagaaagacttcaaattaacaacctaatatcacaactaaaagaactacagaaccaagagcaaaccaatcccaaagctagcagaagacaaaaaaaagtgcttatgttaatagatgtagaaaagacatttgataaaattcaacaccccttcatgttaaaaactctctataaacttggtattgaagtaacatacctcaaaatagtaagagcaatctgtgaaaaacccgcagccaacatcatactgaatgggcaaaagctggaagcattccccttgaaaactagcacaagacgaggatggcctctctcactgctcctattcaaagtggctacataatcttggaaccaaagagaaatctggcgagtggagtcagtgacttttaaaaattatcttcaggccaggagcggtggctcatgcctgtaatcccaggactttgggaggctgaggcaggcggatcacctgaggtcagaagttcaagaccagcctggtcaacatggcaaaaccccatctctactaaaaatacaaaaaattagctgggcatggtggctcgtgcctgtagtcccagctacctgggaggctgagacatgagaatcgcttgaacccaggacgcagaggttgcagtgagccaagatcgtgccactaccctccagcctgggcaacagtgtgagactctgtctcaaaaaaaaaaacaaaaaaattaaaaaaaattatcttcaggttttataaggaatcagaatataaaaggatatgaagggaagtccttcaataatcacaagtgatgcaatggatgaaacacagagaaggtagagctaggaaagttcccacccaatctccaagtgcgtctgttaacaacaataaacacaaattcatatgagaatgttccttattgttttaaatatatattactgaaaagctaaaggaccccactgcatagtggctaatctctgatttttagaatgactccaggtaggtggggaataagtcaagagggatgtaatatgtactctgagttttaaattatgattaaattgatatcaccaaattcttatgttcatgaaaaactccatagtaaaggtgaatactcaaaattttcctcaagttactaaaagttatcatcaataaaattcttaacagagaagaacaagcaaactagcaaaaaagaacgacaacaacaaaaaataacttctagaatgtatttatactggagtaagcaaatagagaaagacttaagcctgcgtgtgcctagattaactggcaaaatctgctttaagtattcttggcgtagtctgaaaaggattcatgtacttaaggtccaaatctcagaaggaaaaaaaaatgccagtaacactgtttcatgctgggttccctcataccttcctcatgtttaaataaaacaaggtcaggagttagagaccagcctgcaatgctgcaatgatttttttccattgtatatgtgtttatttgtgtgttcctgtgagcatttgcatgcttatgtgttccacttccttatcaaatctgagatgtgcctgatttcccagaattagctatgttctaaagtgaccctaagcttttttttttaacatagtgctttcacttttgtttctccttattacaaatggaatcataaaaatttagagtttgaaggatagtaacttcttattttacagatccagaacattaggactagtggtttgctcgagccctcctgagctccatacaaagctctttttgcaaaattttattctggatttaaatgttaggtaaaattccatactcttctattatttgattaaagttataactacacttgaagccatctgggagtcagttatattaagatcattgtccacaaacaaaaaatatattcaaagaacaacttagaacagtgtccccctaccaattagatatgatattcaaaatatttagtaactggcagggcatagtcactgacgcattgacacagacaccgctgtcaacacctggtctgattgaagcatgcaaactagggaaataacaaccctttttccaaccccttccagaaaattcagagttcggtgaaatgaatcagaaatgaatacttaaaagatttgacaaaattacaaagaaaaaaggatatatacttgaacgtaagatatctaatagtctattaattaggaattaactactaacacttaaatacagagtcagtctaacatatcagccataactatatcagccaggacagatatccagcacaaaattactcaggcaaaagaaaaaatttatttgtttgcgcaatccaaaagtcccaggagtgtcttctggtacagtttaatccagatgatcaagagataaaatcaggactgggtgcggtggctcatgcctgtaatcctagtactttgagaggccaggacaggcagaccagacttgaggctaggagtgtcagaccagcctggccaacatagcaaaaccccatctctactaaaaatacaaaaattagccgggcgtggtgttgtgcgcctgctcgggaggctgaggcatgagaatcgcttgaacccccagaaggcggaggttgcagtgagccaagattacaccactccattccagcctgggcaatacagtgacactctgtctgaaaaaaaaaaaaaaaaagagagagagataaaatcagaaatgtctcagtgttggcttcattctcagcagattcttcctaaataggagtaagattgccattatagtccaggattatagtctaccatgttagcaaagaaggagaaaggaagtgatcttttctgactctaacaaatcttccagagctgactctttctcactggattaatttgggttacctgccattcctaagccaataatgcttctgactggacctggggatagaatcagttccactgaaatttcatgaatgaaataaggaaaggtggttccctcaaagataaatctaagtgtgaataccaaaaagaagaatggatactggatagaccaaaactgtagatatctaccaagtgcgtctctcagcagcccaacttccacattcatctttttcctcatataaacaatcatcagaattctccccactaatacaattcacccatcagcatacaaccaaaaatacatagagtttctcttctaggaagggagatagcctcaagttgcaccagttcttgcatacaagttccaggatctctgggagatgcacatttctctctagactttatgttaatggcatctggactaaatgacgtatttattcatcctctatactcccagtgtaaaataatggaggggaaacgtcataataaaaattccttttgcaaatgggaaaacggggaaacaaaattcaaaggacactgctttgttgcatcaataaatgctgctaaaccaggatagcaactatatcctgccaagacagtagagcaagtttctaaatcaaccaacttggctttccccagtcctgcaagctaaccattgatcttagctaagatgggcaccagtgagaacccgctttctgagggatgcactgtattagtctgtttccagttggtgtaagttctaagggttgggatttgcaacagggggtgtatttttgcaggtttttgctcttatttttttctttctttcttttttttttttttttttttttgagacagagtctcgctgtgttgcccaggctggagtgcagtggcgcgatctaggctcactgcaagctccacctcccaggttcatgtcattctggtttttgctttcttaagtaataggcttggaatttatcccggaatacatctcttaaagtttgttagcctctgttgacttatatttgttcagttccacagatctggttagttatgactcttgcattaagagcttaatctgagggattctgtcatatgccaacaagttccagtgctttgtccattctgtaagttttcagcattcgacctggagagggcatcttggcagtgcaaacctgtagcctggattggagaagaacagctctcctttcccctaccccacattatacttcatggaatggttttaacaatggtggtagttgccaactttgtcaataaatagagccccaaaggatatgttggagactgagagactgaagaatcaaacatccccagatctcagtcttgtatctaaccacgttttcaccctgatttgattcctcttactttagcttggtgccgagaatacaggtttcaaccacattggatttctggacacaggcaagatgtatctttcttagaaaagctttaattttcttcccttaccactagcctttcaggtaggccacatttgagagatgtttgtcattgataagactttactgatgtttgcagaaagtggtcaacacataatatcctgatatttccccactagatccccccaaatcaggccttggtataaggatatggtctgattttatttaaaaacaagctgggaaaaatacctgcaaaggacatatttgataaagaactgttatctgaaatttacaaagaactcttaaaactcaaaaataaggaaacaaataactaaataaaataggcaaaagacctcaacagatacctcatcaaataagatatcccaatgtcaaacatgcatatgaagagatattcaacaccatatgtcattaaggaattgcaagctaaaacagcaatgagatgctactgcatgcctgttagaatggcccatatccaaaacactaatgacaccaaatgctgacaagattgtggagcaatgttggtgggaagtcaaaatcgtacagacattttgaaagacagtatgatagagggaatgctcacgtctccctaaaattcatatgttgaaatcctatcccccatgatgatggtagggagtgggatctttgggagtgaatagatcatgagagcagggccctcatgaatggaattagcagccttgtaaaaaaaaaaaaagaagacccaagagctagcaagttctttctgccatattaggacacagccagaagacaccatctatgaaccagagagcaggctctcacccaataccaaatctgccactgctttgatcttagacttctcagcctccagaactgtgagaaataaatttctgttattttggtatttgttagctacccagtttatagtattttgttatagcagcccaaacagactaagagagacaatttggcagtttcttataagtctaaacatgttcttactatgtgagtcagcaatcatatccttggaatttgcccaaaggacttgaaaactcatgtccacacaaaaagttgcatatggatgtttacagcagccttattcataactgtgaaaacttggaagcaaccaagattttcttcagtggacgagagggtaaaaaaagtgtggtacatccagacaattgaatattattcagcactaaaaccaaatgagctatcaagccatgtaaagacacggaggaaatttaagtgcatattgccaagtgaaagaagccaatctgaaaaggctacatactatatgattccaactatatgccattccggaaaaggcaaaactagggaaacagtaaaaagatgagtagtttccaggagttagtggggagacagagataaataggtgaagcacaggggatatttagtgcatcggaactattttgtatgatactacaatggtggatacatgtcattagatatttatcaaaatccataagatgaccaacaccaagagtgaagcctcatgcaaactatggaccttgggtgataatgattcattataacaaatgtgccactctggtgtggaatgttgatagtgggagaggctaagcagttgtaggggcagggaatatatgggcactctatttcctgatcaatttttctgtgcatctaaaaatgaacctaaaaaataaggtctactaaacaacaacaacaagaggtgacagtttagttgactgtttgctatcacctatcaaggatcttcccttctcagccaggataggaagatttccaccctcctgtgatacatcttgtcttgtacaaatccaatttagggtttgtcccatgtaaaacttcatttccatagactaacttctagaataaagacttcttgagtcattcagaaacctaactcaaactggctcaattgaatgtgagaatgtatcagtttatgtaactaaaaagtctagggactaagataaggctgcattcaggcataattaaatccaagtacttaaaagatgcagtcagaaatcaatctcctctctctctctgtctctcagtcttccactccatctcccacctccatgttgacctcattcttatgagacctctctccatgtggtaacatatgggtatcagcatctctagactcacattctgccacttaagctatacttagaaacaataatcttctttctcagaaaaattcaagctgctacctcgattgataaactgcagccacttgtgcatggcttaaacaactttagtccattgtttccaaaattatatttgcatgtcactggtgctccctgagatgatctggtagtaagcaaacatttattataatacatgccaggggctagaggggagggacggataaataggcagaacatggaggatatttagggaagtgaaattattccgatattatattggtgaatgcatgctgttttacatttgtcacatgtataattatgtgtaaatttttatgcataataaaaaataagtagtgcctcaaaattttttttcttttgcttgggatgaggctgaaataggaaggaaagtagtattcattttacaggattagggtgagtttcagatatggtgatcaggcatgttcatgatcattttgtacctttacgaatcgaattatcaaacaagacttaacctgttccatgtagttgaagtgctgtacaggcagaaaaaatctagtcactgttgtatactgaggggaaaatcttaggttaagtccctcaaagattctggaaaaatttcatatggtaattcataaggcaatttttgaaaggaagtcaatatgtcacaaattgaatgtaactttgaaaatctttaccctactttggaaaaaagtatcattttagtataacataaaatgaactacatgactgtcctctccatggttaaattccttgtctgccaacattatataactgacttttgtttcttctgatttgttttcatgcagttaattttcaagaggaagagcttccttcctaaatttgattcaaatctattccaggaacaaacagaagcttaaagtttcttttcacagtttcttttaaggcgccacttttgtttctctgtggtttcattatgagaagtaactcaaagtggaagaagattgttgtaatgtattgcatttctatacttgagagagtttttaagttcttcagataagtatggtatgtggttgcaaggtaattttcacttatttgcaataatacaaatttgtgaatttctgttatttgttagctacacagtttatagtattttgttacagcaggcccaacagaataagagagacaataagcagattctgggaaaatggcagagtaggaagaaccaggaatctctctcctgacctacccaactaatgcagtggcagaatatgacttaactatcttggaactctggagtaatctaaggttcacaatttccagaggaaggcttaggttgtgtattagtttgttcttacgctgttatgaagaaatacctgagactggatgatttatgaaggaaagaggtttaattgacacacaattccacatgggtggggaggcctcaggaaacttataatcatggtagaagacaaaggggaagcgaggaccttcttcacatggtggcaagagagagaagagtgaaggaaaaacttccaaacacttataaaaccatcagatcttgcgagaactcactatcatgagaacagcatgggagaaactgcccccatgatccaatcacctccctcccttgacatgtgatgattacaggtgcttccctcgaggtgtggggattacagtttgagatgagatttggtggggacacagagccaaaccatatcattccacctctggcccctcccaaatctcatgtcttttcacatttcaaaaccgatcatgccttcccaacagtccctcaaagtcttaactcatttcagcattaactcaaaagtccacagtccaaagtctcatctgagacaaggcaagtctcttccacctataagcctgtaaaattgaaagcaagttagttacttcctaaatacaatgggaggacaggccttgggtaaatgctcccattccaaatgggagaaattaaccaaaacaaaggggcgacaggccccatgcaagtctgaaatccagcaaggcagtccttaaatcttaaagctccaaaatgatcttttttgactccatgtctcacacccaggacacactgatgcaaagagtgggctcccatggccttgagtagcttcttcacaggctggcattgagtgcctatggcttttttaggtgcacggtgcaagaaggaggtgaatctaccattcttgggtctggagaacagtgaccctcttctcacagctcccctaggcagtgccccagtggggactctgtgtgggggctcctaccccatatttcccttccacactgccctagcagaggttttccatgagggctctgcccctgtagcagacctctgcctggccatccaggcatttttatacctcctttgaaatctaggcagacattcccaaacctcaattcttgactaccatgtacccacaggcctaacactacagggaagctgccaaggtctggggcttgtaccctctgaagccacagcctgagctgtacattggctccttttagctatggctggagctaaagtggctgggatgcatcataccaagtcccaaagctgcacacagcagtgggggcctgggcctggcccaataaatcatttttaacctcctaggcctccaggcctgtgatgggaggagctgccgccaagatctctgacaggctctggagatattttccccattgtctttgtgattaacattgggatcctcattacttatgctaatttttgcagccagtttgaatttctccccagaaaatgggtttttcttttctactgcatggtcaggctgcaatttttccaaacttttatgctctgcttcccttttaaacgtaagttccaatttcaggtcatctctctcaagttcaaagttccacagaaatctagggcaggggcaaaatgtcaccagtctctttgctaaagcatagcaagagtgacttttctccatttctcaataagttattaatctccatctgagaccacctcagcctggacttcattgtccatccatatcattatcagcattttggtcaaaaccattcaacaagtctctaggaagttccaaactttcccacatcttcctgtcttcttctgagccctccaaattgttccaatctctaaccattacccagttccaaagttgcttccacatttttttgtatttttgtagcagtaccccactaccttggtaccaattaactgtattagtctgttttcacactgctataaagaagtacctgagactgggtaatgtataaaggaaaggggtttaattgaatcactgttccacatggctggggaggcctcaggaagcttacaattatggcagaaggggaaacagccaccttcttcacaaggaagcaggagagagagcacacaggaaaaaactgccacttttaaaaccagcagatgtcataagaactcactcattatcatgagaacagcatgggggaaaccacccccatgatccattcacctccctcccttgacatgtgggaattacatgttcctccctcaacacaaatagggattataattcaagattcgatttgtctggggacacagagccaaacaatatcaggttgtaaattgcagttagtttcagtcattgtcagctgtagccatcccttaccctcagcggcttggcaggcagctgtgcagatgatcctggagtagcttacacatagctttgcccagtgtggacaaaggaatgctgtactctaattattggggatctgtgctctaaattgttgcttctaaacatagaagtacagaaaaaggaaaccactgttgcatgttctcttattgttgcccccctcccccaccgaccccacttcccccaccctctagtgacttccaggaaatttgaaaggcaagtgctttttccccactttcatttttctcctttcttttctggagggtcagacattaaggactaggacatttgaaattaagtcaccacataaacccggggaaaggggtacagactcagaaaacacttgagaagaccttacgtttgcacctcaggctaatgctcagcacacagatagcctacaaccaccccacaaaaaccaaccccaaaacaaaactcggcaagtcctgggaagggagagaatctgatttttaaagttatcacattactagacccaaatgttcagttttgaacaaaaaaatcacaaggtatatgtattggtccattttcatgctgttgataaagacatacctgagattcagcaatttacgaaagaaagaggcttcttagacttacagttccaaatggctggggaggccttacgatcatggcggaaggcaaggtggagcaagtcacatcttacgtggaaggcagcaggcaaaaaaataacttgtgcagggaaactcccgtttttaaaaccatgagatcttgtgagtcccattcactgtcaaaagaacagcacaggaaagacccacccctgttgattcagtcatctcccatcgggtccctctcataacacatgggaattatgggagctacaagatgagatttgggtggagacacagagccaaactgtatcagtatacaaagaagcagtaaagcatggaccattcaaaggaaaaaaagaaatcaacagaaacttccttgaaaagacctgatggctggtgaatctaccagacataaaaacaacggtcttaaagatgctcagagaactagaggaagatgtagagaaggtcaggaaaacaacacatgaacaggacgtatcccatgacgctcatccaaatgaaaccatttggtggggtgcaaccccagaatcacgatgggtgccttgtgtacaggaggccaaactttatataagtattgtacatttagcagtgggaactacaatccctggccatggtaaaggtgctagaggaatccacaattaagtgcatggcaactttccatgtgacagtgttagttttgaatctcgcagtgtcacctgtcattcttgcccacaactggaaatgacagtgaccccagtgtccccagtgttcaagagactcataatagtttgtgtagtacccttttcccctgcctctcaaactagggcacaggcgttcagttcccactggtggccccaaatcttggccccatctttagtctgtcttctccaaagatgttagctcaggatataatggtggaagtggttccttttcaagtagtttctctctggcacccaccaatgcctctgctgttttgaacccttcaagtgttggtgggaacactcagggcagagaaccagtcagcaaaatcaactcagtctaacaagcattcctcttgcggttcaattgcttgaaccaatcgtttaacattaagatctcaggatttgggctgggcgctagtggctcatgcctgtaatcccagaactttgggatctgctgcacagatcaacccatcacctaggtattaagcccagcatccattagctattctccctgatgccctcccttccccatcccctgacaggccccagtgtgtgttgttccctgccatgtgtccatgtgttcgcattgttcagctcccacttcaggccgaggcgggcggatcacgaggtcaggagatcgagaccatcctggctaacacggtgaaaccctgtctttaataaaaatacaaaaaattagccaggcgtggtggcaggcatctgtagccctagcaactcaggaggctgaggcaggagaatggcatgaacccaggaggcagagcttgcagtgagccaagattgtgccactgcactccagcctgggtgacagagcgagactccgtctcaaaaaaaaaaaaatctcaggattcattacagaaatgcaaagcaaaatgacaatgaaataccatctcatgccagtcagaatggcgattattaaaaaatcaagaaacaacagatttggcaaggttgcagagaaaaaggaatgcttttacactgttggtaggagtgtaaattcgttcaaccattttgaaaaatgtggtgattcttcaaagatctagaggcaaaaataccatttgacccagcaatcccattattgggtatatacccaaaggaatataaataattctattaatattataaagatatatgcacatgtatgtttattgcaacactattcacaatagcaaagacatagattcaacacaaatgcccatcaatgatagactagttaaagaaactatggtgcatatacatcatggaatactatgcagccataaaaaggaataggatcatgtcctttgcagggacatgaatggagctggaaaccgttattctcagcaaactaatgcaggaacagaaagccaaacaccacctgtactcacttataagtaggagctgaacaatgtgaatacatggacacatggcagggaacaacacacaatggggcctgtcggggtagggaagggagggcatcagggagaatagctaatggatgctgggcttaatacctagataatgggtcgatctgtgcggcaaaccaccatggcacacgtttacctatgtgacaaacctgcacatcctgcacatgtacccctgaacttaaaataaaagttgaagaagaaaaaaagaggaacgtgataaccttcaaaaaagtctcaagatccataaatgcttgaggggatgggtaccacatctttcatgatgagattattatgcattgcatgcctatatcaaaacatcccacataccccataaatatgtacgcctactatgtacccacaacaattaaaataaaaaaatataaaaaacaaagaaaaagagaaaaaaataaaataaaaatttaaaataaaaacaaaagatttcagtttcctccctcagctcatactgatccctcagttgttcaatagggatcccatctgtctcttccttagccaccatgcttaagcagccaccatgcttaacagccatagccacacgactcttcccttgggtccagggcagcctgaggccttccttttctgtggctccttttatcttttagtgggctcctgatggtggtttggagctccatttgctatgtgatgagggagtagccaccactcaccactgtggctgtgtttttggcagcgccccacatgggcacattatggtacagttttccaacgatgtcccccgtagtcattcctagggagactaagagggttaatggagcccacctgttggatgcccccattttattaagtcgtgtatttgctgtcaagcagtggtacatcatctaaatccccttctggattgatagagccatagaggaggctcctggggctctcaccaagtcaaagggtgcttgaaagtctttctagaattgtttcaatttaggaagatcaccaggtttcaagcagattggtttgtcaccagattggtttgtcacctgtccaatcctgaggagttggcctattcaatgtgggcaaagatccattataacaattaatcccatcctctctcatctggtccag

SEQ ID NO: 4146 - DNA, 1186 bp, Homo sapiens
atggccctgccacattgagtgcagcctcccgggcatgcaggtccatgatattcaaagaacattttatgaagaatacatcctgtgaaagataaagctggtcaaaagtgcaagcctaccaatgtgtttgattttcctaataattctgccgtctcaagaattggcaggcttggtgaaaatgagaaagatgaagaaccttatgaaacctttgatcctcctttacacagctcatctatgtatgccaatgaagaattctccaaatattgtggattatctaccacttcaactcctgcaggaaaagaagcaaaaagaagctcgagcacttctgaaaatgaaggaagtgaaaacgaatctgcaaaaatgagtgcaaaaagccaggaagaaaactcaaactcagcgatgagtctgaaagcactgaagaaagtgatgtgagaagaaaagttaagtcagtggagaaaataaagacccaacaacacgaggctattccaactacagcatcttcagccctttcagagaaaccagccgactcagtcacttccaaaaccataggacccattaatgcccagccatctgttgaaaaagacacactgacaacagaaagtcaagcaaaacccagaaaaaagggaatatatcttatggcaaaaggaagaaatcaagaagtgaagcaatagactcagatatttccaacattgtgcatatttggtgtctggaaggaaggaaaaccaacgacatcatggaattgaatattgttttgcctgcatttgagaaaaacctcgtccagtataaacattgaatagaatctaaaatttgtaagaaacacatcaataaattttattgtactagtaaagaagaactcaacaaaatgcttaaaaagtccagatattgaaaaatctgaaaaagaagaatgctaaggtaatttcagatatcaaaaagaaatgacagcgtttgactgaagtccaggatgagctgctttggttagagccaccaactgaaacaactacaaacaaaatattatgaacttaaggagagaacagtcttcccttaggaatgcagctatttcttatctaattcaaaacaactccatcggaagtattcagatgttcaggagaaagaaccaaacgtaaaggaaacataagattcatccagccttccaggtgttatttaaagtaggaacacttttgggagctga

SEQ ID NO: 4147 - DNA, 1938 bp, Homo sapiens
gataactgtattatatttttcatctagctataaaactttaatcttactcttaatatcctggatttaattaaaactcctgttgggttcttcacaaatgagaacttgttcaaaggatttattgaactggtattgatttcactgaaaattttccacaccaccaccattgtttttttgaattcttggtgttgtgcttcccaccttctgtccttttcgtttgtttagagaagatgaatttttaaaaagcagataaattgctaatgagcaataatgaccttatctttaccaaaacactgaaaattaagagaggttcagtgttgaagaagcacaatatgctgcggtgtctttttctagaagtgaatggaaatcttgctcagttggcatttcaagcaggaaatgaaatgcttgctttaatggcaaagcagcgttaacatttttcctgtcgtgtagcagagagtacaagaatcatttcagcaaagcagtgactcaccatgagacgttatctccatggagctgcgttttgacttttcccactctcttactcatagaaggaggacaaaggaacgaaatgaaatcatgctcacaatgaactgttcattacatcaactgatctctctctctctctcttcctctctttctctttctcccataccccaaggcaaaatttttttaaagaaatgactttaaaaactatcatttctgtattttaattacatctcttagaaataaaattatgtttgcaccatagctttctaagaaaaaaaaatgtgtttttaactgagtcttagttgcttagtgcttttatttgtgttatttttagactgtattttaaccacaactacaaggatcatgtttcattgcacttacttatttgccagtgtctgcctgtctttgctaaatacattactatctccaaattgcctaaaatctgctatgattctacagtaaatagctcagggtatttctatttatcactactaaaagggcaccatagtatgttttggtactttaggcagtaaacactgcttggtttatcattttgttattaaattagaacaagaacatcaaatggatttgctgcactagttattctttgtactgttgagcaacttggtgtgcttatatgttgtgttggttgaagaactcatccgttttattgtcttgtaatatgaagttagagtgcctttttatatttgtatattctgaaaatgttctgtggaatgttttgtattttttcatttgagtgttatcagagcaatatgataccagtgagttttcatttcaacttttctttgaatgtataaagtgtcttttttcctatttccccttgtacttgcattgaaatgaatatgaaaatgcttaagttttctataggaattgtttgattttgcagtgctaaaatgctttcgtcttacgaaactataaaccataggtcagtattataggggaaaagcattttaagatagtgacaatctgagtgtttgtataaaatgtaattctatgcgtttcttatgtgatctaaaaattcaatgcaaatatcttttatttggtagttttgtctacatattttatgctctagcatgtgcaatatatctttgtaaagcacgatgatacaaatctggtgccagtgttatattttgcataacatatttgtaacagcataaaatattgtttgatgatttcagtgggattttgtctataatgttttcttatgtaaattggagttgaatgactctggtaaatgtcatgactgtaaaaatggggaaaatgacttttagttcagtgaatgactttgaaacaatctgaatcttctcaagcacagtttaatacttttgcaactactgaatgctctaataacgtaatgaagtacttaactgtaatatactatggaaatgcattcagatggttatttttacaaataaaaacggtacaaatattgtt

SEQ ID NO: 4148 - DNA, 590 bp, Homo sapiens
gtgtttcagagaggctgtaccagaattaactctgctcagagttagatttgctggtcttaaagtacttttcctctttaagataaaagaagttcttctaaatcaggaatggattgaaatctaatgaaccgaaactttgggtaagttttcatatgaaacttttgagttaagttattttttcctaactacatagcaatacgtagtcattgtagaaaataggaagaggaaaacaatagaaaagtaccactttagaggcaaacattccacattttattgtatttccttctgattattcttcaataatttttaaaaattgtggtaaaatacacataatataaaatgtaccatctgaacgattttaagtgcacatttcaatggtattaagtacactcacattgttgcactgcaataactaccatccatccacagaactcttttttatctcacaaatttgaaactctgcatccagtaaagaataactcccatttctctcttccccagcccctggcaaacaccattctcctctctgtgtctatcagtgtgactactctaggtacttcatataagtgatatcatgctgtatttgtcctttt

SEQ ID NO: 4149 - DNA, 1893 bp, Homo sapiens
ttttttttttttttttttgagacagactcttgctctgtcgcccaggctagaatgcagtggcaatctcggcttactgcaacctccacctcctgggttcaagcaattctcctgcctcaacctcccaagtagctgggattacaggcacccaccactgtgcctggcaaatttttgtatttttagtagagacagggtttcaccatcttggccaggctggtctcgaactcctgacctcgtgatccacccacctcagcctcccaaagtgctgggattacaggcgtgagccaccacatcggccaaggaggactctttcaaggtgattttaacttgttccttcatatttatttttaactgcagaatctgaaaaaacagctcttgttttatattaaagggagatcaaaaagaaagcctgttgcactgccagaaaccatctaaagttgggatgcttttggtgtctatatgttcaaagtgtacacaatagtctcttgactgtttttactttcccatctgaagatgggaaattataccacttaagcattttatattacctttttcttctagcacttttgcagcatttgttgcaactctgtaaagcaatgaaaattagtacatgtgttaagcaataacagtacaaaatgcaacttctggtatgagcatctgataaaagctctgggctctctggttagaaaaatgcatatagacacaaaatttgcacgctatttaaaagggttccacaggccctatactaagggggtcattttctttctttctttcttttttttttttttttttggagacagagcctcactctgtcacccaggctggagtgcagcacttttgaaactttatttaatcctcacaactgtactgtaaagtagatattatccccattttacggataaactgagccttgtggagcttaagtaacttatttaacatcacccaactggctagaactagaacgaagattcactcctgggtctgcccctgtccaaatactgcgcttcctcccactgcattttatatccgggtggcaaaacctcattaggaacttgtaaatacaaattaaactaataacaaggagctaaatataccttttacatatctgttacattccctccaagaaagttagccaagcggctaagcatccaggaaaatgggaatatgcatgtgtgttgcagcacgtgttgaaggaccactaggcaatacaacccaagaaccacaactgcaacaaaccctactcttaagaattcatttctaggaaaaagacatgaaagaagaaaaatctagatgcttatagttttctgaaacaatattagttaaagcaaatgcagggaggaaaaatcttatatccaatagcagtgtaacagttaagtaaacaattgcttataaatacaatggagaatgacacaaccttttaaactggctaactatgatgactgtgaaaacatggaagaatgtctataaaatagtgggaagtaaaagagcacaacctaaacgtatatatagatacaatcatagtaacaaaagccttttataaggagaagtaaaaactaggtgggaatgcaaataaatgaaaatagctgtattagtctgttgcagtgatgaatacatgaatgaatgaaaatttaataatgaaaatttatttttttaaagaaatcacctatccagaggaggaaaggaagggctaaggaagtttggtcctgttgggcaatgatggcactggcacttgatgcccacgatctgcctgggggcaaagtcctgccataccagccactctccttccccacccgtcctaactaccacaaggatcacctggcagcatttcacacctacagctcttctcctttctgggaacattgagacagctctgagtgggaggggaaaagcacgcac

SEQ ID NO: 4150 - DNA, 11399 bp, Homo sapiens
accctggcacctccccacagccccgcatcggacccaaggacagtcccaggagacgtgggggcgctcacccctttcgtggacgggaaactgaggcaggcgggtgaaggtcggctcacatgcggagctcaggcatcaccctatgttccaggtgagccactgaggctcagggaggacagaggtgaaggatcttgccccagtcacaggaggaatcacaggcagaaagggggagatggaaagaggtaggagggagagcagggaaggagaggagggactggagggggcagaaggaaggggaggtggctgtcccaggatggagtcaggggccatcctcaaagtccagcttcagcttctccaggtttttgcccacatcctgggacagggggctcctctccccctggacatactcatccggtgggcagctgtgcctgctaggaaggccttctacccacctcccagacatcccacagggaagcaactttcactcccagaccgctggtgctcccctgcctcccaggcctggggtgggtgtgggtgaggacgctgcaaggtagtggtcaggacacaagcatcagcatcggacatccctggttcaagtcctactcagagtgggaaggacacagactttgcagtgattccttgtgtgtgactcccagcttcaccactcctggttgtgcaacctcagacaaatgccttgacctcccctggcctcagcttccttatctgtcaagtggggtattcctagtctccccaggccactgaggggcatggtgggaatggataagaatgtgggtgtgagctgtatgcatgggagggattgattatgttccagtatgtgcctgctaggaaggccttccactcacctcccagacatcccacagggaagcagctcatgttcactgagcactgacgggatggctggtcctacatgaagtcccaggaaagacctgtgcatgaagtcccagggaagaccctgacccgctccctgtgcaggcagggtagacagacacttgaacaaataaccacagtccaagacacaaatgcagatcattttcagatgcatttaattctgaacagccctgtgaggagggcaggacaaagattattatcccattagacagatgaagaagctgaggtccagataaatcaagtgagttgctgaaggtcacacagcaatgaggggcagagctgggtcttgaccctggagcccttttcactctgggggtaccaggcctgccagaaaggttatcaccaaagggttctggaagagtgacctcctcaaactttccctgtcctcagactggcttgtggcctgagagtccgctatcagcacatcatacctttggctaaaaatgtgctaaaaatgtgccagcccctccagtgtcaatcaaatggccatcagtcatttacacttgagtgtggagaagccgatcagattttatgggttggagatgagaaggaatcttgagtgtttggacttttgggtgggaaactggagatatgagaggaaagtttgacagcagagagaactcaggaggtgggtggggagggagtcatggttaactggaggatggagtgagtccgcatgacctagacacctctgtgtacctcacctccatgaagtataaccaatgtctggcactcgtggagcacttaggatataccagacactgtgctctctccttttttttgagatggagtcttgctctgtcacccacgctggagtgcattggcatgatctcagctcactgcaacctccacctctccggttcaagcaattctcctgcctcagcctcccgagtagctgggactacaggtgcatgcccagctaattttttttaaaaacatattttagtagagaccgggtttcaccatgttgcccaggctggtctccaactcctgagctcaggcaatcagcccgccttggcctcccaaaatgcagccgctctctcctttaatctttttgtttgtttgtttttaagacagtctcactctgtcgcccaggctgcagtgcagtggcacaatatcagctcactgcaacctccacttcccaggttcaagcagttctcctgccacagcctccagagtagctgggactacaggtgtacaccaccatattcagctaatttttttgtatttttagtagagatggggggggtcaccatgttggccaggctggtcttgaactcctgagatacccctgcctcagcctcccaaagtgctggaattacaggtctgagccaccatgcccggcctctcctttactcttcatggcaactgttatctttctttttacagatgagaaaagggaggcacagagaggctaaataatttggccaagatcacacagaagcagaggagcagaagggtggacccaggcaggccagctctgcagcccctgctcttggccaccatgggctcctcctctgggctaacccagcccttgccagaatcctacatggaaagtattatcatcccattgaatagaagaggaaatggaggcacagaggggccccaggatggcagaattagtaactggggttggggggagctgggattagacccaggtctgaaagccaggccttccctctacccttcctatttgccaaacacccgggccccatcctgcccaaggtcagcagcccaggtggcaggatgtgcttctgcctggtgctggccttggggagcacttgtttttccccagaggaagcagcaggtgtggccttctttatggaaatgatcctaactgggttggagccaggattccccccaacacacacccaggccaggaggacttcaataggactaggtcagagcttctaggcttggatggaggggctggaatttgggagaggggctcggaggtcagtcccattttggtaagcctctcaccctctggactccatatctcctgctaatcgcactccttggatgagacagtgacatggaagtgcctcccagctcagccctggggagacctctccaaggtcactgaaggaagctgggggcatgcccctacccttctttctggagcagagccctgggaccttctggagtcccagtcaggctggggtctacaagggttaagactccaagtgacttctctgtctgcccctcatgcagataaaagtttccattcaaggaagagctgccttagggctgccaagttatcctgattctgtcattgtagcatcaaggtgggggccttgggccttcccagcctcttcaaggggacattcttgggtgggatgtggctcctaactggtgtcaccacctcaaaggccaatatcccaagacccagaattcccacgttggactcagggactggcgagatcacactgactccttctgccagggccctttaagagccgcccatcccgcccatgatgctcctgcttagtgagtcagacacttgcattaggccccaggggaggaagagaaacaggcctcagaaagcacttggaagggcagggaagggctgggaagaaacctggctcagaagatggtgccctcccctcacatattcccagactggaaggggcatcttacttctgagctccccacagccccagcctcctggctgtctctcctggctgctgaaataaaggccaagcccttttatcacctttgttatgtgaccctgcctgctggttgggcctcatctctcgcccctagttctttgctttcagggccacaccagccctcttgactgttcttgaatccatcatgattctttctaccccagggaccttgcactagccagcatcttgctgcgcttcctcccgtctcaattggctaatgtgggagaggcattttctttacacacccagagaaaatagagcctgctaccttccaagactgagagggttggaagaaactttttgtattgtagcttgagggtgggaaggagaagacacaatttgagcataagaaggtgagctggaagctgggcacggtggcttatgcctgcaatcccagtgttaggaatgcttgttctccactgctgcaaagaaatagcactcaaacataaatttaattttctcagcaagcaatttttagtttctgtagaaagggtgctcctcatagatggaacaatggtgagagcacagttgaacaagggaggggaaggggttcttattcctgacccaggtaatccctgctgctatgttgttcccctgttggctaaggttggaccgcacggtctaagctaattccgattggctattttaaagagagcagaggtatgagccagagtggcgaggtgagtagtttggcaggaaggacagttaggaacgggtaactaaaggtgacttacatcagagcaggtgaccaggggtgactcaggtcaaagcaggtgactgggatgagtcaggatggagcaagtgaccaggggaacaggtgtgaactactgaataaaactgatggaaaaggttgtttactgaaattagaagcaagggggcgaagagaaccaggaagttaaactttaaaatggagaatcaaagaataagagagctgaacatacagacatactgattctttgaagaaaaacttggggttcaccatatttaacatgagcactttggggggttgaggcaggtggatcactgcaggtcaggagttcgagaccagcctggccaacatggtgaaaccccgtctctactaaaaatacaaaaactagctaggtgtggtggcgggtgcctgtaatcctaaatacttgagaggctgaggcaggagaattgcttgaacctgggaagtggaggttgcagtgagctgggattgtgccactgcatgccagcctgggtcacagagagactccgtctcaaaaaaaaaaaaaaaaaaaaaggtgagctggaaataagctcaggctcgtgagcagtttatcttctggaataaagtcgtttgcctttttaaaggctctgtcttcctccatttctaccagaaaccagacctctgagggccccttcccctcccaccatcctcaggatctgaagccctggtcctccctcactttctgtccagcactggaaccccaagggacagagagtgtgtgacagctcctgcaggaagctggtcagacaaggagagtgctgggttaaaggggataaatttggaaggtatccagggacctgatcagggaggatcgtgagtcccaaggagagaagtttggatttcttcctccagtcatcatgaagcttggagggtttgggggcagctgccttggaagggctgaaaagaggtggacggcactggtgagacaatcccttccccccccctctacccgccagccacagaagaaggactccgcagctcttggatacagcactttaatgccagtgggcctttaggatagggaggagttgggagccaatctccatctccgtactcctaacccaacttccaccacgctggaggagacaccagggttccagctgtgagcctggtgcttgccttctgctacaagccccatcccgacctccttggagacttctagctcaagctctggaggaaatccaccagcaggtgctcagggaagccaaagtccatctgcagcagcaggaagccctgaagggaggggcagtaggagagaggggcgagctgggctgactcccaggccaccaggagggagccaagctggtagaggcccctctgtctgtctccccaacagcccccagtcaccccaggaatcctgtctgggcctctctccccaggaacaggggctggtgaggggggctttgtactcacatctcgagtgataatctcagggttgatgatgtcgaagaggctcacgcctttgctgttcatgagggctgtaaacactacctcgagccctggggcaggggacagagccccagtcagcccttcttggggagcaaggccggcccgaggctctgccaccctgggtagtgggagatgctgagacccttttggaccaatattctgtaaacatgcgtttcactttgatttagcagagtgagcaagtgcttctgaggatgaggaagagcagagtttgcctggcggcagggcttgccactctgctgccaaaaaaaattcccttctgccccaaacttgagctcccaacccatccacaatggccacatgacctgcagttagctgagtctaccctgctaggaaggaaactttcccacacagcttctcaaagtgttctttgcaaccacacagagtggtctccttgcaagtagttgtaggaaccatttaatccacatcccctagttttagcttcatggttcagatggggaaaatgaggccaagagatgccaagacaccccactaggatcattccagtttccacgcccttcctctcctacctaagccatgtggacaagcagatgttcaaaaggaaagcacagtcagctcaacatactctgtggggaagggagcagaaagctctcagcagagcctggtccaaaatacccccagcacacgtgtgctatggtgtctgagagtctaccatccgagtcacctcaaagggataaatattctaccatttcaaggtcaaaaggaaaattgggaatcatcaagttcaacattcttgtttcacagaaagggaaactgaggttcagggctgggctagaactaggtctcagactcccagcccaggggtctttctgctatatcaggttgctattaggagacctgcatcctgaaagtgggttgagccatcccgcggggtggcaaagataatattctgcaggtaaaccaagaacaggggtctgggcatctggccgagtcattggcgtgcaataccaccagcagggagaggaaagggggccaggaccgctaagtatcaatgactgggaagaggggcacctgaagctctgcctgggaagggcccacaaggtgaaatgggaagctctgtcagcctcggcacccagtttcccctccagcccacacttacgagacatgacctcagggatgcccacagcggtgatcattgactgcaggaagctctggacggactcggagctgctctgccaatcaaatgcccatggagatcttgggcatcttgaggcagtggacggtgacttgggcctggctggggaagccgccgacaacctgtggaagacaggggtcccatggccaggacaggggcccatcagggcagcagcagtccatgccctcggagatgggaaggacaaagctggctccgggccccagggctggggaaaaggaagtagctcggggtagtgcccaggccccaggctgtgcaaattaggactcttgtcctctctgggcctcagtttctcatctgtgtgctagtgaagctattcctaccctgaactcctctctcaggatgtgctgaggatgccttcacttagccttctgggcctcactttcctcatctgtaaaatggggataatcatagatcctacctcatagggttgtcctgaggatggaatgagataatctgtggaaagagcttagaacaggacctactgcatggtaaccctccgagggaagctgctgtagcagctgggctaggggtggggatagagcagagagcgcaggagctgcgggccatatctgcaggagcccagcattttccagggcatcccagaacagaacgtaaaactgcagctgaggagtatttaaaggagagacacaccaggctgtggcacgaggggacctgacctagtcagggaggtgggagaggccttccctgaggtggcaggaggaggagcagatggcatgggggagggcaaaccattctggcagaggggacagtgtggacaagagccctgtggaaggaacatggccaagataaggaatgcgcaggcagccagcggggctggggagtgtggcctgaggaccttcgattacagcctgtgggactgggctcaaggagatcacatgccccaagaaaccactgaaccgctggatacacaagaaaaggtttcattaaatacatagctcagctcaaaagaaagaaagggccggcggggtgcgggagctcacacctgtaatcccggcactttgggaggctgaggcaggaggatcatttgaggtcaggaggtcaagaccagcctggccaacatggtgaaaccccgtctctactaaaaatacaaaaaaatgagctgggcacagtggtgcacccctgtaaccccagccaatcgggaggctgaggcacgagaattgcttgaacacaggaggcgtaggttgcagtgagctgagattgcgccactgcactccagcctggggaacaagagcgagactctgtctcaaaaataaataaattaattaattaaataaaataaaatgaaaatctcagtgggtaagtaaacaaataagacacagctgtaaaaagaattaatgaactaaaaagatacttgaagaaactatccagaatttaggatagagataaaagagatggaaaacacgacagagcaactaagagacacggaaaatggaatgagatggcccaacgtgtgtctcatggaaattccaggaggtaggcatggagaaaatagggatggggcaatcatggaagagagagtgatgaagaaatttccagagctgatgggctgggtgctgtggctcacacctgtaatttcagcactgaggcaggagaattgcttgaacccggaaggtggaggttgcagtgagttgagattgtgctactgcactccagcctgggccacagagcaagactctgtcttaaaaaaaaaaaaaagaaagaaaagaaaagaaatttctagagctgacaaaagacctcgtcaactttcaactaaacagttacaattacgctgggtgggaaacaactagatgaagaagtagacaggatgagaaaatgcagggccctggaggccatgggagagcgtttagcctgtatcctacaccggctttaagcaggcaggtgaatgaccagttttatttcttgaaaagattgttctggctgctgtggggaacagattattggagggtatcaggacacagggagacccaccgggagctacagatgggtccccactagagataatggtagcctggggaggaggtagagacagagagaaatggaaagactagaaataggacatcaaaggaacaggactcagacaaggggctaagggagaagagccggtcaggggcctgcccaatattgtgagttgtgtatgtgcaaggagagaggcatcacagagccggggaaggctggacggcctgagttcagaagggaagagggaccgtcctctgttagaacaggagaacggccgcaggaaggcgcaggtgtgggtgagtgggttgcgactgggagcagcgacgtgggggggaagttctgttggtggctctgctcagctctctggtaagcaggttgtgtgtggagagggaagtggaaggtagacaggagggggcagctggagatttgaggatggcagggaaggcctgaagaagtcattgcagtgggtggggggagtgaggtgaccagaaagctgagggaggcttactcagaaagcatgaggtccatttgaggtaggagatcatgggttcttagtggaaccctgcactgaggagtgggattatgaacatcattgccactgggcatagcaagaaggggctgcgacctccaaggagcttgcctgaagtcagctttgggatcaggagtaatcaacagtcacttattgctggggccctctgagcccagagttgatcctggggttccagccccctacaagtccctatgcctgggaaatggagcagggaatggagccttatctttgggggcaatagagctgggctcaaacccagccttgccattcactaagtttccctgtgtgtaaaatggggacagtttgaccgccccactcatagggtcggtgtgagcactgaaggaagtcacacacactaagtgcttcactccatgccgaacaaccgagtaggagctgtgttcgctgttataattgttgccattggtggtgttattggctgtgtgggggctcttgaagccagagcaggattggggtacgtgagataaaccccacacaggggcagggggcagttacctcttggaagatttcctggttggtgttgaagccccaggtctccagcactgcctgaaaagaaatgaggaagttggagggtgggtggagtaaagtccactcctcagaagaaaacttcgcagggaccaagggcagtttcaaggactggacccctcctcagacgcaactcccaacctcccagacaacatgtgagatgctctgggcagggtgtggaacagggaacccctgtcccggctggaggcctggcttctgctccccactgtgccccacacatgctgtgtgacctcgcacaagtctcttcccctctgtgggcctcagtttcctcatgagttcaatgacaagcacagcctggaaactacctaagcatttctagtacagtataggtgaagagtacaggctttggggccacctcttacaggctgtgtgatcttcagtaagtcacctaccttctctgagctttgtggtttttttgtttgcaaaacagaggtaacagtacttatttcacaggatgagtgcaacaaaacaaagtgtagcaaatataactgcaataaatgtaagtctaatatcaacttatatttaatgcacagttactacgtgccaagttatatctatacctaaatctattgatcactctgtctatctatccatctatctatctggcaacacatagttgactccaataaatgctggactgtatttttttcttgagatggagtcctactctgtcacccacactggagtgcagtggtgccatcatagctcactgcagcctcaacctcttgggctcaagtgatcctccctcctcagccacctgagtagttgggactataggtatgcaccgccgtgcacagctgatttttaaacttatttttatttttgtagagacaggggtctccccatgttgcccaggctggtcttgaactcctggcctccagggaccctcctgtctctgagagaagagagacagaccctctcatattgttttatattgttttatactcagaaaaagaaagagaagcgaaactaaaggcaggtagcccaacgcctagagaccagacccgaaaccaaggaaccagacccgaaaccaggcctgggcctacctgacctaagcctggtagttaaagatggacccctgacctaaccagttatgttatctatagattccagacattgcatgaaagagcattgtaaaaatccctgtcctgttctgtttcgttctgattaccggtgcatgcagcccccagtcacgtacctgctacttgctcaatagatcacgaccctctcatgcagacccccttagagttgtgagcccttaaaagggacaggaattgctcactcggagagctccgctcttgagacaggagtcttacccatgctcccggctgaataaac

SEQ ID NO: 4151 - DNA, 8403 bp, Homo sapiens
gcgcccgccaccacacccaggaatccaacttgctgtttgctatcacatgtgctatacatgctgttgatgaaactgctaaaggggctgaatgtgactgacgtctttggaaggatgagacttagcgtgcctgtacagttgtgtccaaatgctgtcctcatctcccaatgaaaagggtttttccttaagcctcacaacaatttacagcattgccagcagcattcagtacattcagaacaggataatttcacccgcagctgaactagggccatgcctgggacagacagagaatggccttccagcagacatgccaagaagcaagccagggtcagtgagtgaagaggagggcaggcccatttgaagcaacacagtttatgtaagtgtgatctaactgctttcactggaaatgggtcagactccagttgagagaaccaggggcctgaatgaccccagcaaaatcactgtggcaattctttcaatcacctctgagaatatggccctgtgacgacataatgacgtttggattaattccagtcggctgtgttttcccctcctttcttgcctccccgtagttgatttgccaaattttttttgtttgcttaaatacgcggaactaaacaggatacattatatgacagtctgtgataaatttaccactgggaatagggaaaaagtatgggataaagaaataggtatttttcgcctctcacagctgtgattcagttctgactcaaaaggaagtgtgccacctactgaatcacagaaaccacttcctgtggctgtttggtttattctggaggagcatcaggccaagtgctgccctgccctgaccctgactggctcttcagagccaaggcattcacagcttgaggtggtttggcctcagactcttgagaacattgcatattaaattacaagtgtttcgtttcctagcaaggagtctttagcaacatgaaaacgaacgtgtgttatttgcaaaccaagtatatcattactgaacctgaatatccttactttttcataagatacatgaaaagaaagaaggagagaaggaagaaaggagggcggaaggaaaggaagaagggagagaagaagagaagaaagaagcagagaaaggaagagaaaagaaattacggccagtgcggtggctcacgcctgtaatcctagcactttgggaggcctaagcgggctgatcacctgaggtcaggagttcgtaagccagcctggccaacatggtgaaaccctatctctactaaaaatacaaaaatcagcagggcatggtggtgcgtgcctgtaatcccagctacctgggaggctgaggtaggagaatcgctggaacccgagaggcggaggctgcagtgagttgagatcatgtcactgcactccaggctgggcaacagagtgagactctgtctcagaaaaaaaaaaaaagaaagaaagaaagaaagaaagttaccattagttttttgttgtatttgcaagcaaagacaaaagcaccaaggtacttgtttccttctgtaattagagtttcaaatagactaaaagtttctgctcttaggtgggtctagagactctccagtacctcaggacctcaggacacatggggtctcttggttgttttcttttcattgttgttgtttattttatttttgtttttattttttaactttaaaacaattttttgtagatgaatatgcttacatatgtttgggggtttttttgagacagggtcttgctctgttgcccaggctggagagcggtggtttaaccacagctcactgcagcctcgacctcccaaggtagggactgcaggtgtgtacactggggtgcaccaccacacccagctaatttttaaatttttttttgtagatattgtctcactctgttggccagactggtcttgaaatcctgggctcgagcaattctcctgcctcggcctcgtaacgcgttaggattacaagcgtgaacaccgcacctggccagcatgtggtctcttaaccagaggaggcctcttctgaactaggtagaggtcctgagaattgattctgagagtaaaaggctctttgttctcctcagagtagattagaatccctaatgatagagcatctattattcctctagtggtccatgcccaacagattcatccaagaatagatgaagatctttgtaatgttgtgcaagtaatctaatcaccccacagaagagctgtgacttaaattatcccagagtcggcccacctgttttcataaagatcaatgtaacttgtaaatttcttcagttctcctcacctatcatcatttgactaacaaaacccagaaaactaggctagttatggtggcctatgcatataatcccaactctttgagaggccagggtgggtggattgcttgagtccaggaattcgagaccagcctgggcaacaaagggagaccctgcctatatcccagctatgcaggaggcgaggccagaggattgcctgagcctcagaggttgaggctgtagtgagccatgattgccccactacactccagcctggatgacagagtgagaccctgccttaaaaataataataatagtaataatatttcataaagatacaggaaactagattataattgacattttcaaagtgaaatactgtctagaatggtgcttggccaacagtaagctttttgtaagtggaagtcattactactactatttctttcattattattaccattactacttttttttacaaaaaaaaaaccctggacaacacactgaaaccattactacttctactactataacttaggttgcacctgatagagccagcaatttttccaaggtatgacaatggccatatgtttaatgatataattctatggctcagtgtatctcagcctttttaaaccctgctcttcttttgacaattgtaaaaatcttaaactgacctccagttgaaatcctctgtcaagaagatattgtcggccaggggcggtggctcacacctgtaatcccagcacttttggaggccgaggtgggaggatcacttgaggttaggagttcaagaccagcctggccaacatagtgaaaccccatctctactaaaaatacaaaaattaggcaggcatggtggtgtgtgcctgtaatcccagctactcaggaggctgaggtaggagaattgcttgaacctggcagggcagaggttgcagcaagccgagatcacgccactgctctccagcctgggtgagactgtctcaaaaaaaaaaaaaaaaaagaaagaaagtaagaaaaagaagaaatcccaatctcttcttttatgtggattcttcctcacttgaataatacttttcttccccagtattctccatattatcccagagtcagcccctctgtttttgtaaagatctacgtaacctcctctaagtttcccagttctcctcacctatcatatcatttggctcaacaaagggcaggaagctagattctaattgatattttgaggccgggagcagtggctcatgcctgtaatcacagcactttgggaggctgaggcgggcagatcactggaggtcaggagttcgagaccagcctggccaatatggtgaaacctcgtctctactaaaaatacaaaaaattagccaggcttggtggcttgtacctgtaatcccagctactcaggaggctgaggcaggagaatagcttaaacctgggaggaagaggttgcagtgagccgagattgctcaattgcaccccagcctgggtgacagagcaaaactccatctcaaaaacaaacaaacgaacaaacctgatattttcaaaattgaggcaattataacagctatttagccaagcattatgatagcaataatagcaagaaaataaattagttaacaaatgagtctcagaagcccaatgatttttattttatttttattttttgaacttttattttagaatcaggggatacatgtgcaggtttgttacccgggtatattgcatgatgctgagttttggagtatgcatgaatccaacctgtcatccaggtagtgagtatagtacccaacagatagtttttttaacatttacttcactcccttccccaatcttgtattcccctgtgtctactgttcccatttttatgactgtgccaacaataattttttttcttttttctttaaatagagatgggggtctctatttaaagagcctcccaaagtgctaggattacaggtgtgatccattgcacctggcccatgccaacaatatttgaaacccttatctgcgtgtacaagtttgctactggttttgttttgctcattaatacatcccaagcatctatacctggcttgtagtaccagcatgtagtaggtgcttaataaatatttattgaataaataaattagtttgacattagtttaacatctcaagtaaaacaaaataccattcaattaattctcttcttctacttttttcttttaagagagacaaatagtcacacatacatcagcaggagaggatacaatttcctgtgtttaagtttttatgagttactttagttcaaatgtcacagaaaattatattgaactcttgaccaatctatctattttttccattggagtattgacccaaataagaaatagcataaaggaaaaattattttttggcagaaaaatattctctctaaattcttgtgtgttttgttttgattttttccttagtgactggaggccagtttcaatccactgaagcacagattccaaattttcaatctggttttcttgagtagtgactgagtgccaaaaatgaagcaatgacacaacatcaccatcaagacactccccagcacgcacacacatgccagagtccaacaccaagatactccccagcacgcacacacacgccagagtccaggccatattcgggtggcttgcaagcttcttccccccaagtatttactctcaaaataatggtttttgttttgttttggtttggtttggtttgtttttttccaaatacatttcttccctatatctttaaccaattctcataaaattttgtctaatacactggtcagtgtattccagaccctaaaagataacataatgaaactatctatgactaaaaggtaatcaggatcttctacttatccttttttcctccctcttaaactttaattttgatacatttgggagtgaaatgatgacaataaatgcaaagtaattattgaagaaacagtaattttgtattagcttactgaaaaaaaaaaaaaagataaccaaatatattttggcagccccaaacgagtcacatgtgaaatgcagtgggagagcagtgtcctgaaggaaaaggtggcctgctggacagccaagagaacaaacatccactgcaagtaatatgagctctaagtttggactaggcctatgtctgctctgagacttggggcaattcacttaatcagagccttaatcagctacggactagcaatatccatacccgctacttattttgtaaatctcctttctaaagttaactctatttattgttccataatcccataaattctagaatcttttcctgttatagccaagttgtctatcattgacagagatattcacctggttgttttggcttctctaatcctcctggtgagaacacctccaagggagctttcagtggcatttaaggtcacttgtgctcttggtcctagaaactgccttgatagtggttttagctcacatgaggtaagtctttattatatgcccaacctctttatgcattacttcatttaattgtatactaatcctttgtcataggttatcagagtgtttgattataagttacaggaagaaaaaaaaaaacaaactccaattgactaaaacaatggggcattttttgactcacataacagagagtctagagagaaggcaccttcaggtttggctgatgaatcctgtatctctgccttgtctccaggcccccaggttctgcctctgtcctgacatccagtgttggattcctcttcacatcaactcctctctgtaggttgggccatcagaccctacctccttatttatgttgagcaaaggagagagaatgcctctacaaacaatgaaaaaagtgaaaaaaaaaatctttctcctccttataactttagttagcttaactttagtcagttgcttagctactaaacagtagctattgggaggtgggaaggaatactattgtgtaatcaactaaggctcatacagaggattagggttatctgaattgatttgaattaattagaatttactctcagagctgtggcaattccttgaaccacactgattgctataaagtggaagaggaatagattgaattttggggagtcaactacaatgtgtactacaggtaaatactatgaatttccaattcacagatgagaaaactgaggcatgtggtgggagggaggttatgtaatttgcccagtgtcacagttgaacctaggcaaaggcctatctccaggtctaaacaattcagtggcctcctgtgtacatttctgtctctccttttttatccactgtgtcaccgaggctggattgcagtggctcgatcatggagatcatggctttctgtagccttgaactcctgggctcaagtgatcctcctgcctcagcttcctgagtggctgggactacaggcttgacaacacacccggctatcccgtgtatatttcttgagggcttatgatatataagagaaactccaaaataagaggacggtgtgctaaggggaagaccaaagcactatcaagaggtagattcaatcgtaccccttctatttactagttgtgtgactcttttgaaaatgagaataataggccaggctcggtggctcctgcctgtaatcccagcactttgggaggctgaggcaggtagatcacctgaggttagaagttcaagaccagcctagccaacatggcaaaaccccatctctattaaaaatacaaaaattagccgggaatggcagcatgtgcctgtagttccggctactcaggaggctgaggcaggagaatcacttgaacccaggaggcagaggttgcagtgagccgagattgcgctactgcacttcagcctgggtgacagcgagactccatctcaaaaaaaaaaaaaaaggaagaaaagaaaagaaaatgggaataataaaacttacttactggagcagtagcaaagattaaaatttagaccatgcagaagaatgtttttcaaaatgacatgacctggtaataggatagaaatgcaaattcctgttactgcaccagacccaccaaataagaaactctggggatgggacccaggactaagtactttaataagcactccaggtgattctaatgattgttaaagtttgagaaccactggtctaacacattgcctggtacataagctcttattttgttgttattgttctaaggacaatgtgtgtattgacttctatttccaggagttcatgacttggagaactagggaaaggaagacaaaaattctttaatgcagaacgatactgattgataaatacctgaatataatacaggttaaatgtgctttgaagatttataaaaggttgaatttatttccagcaagatgactctcagaagcctttatagattagagaagaaatggaaaggggtaaaaataattaggaactataaagcagggcagacaagttttcaatggttactgccaatgtgtatacagaaagttagcttggccaggcaaagtggctcatgcttgtaatatcagcactttgggaggccaaggcgggcaggtcacctgagatcaggagtttgagaccagcctgaccaacatggtgaaactctatctctactaaaaatacacaattagcccagcatggtagagcatgcctgtaatcccagctactcaggaggctgaggcaggagaatcgcttgtacttgggaggcaaaggctgcagtgagctgagatcgtgccattgcactccatcctgggaaacaagggtgaaactccgtctccagaaaaaaaaaagttaccttgaaatatatcaatacaaacaaataaattagatatttcatattgtacaggaacaaaacccatcagaagatgtcagaagataaggatttttgtcctgatgctacacttaccagctgtccctcagtgttctacttcttaaaaaaagagagatggataaacagaggcaacccgaggataaaggccttgctcagtgtcacacatttcagtcactaaataagacacaatggatgccagtattctcatcccctcacaaataaagagccttcaagctcttgcagtcaacaagaacttttggaatgatttcactgcctgaaaaggcagatacataggtgacacccacaaataggaagaaaatcaacctgaacctgag

SEQ ID NO: 4152 - DNA, 924 bp, Homo sapiens
agaaaacaattccatttatgatagcatccaaaaaaaaatacttaggagtaaatttaaccgagaaggttaaagatttgtacactgaaaactataatacactgatgaaagaaactgaagacacaaataaatggacagatatcccatgttcatagataggaataattaatattgttaaaacagccatactacccaaagcaatatacagatttaacccaatccctatcaaaattctaatggcatcctccactgaaatagaaaaaacaatcctaaaatccatacagagccacaaaaatcctaaataaccaaggcaatacggagaaactccagcctggtgacagagtgagacccagtctcaaaaaataaaataaaagagctcaaaagcttcgtaggtctaagctgcaatgagccatgattgtgtcactgcactccagcctgggtgacggagtgagacccagtctcaaaaaataaaataaaagagctcaaatacacagaaatagagaatgaaacagtggttaccatggttattttggggggaaaggagagggagctgtgggtcaaaagatacaaaatagcagatattcagaataagtttagagatccatgtacaacacgaggactacagttaataaaactgtattgtacagtcatgtgtcacataacattttggtcaacaatggaccacatatatatcacaccacataataacaatagttccataagattataatactgtatttttattgtaccttttctatgtttagacatgcttggatacacaaataccactgtgttccaattgcctacaggactgaggacagtaacatgctgtacaggtttgtagcctaggagcaacaggctgtaccatagggcctaggtatacagtaggctgtactatctaggtttgcgtaagtacactctatgatg

SEQ ID NO: 4153 - DNA, 2666 bp, Homo sapiens
ttttttttttttttttttgagacggagtctcgctctgtcaccaggctggagtgcagtggcgcgatcttggctcactgcaagttccgcctcccgggttcacgccattctcctgcctcagcctcccgagtagctgggactacaggcgcccgccaccatgcccgactaatttttttgtatttttagtagagacgaggtttcaccggattagcgaggatggtctcaatctcctgaccttgtgatccacccgcctcagcctcccaaagtgctgggattatgggcttgagccaccgcgcccagctagacttttttctaatagagtcccccataaattttattaccatagatacgctgtgtatgtactgtttctgtgctttgtacatgaaaagagtaaaatgtttttgtttttgttttggagacagtctcactctgttacctgggctggagtgcaatggcatgatctcagctcactgcaatctctgcctcctgggttcaagcgattctcttgcttcagcctcctgagtagctgggattacaggcggccaccaccacccctggctaatttttgtatttttagtagaggtttcaccacgttgatcaggctggtctcaaactcctgacctcgtggtctgcctgccttggcctcccaaagtgctgggattacaggcgtgagccaccatgcccaaccaattttttttttttaaatccttggtagtgattgacccccattgagaatgcatgctctaatattttttaaaagggaagaagacctagtgatagacctttgcattggcaggcatgtctttatgtttatacagtgaagtagtattttttctgtcagggtcaatagaaagtagacgaaattcattttcagccaatctttcaccagttgtgctttgttccttaccccaccacaggcaacagacaaagcatttcctgctgtctttcaaggtcttaacagattctttcttgattataaatgtattactaagtagaatcatttgggttctttctataaaaatcagtgaaaatcctctagatgaatgaattaaagttgtaggcataacactgataaacctctgctctcatactgaagtaggctgcttgcaggaactgacaactattggttggctttaaatgtaatgtagatgccaaagttttagtgtacagtgttacttaaattaccaaattacctttgtacaaatattcctcagatgctgtctacaggtgccatataaaataggttgataagtatttgcaaattctggtaaattgccttgctatgatttttcatgctcagtattagtcctctagtatcaatacgaagtttttctattccccagcctactaaggcctacaggttaaaataccaggaataaaaaggttttcagtggacttgatttaagtggaatctggatgatgtgacaagtacctttgtctttggagtaatgagtttataattggcttttgtccaaaaactcttaagtggattaatatctgaacaatcttagacataattatatgaaactggatcagaaaggctttctgactcctttctcttcacttttttctcccagcttaactagaggcaattaacagtcatttcaaatctaattatttttattttccagtgtacttatcatcctttcatctttatgctaggagtatagtctcagttcttaatgagttgatgggatgaagatatagatagatagatagatagatagatagatagatatttttttttttttttttttttttttttttttttttgagacagagtctcgctctgtcgcccaggcgggagtgcagtggcacaatctcggctcactgcaagctccgccttgggggttcacaccattctcctgtctcagcctcctagctgggattacaggcgcccaccaaccaagcccggctaaggtatttttaaatgtactcaatcactgtcattttagtaaccttgaatcagaacctcagttgttaaaggcttaactgcttgtggcaactactatagtgctctagtggggacagtggttaaaatctgcagaatcccttgctttgtcatcttatccagaaggactgatagcttgttaaactgtggtatgattagaatgttggtggttgtgtagtgcatttggggtgctacaacgttaatcaaatataattgagctgttctgtttccagtcagtgtaaccatttaaaaataccttggcaaaacaagctaggagctagttcatgctaatattcttaaggacaaaaatagtttacagcttttttttttttaatctgaaatcctgaaggctatgcttaaaagttagagataaacctgttggaaataagtgattcatttatagactgaagcctctatgacttcaaaaagatactcaacagtctctggcatttgaagaacaaaatattttctctgtaaatacacctcatttccattctagttaggagcaatggcgcccaggacggcacacagaatggagaaaactggatagctggtaactcatttagctcttggcactctaaaaaacctcaaatacagccatccaagccagtaattctattgctgcgttatttctgtgtttaactgtgaaacttgcttcttgtctgtacccttgaaatggaataaaatttcatgagactccttgttaatgtagagaaaa

SEQ ID NO: 4154 - DNA, 1757 bp, Homo sapiens
cagcgcccgggtggaaggggcgaggaggcgggggcggcggcggcggcggcggccacctggcccggaccaccgcggcccggagggccgtgaacaaagtggtgtacgatgaccacgggagctaggaggaagaggacggcgacgtcgaggagacccaggagtctgaggacaacgaggagcatgagatggaggaggacgaggctgattccgattatctggaggagctggaagacgacgacgacgccagttactgcacagaaagcagcttcaggagccatagtacctacagcagcactccaggtacccacccagcccagttgctgcagactccttccccacctcctctgccctccccccttgctcactcgtgtgctgtgcatcctgctccgatctccccccaaccccgcctcccccccaaacagaggggaaatgcgagggcacatcaagtggcaaaaaactagatttacaagaggaaagaggcgcattgttaaaaatggagattgcattgttgcagtttgcaggctacactcgctcgctctctctctcccccccaacctcctctttttcctcttcaaaatttgtgccagtgcagtgtctccaccgggcaggattgaaactttggcaaacacgtatccattgcattcatttctttccccttgttttggtctggttttctggaatgaaagaagcctcttgttttacaaacctctttgcatttctaatgtggtttctttcagatttttattagatatgttacttaaaagggaattaagggtttggacagattgtggcacacaaacacacacaaaaacatgtctgttttcacatccctagctgtggttttaaaattgtgttaaggaaatggatcatttgggttagtaggggaattttatctggtcctgtatgtttgcttttattcttcgagtgctaatgggcctgtgcaacagttgctggtaaatggctgattaaaaagcaaagcagaaagccaaacaagacccacccaactttggttattcattcgattcaaaattgtttttggttaaatcaaaaatgaaagtacaaaaccgcaggaacgcgcatcttagctcatttgatcgctttgccttgcttgggaaatgcagtttcgtgtcacctgttgcagaagatatgtagttgatcatctagacataattgctgaagataaacttttggaccaacttctaagtcacacagcatcattatcagatttattacacaacgacttttttgttttcactctatttctgaggaaaaagccttcccgaaatccgtaatgaatttctccatggtaacccctcttctgttttcacacagaaaagtttctctagactgttgctaagatgcattttgttaaataccccccccccacaaaggctgctttgtattaaatacgtagttggaatttactaaattgtgaaattaacgtaaccgaagcaacaaccggcaagacttttcctttataattttgcaaatctagattaattaaattagaatctgtttttaaaagcattaaaaaaataaagtttatgagaaaatacttgtgaggaaaaaggacccttttttccttgaagtaaggtgtgtcatgtctttctcagagagactgctgtagtagaagtggttaacttgaaaagtttctgatttttcataaatgcttacttactggagaagtagagtagtattatcttgagccaaatataaacctacgtaggttgtcctaatgagaggtgacaccgtgctggcag

SEQ ID NO: 4155 - DNA, 1056 bp, Homo sapiens
ccttaccaaagatctactttggtgtcattgatatggcaatagttttctccgagagttatccaagagagagcaaggcagaagtggccatgtcttttaggacctagttgtggaagtcacacagcatcacaggtgccctattctactggtcacatggaccaaccctgatgcattgtgggaggaaactgcacaaggataattaggcgccatcttggaggctggctaccacagccatgctggaaacagttaaatgaggcatacagagaggagccctctttttacttgttttctgacagcaaggctatagtgcaggacaagaagacacttgaatggcagtggcaccttctcctcttagtctgaaaccatagtttccctgtaagtacaggtatgagagacgagttctcttttcagtctacatagtaatgtcctggaggaatagaataattcccttttgtaactaagctcaccaccaggcagagtaggcactcacatatataatgaggtggggacacagcctcacagatcatggtgacagcagagttaatggaaagatggctttaaaaccacatctttgaaattctgactcttctttgacgaattagctttgtgagtttcgataaattaagctgagggaaataaatctatcttatggagctgttttatcctcctaaaatgataattacaagcatctttatatctctctatcctttgagaacctatcatcatcagttagaggtgcaggttatgatgacatatatggatatcagtctcaccagcaggtgatcatgaaatcttcctctcaaagactaagatttagaattgttaaggctgggcgcggtggctcacgcctgtaatcccagcactttgggaggccgaggcaggcagatcacgaggtcaagagtcggagaccatcctggccaacatggtgaaaccccgtctctactaaaaatacaaaaattagcctggtgtggtggcaggcgcctgtaatctcagctattcgggaggctgaggcaggagaatcgcttgaacccgggaggcggaggttgcagtgagccgaga

SEQ ID NO: 4156 - DNA, 1194 bp, Homo sapiens
tttttatttactcagttgtgatcctgggaaatgtcagcacagcagagactgccccaggcacgaaggtgagttgggcctgcatatcagctgcacacagacagagatgcagcgataacaaggctgctggggataaggccctgctacatccctgccattcggccagtcaccggctgccaggcactcttccaggtacgtggaattcagtgatgaacaaaatagacaaagcccctaccctcgccaacctcaagacattctattagaggggggcagacaataaacaggtacacagggcttgaagaacacgaggccaggtaaggcaggtgagcatggcttgtaatgaggtcagggggacctcggaggaggtgacacatgagcagtcctgaaggaccagagggagcaccatgcacaatgcctgcaacctggcatgtgttgcttcagtaaaccctcctggtgtccctggctatgcaagtgacattctcccatcttactgatgaggaagctccacctgtagctacaaatggaggcacgagattcagactcagccctgtctcccagaactcagctacctctctactggctcacaggagtacaagcacgcttcaagaatgtggacgtcacaaagcctgtggagggggaagcgggtggtgtgcagtgggggtcttggggagagggatatgcacagggttagtggggtgagtggatctagagttcactcgggaacacctccttgtagatgtgagtttagagttaggcttggaaagaaggaagggagggagagagggagggagggaaggaaagaggaaggaaggaaaggtggacaattccatagggagaggatctggctcatgcagagcttcagtgggagtggtgaggagggctgtccacagggaggaacctgctttggagtggatggtgcaaattcgtggcaagagaagaggcctcagattcaggttgtacactctggttctttcaccaccatacgaaggtccagcctcatgctaggaccttgggggccccacaaggatgaggcctctaggccttccctcagggagcaagggaagaacagcaaaatcagaaacatcctaggacagattgtatcagactgaacagtgaccacacatcccagatcccaccctgtggtaggctagccaagcatattcccctactattgcttactcggtcccaccatttggg

SEQ ID NO: 4157 - DNA, 977 bp, Homo sapiens
aaatacaaaaattagctggttgtggtggcgagcacctgtaatcctactcggcaggctgaggtatgagaatcacttgaacctgggaggtggagtttgcaatgagccgagatcacgccactgcactccagcctgggtgacagagcgagactctgtctcaaaaaaaaaaaaaaaaaaaaaaaacaaaacaaaaaacagcaatcaaaaaacaaaaaaactagtgctttcctgttgaagacaatcaagaggcctctacccttaaagacaacactcactctccttcaagatctgtccccacctcccttcctagacagcagataaatatcaaagttaagtcagtataaaccaacaggggagttttgggcttgctcaggaggaaaggtaaaatactctgaaagttctgtagaacttagctaacgtggaccttaaaagctaagagggtgtctgtaagacttaactctggaagtccttgatccagggacggagatagaacacaaacttggataagggagtgtttagcaatgtgagtgtaccctcctgggatacaggttttaatgccctggcaagaaccctgggagaaggtgttgagactctgctaaaatgactcttagacacttggagaaagtgacagcccacacttaagtgaagtggaaatactagaattgtcatgccaggcagtggaaaaaggggtcaataggattaaggaaatgcacatgatagaatgaatggactatataagccttgcaaacccaccagatgactgtcttgcaggaaggccaaagcaataaagaatagcctggtgagagcaatcagcacctctgagccatctgcagtggctttcctctgaaaggcagggctgatgttgttacataactgggcttattaatagcagtgggaataaagggtaccaaaataatagagaccaggtggtagtgctcaaccatcagaagccaagaggtgcagttacctttttttttttt

SEQ ID NO: 4158 - DNA, 1547 bp, Homo sapiens
ggagacctcggctatcctggccttccgaggcccacgaggaggcgcggcccaacgccggggcctggagcattgaggccggaccctcgcgagacagcagagcctggcctgacgctggaaaccacaccctggcccagactgccagccctgacgggacagagccagggcactcaccaggctgcaagaacagtgctggggtaagaggggagcgggcctaaaggtggaggatcccgggcctgggacccagcctgcattcctttgttcattccttcattcattcattcaccagcagggacccactagtgaggggccaggcctgcttccccagggcctagctgaggaagacagggcagaggggccaacagtctcacaccttgctgggacatcctggactctggaaccaagagcaaacagggatgtcaaaacagtatgcaaaactgtggatgatcgcggggcattgtggtgcatgcctgtaatcccagcactttgggaggctgaggcaggaggatcacttgagcccaggagttccagaccaccctggacaacagagtgagaacctgcctctacaaaaaaaatttttttttttaaattagccgggcatggtggcacatgcctgtactctcagctactcaggaggctgagacaggaggatggctcgagcccaggaatttgaggctgcagtgcactatgattgcaccactgcactccagcctggacaacagagggagaccctgtctctaaaaaaataaacaaattttaaaaagcgtggatgctgatgaggatgggggcttccaagccagagggagggttggggcatgactggactggactgggcagtggggtcagtgtttgggggtctagggtcagcatttgaggtcatagtgtcagtagtggggtcacagggttgctatgggggatgtttgcagtgggagtgggggtcactcaagcaattatggagcactttcagggacagcaatgggaagaaccgcagggtcattcttgaggtgcagagggtcagcctgggtgggggctgggggccttccgtgaagggtcagagtccatcttggagggattccaagctcacatggcatcaatgagttaatgaggagtctctgggttggatctttagatctgaggataacagggttaatcttggggtttctggggatcccaggatcagttaggggctccctgtcttgttccctctccaggctgcagaggtgagggaattctggaagaaggaatatttgctcagaggctgggcaacagcgcccctcctgggtcacaaagagctcagggacagtgcgctgcctagcacctggggggcgcctcctactctaacgtaggacccccctcccgtgtcctggaagtttctgggcctgcccccgccatctgcctttgcctactgaaacttctctcctcctcctttccccctccccctccctccttcccatttgaggggtttcttgagctaagcaggtgggagcggggcacctagtcctcctccccactggctgccttctttcccacaggtgagtacccccacgtcg

SEQ ID NO: 4159 - DNA, 565 bp, Homo sapiens
gttcggacccttctccaggcagcagagccggggcaggggcgccccggccgctgcgtccgcgctcatctcgccctgcgacgggtcagcggcgcgacttggggttccgatggggacgggacgggacggcccagcccttcttcccgtccagcgaaccgggagcgcagcagagaagccctgagccgccggacgggccaagcaagcaggtgtcccaggaaccgtcggccgccgcgagccgcgaggagccgagagaggaccacagaccaatccccgccccgcgcggcgtctgagcgtcccagagtccgccccggctccttaccccgggggcggggccgcgctgaggaaaaatgattaggactgtaaagccttctagctccctcttgccaaagagaggctggtcacagaggcgggagacagtctgttgagcggggagctgaccatctgaggacagacactgaggaaggaggatggaatgattttggcagtgaatgacaattccttcaacaagaccccccccccccactcacttcaaagaaacagtggacaggatgtgctttccaaaatactg

SEQ ID NO: 4160 - DNA, 707 bp, Homo sapiens
gctctttgaccgcgcgcgtgtgggcgctgaccttgcgggacttctccagcagcttgctcaccgtgttgctggtggaggcctggtacttggagagcttggtgaggtcattctggatgcccttcacggagccctccaaactgatctgtcgctgctccatcttgtgctggttctcctgcacagcgtctagcatgttcaccagcttgtccaggagcgtgagcaccgtgactgcgttcacctgtgagttgtcccggatggcctcctctgtgttccctaggttcaggctggggcttggtgtggaggaaggcatcgggctggggctcgagggcttttcctgccgcatgtcagacccagggtgctggaacttttcggcctgtgcagcgtcctctcccatggctaggcaggtgggaacgttctttctctctgggagctgcttcttgctcgggtgagaagttgcggtggtgagggtgtaggatgaggcccgctggttggagctcagggcaccagtctccaggactggcagaggttcagacaggcaacaactggctacgctgatcaggggaactgcattccagctgctcttaaaggccctactccacccagtgggaggagaagtttacagaactgagaaccatttagggttcagacgtatgcacacacttcctaaccgcgttctgggcacaggacactttgttgcaggtttagctttt

SEQ ID NO: 4161 - DNA, 923 bp, Homo sapiens
atcaacgcaagcttatgacccgcacttactgggaattcctcgttcatggggaataattgcaatccccgatccccatcacgaatggggttcaacgggttacccgcgcctgccggcgtagggtaggcacacgctgagccagtcagtgtagcgcgcgtgcagccccggacatctaagggcatcacagacctgttattgctcaatctcgggtggctgaacgccacttgtccctctaagaagttgggggacgccgaccgctcgggggtcgcgtaactagttagcatgccagagtctcgttcgttatcggaattaaccagacaaatcgctccaccaactaagaacggccatgcaccaccacccacggaatcgagaaagagctatcaatctgtcaatcctgtccgtgtccgggccgggtgaggtttcccgtgttgagtcaaattaagccgcaggctccactcctggtggtgcccttccgtcaattcctttaagtttcagctttgcaaccatactccccccggaacccaaagactttggtttcccggaagctgcccggcgggtcatgggaataacgccgccgcatcgccggtcggcatcgtttatggtcggaactacgacggtatctgatcgtcttcgaacctccgactttcgttcttgattaatgaaaacattcttggcaaatgctttcgctctggtccgtcttgcgccggtccaagaatttcacctctagcggcgcaatacgaatgcccccggccgtccctcttaatcatggcctcagttccgaaaaccaacaaaatagaaccgcggtcctattccattattcctagctgcggtatccaggcggctcgggcctgctttgaacactctaattttttcaaagtaaacgcttcgggccccgcgggacactcagctaagagcatcgagggggc

SEQ ID NO: 4162 - DNA, 923 bp, Homo sapiens; identical to SEQ ID NO: 4161

SEQ ID NO: 4163 - DNA, 11955 bp, Homo sapiens
cttccggttactgactctgtggctgctgcctcccacaacgctgtgcttgcagaccccaggagcgctggctgtcccttcacttcctgaacatgtggatgtgtgctttgggttcttgacctcagctcttcccaaggtcttcttagagaagggtctaaatgaagtcatttttagagtatttgtttttggttacacaggtgcttccgcccatgtggcctcggagtgggaccctgcgggtcatcaatctgtacattgcctgagagcagccgtgtatgctctggaagggacaagaccaggtacctgtcgggggatgcggccgtggtaccaggcatggctgcgcaggtcctcgctgctcaggagcagctcctcctccagctccttcttcagtttctcgggggtcctgtccatgatgtgcctctccttggagaactgcaacacagagtcaaccatgagctcaccctgcccaggccacaccaggccatgccagctggaggtgaccgcctgcttcactaatccaaccagttatgctacagcctgcattcagggagatgtggccacaggactcagttctgaccaaggagctgagatgtgatggctggagactcaacaccattctggacgccaaaaagagctggccttggctggaaggttctggctaggaggagagggctaaagcatgcgaaggcacaacaatgatggaactgagcgaagaagatactctatcccacttcagtgaaaacatcatgaggcttgaagcatggaagttgcctcacccccgtgtttcctgccaggtggaacaaagtgctgagagaatcaaaccagcaagcaaagagaagaggagcaagagatggaaagtgacctctagcatgcacatccctaagccccagctgattatatcagccggcaaactcctcttgtgacctaggctagtatgagtggaatccctgtcacttgtgaccaaagcagtcctgacccagaaacgcagggactggctgagggcagcccaacattggtggctgagggtttagaccatcacactccagaaagtcagagtcacggaaaatctttgcccaggaaggcaacaggtatataaaaagatacttttagagagatctggctgcagtgagagcaatgggctggatggggccagggctggaggcacaggtcagagtcttttgaaatgtgctgacaacgcccagatctccatctccagcccttagggtcggtgcctggtagggatatttactggaatccgcattaaagctcagatgtcaatatggataaattgaactcatcccctctgcaaagcctgatcttcgcccttttccccagtcactggcatctcttctgtcctcattacctgaactagaaccctcagaatcggcttccattggttaagacattcctgattcttttacctatccccattcgaatccccactgtttagattactgttcttttctcctagaacttctgcaatagcctcctaacagtttccctacctcccatttctagtcccacaacctgccacctacaataccaccaaccttgtcatattgcccctaggttcagagattttagtccaagggtgctccagctaaggccgacatgacagccacagtctctttcaactcctctcccaccacacacacatatacacagaatcaacgagcttctaatatttagttttcattcatgccagggttcgggcctggtccctgggggcgcagaccccagtcctgccctgttcctccagaatcctgagctttaagcaccatttcctgttgccccagggagctgacccatggcccctgacatatactgaacttgcagacacactgggatttggctctgaatttgctaggaggcccagatcatgagagggctgtggatgcaaacaggaagcgtccctgtgggcccccagaaataactgtcagaggcatgactggcaggggagatgggcaagggtcctgccattatgaagtgggttccaagagtcagcagagttgaggcattaaagttttcaggacattatttggggctgttggctgccaaggcctgaggaaatattggttatgcttccaagggctcacagtgacctccagataaagcccaaagcctccttcataagtcaagtaatgcctttttccacctggccacaagctaacttgctaacatgttctgacgcagggtccaattgcaggaaccttccatggctccctgaacaaaacatccctcatgtcctgcctccatgcctttgtcttgtggtccagcagacagtgacacatctgtagagggtcttgctctgtctcccaggctggagtgcagtggcgcattcatagctcaagtgatcctcccgcctcagcctcccaggtagccaggactacaggtctgcaccaccacacccggccattggtctaatttctaagcaaggccagtgtcttccaatgagctcagggtgggaaaccccacgggggttgggctgtgaactgtaccaggtggcccaagctgggggtccaaaaagacagatccacatctcaaatccactgaactctgggaatccctgtgatgacctgagacctgcatcatcactgcccccaataatgttgtaaacatgtaaagaaactgaatccccaaaaagcacactttcaaaagcactacacaaagcagtctgaacccttcctctgaagaaggctgctacatctggcatcgtcttacaagtaaatccaacccgaaatgaagttctttggagaattcagaaactcagcccttttgaacccctgccttgcgttgaatttcaagccaagtttacaaccaaattctgaagtatataaaggacttttaaagacccaattggtatttttacaattgaaaacctgcataaattgatcatgaacccaaagaatgaataaaccccaattactttcatcactctaaaccctgcccgaagctgaaaataaaaatccagttctccacaagtttgaagaccagttacttctagtacgagcccttgggtgttttcatctaaagtagaacagaaagaacaggaatggcacttgtggcgatcctaaagccttgcaatgaaataattagtagattggttctgtttcaccttttactgacacttgctggttttgtggcttacttaaaaatagtttattttattataatccaaagataaatgaagaaaggtttgaattcaccaatcctacttttcccactgggatgctaggctagaaaaatagtttcttatgctaataactgtgattaaagccaaagcatttacttaaataattaactttacaaataaaaaagttcaaagagaaaaaaattcatattttatatccctgttgggtaaacaaaaccaaatgtgaacgtgggcaattgggcatctttgcctgacccagcccagtgggcacatggtggcctggccagcggtccaggacgttgccagaaccatagctaaggaggtgccacttgtacacagctgtcatggatctatatattgattacaacagctgcccaacatatgacaataaagtgtcctgaggaaagggtgtcttactcttattcactcaagaggcactctacaggccagcagggagggtccctgagtgtgtccctgagacttctctgccttttaggtgttggacccttggcagatgaggacctctggcctcactgggccccttgctatgagccagctccttcaaattctctcattaaagctcagtgaagcagcctttgcagagagcttcctaatccatgcacacttcacccttttggctaaagttctgcagaaatagtcaggggctccattttcaatcaagagtttgatagtcactggaacaccgtgccttaaatgaaacccaaggacttactgcatgcctgccgtgctactctgcctctctggctagatctgaggcagccgcagctgtgatggaaggaggactccatgccctgcagcagtcacagcctttttgaggagacaaagcatttgaagagaatgtgcagcaataaacatctatcttatctggggtcagtgagggtttctggtcccttctgacaaagaaattggcagcagagattccataaaaatttcaataagttttagcattctgaaacacttcaattagtttgatgttaacgtttaagcaccttgatgaaataaatttatctcttccaaatcctagaaagaatctccctttcggcaaagattctgcagatgggttttgatgccatttttccattttgtagttagatctctatcatttatcacactgtagaccaaatggtcgttttagtgccattaaaaactgatttgcaatttgctgttaaattaagatgtttcattttcctactgtatatgattttccttttcacagatgagtgaggatacaaggggcaatcagaccctagtgcagacaagaaaataccatcaaaacccctagagatcccaaatctaagagatttccttttattcattatcaaacctaatcaatctcttatcaaaagaggctcagaaatcatgtatagtaaatatgaagaggatatctgtagaaccccttgcttatcaaagttctgagaaattcccattaaatttctgttatccatgtgtgcaaactaaaaagactaatttaattttaatttgtgcagactgaagtcttagagcagagcactctgtaagcaggcagcagtaacttaatcctacatgacaaactaattacattagaatcattgtgataggtgcccatgccttctttgatgttaaacccctgttacctttgatccacagtcattctctgggcaaggtctcttgcacacattcccatcctgccagatcatgaagctgttgcttttgaagctcagttttattttgatagaacaccaagggactgaaaattatttctcactgattttgttctgaaaacttcgggtagaattctaagcttgacagaatgtagcacatacaacgccaacaaatgtggcttcttttcttcactaagatcacccactcactggtgaaactgctcaatgtactcattgcactgtaacgtctctctccatcccttcttgaccccagtgagtttgcccatcatgtttcttaccccttgataaacatcatttacctacagcctcactcaaagctcagctccaagggggtctcaccttttcgttaatagataaaccgaaacacgatgagatttccaacaggccatttgttaacatcttgccacgctgaaagccctggcgggtaccttccgtctagatcaaatttagatgatgacttcctggagcagcccacagaggaccagacatccaaatcaccccaagaggcaggcctgtattctcattcctcctagagagaagtcggatgtgccacacttcagaggaaggccgaaggtcaatgggtgcacttaatcattattggactagagaaatgaagggctttgataaaagctaaacaccagtccaacctactgtgaaaaccctgtctaaactactttgctccctttaaccatgtcctcgagcgactttgaataatatctctcttgctttcacagggctggcacttgggttaaaagaaacaatgcaagtgaaatattaatcgctgagttcagcagcaagattacactcagtaatagtagtgctttcttaacatctttaaagaatgaaaagaacaaagactgccctggctaaggcagaccctaataaaagagtttgaaaaccggctgatcagagttcaaaatgctagaagatccaagccagaaatcctcaccactggtaattcaatcttgttaattcaacatcttaatgcaaattatgaatgatctggaacacagctattcatcaaaccagatgtcctatttgctcttcaataagaatgtcagcaaatcaaaatcaacttaattcaaatactctcatttcctaattcaccttgaatgaatgagatgaattaggaaaaggagagtactgaatgaacaaaatgcaccgtagttgaaagacacccaaagatgtaattggaaggaaaaacaagatatgccaaacacatggaggaaaagccaaagattcagacagccttccagcgtggggtgtagaacaaatgactttcaaattctctctctccaaaatagtaccatgactaactaccatcttagaactctgctctgggacaaagcgcatcacatgtcagtgctaagtacgcagcaggcttgcagtaaaacaaaatgattcatcacaagatgggttttggccagacatcaactgcaccactttcaatatacaactcacaggtcactttaaaggtatattccttctagaggagctcaaagcactagatacccacatatctcatttaacaagcattttaaaaaatgcaaacagcaaacatcctacatgtcatgcagagaaacagagaaccagaaactggacttaaagacacaagatactcaacccaatacaactcagatctcatgagttcatacagcattcctgtgggctaaacagtgagcaagaatgtttacatctcacaagaaaatagggtggtggtagggacagaaagaaagagacaggtgagagtggtgtttagaaggtaatatcatgaagacctactcattaattacatgtggaaaatgaataggaggaaggggcatgggcattccagaaagatgactgagccaccaacatccaataaaaatgcacgagggcatagtgggtttgtggaagaagatgtagaactaaggtctgctgggccttctggatggagtcacttactgggccatggggtccaggtgctatggacataggttgactggagagcctatctggagaactacggcttgggagtcctcagtatagaggggtattctatcccaactttcaccaaacagatgggatacagcatgagaagagggctgggggaggcttttcagaggcagactagaaagagaaacccaagaagacagtaggactggacaggaaggacacaggagaacaaacagaatgcagtgtcctggaggttgagaaagctgatttcaggaagaaatggtcaacattgtcaagtgctgcagagagttccaatcatatcagaattggacagcatccgctgcacttggcaatgtgcaggtcactggtggcataaaaggggctgagtggccaatggaaagggagggagtaaagactgtgttaacttacaagtgagagtttatgcatgtatgatatacagagggacataatagacactggggactccaaaagaggggcggagggatagggagtgaggggctgacaaattacccattggtacaatgttcattatttgggtggtgagtacattggaagctcaaatcccaccgctatgcaatatatccatgtacaaacctgtgcatgcacccccagatcaataattttaaaaagactgttaaccagcttcggggtggaggaagatggggaccaggaatgagcatggaaacgaggagggtttttaacatgggaaagaccacagcatgtttctaagctaagaggaaacacgatctcgttatgagagttagaaggacaaggcctgaagagaaggtggagggaggaaaattagggtgagctgaactaggacaagcaggacagatgggaggcttcaggggcccagggaggacacaggcatgagttagggggatgctgctgctgctcctcaaactcatcccacacatagagtccaacgcccaagctctcactcactccgcatccaagccacttgctgggtccccactgcccttaaaaaaaaaaaggcccagcatgctctgttccccaaccacctctatgggctcatctccttccactcctcagcttcagcctcaagctcccgtataggaagctctttccctctcctgtgccttttgtccctatggctcctacagtgttatctccttcaggaagtcccctgatccagggctgggttaaagacctctccctggatctcacaataggctgtgcatccttcctgcctttgcacccaccacaaagcacagcgtaagctgcttgtatctccatccgcccaccagacacagcagagctccttcgggcggaatgttcacctctgtcttccccctcctagtaggccctcagtgcacatgctaggggtaggctggggaagggcgatgaatcaatggcttctgagtcagaggctggatggatagttcctcaaatctcatcttactgagaatccagattttactcatcagtcctttctacataactatttttgtaaaagcacacacatatctagagtagacactggggagagttcttctccacaagaactaaaagacatgaaacatagcactttcatgagctagacagaaaaataggccataagattctcatggccagagccagatttcaacagtagctcctggcactgtggacacacactggaaatacagctgaggccagagatggtgtccaacctcctgaggctctcctttccttcccaaccaggacaggctgagtctcctctgctgttcctggggatacccaagatacccatcagctaaaaggcccccaagctatcactgacaacatctttaaacccagcaacaggcctgggtcccccgtgcactgctgacctctcgcgcaggctgtgcggggagacctttgtggtcggagcacaccaagcctccagcgtcctccccagtgtttagcatggcccatccctctgcagtcctggaggtgctgaatccactaacagaattttcccaagatcccaatcccgtctctgcttcccacttaggtctctccaacaaaaacaagttcttggccaggatcccagctccagggtctgctagggaaccgggtcctgggacacaggctctgtcaagcatgtctttcccctgatattgaaaccagatcccacccaaccagatgccaatggaatgcatttaagcctctttcaaaaagctacactgtcctttctttttggagggctggagagataagtgagcaactagcagctgccacgaggaggggctgagttacttggaaagacatttcctgcaaggcttcttccaccttgcgcagctcgtgctgatggtgcatctgccccactgacaaaggcaactcaggccatcgtcaatgctgggatgtgtcaccagtccccaagctgtcaccgtaacagacagaccaaatgaccagccacagggaagatgagcagggcctctgctgcaccacacacacgcaccgccacagaaagacagtttcacatgaaaccaagttccaggggcctggcactctaggatgggcagatgtgactcctcaggctgtaatatggattccaagaggctccagatatttttttcagggtaggggaaatgactttaaaggaaaacaaaaaagaaacaatactacatagcacttcctggctgcaaagacagtcgaatataagtctaggaaagcacatgtctaacatccctgccttctgtggctgctcattgacaagaccatggccactagacttaaggcctggttagctgagacttactgattccatctatccacaggcaccacaccccaacctctctatctgcgctctttcagaaaggtggcttttccgcccttgcaaggtaattcccgtctcttaggttcctctgacacaggcacccctgaccttcctcaggcgcaaacattgacaaagtgacaagtttcagctcctttgtcccctgtccacaaaaatacctaaataaataagttactaacagtcagagacacaaggggccagaagaggtaggggtttgtttccagtgccagccccagaaatgtgacccattgtgctttttaccaagttcctcctctagctcaccagggacctgggggcgggcctgccagcggccactccctgtgctccccttccaggctgatgcctccctgcctgcccacaccggggtactccacgtctctacactttgtgcgtgctcctctctccacgaagaaggccaattctcctccttctctggataacttcgactaattcaccagactcagcaaaggctctgcctccctgcaggaggccatccctgatcctcgccactcctgccccatctatgccaggcatgtgcctccagggagccacagcaccctctaaagagagcaacaccaaatcagtgataaccgatcgtttccttcaaccagagttaaatgtctgcagaatgcccaccaggcatggtattacagcagagatccccactggaccaacaactcccactgggtccccagcaccgacacatccgaggtaccacaaccggtgactgctgagctgaactaaggatgcaatgggatgaaagccaatggggaaatgtgcctcaaatacttattaacccctggtacaggaggcctggctgctgggattattcctagatcctctgtgacttctctgaccatgtcacacactaaccttcccagtgaaccttctgctctgagcaggcctggccttctgcactcctgcaaatgccagtggcttttctatctctgagctactgggtctgctgctcccccaggctgaaatgccgtccctatgccattcttttctttgtccatccaaatccccagttattaaaaaaaggagaaaaatttaaaaggggttacctgttcttaaaaacaaacaaacaacaacatcaaaaacaaaaacagtcccacatcctccctgaagctttcctaaaaactaaggctcacactgttctctcccaactgaactgcaaaataaagtattaacatacacaatatcatcttattttaggcgtcaattgtcttaatatagtacagtagaaagaacgctagcagccaggcatggtggctcacacctgtaatcccagcactttgggaggccgaggtgggcagatcacctgaggtcatgagttcaagatcagcacggccaacatggtgaaaccctgtctctactaaaaataccaaaaattagccaggtgtggtggtgggtgcctgtaatcccagctactcaggaggctgagacaggagaaggcggaggttgtagtgagccgagatcacgccattgcactccagcctgggcaactacgtctcaaaaaaaaaaaagaaagagcactaggcttcagcccagaaaatctgctttctattcctagttccccacgaaatgattctgggcgggctgtttctctgagccttggtgtgtcctctgcggaaagggtaaattattgccctgctcacctcacagagcttattttcagactccagtgagacaaagttgttgaagtcttcatagcatagagagcttgttttgagactccaatgagacaagatgtgaaagaactcatacatttgaaagtcttttgcaaatgtaatgaagtgatattatgacctaataatatccttgtggtaagtctttgaaggcaggaaccatgcctcaaatctcatttattgccccacacctcccacaaatccctccccacctaacagagggcttatgcatggactttacattcaacacccattctacattcaacacgcatggactttagaacttgaatatgtctgttaatgttatgatctggaatatctccattacaagtttctttccactgggcttaaataaaacactttcgtcttttttcccccagaaaaaagatccagtagtcttttatgtaacggctgtctactgtgaaccccttcgggatattaaagtcatgaccctcaacatggctggaacatcttgtatttggccccaactctatgagggccagcacatccctgatccttctctccattttcggcctcccatttaattcctttccaaggtctttatacacaagtccgtatgaggcctctaaatacatcctaaattctgtaagaccgctgcaaataagatcttactctctaaaaacacctgtataatcattctcctatgtaaggagggaccctctatatttttagttttgttcccat

SEQ ID NO: 4164 - DNA, 498 bp, Homo sapiens
gagttcggaaccctataggcccttgccccgccgagggtcctgaattcctcgcccccggggtgctgaatcccacagcccgcgtcccatcgcgtgtggggctgcgactgctcgcgaggctggcagcagggcgcgagctccggcaaggctccccgggggcaggcggcggagcccatgggccgcggcctagacgtgccgggggcccgggctcgagtgtggcggccgcctggcgcctcctcaccttctcttccacgcagttgactatgatggacgggtacttgcggctgagccagcggaagaacgccgggactcccatagcggcacacggctggaggcggcggccgaccggctgacgagcgtaaccaaagagacgggagcagcggcagagggcaccagcacttcctcccacgtgcgcgctggagaacggaagtgacgtcacggcgccgccgccggggaagctgggaaggaggcttcgctggatgagggagcggcggaaaaggg

SEQ ID NO: 4165 - DNA, 14158 bp, Homo sapiens
gatgctcccagaacctgcgcagctagcggatcccgtccgacagctgtgctgggcgcccgagagagcgcacggctcagcccaccccgtcccttccccggccaggagccactcacaaactcaaagatgaagagcaagtcgggcaaggtggtgaagaccgagaagccactgggcagggtgctgccccccgtcgccgctgcgggggccatgacggcgtgctggcgtcggccttgggacgggacgagcgccgctcagactccgcgcagacctctcgctggctccgcggagcccagtggcctgggcgcccccgcgcgcgggttaagagcaggggagcccggggcagaagagggaggagccccggccgccgcccaaccccgccccccgccccacgccccgggagacccggcccgagcgccgcgggcaccgccctgaacctcttcgaggccccgctgcgggcgtccagagctggggactgtgggtctgactcctgcgttccagccgtgggtgccacctcttgcgggaagcagggcaaaaccactttggtcaggcgctcctcgtgcctttctcccttcgtaggtgaccagcatctcgtaagaatgataaccatcagtaaccgggaccccaaaccttctcatcaaggcacctctcgggtcaccattactttaactttgaatttgggtctccttcatttttccgctggatgcgttaatgtgcgcgacccacagctccaggcggcggtttcctggcggaactggaccaccgccacaggctgggggtctgcagtgggggatgggaccggccgcggccgccggccccttccgcgtccactgagccggcgctggttcggcgctgggatcctgcaccgggcctctctgcttggtgctgcgcgtctgcctgagagtaggaggttgctcccagctgtgccggccccagcagaaggctgctggtggtggtgctggggcaggtcggccttgaatccatgcgacaggaagggacgttaccagaagagattcatcgctttctcttggtctgggcagcccgggccttttgagggtgggaccgctgctacccccacccccaggttctttgcctgcctgttgactgccggtgtttcatgttttgtttctctgtttcactattttttattttttgccttaaaaaaaaaagtattaccatgcagcagttgcccatttattttaatttactattaatagtgtgattgctgtgtttcctcctacaaacactgaagcctgaaatccgcccgagtccggattctcgcctgccaaaagggaattggccccgcaacctccagcttagactcccaactcttctttctttccattggcagctgctgcaggcaggacaaggggctccccttctctccagtggggccttcacctctccctgctgcacaattcttcctccttcccagtccctagggagagaagtatattcgtggacgcattttccaaagcaaaagtagcacgcccatcagctggccattctaagtgcctctggaaaggggccaggcatttgaaatgagaaaaccccactgtgcctctgtgagctgccagcccggacggctgcaaccaaggtgccattgtgtcgggtccccagggcagcatctctctggacacaatgggctgtgggactttaggagcccaggtcctcatccaccttgggcatctcatagctcgttagttggacctgctggcctctgagaggacatcttcttcctccccaggagaccgtcctgggaacaagccttaaagcaaggtggccacaggaagccgcagcctgaagagaggaggcaccgcaccgtgaattcctatacagcagaagatgggacggccacctgagccaaccccacagctgacagctgagcctccagcgaaacccaaggctgacacaacgtgagtgcctcactgtgagctcttacaaggggtcactgtggccttgcgatgctagggaaggaaagcaaattcaaaaagcttccagggttgtcatcagcaaataaagtctctcagccccagtggaagcccagccttcatgggaacccagctctcatgggctcactctctctacggctcaccagactgcctggtgcactgacggggtctcattagcccttagtcacctgctgaggtggctctaaaggtttcacctccggtggcctctcgggcctgtgagggagggctggagcccgcccagctcagaagtatgacagggcaggctcaccactggcacgttctgcttggggtcaggcctggttcaggggtcctgagggatggcttaaagcccagaggctccatttcatcgctgggaagcgaacgtggttcacagaagtcctgcccatgcatctggacctgctgcactaattcagggactcggttctttctgctctttctgtgttggggaggaaggggtcgggagtacaggtgtgcgctgccacacctgtctaatttttgtattttttttttttgtagagacagtgttttgccatgttgcccaggctggtctcaaactcctaggctcaagcgatgctcccttcttggcttcccaaagtgctgggattatacgtgtgagccaccatgccaggcggcgggtgtttgttccttttttttttttttttatttttttttggagacagtctctctctgttgcctaggctggagtacagagatgtgatctctgctcactgcaacctctacttcccgggttcaagcgattctcctgcttcagactcagtagctgggattacaggcacgcgccaccacacccggctaatttttgtatttttaatagagacagggtttcacagttggccaggctggtcttgaactcctgacttcaagtgatccgcccaccttggcctcccaaagtgctgggattacaggtgcgagcccgcacctggccctggtggtgcttcttaacaaaggtcagtggatttctggactttctgagtaacttgtggacaaatgaagagagtcctcagggactttctgagcttggctaaatttgatattcacaaatgagaagtttggtaccagagttttctgaggctccaattcaggatttccctaagaaatctgtctggaaagcagtgtctagcttctgggcctgaacccaggcacatacgcgagtgtgcacacacacacggttacagtttctgcgattttgagaaaggcctcgatatcacacacgttgttgccgtgggtgtctcatggtttccagctgctcctgcactcatattgatgaatacagccttagagagatttactgctttcttttgtggatggctttgttcctgcgttgatgtatcatttccatttcaccgtggtctgtgtggtcatcacgttcttcctgcgtgggaaagcagaagcaagtctggtgtacagcgtggagccaaggaggacagctttttctcaacagaagcccacaggcaactcatggctgcattggtggtccagagactctgggaggctggaggaggctgccaaagaatcttcagggaaggagtctccaagtgcactaatgggagtggtggcggggtcaggagagtgtgaagtttgctggtgacagcagcaaggtgtgcagcacaaaggagacacgtaggctgcagcccccacctgagcagcgtcagcactgaggccagggtttcacttctgtaccaggggggagtctggcaacaccttccttcacagcagttgctcgaaagacacagacaagccaggattctgccccaaataataataaacactgacgctgtagatgtaatgagccctaggacaggcctccaccacacacactggaacgcctccccccaggaagagaagagctgctctggttctcatcactcccctcaccctaacatgagcctcctgggctggtgtctagtcctgaagtttagtcagttagctctgttcactttgattagtcccatgctgaggacatttgggtggggagagacttggcaatctctggcagacgcagcagcaggcaactgggctgaagtgtaggctcaagttctgccccaaaccctctcgaagtggcctgggagaaaatgacaagccaagggcagtccctgacgaagctgtccaagggccagtgtcacggccatgccatcctgctcacaatgccaattgttttgtaagatttcaatgttcttttgatgatggacacaacacaaacactctggaagagatgaaaggcggagcttttggttacttacagctccaaaagagagccagctgccaggcagggccacacaggggactcacccagggacaacagaccagcacgctgggactatctgggcagctcgtacacggcaagcggggtggcttaggtgggcttcatgggccccctgggaattgattcattgacacaatattgcaggctcaggaggctgggagccatcccgggttggtctggaacttgacaccaggcagttagggcaggggcatggtggtctggagagatggtcatagtggcagccccctaagggaaggggttggaatgtggacttaactgctcaggaaagtaaactaactggcatctaaccagggcctcaaaactggttcaagacagtatatatatataattttattacaactggttctggtggcagaggcctcttccaggcctgaggaagtagcacctcagcaccctggacctgcccgcccctgcacaccagagaaggaccccaggtcgagcccagtcctggtgatgccagtctccctgacggttgttagctcaggcgtgggcatgctacacagcccctgccaatgatagagttgatctgctcggtttccactggcacatttactctatctgcatcaagcacctgctcttttctaggcactattgtgtgaacagggaattcacacgggatagaacaacatcccttcctcagggagcttctgccctagagagagagctctgctgtgggtcagggtgttttcatcgactcccactcaccctgctggtgaaggagggattctcatcccagggttatggggatggcccaacacacaacgttgacacactggacagaagacacagacaaaagtttctgaggcttatatgcccacagcctgggagaggaggacgcagggcccatgggagctgcggtgggagcagaaggacctggcacgggctgggggaggcggactttgcagtactaagaggatgcggtggccctagtttctatctgatggtgtgattggcttgtttgaataattctgtgggctgatagggaatggaaatgcagggacaagcaggaactgtgaccggcccccttgagaaggagggtagaggtgtgcagaggggaacttgtggttaggccattcgaggccctcccggtttcaccagatgtcaaggcagtgcataatgtcattaataatattagttttaggctttacaccacagagggctgcttctgggatgtggcttttttatgtccttaggccttattgtgtaaagatatgatgcttggagctgccacagcctctgtgagaagatgagtgaaaagccacagaaataacagagaggctgactcgggccctgactagggtggagctgctgaattactcagtctgggggtgccgtgcctccagcctttccatttgtgggatgtggcactcagttcctcattgtttaggcctctctgggttgggattctattcctgccactcagaagtagcctggtcctgtgctcatactgtgtgatcctgtgtgtatcagtggccccagctccacggtgctgaggagcacagagcagatgtgggtttcttctgtgtttgtgcatttctctgtgcagatgtgatgatatctcgtgtgcattcttttttttttttggagacagggtcttgctctgttgttcaggctggagtgcagtagcacaatcatggctcactgcaatctcgaactcctgggtccaagtgatttttccttctcagcctcacgaatagctaaaactacaggtgcatgccatcatggctggataattttatttttattttttcgaagagacaaggtctcattatattgcccacgctggtcttgaactcctggcctcaagcgatcctctcacctccgcctcccaaagtgttgcaattacaggcatgagccactgtgcctggcctgatgtgcattctatacaaaaaaaatataacaagccccaatgtctcattggagggtaacaggaggaggagtctatggaggggctggccagtcctggagccagagtgtgggcctctcaggagggatatcccacctggtctgcaggactggagaccagcagggctgaggtgagtcctgggccactctggcagcaggggaggtcagagtctgacccccactggggagacagatatgaggaagctttagaagaggggagcattccctctgttgttgtctctggtgacctgaagacccatctaagtgctgactgatgaccaagagaacaaggtgctggtacccgtgacctgggccaccatgagccactgcacctgaaggtagggagcccctctaaaggatggcagcctatctcatggccaatgataacttacctgtgagcttgttggggcttgggggctcttccttgcaaccaatgacttacacgcaaggttgctagtacaaggagctctttgtcaggcttctggttggtggatagagtcatctgaaggccacttctgtcctctaagccccacctgcccttctgaggattacaggatgggcatggccacttattgaacatgtattaactgccaaaggctttttactcgtgatctctaaaccttacaaccttccttataaacaaaggaagtgatgctcagagaggctaagtgactttcctaagcccacacagcaaagaaatagtggagcctgatttgaacccaggttccttcttcaatgcagagcctgctcttccctctggccaccatcccgtgtatccaatgctttgagcagttgcctcagtggcaggctgggctgttactgcttctctgagcctcagtcccctcatctgtaaattgggatcacaagagttgagaaggaggtgcctggtgcctggcacaaagcagctcttgactaccgatgccagcccctctgcatgacccgcctctgggcctttaaaaattttggcagtggctcacgcctgtaatcccagcactttgggaggccgaggcgggtggatcacgaggtcaggagatcgagaccatcctggctaacatggtgaaaccccgtctctactaaaaatacaaaaaattagccaggcgtggcggcgggtgcctgtagtcccagctactcaggaggctgaggcgagagaatggcgtgaacccgggaggcggagcttgcagtgagccgagattgcgccactgcactccagcttgggcgtcagagaaagactctgtctcaaaaaaaaaaaaaaaatctctctctatagactggaggcaaagaagaggatggagctaataatgaatgatggcagcatggagtcaagcccgaggtcttagagaaagtcacagatgaccgcgtcccgtcatctgcccactgcagagcccaaggcacagaaggcctctcgccgtcacagctccaagtgctggagctggaggcacacaggcggcagtgtgtgaggggcagggctgccaatgggctgtaggctttatggcctagtgagagaccctggaatgtaatctgggctttcatcgctctgcagctggagtagggcaggtcactgccagcctgcgctgggctggactgctggtcaccagggacctctagacctctgttcacagcagactgccaggcctagagcccagggaacccaaggcaggactgatggagtggagaggagggaaaggcgaggcccccactcctgcagctctgcaggctccagcagcattagaaaggaaaactgttttaatggcctcctcgaggcggagggagtggtgtttaacagggcctgaggaatgggccctcagtgagctccatgaggcctactgggtgctggatcacatggcatgaacaccagagccctctaccatctggagactgtggcaagttctttcatgctcatgggtgaagcaggcatcctggtggtacttccccgtggggtggttgaggggttaagggaggctttcctgtcctgagcccaccccatatgagtggctactaaacgacggcctcagcattcgttacccctgggagggcctcctgtctctcctctctctgcataagctgccccagccgccttcccacccagcctccgggcttccagcccccagacctgggagacataaatgtctgttgtttcagccacccagcctgtggtatttggttacggcagcgtgagttgactaagacccaaggagagagcccacacccccgatttccactgggaagtggcggcagcagcactcagagctctcaggtctttgtacagcagtccctgggccaagtcttgctgtagatgagctcctatcagctctaccagggcagtcatgctggcatgcccactgtaaggataaggaaccagaggtacagagagatggaaaaacttgcctagaatcacaacggttagaaaatggcagaggagggatttgcacttttgggctccagagttcaccgtctttttttgtttttgtttttgaggcagggtctcactatgccgctgaggctgcagtgcagtggcgatcatggctcagtgcagcctcgacctcccatagccggctaatgttttttgcattttttttgtagaaatggggttttgccagttgttgccctgtctggtctcaaactcctgagctcgtgatcctcctgcttctgcttcccaaagtgctcagattacaggtgtgagccatggtgccccgcccagagtccagggtcttaactacagtgtttgattctgccccaaaccagctcagttgcctctgggtctcagcaattccatttttaaacttgttattgatatactcacagtctgtgaaatttacacaacacataattatgtgaacacactgccaggtcgccttgcagggccatggaagggactggccagcaagggcccagctgctgaggctgcacagccccacagcaaaacgtccctgcgctgagcagggttcaaccttacaaagaattgaagagtagatttatataataatgggatacgtgatgaattttgaaattattgcccagataatgaaactttggagcaatatataaagattgtgaccccttgggtaggcaggtgttaccttgactagacttgccctctttaagttatggttattctttttattctttattccacttctttgcccacagtgctgtgggctttagggtcactctggcttcctctgaccggccctggaaaggaggcctccttcatggcaccttttgttgtccttgaagaaagtttttgttacaggaaaggttaaccagaggttactctgctttatagagttaatatctcactcattaaacccacacattcaaaaacccagtttttactcaggcatttaatttcagccagcaaattgtaaaattgtacgtgtatattttgaaaattgtacatattttgtctaacatttttggcaatcattttaaggacaactttatttcttaataatttcttaaggattaaattcccttaaacctttagaattgtatttataaatgtaatagtttctgtttttcctgtaagtattctaattattagaattatttaaaatattcctgaatatttaaacaacttatgaatccaatagattaaatctagaaatatggtgtattttgagttctctcaagtcttctatactgcttataaatttaggacattttaagtaaaaatcacaaagctcagctgatgacatattttaaattagaagcaaaaaaggtgaatatttactccattagggctaatttcttttaaacttgatgaaacacctagaatttgtaaactatgtgcaaacttacatgaaatattattattttgggtttggtttatttaataattctctactttattctaaccctccctgggccatggtgactcagagacagggtcagtgcacaggctgggcccatggagagcagggcatccagagcttgtcaagggctgctggccagagcctgctcccctcactgctctttaagtgactgtaacagaaacgggtggccttaagccaagctgagcgggggtttcattacacctgccttgtagggattctgggatttgtcatggggacacactacaatgtgtacctacaataagatggaaagatgttcaattacactctatacacatatacacatgaaagggagggaccccttttgctttgcctgtgtgcagtagatgcttacacggagagtttggtgtagacagacagagacaagaggctccgcatttcagggaggagcagacctctacagcgaccaaggaggagggccagatacaactaactggaagctgaggagcgggttctcaacttgaccctctgagggcacaggagacattactgagcaggtgcacagctgtgccagaatgaaaatgttctgtgacagagacaagagcgcctgctgagagcggagctgtctccatgtgcatgaccacagccacagccctgtgacatcaggcatgtgacacgcttgctggctgatgaggcccagaaagggcctttagaggtggctgcgaggcagcgctgcagtaggatacccttataaggaagctttttgccaggactgggctggcggctgtcctgggaaccccaatcccacagtgcttctggctttcctcaccattagcatctcctttcctagcaaatatcctgagagcgctttgagattgtgtttttctcctggggcaaccacctgcagaatctccacggaggggctgggaaaatgctttgcatgatccctcaaagctccctttcatcgagggaggaaaggctgagaggtgggcctcagaaagagcttcgtgggggcaggagccatcctgggggtagaagaggggtgtaactggtctagtccatccgaagtaagggctttaaggagcctgctgggagagtttaacctgggacccccgcagcatgagggacatagagactggcctcagacccaggcttggatgatccagagggtgaagtcaggctggcagcctgctcttatgctggagcccaagtgggtcatgggaaagaagagccaaagcgttcccattgaccagaggccaggtgagagagtgaggcggcccaaggtggtggcagctcctgtgggaagagaccaccccaggggctggaggtgaggctggctgcccaggggccgaggaaggagggagtggccaatctgaacagagcggccttctcctccttagggtctgtagccaaaggtgcgccgtgcagcacctggagtggggggtggtgggggaaatctccgaaggagtcaggaaagcacctctgccagggccagatcccatcacaggcatcagtgggtgaaagcgctcctgctgctttcctttctccctttcccgtctccatactggaagggctggaaatggctttgaggagaaggggtgtgaagaagagttaggcagcccactgtgccgccccgccctggctgcagcaggctggagggggtttagggggtgaggagagaaggggactcaacactggatccagtttttatcacccaagaatgaacagatcccctgctgtgctttcatccagaacaggaactgccctggaagagagccctcctcccagccccagaagaaacctcagctgtgttcttgtgctgtgcgtccaagagaaagatgatcagagcccagcggctgcatgcctaagcttccatgctctagtggccacattagaaaaagtgaaatggaacagacagatacttgctttgtcacccaggctggagtcagtggcaccatctcagctcatcgcaaactccacctcccaggttcaagggattcttgtgcctcagcctcccaaatagttgggactgcaggcatgcaccaccatgcccagctaattaaatgagtctttgtatctaattcctaaattctcctcattctgctccttcacatttaaatcgacccccagacaggatcaggacctcctggccttcttggagatgtgggctctatgcagggatgacagaagccaatgtctggagccctcccccaacactgcagagctggagcctgctcagagctcacaagtcatcaaggaaaatcccctgggccctcagagatatgaccactggacctacagggttctgactagggccaacccctttgcagaagtcagcaatccctgggaacctatgggggtgtcatgtaatacctgccacatcaactgacaagtagacatcccaatggccatggaaaaaatgtctgtgccagggcttagatcctctgaggctctataacactgctattaaaatagtcactgagcctaataaaaagtataatcatctccatttacatcatgatgtggaatcctgaaatggcaatttttagttcttggtgaatcaaagtacacagattcttgagaaggacacagcccctaaagagacttgggtcccctcctgcagttgccaccctcccaggtggccagtgcaggcacaaagatctgccactcgctgcttaaacccccacccatggggagccccccattcactgtgggaagtcataggaactgccatgccagtgagccagacccggcccaggccctgcggtcagtcacctgccacctggctgctgctgtgcctgtgatcctcttcacgctcttcccagccgactctccctgtaggctgccctcaacttctagagcgccagccagggtgactctggtccatgtgcttgaccagtgatcattctagtaactttctggaggtcccactttctaggaggcccctggtaagtctctgccttccacttccagctgggaccagtgaccccctcaccttaagaagtgaggcccctggccctgcctcattctgcgcctgccttccaggttcttgagagcaggagggcctggtccagggccaggcacccagcggatgctcagcagatatgtgtgcaatagaactaagccttcgaacttttgctgagcaccatggctgtcccagcagtcatgtgttcccagggttgtgccctttcctgaagatctcagcttctcccacatctgtgtctcatgaatctacaccagcagagcctggctcagcagggaccccaggggaaggcgcaggcatctgtaatcccagcactttggaaggccgaggtgggcagatggcgtgagctcaggagttcaagaccagcctgggcaacatggcgaaaccctgtctctacaaaaaatacaaaaattagccgggcaaggtgttgggcacctgtagttccagctacttgggaggttgaggcaggagaacagcttgaacacaggaagtggatgttgcagtgagacaagatcataccactgcactgtagcctgggcaacaaagcgagactccgtctcaaagaaaaaaaaaaagaagaaaaagaaaatggaccctgggtttgacggggacctcatgacacgacctgccctctcagtgcacgaaagtggtccaggggctcttcttgaatttcccctccgctctccctctgtccctctctcagaggtggtagtggcctgggaggtccttggaggggatctttgcatacccaccagtccacagcgaagtaaactgaggcacagagggaacggcatgtgcccaggatggggggtgtaggtgctcgctggagcagccccttctcggacccaggggcagaatttcatcagtggctagggccgaataacaggaccccgggtgcgagaaacgcctgtgtaaacgcctctcagagggccctggagaaggagggtgggagccgcgaagtcagggcgcccctggaagcttctagagatctgggcgtacatcagacagcagcggctgaagaaggaaacaggctggcttctaataatgtgcagacagtctcgatccttctcccgtagctctgcgagcccatgttcctggccacggtccctcagccgccctggaagccgccggcaccagccggtgttctgcttcagagcgggcgcgcggtgaccggactgacaaggaggggcttcatgcgaaagtcccc

SEQ ID NO: 4166 - DNA, 1306 bp, Homo sapiens
gaatacagaatgtgggcaaactcgcttctgtgccggccgccagaaggtttgctgagggcaatcactccctggtgccgggctccttgaggttatgcactgggacatctagagcctattgtttgaggaatgcagtcttgcaagcctgctctggatcaagccacagactgaaacacccccgaagagcaagcacgtttcttggagcaggctaagtgtgagtgtcatatcttcaatgggatgaagcgggtgcagtacctgaacagatacatccataaacgggaggagaacctgcgcttcgacagcaacgtggaggagttccaggcagttacggaactggggcggcctgtcgcagagaactggaacagccagaagggcatcccggaggagaagcgggacaagatggacgactactgcagatacaattacggggttttttgagagcttcacagtgcagccgcgagtccatcctaaggtgactgtgtatcctgcaaagacccagcccctgcatcaccgcaaccccctggtcggctctgtgagtggtttctatccaggcagcattaaagtcaggtggttccagaatggtcaggaagagaaggctgcggtggtctccataggcctgatccagaatggagattggaccttccagaccctggtgatgctggaaacagttcctcggagtggagaggtttacacctgccaagtggagcatccaagcgtgacgagccctctcacagtggaatggagtgagcagctttctgacttcataaatttctcaaccaccaagaaggggactgtgctaatccctgagcgtcaggtacacggactgaatctgcacagagcaagatgctgagtggagtcgggggctttgtgctgggcctgctcttccttgggacagggctgttcatctacttcaggaatcagaaaggacactctggacttcagccaacaggactcctgcgctggactcctgagctgaagtgcacatgaccacattcaaggaagaaccttctgccacagctttgcaggatgaaaagctttcccacttggctcttattcttccacaagagctctctcaggaccaggttgttactcgttcagcaactctgcagaaaatgccctcccttgtggcttcctcagctcctgttcttggcctgaaaccccacagccttgatggcagcgcctcgtcttcaacttttgtgcttccttttacctaaattttcctgcctcccctgggtctgtattccccttgtgccacaaacacattgcattattcaatgtttctcaaacatggagttaaaaattatctggt

SEQ ID NO: 4167 - DNA, 7453 bp, Homo sapiens
aaaacagacaactacctgagtctcggctcattgctctctggggaattcgctcattccttcggaaacggaattggtctgaattgctccgggatgaagtaacccaggctggtgatccagagggccgctgagcgccccgccggccaacggggctgtgggcccagcactcagcctgtactgggcacccaacatattcccggagttctgggtcctgttggttctggaggcataagacattttttgtctctgccttctgttctctgtttcttgctccttttgtctctccgtccatccttccatctgttctaccctccctcccctggctttttcctccctttctccctccctccctctttctctcccttccggggtccctccttccacccatccttgcctagctccatccttccatctcactctgtctctgttcctgtcctcatctctgcctgccttccctcttgcctggaaagggcagcaccctggtttgcgcgaggtctcgggtctttatttagttgtaaggcgctctatggtgctggcgaggaggctggcgggacacgggttggcaagtgatggtgagcgaagaggcggaggagttgagccacagaaaggagaactggcctggattctgccccggcccagtgtttcgcggactgaggtctccgccaacccgattgaagaacgcgggggggaaagggaggagagctccgcctgggctagttagaagactaggctgctgcctggaaacccgcgcatgcgcagtagacagcccacctccctgtacctggaccggccctgggatccccgggatgctcaggaatgctttcttttcattgttgacagccctactctgtgtggagtctctcgctggacctggaactcagggatcctagggaggtcagctggaagggaagacacgcctctccataccaagcctgaggttcactgcaaaagagaggccgccgccctgcccccaccctgcccccaccctgccccaaacccgccccaacctgctcctccagcagagccctgtgttcttcctgtctgaggagtggttccagcaaagcgggctcttccacgtccttcagctcccccagtggcgccggatctaggaaaggttgtgccttttgctgaaactctggggttgacaggagctcatctaacaggctggaggtgagtgcagacgagagccccggctcctggagcggttgggaggtgcccggttggctggcatctgcgcttgacgcggaggcctccggggtcacgagctcgggaggtgaaggtgccccgtcttcgggttcccatgccgccctggcgacctggggctccagccccaccacggactccggtgggacgtgggtggtgcaagcacacctttcccctgtgactcagcttgaggggccccaagctgtcccactgagcacgcgcccagcaggccgtcgcgctgtgggttctggtcttcctgtcatttgttggggttcggaggccaccagggagtctgaggatgggagagccccagtttcggagggaggggccaggacagtgaacacaaagccccgcatgctcgggcaggttgggagagtccttctgcctgtgcagcctggctgggctggagcagggggatgacccttgcttcctggctcacgaaagccccctgtgggagagccccaggagcgcagggcatgtggggtgcaggaagcgacgttccccacgccccggtgtaggtgaacccgatagaggagggaggagggtgacacccaccaggggtgctaattagtaaccacagtggcctcaaagaactcaaatgaaaggaagacttgcaagtctctcactttaagtccagagctagaaatgattaagcttagtgaagatgtagaattttcatagctagagagaagtcaacacttggcttcagaacttcaaaggatgggctgactctctttgaggaccactgcagctggtgactttaggttacagccagtgctcattgaccactctgaaaatctcagggcccttaagaattatgcaaaatctattctttctgtgctctagaaatggaacatcactgtctgggtgacagcacatctgttaatagcatggtttactgaatattttaatcccactattgagacctactgctcagaaaaaaaaaaaaaacgattcttttaaaaagattgttggttggccaggcatagtggctcatacttgtaatccctgcactttgggaggctgaggatcacctgaggtcaggagttcaagaccagcctggccaaaatgatgaaaccccatctctaataaaaatacaaaaaaaattagccaggcatggtggtagtacctgtaatttcagctactcgggaggctgaggcagaagaatggcttgaaccctggaggcagaggttgcagtgagccgagaccgcaccactgtactccagcctgggcaacaagagtgaaactacgtcaaaaaaaaaaaaaaaaaaaaaaaaaaaaaaaaaaaaaaagaaaaagaaaagaaagaaaagaaagaaaaagaaaaaatcaaaggaaagaaaaggaaaaaagaaaaaaagattgctgcttattgacaattcacctagctccccagaagcttagatggagatgtacttggaaattaatgttattttcatggctgctagtacaatatttaccttcagcctgtggatcaaggagtggttttgactttcaagtgtttttattaattaataattgcattttgtaaaggtatagctgtcatagatagtgatttctttgatgaatctggataaactgaattgaaaaccttttggaaaggattcaccattaatcctttcatgatatttgaacctcctcccgtgaatcacaaatgtccttaatagcaatccttaaatgccattaaggacatttgtgattgatgggaggaggatgaaatattaacattaacaggagtttggaagaagttgattccagccctcatggatgactttgagggctcaggatgtcagtggaggaagtccctgcagatgtggtagaaatcacaagacaactagaattagaattagggccttaaggtgagatgaaattgctgtaaactcatgatgaaacttgaacaaatagggagttgcttcttatggacgagcaaagaaaatattttcttgagatggaatataatccaggtggagatgctatcaacattgttgaaatgacaacaaaggatttagaatattccataaacctagttgataaagcagcagcagggtttgagagggtttactccaattttgaaagaagttctactgttgataaaatgctgtcaaacagcatcacatgctacagggaaatcttttgtgaaaggaacaaacttcattgttttaaaaaattgacacaggtttccaaccttcagcagcccccacgctgattagccagcagtcatcaatatagaggcaagactctcaccagcaaaaagattatgacgtggtaagtctcagatattcattagcattttttagctctgacgtattttaacttaaggtatgtacacagttttttagacatgctattaattaataactaataattattaaatactcattagactacaatatagtttaagcataacttttataagcaccgggaaataaaatgtttatgcaactaacttgattgtaacatttgccttattgaagtgttctggaacaaaacttacactatctctgaggtgtgcttgtaggtttttgtttgtaacatttgccttactgcagttgtctggaaccaaacccacaatatctctgagtatgcttctaggtttttggttgttctttgttttgagatggggtttcgctctgtcgcctaggccagagtgcagtggcatgatcatagctcactgcagcctcaaactgctgggtcaagtgatttttctaccacagcctcctgagtagcttggactacaggcatgcagcactatgcctagctatttttttttaaatactttttttgtagagacgggatctcactatgttgcccacctggtcttgaactctggggctcaggcaatccagccacttcagcctcccaaaatgcagacattacaggcttgagcaactgcacccagcttgtctgcagttcttaaaacaaaacggccaggtgcggtgtgtgacgcctgtaatcccagcactttgggaggccaaggcgggtgaatcacaaggtcaggagttcaagaccagcctggccaagatggtgaacgcagtctctactaaaaatacaaaaattagccaggcacagtggcgggcacctgtagttccagctactcgggaggccgaggcaggagactcgcttgaacccgggaggcggaggttgcagtaagccgagatcgtgccactgcactcctgccttgcgacagagcaagactccatcaaaaaaaaatgtaatttaaaagattaaaagttaagatagatttttacaaatgtatatatctaccattatagtatcatacagaatggttttactgccgtgaagattctctgtgctctgtgtatccatctcttccttccccttggtccatggcaaccactgatctttctactgatcccatagtttcaccgtttccagaacgtcatataattggaatcgaacagtacgtagacttttcggattggcttcttcttttagcaatatgcatttaagtttcctccatgtatttttttgtggcttgatagttcatctcctgttagcagtgaataatatcccgttgccattatacttttgtcaagactcagaacgtacaacgtgaagagtaaacgtgaatgtgcactgtaagctttgagtgataatgaaggatcaaggtaggttcctggttgtcacaggtgtgctcctgtgaggcaggaagctgtagtggggaggctgtgtgtggggaaagggacatatgagaagtctgtactctctgctacgtttagctgtgaacctgcacttctctaaaaaataaaattagttaaaattaaaagcaaaaaattagaaaaattaaaacattacaatgtgttatatagttttcaaatcacaagacagaaaaagacataataaaagaaactatagaaaacaacaaggataggaataaaacatcagtgatagaaggcagaagacagaaatgtggagccaaacacattaatttattttaatcattagttatactcatttatactaatttatattgatttaacatattaattctgactaaatggcattaaaggaggtctgaggaatttgcatgtcacattctggatgacaggactcaataatattaactctttagttggctgtaaatcatttaaaaatatgctcaaattccaataaaaattccaagaaaaatattttcgaacaagaacatgtgattttaaatccatatattgaacacacacatacaatgagagccattattataaaatttactataagatatttaagattattatcactatccaaaattaaacaaatttgaaatggcacaaaaataaacacattaatgaaagagaattaaaaacacagaaattgagtgtaattttatctagtaacagggtaacattttaaacccacaaaacagagcgattgttccatttgtggtattaaaatattgggtaatgatttcagaatataaaatgacagaattgaatcatggtcctacaccttacataaaagttaattccagtattaaatgtaaaaaaaaaagagagagaaaaaagaaaattagatgtgtgtgttttatgaccttgagaatgaatgtcttctaaaaccaaaatttcaaacagaaaccatataaaaaggaataaacctaacgtacctaatatgtaaattcttaaacattttaacaccaggtaaatagcacaaaacaaactggggaaacttttacagcaattatgttacatgaaagttaaaatccttatgacatatacaatgtataaaacaatatgattactgctattattaatagcattatgattacctggtcttcccacgcaccagtcctcttctggtgccctgtggtgaaacagagccctccctctctggccacagtgagggatccagcaggaacccgtgcctaaacccacagagggtgtgagccaagccaggacatcacattccctcctgcgaaatgatgcagatacccactcacgacagagatttggtccctctctggaaaagctgtgtaacaattattgcagaaacttgtttcttatgttcccagacacatggagaaagctggtctggaagactgatgtccacatgctaaaagcagtcactcataacacacacactgcacacaccacaccatgtgcacatgcacacacaccccacacacagacaccacacaaacagcacacacaccatgtgcgcatgcacacacacaccccatacccactgcccacaccccacaaacacacctactgcacacacaccatgtgcacatgcatacaccccatacagacaccacacacagacaccacactgcacccacaccatgtatacatgcacacaccccacacactgtacacacacgatgtgcacacatgcatacctctgacaccacacacactgtgtacacatcatgtgcacacacacccccccacagacatcacacacaccacacagtacatgtacccgtgcacatacccccacaccacacacgaatctactacacatacatcacacacatacagcaccacacacatcacacaccccatacatactccccacacacaccacacaccccacacatactccccacacactgcacacgtacatacagtgccacacacatagagcaaacacatacctcacatacatacaccacaccacacacacattctacaaacacatcaagcacacatcaaacactacacacactgcacacacacagcatcatacacacacaaaacacacacatcacatacaccacacacatatcacatgcacacatcacatatagtacacatacacaccaaacacacatacaccacaaacacagcacatatacacaccatgcaccacccacatactacacacagtatacacacataacacccacaatacactccacacacacatatacataccccgtgtacctactacacacacagaccacacacacatatcatgcatacacctgcacacacctcacagaatacatacaatcctcacttttagaaattaatttggcttttaaggagcctggatagtaaagtattttattggcgtttgagtgagccaagaaaatgcgtataaatacacatgcataactatgagggcccaagcagcactttcgaaatcacaacatgagattaaaccgtgtaaattttttattgtttttaaaaagtcaactctttctcattttactagaaactatttaccagagtaaactaatgagattcttcctgaggtcaaaagactttctggaaaaacttctccttgatgaaat

SEQ ID NO: 4168 - DNA, 3534 bp, Homo sapiens
ttgggaggccaaggtgggaggaccatttgaactcaggagtttgagaaattgtgcaggaaaaagaaattcgtgctagttttgctgtcacacctcaaactttgccacaagtatgtatgtgtagataaaaacatatagggttcggtactatccagtctaagggatccaccaggagaattagaacctatcgcccatagataagtggtggaggaaattactgtacaggaaattagccactttaatataattacactgaccgattttaagatgtcaccttcgtgtggaaataaaatgacattatatgtaaacagcttttaactgaatatattttttgcctctatagtaaggagatcagattatattgttatgatcttcctataatcaaatttctgatgggaatggtgaactaacatttctaaaaggtcttttgggtgaactgagtactgcaaggtttccataacaatgcttctttctagtctttttattccaatagagtacgcaaatctggacagctccttggagtttcaaggttcaaggatgaaaaatctagtttatgtgttgtatacagctaatgtcaagcctactacttcacataccatgtaacaaaaactgagctataaacaaggaaatcatacaagcaaaactacatatcagaacctaccacaatagctaaaaatcacaatgccctcaagaaagctacattaatgttggtttactaatagaacagcaaactagatagctactggagtaataatctctgaagggcaatattaccaatgccactatcacaaactataaataatcaattactagtgaatttccattatcattgcttagtgcaacaggaagtcacaaaatttagaggtgcatgataaacagaatgggaaggcactacaggtatcagtaaatagccctcctaatacctcaaacagtggaaatacactattggccctcaaaatcctaccagagtactcttttaatttaaatatatgaataaaggacacttaacaattatacaatacactagtgattatgagaggaagtgttggatagtaatactagaaaaaaattagggaaccatttcaggtacgtgcagttctgccaagggcacaaccatgtggacaaaattcatactacacatctatcgtatcaagttacttcacaagacagcaccaaatctaataattcatatggaaaatagagttgaccatcacttctacagggcccttaattttagaggactttaaaagggcataactgtaatgagacaacagggaaccaaagaattacagtaccagtgtacaataaaaaattacattttaaaactttgaaggtctctaccaatttcaatatatttctgggcaaatagcactgagccattaaactgtagtgctaatggaactgatttcctaaactcacatgaacctccaaccatctatatcagcaaaatgcaacactgcatggtacaaattatgtaccacagaacttgtgattagacatcaactgtccagaattccacaacaaatctggaaaggcccaatatattacaacctatgaaaactgaacactattatcctggagctactgggattgaacaaatggccatatgagaaccaagagaatctggcaaatatttttgactaaattcacctatactgtatatactttgtcaaaagtccttataaaaactatttttgtctgtaggacaagaatgatatttctattaattaggagcagatacagattcttaactttggactctatgccaccagctaaagagcgctgctgtgtagacaaatttagtacaaaacttccagttgattcattaccaagtccctgaagaagcaccaaattaaaaattttaagattacaaatgtgctagataaatacatgctaccattacaggggagggagttctaaaattacttgcaaatgacaatggttaagaaatcaaatttggttatgaaacattcaggctaaaggatcaaagcatatatacctctacacttaaagcaaaaatgttggttgcttcatcaaatgtctttattattgaataattgatttccaatgttgctgaagtgttatattaagaggaattttcttttttcataaatttatcaatttataaagggcaacattgtgagggcaaataaagcactacttaagattcagagtaatgagttatttgtgcaaaatacatcacaaaatttggcatttagacatgcgaaaaatatgggcaataagatactacttaacattgccaaaaattcatgactcccctcgccaactccccactcccaagaaaaagtacataggtactaaacttatggaaatacattgcattgaatagttcctttaaaacctttataattggctggaaagaacggaggaattctaattgaactagaaaatacacaagaaatgtgcatgtaatgtactctctaaagggacaacagagtggacagtcaaggaactccacatattcatagtgttatttgcaagtttctaagcagcatccacaaataaaaagtaggtggctgaagttacaggctgatgttacacattagtaacacaatgtgatcacacaaatttggcaaaacataagtattcaagtttgagttgaatcaatttgacaaagcatatgtcaaacagatgtcagatagcaaaaggctacattagggactacagatttgcacgttagttgttcaccatctcaaaaacaagtaccaaacctttaattttattgagtacattcactgtaccaaatatcaattggcacagaatggaaatatccctactaggtaacatgagttggcaaatgtaattagacattgcaccaaaaccaacccaaaacaaaaccctaaacacaattcacctatcactgtgtatatgagaaagcatgaatactatctccaagaagtccttaagatcctgtattttcctcagctgaaaaatcttactaaaattttactgtctcaacattagaagacagcactgtacctgttatttccaaaagacaaggccatgcaaatacatatgaaagatttccattgtttcccattttgtccagagaagccaaaattggaatttcaattatacacagatcaaaatatcccatttgctgagtttagctgctaattggatgttaaatccaatttgaaaaaccagggcaggtgccgtggctgacccctgtaatgtagtcttagcacttgaggagcccaggtggtaagatagcttgcgcacaggagtttgagaccaccccgggcaacatagcaagaaaaccttgtctccacataaaatttaaaaagtaaccagtgaagctagaagatagagtagcactacttaaaatgtttatcctacttcaggacagcaataatctgggaatggatgttgacaatgcaactgcaaagcagcatatatcaacatgtataacaggagcagatggacaatttattattttttaagacagagtctcgctgtgtcgcccaggctggagtgcagtggcatgatctcggctcactgcaacctctgcctccc

SEQ ID NO: 4169 - DNA, 1927 bp, Homo sapiens
ccttgccttctcattgcagctgaccagacacaaaccctcgcatgtgcaatacagaagactcccccactggaaaaaaaagaaaaaagaaagaaagaaagaaagaaaaaaaagatggagggaggaaggctttaattttgaataatttccaaggacacagagaaaaatgaagtatctgtgatttacactaaagctcacaggcaactttctctctccctctttttcttcccccacagaagcagtcacgtacaaaacattaaaatataaacagagctgcagttgctgaagccagaacccttgtctgattttttttaaactccgtgtcatgctaaaaaaaaaaaaaaaagaaaaaaaaaagaaaaaccaacaccgtatctgaaaagcttagcacaatataactattaaaaaaatcttttggttggcttggttagtagtgtgagaatgaagaaacgtaaagacttccacgtctcaggaatatttcagataaaaaataatcttttgcggctccctgcccgggctcccagcagcctcttcccctttgtgtctgagctctgtcccctctgcagggccccagcagacccccaccaggcctgatgtggacagctgttcccaagccctgccagttaatcgcttctgggtttgcacccttgagctgtgtgcaccaggacacccccacctactggaagtactcagggacgcagcctggttcactgacacagcccccagctgcctgaggagtcggtgaagctctggcctttccacctcttctgctgcaagaggccttgcagcctgcttccctggtggaaaaaggaaagcagaaactctaggccttcctgctggatctacactactgggagagccccgatagtgcaaatttaattggcagggattctattaaatatgtgactttatttggggttgctaatgaaatcaaaggcttgttgtatgacttacagtgtggacattaatttttaagaatgatgggatagaaagttagaacggaagagtttttctacctaaagaaatgagaatctagaatttgtgaaagggctgaatgttcctatcttgctgcttctgggacaaacttttccctgacatgtaaaacgcctgcaactgccatgaacaggaaagaaatggaaatggtactgattcactcatcaactccaggcaactttgtgtgtgtgtgtgtgtgtgtgtgtgtgtgtgtttattttgaaataactttattcgcagcctaacactttgcactgcattcagcatgacttagaatttacttttggtgttgtccagctgctgccaaaaattgggtagaatcagattggtattctttgttggtgcctggaattgtagccagtggtacaaaggtgatgttgttccttgctgagacttcgtggaagaaggcaaaactttgatcatctgcccttgcacttgggcagtgttgaaggtgattggagtacaagtgccaatttgcaggaacaattgtaaacacctttgatacaaatgccatcatcccatttttactgattagaaaaactttgctattaataggtgcaaagtccatttcaggtataattggtaaggaactgagtgcactcatgggaagaaaccttgttttgttttttgttcgcttttcttcttatccccttttctcagttttatggctggagacatgatttattgcagccatccatcttgggggctcatccatcacacccgggttgctaggagattgtggcagcagctgtttgctctgaatcagacagaaaagttgtcaatcatcaaaggcaggtgaatagcattagaaacacgctattgtcagacggaataattaatcaaagagagaaaagataattaaaaagatatgacccttgcaagtacttgctctgggttgcctgtaaaaaaaaaaaaaaaaaatagaaaaaaagaaaaa

SEQ ID NO: 4170 - DNA, 1030 bp, Homo sapiens
gttttgaagcctgtggaccttaatggtgtcatcaaactttttgaagagactgctaaagaaggcttagaagaaaagcaacttaaatctgtcaagaaactggtacagtgttatcagaatgaacttcccttaagggatttagtacagacatttgaaattctgaatctgtgtgcagtaaaaattgaaaaccagccgcattttgtagaatctgcatatgatatcataaaatagtgtggcttgccatttttgaaaaagaaagtatcggatgaaataacttatgctggagatactgctagttcagttgcgcttctgggtgacttaatgaaaataccaagttctgaattgaggataaaaaattgtaaacgtattgttgacttttatcaggcacaaccaccaaaggagcatattccaggttaccagcaagtgagttcatcatacaagattcaaatggctgaagttggaggattggcaaaaacaatggcccagttaatgaccttgcttgaaaatcaacttgttgagaaactttgggtacttaaaattctgcagcatctctcgacttctgaagttaattgtactgtaatgatgaaagcacaagcagccaatggaatctgtgctcacctcaatgactcagatttctctggacagcttttatttccttcatcagaaacactttggaacttatcagaaaaaatcttcaaaataagaaattgttcaacagcttagtaacttggaatgtttactgactttgaaggaagtattttaaaatctatgagaggttttagtcattatgaccgtcagcttagaaatgacatattagtgatcactacagttatagctcaaaatcctggagtgccaaagattgaatgtggctttaccaaggatttgatactgttcgcaacctttaatgaagttagaagtcaatccctttggtaaaggacttaaattttctaaatcctatgaagattttgagttgaataaattactattcactataattgtgatcttatgtaaagatttaaatactatacaggta

SEQ ID NO: 4171 - DNA, 2767 bp, Homo sapiens
acagagcctacaagaatatacacttcactggacagggattttaaattattgtgtttgctgctatatcctgaatgcccagaacagggcctggtatatagttagtgctcaataaacatttgctaaatgaatctaaatctgctgagaataactcagcagaggaacaattattagaccctatgaaacaagtcatagttgagagaatttatatatgaacgttttgaaatacaggataacataaagacaaagctattgcttggagaagtcatttaacaaatatttatgtgacaggcaccatgtgaagtgctgaggatacaacagtgatcaaaatatacatgatccctgcctttaaggaatttagagtcttgcatgagtgatacaagaaaaattcctgtgctagtctactttatcccatataggaattgcaagtctgtatgacaaaaccttacacactcactcactcaaaatttggtatttaaagagtgtgaaggtaaatgaataactgctcactactcaaaaaaaggttaaagtttgtagttcataataaaagaaaactcacttactaatgaatatatagcatggctgaattcaaaaatacttattaaggaacctatttgtgaccatttctgtgggggatatataaggagtatgtgaaacagatataaaatacataagcactatctttaaagagcttacatgtccacattaaacacttaggtaatattgaaatatcaggtaaatatacatatacttttaacctaattttacctaattacctacacttttaaaattatataaagggctgggtgttgtggctcatgcctgtaatcccagcactttgggaagctgaagtgagtggattgcttgagccctggagtttgtgaccagccggaacaacatggcaaaaccccatctctactaagaaaatacaaaaattagccaggcgtggtggcacatgcctgtagccccagctactcaggaggataaggtgggaagatcgcttgaacccaggagatggaggttgcagtgagccaagatcgtgccattgcgctccagcctgggcaacagaacaagactctgtctcaaaaaaatatatgaaattatataaaaatatttaattatccaaatatgtttgcctactttaatataaatatatgaaacatatacttatgttatatggaaatatatttaatatatattaaatatatatttaatatggtaagaggtatttaataaatatatttaaggtaaattaggtaaacacacatacatgtaatatgtgctaaaaccattatgttactaagtgctttaggagtttaaaggacagaagagattaatgtgatacaggctataaggatcagagaaaggttctttaaagagacagttcttatggaggtcttacatacagaacaggtccagcataaggcagtattctgttctaaggaccactaaggatagtaaagaagctggtgtggctacagaagaatgtttgtgaactagagaatgacagacatttgcatcttccttattttccatatgtagagcacaacgccttacaaataacaagctctcaataacaatggctgactgacggaaaaataagtcagactggatcttatcttgtagtcccagatttaaaagtttttcagagaggaatgctttgatgaaaatggcattttataaagattgatctggcagcagtaaagtctcccaaagaggctactcaaaaaaccactgcaatacattgttgagttttctctcattcatttcccttaatttatacaagttatataatttaattaattttgtgaatatcttagaaataatcattgcttctaatatggatgagtcctttacactgttccaactcaacaaaaactaatcatgctaggaaaaaaaatatattggaagcattgtaatgtaatgtacttctgggagataaattcttaacagttctaggtagaatctaatagcataaaaggcactgcaaaataagctatccttgtctatggaatgagaaccatttcttcataagactcattgcttttagatacctgagagtgcttctcctcgttgtaacacttcttcgatattggccaccatgatcctctgcacatcttgcaattcagtgttgatggagcctaggtttcttcgagcacaactgtcaatgtagagcttcttggttttctgaatgaaagtatctagaatgatgaagaaaactgaccatttctttcatggccatcaaagtactgaggtaggaaattaaaagttctgagttggccaggcacggtggctcacacctgtaatcccagcactttgggaggccaaggcaggtgaatcatgaggtcaggaaatcgagaccatcctggctaacacagtgaaaccccgtctctactaaaaatataaaaagttagccaggcgtggcggcacacgcctataatcccagctactcaggaggctgagccaggagaatcacttgaacttgggaggcagaggttgcactgagctgagatcacaccaccacactttagcctgggtgacagagcaagactctgtctcaaaaacaaaaacaaaaaaaccaaaacagttctgtctttattcctggatttgccactgtccatggttaaccaaactcttggttgaatatcaaaatctaggctttgattatttcatttgtaagatgtaaaggtataattagacgaccattcaggagaaatgtcctttgaatacctttaaattagaagtatttgctatctaaggctgctatcag

SEQ ID NO: 4172 - DNA, 521 bp, Homo sapiens
aggcatgaaccaccatctccggcctgaagtttatttaatccattgccttgtggactgggcattgaagttgtgtgtagttgggtttttttgttgttgttgctgttgcagacaatactactgtgaacattcttatccatgcttccttgtgtcccgtaaatgttccctccagggagataccttggagtgacatgctggtgtgagggatgcatatcataattttaccagatactacagatcttgaaattgttccaattctaccccacaagcaatataagagctctcactcctccaaaactccctgagtctttacttatataatttatgattttgacagtcttacagatttaaaatggtacctaattgtgtacttaatttgtgcttttctgatttcactagtgagattgagattctttttgtatgtccattagcccttcaggcctctgtgatttacccatgatttactgtggtttaataatttttattgggttcttttccttattgatttatgggaacttattata

SEQ ID NO: 4173 - DNA, 2728 bp, Homo sapiens
agacgcccgctggacgtcaactcggccggacgcggggcacgggcgctaacaggctcctaggagcctccccgggcgccccccgcccagggcgcgctctgctcacctgcaggtttcggcggctccgcggtgactaacaacagcggcagcagcagcagcagcagcagaagcggtggcggctgtggcagccccgggcgcccgcccggaccgccgcgggtcatcgctccacggccgcgaccttcctctgcgggatcaggcggccgcggtggcccgcggtggcagaagttgcaagagaggctcctggcctactcaggggcgccgcctctccgaggtggggcgtcctcaactttcctctttcttgagcccggcctgctccgggctctgaggggcgaggacgcttcacgtggtggcctggggcccaccccgcctaggaaaggcggatcctttacgtctgaccctctagcaacccctgggccggtctgggaaagttccccagctgcacttctgggaaatgcagaggctgcctgccgctttctttcgcagttttgcggcccaaggcttgggcgaatcagttcacatcaacacccctactagcctctccctccggggtcgaccatttatctccagcagcggaccaggcgcccgggccagggtgacatgcgcgccctgcctacacgcagctcggatcctctgctgtttctggagaggcctccacaggtagaagctccctggaacaactgctggaataaggttccagagtggaaggtggaagctccctcttgggataaaggatccacagtggaaaaaaaaaaagttgccctctgctggaaaacagcatctttgtcctctgagaaaaacagtctcccttcttacggaggccagtggattccatcctagaggctgtgttgaccgtatctccaaatagacaataacgaggcatcttgattcccacaactccagcagcacagggacctgaaatgaaggacagaaagcaggaagtggaggcaatagaaattgcagagtagagtgaagacaggtggcatttctgggattggtgccatgacaatggaagacagaagacaagacaaaggcataactttccgtaagcatttcatggaccaggcgaatgcagctggatggggaagcctgtggcacaaggaggttccaacaagcagaacaaaagcccaggctagactatgcgctgtggcatattaggccttggatattcaggaagatggggaagatttggaggtatgctgactgcaacaaaggaggtgggctctcccggaaagaaaacaaccaatcaaccacaaagatttctaacactcatttggagaacctccagagtatccggagaaacctttttaattggtgcaatgacaaaacttggaacctttgaaaaacattcctttggtgtggcttggattcctaggtacacgactggagtggttgttcttgacatgccctgtataaagtgcatagtattttggaggctgcatagatgcaatgacaaaattggatattctgccatatttgcaattcattgtactgcttatatctgaaaagtcacatgagtttggtgatatggtttggctccgtgtccccacccaaatctcatgctgaattgtaatccccaatgttaagggagggacctggtgggaggtgatgggatcatgggtgcagatttccccattgctgttcctgtgttagtgagttctcatgagatctagttgtttgaacgtgtgtggcacctccccctttgctctctctctctcttcctgccatgcgaagaaggtgcttgcttccccttcactcttccaccatggttgtacatttcctgaggcctccccagccatgcttcttgaacaccctgtggaactgtgagttatttaaacctcctttcctcataaattacctagtctcgggtagttctttataatagggtgagaatggactattacacttggaaaatagtgtgttatccagagagagaaactcatgttgtaaataaacgaaggaagggctgggagttaacatgatgagctttgataacaggttgttgctgacatagataaaattagtatacagagtagatctcttagaaagtcttcccagaagaaaaaacttctggccaggcacagtggctcacacctgtaatcccagcactttgggaggccgaggtgggtgaatcacctgaggtcaggagttcgagaccagtctggccaacatggtgaaaccccctctctactaaaaatgcaaaaattagctgggtgtggtggcaggcgcctgtaatcccagctacttgggaggctgaggcaggagaattgcttgaacccaggaggcagaggttgcagtgagctgagctcatgtcgttgcactccagcctgggcaacaagagtgaaactccatctcaaaaataaataaattaattaattaaataaaataaaaataaaaaagaagaaacttctattttaatgtatttaccccaaggggtactattcaaataaatgtctaagtgatatctggttcctacatgcaatcttaagtttatttgccctttgctacacatatttctttttgattcttctagttattgctcatgcatgttttagttttatcttgcgcataaaatttttacataaataaccaaagtgagttgtgctgaagccatggtgtattgtagctcttcaagagacttgtgtgatataacctttggaaatccaataaaaac

SEQ ID NO: 4174 - DNA, 7870 bp, Homo sapiens
atttttaaaatttttaacttcaggggtccaagtgcaggtttgttacacagagccgcatgttgaagtgtgaggcgtgaaagggtatgtctgatatttgctttaaaatgctccagcaaagaaattaagggatggatgaagcaaaagagccaggtatggtggctcatgcctctaatctcagcactttgggaggccgaagcaggcagatcacctgaggtcaggagtttgagaccatcctgaccaacatggtgaaactcgtctctactacaaacataaaaaaattagctgggcgtggtaccacgcacctgtaatcccagctactcctctggaggctcagacaggagaactgcttgaaccgggaggcggaggttgcagtgagctgagatcgcaccaatccattccagcctgggcaacagagtgagactccatctcataaaaaaaaaaaaagtaaagaaaaaaaagaaaatgtctttatttcattttctttcctaaagaatatatttgctggataaaggattctgtgttgacagttttgttgctttttaaaagcactttataaatgttgctccatggtttctgatgagaaatctgccatcactgaaatctttggttctcctatatacaaagtgttgttttcttccagttgttttcaaagtattttctttacagttggtttcatcactttgattatgacgtgcctgggtgtggttttcctttttgggatttgctgtgccagcagaccggctttaaatagaatgctatgtaaatgtatgtgaatatttgttttttgccagatgtttggaagtttttagctattatttcttcagatatttttttcttccaattgttctttctgggctcctaagacatgaatattagactgtttcatattgtcccacagatccccaaaggtcttctcatttttttcacttttttctctgtcattcagactagataatttctgctcatgtatcttcaaatttactgactcttccctcagtcatcttcattgtgttgagaccttccagtaaattttgttattgtattttcagttctacaatttccacttgtttctttttatagcttctatgctgagacttttagctttccatttatttcaacagtgtttccctttatatatttcctttggagaaatgtcttctttgtgtagcatgattaaaataactagtttaacggccaggtgtgctggcttatgcctgtaatcccagcactttgggaggcccaggcaggcagatcacttgaggtcaggagtttgagaccagcctggccaacgtggtgaaactctgtctctattaaaaatacaaaaaattatctaggcgtggtggtacacacctgtagtcacagctactcaggaggctgagacaggagaatcacttgcaccctgggggtggaggttgcagtgagccaagattgtatcactgcactctagcctgggtgatagagactgtctcaaaaataaataaaaaaaataaaataactagttttaagtctttttctgataattctgacatttgggtaaccttagagttggctcttgttcattgtcttttccctagagagttgcttaggtttcacaagttctttgtccaatcattttgggttgtttctgggatatatttggaatattatgatattctctatcctgtttaaatcttcataagaatgtttttgttttgttttgttttagcagaccatcaattcagttaagtttcagagcacacatcctggccactttttttggtggctgtggttccaatgttagttttcactgcctttgttaagctgttctttgccccagttgtgcaccatctagtggccaatctgaaacttggacagtggcctacactgtaattcagtgttcagaacctttgctcagctgcttctggttagtttcacacatacacagcttgtgagatgatcccaggattttattgacagatttaagggttccttttcttcagttccctcctatttgtgatcttacctatactctggtttctagaaccccattcttggtttttggctagaaagtcagggcgttagcctccccattgccagtgttctgccctgcaatgtctgccactagtgcaccagggggaagagaagagtgatacctctttactgctgcgggattgatgtagagcaaggaaagtccagaaggttccaagtcattacccatggttctcctggtggggcggtgggtcttactgcatctttcctgaggctctcttagaatactgcaattaaattaaaaagggttttgtcccatagcctccaacctcctttctggtcctctgactagaaacagcaaattgttccttggactatttttctctctgtcagctagcatttccagttttcctgttaaatgtcttttttctttttccttttttttgagacaaggttttgctctgttgcacgatcacagctcactggagccttaacctcctgggctcaagtgatcctcccacctcagcccccgtgaagctgggaccacaagtatgagccaccacacctggcaaaatttttttaattttgcagagacagtgtctccctgtgttgctcactctggtctcaacctgagctcgagtgatcctcctgccttggcctcccaaagtgctcgattacaggtgtgagccactgcacctggccttattatgtgtctatgtgtggattttctagtttattctgtttgggatttgtctggcttctagaatgtgtggggtcatgtctttcatcagtttttaaaattctgcattctatctaagtatttgctctgtcctattcttgcctctcctctcacagctaatgaagcacttaggatttttcactgtattctctacaggtcttctgtttttttttccagctgtttctcccatggtgcactgtgaatagtttctcctgagttatcttccagtttataaactaccccaattggctacattctattacatctatttactgagttttaaagtgcagtttttatgtatattcttgtaatgtttatattcagttcttttccagattagctccacaactttttatcgtatagtttcccatttcctgcaagtacattcacacaccttatttccttaaacaaagaaaacaaatctaatacctatatctgtgagtttgttttcattgcttcaagtaattcttgcctctggaatctagtttccttatatgactactttttactatgtgttactagacatatttgaaaagtaatttgaggcctacaatgaaattacttttccatgaaaagtatttacattttattttctctgtcacctggaggcattactagtgtgggaacaccttaaaggaagctcagtgcttaagattctttagatcactggggcaattctaaacttgcctgttcttttacattggttcttccacctctgattcattatcatcctaaaggtgaaagtatttgggagtctcagcctattgtgtggagggtctcctgttaggttcatcaccttatatgggccctgaactttaatttctgtccccctcactcataaggttgtcagagtaagggtacatgcttgcttctcttattctctttacttttggacttggcattccttattgtctggaaaatctctttgatgttttaagattattcttgtattttaatcaggaattgttttcaacaggaacatgatgtaaatatcctagcatgcaattttcagaaacaagtagtttcccacaattgaatctttgctcctacagggccaaatcctactctttctcttggcatgctctgcacttaagcgcatactacttgtggcatggaatccataaatgttgataaagaactacgcctaattctgtcagaacaattaatcatttttagaaatttttgcttagaaacctggtaaagtgctctgcatgtagcaagtatacgaacacacaaagtttgttgaatagctgcataaaacaaatgggctagattttacttcatatttcaaaattcagagaaagagagtagtattaaaagacataagccaaaaatagatcattgcagactgagtacaaagaaccattctatttcttctcttaaaaaattaaaatttcaaattaagtaccaatgaccaaataagtaacaaacacattcagaaacatactatatgtctacaaagaatacttcaaaatgtgcctccaaacttcaggcacataattccaatttttattgaatatagagattttatgaaaacaaatccaaagctgtcccatcatggaacagccctctaccatttggttattttaagactgttcaattacttacatggcagaatacatacactatatttagaaaacataaattgggtttgatatgcaattgttttcatcttacaccatttcaataaatttcacaaattataacaggttgccattttattgaatatctgcgacactttacattgttcaggaagtagctacttccagaaggctgatattctcctccaaattgtctttggctaagtactacagatgtgattcagtccaaactatatgcccaaactgattaaaattctcagtctctcctagcttgagacctcagatcctgagttataactttgacttgatcttcaagttgagatgcttcataaatatttttcttaaaacagggctatttaacataatttctttttcttgaaatatatgagtgtttttgatacaaaaacatatattacacatgagaatgtttaaagcatcaaaataatgattaaattttttacataacttaaatgacaggactacaatatgccccccacttttttgctgtttgaagtaaagaggaaagctctgtaacaatttcaaatacataggatttaacttatgttaatatcctgttataaaaaataactaccatataaagaatttaaaatatgcaaaagtaattagttcatttaaatttatacttatacactggtgtcaatgaaaatatgcgaagttgccaagaaatttctaaggattaaagtggaagtaaaaaaacctgtttcaggcttcatttattgctacataatgactacttcaagggtcatctggcccgtcgtcagtcactcttagaagtggtaaatacagtggtatagtttggaaggaaaggaggaaaaaaataatgcattgtgatacaaaaatattacctacatataaattattaaagatttataaaacattcagaatatgttcttgctataaaaacaatatacttaaatatagaagcaaaaagtcctgaagcacccgcaattattttaatatccatttaatcagggaaaactatatatgtggatatataatacatacatatgtaataatttgagaagaaaaaaggcaaaattctgattataatccaaaaagagtttatctaattatggaggtaggtctccactccaattatacaaataagttatcagttttattcaaagaattataagtctaagacctcaaaactggtttttgtgccactgaaatacaatttgacagactttagaaaccagtattctaactggcatatacacaaagcagatatttccttcataaggttacatctgaaaagagccttcattaaaatcattattggcataaagaggtatacctaagtgcagatactttggcttagcatttaaataacacagtaaatgctataaatttcttaaaagaaatccttgtctttttagtacttaaattaattgtaaagctacagaaagtatggatctcttaaatttttagatatttaaatattgtgctaatgatttgaaaagatcattcctgcctaaagagcaaagcttatgtgtttcaaaaatcagacatatttatacttttagtgtttgtggcatttcagctttagtgctggagttagttttaacaaattaggttgcaatatgtaatatggcacattctttcactaaaaaagatgttctataatgaaaaacactaattctatttctaatggtaaactagagttggaggtcccaccatggatcacaggtatcagagcactatcaagatcatttagataatgctgaggcagaagttggccttcagatcctgcctgaaattcaacctagaaaaaaaaaaaattcttgataagaaaatgagcaatcttgtttaactcggaatgtgaatataaaataagtgaaatattttaaaatacagttcaagcatgttaaataaaatatttgatatatttataaaaaaattctacattctcctgtatcttttatctgtctactacataaattataattgttcctcctcatatatcataaagataaaattgccactatgtcatactttacgtttcctctaaatgaacacataaacaaattagagggatgaggctttgaataactgccgacattacttaaattaaaaaccccatggtattaaaaaaatctacttgaaatatttcaaatttgttgttgcaataatatttaatattagactctaacattggtgcaaattacattttaatacaattggctaaaaaaatttacagtgcttactccaataacaaatagtgagtgcttccttgaaaagaggacttttaatagtgagataaaaacaaaaccccttttccagtaagaactatgagtaaaatatatcctggctggagaaaagcaaaccctcagcatatgaactcacccacgtttagcttaaccattctaatgaattctctgatttgaaaatctatattggatgttggaaagttacctggatgtcagaaagagaactttcagttcaaagaaaaacaaattgtttttacatgcaagatgatcatcactccttgttaagagaaatacaaattaaaataatactggggccaggcgtggtggctcatgcctacaatctcaacactttgggaggccaaggcaggagaactgcttgagcccaggagttcaagaccaacctgggaaacagagtgaaaccccatctatttaacaagtaataataatattaataataatgtggtattatttttcacctatcaaattgtccaagttcaaaagtttgattatatacttctttgataaggatatgggggaggccaggtgcggtggctcacacctataatcccagcactttgggaggccacagatcacatgaggtcaagagttcaagaccggtccagccaacatggtgaaaccctgtgtctgctaaaaatacaaatattagcaaggtgtggtggcacatgcctgtagtcccagctactcgggaggctgaggaaggagaattgcttgaacccagggggcagaggctgcagtgagccaaaatcgtgccactgcactccagcctgggtggcagagtgagactgtctcaaaaaaaggatgtgagggaaagagctctcacaaattgctggaagaaataaatataaattgacataacctctatttgggataatatggtaatatctattgcgtatatactcaggcctggcaattctactcagaatttttcttatagatatacttacgcttatgtaaaagcaaaatattgtggacaacctgaatgtctatcaacatatatcaaatatgcatgaataattagttagataaattatggtacatttatataatcaactactatgccgctgttaaaaaagaatgtctgctagtattaatatctttaagatatattaaagaagcaaggtaaaaaatgtgtaaaagagggaagatgaaaaaggaggacacacacttatttgcttgtagatgcataaaatcacaaagaatacgtaagaaatgagtaacactgattgcttggccggagagggaggataaagaaaagtatgaaggtgaactgatgggttggatgtcaacagtaggaaagatatttccaaggc

SEQ ID NO: 4175 - DNA, 5716 bp, Homo sapiens
gccgccctcctggggtgcctctcagggacccaggcgctcagctgctggggccgcggagggcgttcgcggggcgccggggaaggctagggccgcggggtccccggggcgccgtccccaaccgccgacgcctgccagaccaccaagtgggggccatgtcgacgtgtgaggagcctggtggaaggtgatactggaattccggcactgggcctgcaacccttttagtccacagttgtcagaatctaaagggaagaaaaacgaagtgctcagaaccctcacagaagccgggcacctcatcccgtgtgtgggttttttccccagtacaaacccattgtggggacaggcgcttttgaagaaaaaattcagattcccgggctgaagtggctcctcacagccttgaacctgacccccagcttcccgctaaagccgagcgtgcccagcacggcgaggtcagcagaggcccctcggagggcggccgggggaggtcagtgggaggccctcgggcagccggtggatgggccggcgacctccccgactccatcagaagcgctcagtctgtgcccttcagttactggagcagctcccgtcctttggccagttctctggaaggtcgtttccgtttctgtgtctgccacacgtgcagcacaatcgaaaaaccttgttcgacatttctagaaagagtagatgctactgaagacccaatagattgctgagggttttcagagcagggacaattgcatcagggtgctgggctccgggaagaactcagaggacttggctgacgggcggatgggacagtgattggtgccgagaatgggccagagaagcaggtctgcctggagcaggcacccgaggccgcgtgcaggggcggtcctgggccaccaacccctggaagctgggccaggagcttcggagccatccgaggcttttttcgctcctctcactctcatgcacctagttaccctccccacagagtcttctcacggcgcggttttcggctaccattgcagtggtgtctgactacacccagtgcctctatcgttcccccctcagtctgttctcgcttcttggcaaacctgtccttggaaagccctctgctgactcctgttaccctgatcaaatgcatcctcctcaggaggctcgtgagccctttgcagggtggcccaagaggcatcacgccctgctctccagccactcttggggtcccctacagggccaggcgtcccacaccagcagcgggtgctggtcctgccacagtctgtgcgacacgtgaatgaaggctgtagacctgtggtctgcgggaggcaaattccaactccagctgtcaaacataaggggactggtaggctctccagggtggattgtctcacggcatccagaggcagggaccgaggcagggacctagccaggcctcgggaaggagctgcaaacccaggagctctggggtgtggcttcatctccctccctccctaccaccctacccccatctctccgtgttcttcagatgcctcattttcctgtcaggcacctggccagctctaggagctggaatcaggttggtgcctccttggtcagtgtccacccctagtgtcatccacagtgaccaacggaaggggtggccggtggtacaggacattggccatcttgggaaagatcacagagacaggaagggcctctccagctgagcagatgagaggttcttcagtggtctggacacatttgcccactcatggccgtccccctgccctgttgagagaaccgatgaggaaagggagccctgcatctgtcgccttccgactccgaccgcctgaggctgggctgccggcaagccgcggcagcatatgacagcacttgaaagaaagtccctggaaagaatgtggatcattgcagaactccctcaagaaagcgccagaggaggaccccattcagcaccccgcagaactcctcaaactcctgcgtccacactcccccagcgtggtggctgcttctatctccccaggcttagctggcctgggtcttgaaggcctctcctcctgctgtccccacgcagcatcctctctgccactgcacagctggatgcagtgaaggccaggcggctgtggctgcttgggcaacaggagctgcttgaccctgttctgctggccttgttggcctcactcccgtagagagccaaggttacccacgtctctgaagctaaggctttctttctaggcctgggggagtcacatcttgcattcgtactcactgagctccacgtctatggttagagaatttatcaacattttataatgcttttatcaattccatcatttgagggccctctggcaaggaacctgttagtacatggagtgcctggaatgttccagaaagctaacatgaacagctggcccttgctgtccttatacattgaggactccaaaggccactcaggatgacaggaaatgcaggctccaaaagattcggttcctttgtgaggccctcgggcagtggtcagacacgaaggaaataggaaatcacccccaaaccacacctctccctatgaggccacagctgccgatgcagccttgggagggggatggagggagagaggagggcatctgaatgtggacacaccctgctgtgagggctgtgggcggtcctgagactggagccagcccccaggctcagctcagctcggggacctcgtgcccgggctttcctggggaggaaggtgttggatctcctgcctctctgtattcattcacactttgggtttctctctcttccgcgcattctaacatctgcaggatttttttttttttttttttttttttgagacagagtctcgctctgttgcccaggctggagtggagtggtgcgatctcagctcgctgcaagctccgcctcctgggttcacgccattctcgtgcctcagcctccagagtaactgggaccacaggcgcccgccacgacgcccagctaattttttgtatttttagtagagacggggtttcaccgtgttagccaggatggtctcgatctcctgaccttgtgatccgcccgcctcggcctcccaaagtgctgggattacaggcgtgagccaccgggcctggcacatctgcaggatttatggatgaagggccacaaacccacatttggtctcattcaacagatgttgtgtcggcagggcgaggtgggactctgtctctgcccacgctacctgcccctggggttgtagttctaggaaagcaagtctcagactgagttttgatctggattaaattctgtcccaggtgcagatatttataggaaagcagggacaagagccctcaggcaaagctgggtatcctgcgatgggtgcctctgggagttcgcagataacaaggccttttcctggaggcaaagcagaagcgttctgtggcagaccagtcagctttctagcaggtcaggggcagggacatctaggcccaaggtgtcacaccgtgcctggctgctggctctcctcttgcaaggacacagctcttacaggacttcctagcccacccaagaacatctttccatcatcgaaaagttattgataagatttttccatcactgaaaagttattgataagtgccaccatgtgcatgagcagccctccaggtgctggcttgtgggccggtgtttgagaatcttgccagttgaatgtgggcatctgttgagggtttcccaaaggctaaccgttcgtgccagagggaggccgtggctcattcctagggccctgggtgagactggggctcatgcacacacaggtatcgatggcatgggctgtaacgagctgagtgcctgctgccctttcctagtggggggggtgggctcctggagaaagaggggaggctgctactctccagggccacagggagcccagaacgccacctcctggtgtcagcagcagcaaatccatataagtctgcagcaacttagcttttgcctcctcagaggaaataattcatccagggggcacaaggcagggtcagagactgaggtaagtttcagagcaagagtgaaagtttattaaaaaagtgttagagcaggaacgaaaggaaataaagtacacttggaggagggccaggtgggcatcttgagagagcaagtacacggttttgacctttgacttggggtttatatcttggcatgcttctgggggctgcgtcccttctcccctgattcttcccttggggtgggctgtccgcatgcgcagtggcctgccgacacttgggagggccgcgtgcacagtgtgcttactggagttgtgcggtgccctcttgaggcagtcttcccttaccagttcctaggggaaggtcacacgctggttaaactttgccactttgcctcgtagtgtgcatgcttgacctcactcaccaactcctgagattttttttaaattttttaatttaagttctagggtacatgtacacaacgtgcaggtttgttacataggtatgcatgtgccatgttggtttgctgcatccattaactcgtcatttacattaggtatttctcctaatgctatccttcccaccccacgacaggccctggtgtgtgatgttgcccgcactgtgtccaagtgttctcattgttcaattcccacctgtgccaactcctgggatcttatcgggaagtggctcatcatcagctttaggtgttttctatctattgggagcctgcctttctctggcaccagctgcaaccaataattattttagacagtttaacaacagcttgaccatcacctgatgatcacctgacatttctgttggggcgcgggcccatctcctgccccgctcatgtggggctcagtctgcccaacctttccccaagggcctgtctttacttcatttgtggtaagccccaagcagaatggactcttgttatgatcccaggaactgctcacggccacctctgtggatgaacacctagcggctgctctaaatacatgctgtgaaagttgtcagaatcaaaatggagtcactaatgttaagaaagccctgacaaagagttggtggggaaggccacgaagagaggacacttatgcttgcatgcctgataccagaaaggactacaaaaaccacagcccggcacagaggccatcacacccttacacaaaaaatatttctgcaaggacaactgcccagcaattgcctgtccaacctcagactggaatgacctttgttattgatgtttgtagccaaggagaattatctcaaaaccactgtgatcctgctcgcttttcctttaaagacctttgtcttccttgacctccctgaataggcatatggtttactatggcgtgtgtactctccttgtaatgttctgttctcaagctaacatctattcttctagagaacctctctcttaggctgacaacgctgtggatctgggctcccaggaactggggctgacatcagaggggtggaaagagaacagcagctctccctgaggggatgcttgccaaggataaggagacgatggttctctaaggattattttatattcatctaaaagggtatttttgttgttacccctagccttttttcccttttaattttctgatgaataatttatataaagaaaacccattctaagtgtgcaattctatgagttttgacaaatgtcttcacccatgcaaatcctgttacaacggagatatagaacatttccattacttaaaaacagccaggtgctgtagctcatgcctgta

SEQ ID NO: 4176 - DNA, 7857 bp, Homo sapiens
atttttaaaatttttaacttcaggggtccaagtgcagagccgcatgttgaagtgtgaggcgtgaaagggtatgtctgatatttgctttaaaatgctccagcaaagaaattaagggatggatgaagcaaaagagccaggtatggtggctcatgcctctaatctcagcactttgggaggccgaagcaggcagatcacctgaggtcaggagtttgagaccatcctgaccaacatggtgaaactcgtctctactacaaacataaaaaaattagctgggcgtggtaccacgcacctgtaatcccagctactcctctggaggctcagacaggagaactgcttgaaccgggaggcggaggttgcagtgagctgagatcgcaccaatccattccagcctgggcaacagagtgagactccatctcataaaaaaaaaaaaagtaaagaaaaaaaagaaaatgtctttatttcattttctttcctaaagaatatatttgctggataaaggattctgtgttgacagttttgttgctttttaaaagcactttataaatgttgctccatggtttctgatgagaaatctgccatcactgaaatctttggttctcctatatacaaagtgttgttttcttccagttgttttcaaagtattttctttacagttggtttcatcactttgattatgacgtgcctgggtgtggttttcctttttgggatttgctgtgccagcagaccggctttaaatagaatgctatgtaaatgtatgtgaatatttgttttttgccagatgtttggaagtttttagctattatttcttcagatatttttttcttccaattgttctttctgggctcctaagacatgaatattagactgtttcatattgtcccacagatccccaaaggtcttctcatttttttcacttttttctctgtcattcagactagataatttctgctcatgtatcttcaaatttactgactcttccctcagtcatcttcattgtgttgagaccttccagtaaattttgttattgtattttcagttctacaatttccacttgtttctttttatagcttctatgctgagacttttagctttccatttatttcaacagtgtttccctttatatatttcctttggagaaatgtcttctttgtgtagcatgattaaaataactagtttaacggccaggtgtgctggcttatgcctgtaatcccagcactttgggaggcccaggcaggcagatcacttgaggtcaggagtttgagaccagcctggccaacgtggtgaaactctgtctctattaaaaatacaaaaaattatctaggcgtggtggtacacacctgtagtcacagctactcaggaggctgagacaggagaatcacttgcaccctgggggtggaggttgcagtgagccaagattgtatcactgcactctagcctgggtgatagagactgtctcaaaaataaataaaaaaaataaaataactagttttaagtctttttctgataattctgacatttgggtaaccttagagttggctcttgttcattgtcttttccctagagagttgcttaggtttcacaagttctttgtccaatcattttgggttgtttctgggatatatttggaatattatgatattctctatcctgtttaaatcttcataagaatgtttttgttttgttttgttttagcagaccatcaattcagttaagtttcagagcacacatcctggccactttttttggtggctgtggttccaatgttagttttcactgcctttgttaagctgttctttgccccagttgtgcaccatctagtggccaatctgaaacttggacagtggcctacactgtaattcagtgttcagaacctttgctcagctgcttctggttagtttcacacatacacagcttgtgagatgatcccaggattttattgacagatttaagggttccttttcttcagttccctcctatttgtgatcttacctatactctggtttctagaaccccattcttggtttttggctagaaagtcagggcgttagcctccccattgccagtgttctgccctgcaatgtctgccactagtgcaccagggggaagagaagagtgatacctctttactgctgcgggattgatgtagagcaaggaaagtccagaaggttccaagtcattacccatggttctcctggtggggcggtgggtcttactgcatctttcctgaggctctcttagaatactgcaattaaattaaaaagggttttgtcccatagcctccaacctcctttctggtcctctgactagaaacagcaaattgttccttggactatttttctctctgtcagctagcatttccagttttcctgttaaatgtcttttttctttttccttttttttgagacaaggttttgctctgttgcacgatcacagctcactggagccttaacctcctgggctcaagtgatcctcccacctcagcccccgtgaagctgggaccacaagtatgagccaccacacctggcaaaatttttttaattttgcagagacagtgtctccctgtgttgctcactctggtctcaacctgagctcgagtgatcctcctgccttggcctcccaaagtgctcgattacaggtgtgagccactgcacctggccttattatgtgtctatgtgtggattttctagtttattctgtttgggatttgtctggcttctagaatgtgtggggtcatgtctttcatcagtttttaaaattctgcattctatctaagtatttgctctgtcctattcttgcctctcctctcacagctaatgaagcacttaggatttttcactgtattctctacaggtcttctgtttttttttccagctgtttctcccatggtgcactgtgaatagtttctcctgagttatcttccagtttataaactaccccaattggctacattctattacatctatttactgagttttaaagtgcagtttttatgtatattcttgtaatgtttatattcagttcttttccagattagctccacaactttttatcgtatagtttcccatttcctgcaagtacattcacacaccttatttccttaaacaaagaaaacaaatctaatacctatatctgtgagtttgttttcattgcttcaagtaattcttgcctctggaatctagtttccttatatgactactttttactatgtgttactagacatatttgaaaagtaatttgaggcctacaatgaaattacttttccatgaaaagtatttacattttattttctctgtcacctggaggcattactagtgtgggaacaccttaaaggaagctcagtgcttaagattctttagatcactggggcaattctaaacttgcctgttcttttacattggttcttccacctctgattcattatcatcctaaaggtgaaagtatttgggagtctcagcctattgtgtggagggtctcctgttaggttcatcaccttatatgggccctgaactttaatttctgtccccctcactcataaggttgtcagagtaagggtacatgcttgcttctcttattctctttacttttggacttggcattccttattgtctggaaaatctctttgatgttttaagattattcttgtattttaatcaggaattgttttcaacaggaacatgatgtaaatatcctagcatgcaattttcagaaacaagtagtttcccacaattgaatctttgctcctacagggccaaatcctactctttctcttggcatgctctgcacttaagcgcatactacttgtggcatggaatccataaatgttgataaagaactacgcctaattctgtcagaacaattaatcatttttagaaatttttgcttagaaacctggtaaagtgctctgcatgtagcaagtatacgaacacacaaagtttgttgaatagctgcataaaacaaatgggctagattttacttcatatttcaaaattcagagaaagagagtagtattaaaagacataagccaaaaatagatcattgcagactgagtacaaagaaccattctatttcttctcttaaaaaattaaaatttcaaattaagtaccaatgaccaaataagtaacaaacacattcagaaacatactatatgtctacaaagaatacttcaaaatgtgcctccaaacttcaggcacataattccaatttttattgaatatagagattttatgaaaacaaatccaaagctgtcccatcatggaacagccctctaccatttggttattttaagactgttcaattacttacatggcagaatacatacactatatttagaaaacataaattgggtttgatatgcaattgttttcatcttacaccatttcaataaatttcacaaattataacaggttgccattttattgaatatctgcgacactttacattgttcaggaagtagctacttccagaaggctgatattctcctccaaattgtctttggctaagtactacagatgtgattcagtccaaactatatgcccaaactgattaaaattctcagtctctcctagcttgagacctcagatcctgagttataactttgacttgatcttcaagttgagatgcttcataaatatttttcttaaaacagggctatttaacataatttctttttcttgaaatatatgagtgtttttgatacaaaaacatatattacacatgagaatgtttaaagcatcaaaataatgattaaattttttacataacttaaatgacaggactacaatatgccccccacttttttgctgtttgaagtaaagaggaaagctctgtaacaatttcaaatacataggatttaacttatgttaatatcctgttataaaaaataactaccatataaagaatttaaaatatgcaaaagtaattagttcatttaaatttatacttatacactggtgtcaatgaaaatatgcgaagttgccaagaaatttctaaggattaaagtggaagtaaaaaaacctgtttcaggcttcatttattgctacataatgactacttcaagggtcatctggcccgtcgtcagtcactcttagaagtggtaaatacagtggtatagtttggaaggaaaggaggaaaaaaataatgcattgtgatacaaaaatattacctacatataaattattaaagatttataaaacattcagaatatgttcttgctataaaaacaatatacttaaatatagaagcaaaaagtcctgaagcacccgcaattattttaatatccatttaatcagggaaaactatatatgtggatatataatacatacatatgtaataatttgagaagaaaaaaggcaaaattctgattataatccaaaaagagtttatctaattatggaggtaggtctccactccaattatacaaataagttatcagttttattcaaagaattataagtctaagacctcaaaactggtttttgtgccactgaaatacaatttgacagactttagaaaccagtattctaactggcatatacacaaagcagatatttccttcataaggttacatctgaaaagagccttcattaaaatcattattggcataaagaggtatacctaagtgcagatactttggcttagcatttaaataacacagtaaatgctataaatttcttaaaagaaatccttgtctttttagtacttaaattaattgtaaagctacagaaagtatggatctcttaaatttttagatatttaaatattgtgctaatgatttgaaaagatcattcctgcctaaagagcaaagcttatgtgtttcaaaaatcagacatatttatacttttagtgtttgtggcatttcagctttagtgctggagttagttttaacaaattaggttgcaatatgtaatatggcacattctttcactaaaaaagatgttctataatgaaaaacactaattctatttctaatggtaaactagagttggaggtcccaccatggatcacaggtatcagagcactatcaagatcatttagataatgctgaggcagaagttggccttcagatcctgcctgaaattcaacctagaaaaaaaaaaaattcttgataagaaaatgagcaatcttgtttaactcggaatgtgaatataaaataagtgaaatattttaaaatacagttcaagcatgttaaataaaatatttgatatatttataaaaaaattctacattctcctgtatcttttatctgtctactacataaattataattgttcctcctcatatatcataaagataaaattgccactatgtcatactttacgtttcctctaaatgaacacataaacaaattagagggatgaggctttgaataactgccgacattacttaaattaaaaaccccatggtattaaaaaaatctacttgaaatatttcaaatttgttgttgcaataatatttaatattagactctaacattggtgcaaattacattttaatacaattggctaaaaaaatttacagtgcttactccaataacaaatagtgagtgcttccttgaaaagaggacttttaatagtgagataaaaacaaaaccccttttccagtaagaactatgagtaaaatatatcctggctggagaaaagcaaaccctcagcatatgaactcacccacgtttagcttaaccattctaatgaattctctgatttgaaaatctatattggatgttggaaagttacctggatgtcagaaagagaactttcagttcaaagaaaaacaaattgtttttacatgcaagatgatcatcactccttgttaagagaaatacaaattaaaataatactggggccaggcgtggtggctcatgcctacaatctcaacactttgggaggccaaggcaggagaactgcttgagcccaggagttcaagaccaacctgggaaacagagtgaaaccccatctatttaacaagtaataataatattaataataatgtggtattatttttcacctatcaaattgtccaagttcaaaagtttgattatatacttctttgataaggatatgggggaggccaggtgcggtggctcacacctataatcccagcactttgggaggccacagatcacatgaggtcaagagttcaagaccggtccagccaacatggtgaaaccctgtgtctgctaaaaatacaaatattagcaaggtgtggtggcacatgcctgtagtcccagctactcgggaggctgaggaaggagaattgcttgaacccagggggcagaggctgcagtgagccaaaatcgtgccactgcactccagcctgggtggcagagtgagactgtctcaaaaaaaggatgtgagggaaagagctctcacaaattgctggaagaaataaatataaattgacataacctctatttgggataatatggtaatatctattgcgtatatactcaggcctggcaattctactcagaatttttcttatagatatacttacgcttatgtaaaagcaaaatattgtggacaacctgaatgtctatcaacatatatcaaatatgcatgaataattagttagataaattatggtacatttatataatcaactactatgccgctgttaaaaaagaatgtctgctagtattaatatctttaagatatattaaagaagcaaggtaaaaaatgtgtaaaagagggaagatgaaaaaggaggacacacacttatttgcttgtagatgcataaaatcacaaagaatacgtaagaaatgagtaacactgattgcttggccggagagggaggataaagaaaagtatgaaggtgaactgatgggttggatgtcaacagtaggaaagatatttccaaggc

SEQ ID NO: 4177 - DNA, 3626 bp, Homo sapiens
atcaacacaagtactactcatgcacaaaacatgcatatattggtatacaaaaagcaattttacacaatactgtttaccaaaaattttttcttaaaaaacagcccttccacataggatcaaaggtccaatctggactggattgcactaatatgttcaggtcaacgcttcggtggcatagcgctcagtgagcaattctgggattggagtcatgcccaagggttacttcattaatagtgaatgtctctgtgcccaaggaccaaaattttatcccaaaactaaatcctccaaggaatgaaaggttggactggctacaaattagggagggaaaagaaggcatctaaatgttggataaacggccctagaaggggttattaggaacagggcctaggcaccaagtgtggcaaaagtttttgtgaatccttttaaggtccctatcgaggctgctatctctggatttaaggtttggcctccaagtcatgagtctagtaacagttctgagaataaaaccgaatggggatacatctgagaaatgtagactacataaaaaaactatagaatacaatgactgcccctcatacctacttcacactattgtatgtggtgcccctcaacaggaaaaccctcatggagacactgccctgaagactcaaggaacaaatataaatccaaaaattccatccacctgaccttgggatcaaaagatcttatcccaataaaacttgaacatcaaaacctgtaccttgccggatgctcagaaagtttaaaataaaaaacagctggtgccacaaaactcactatcaccaccattaaaacctcaatatgtacttctaactagcaaaacattctttaccttccattaaaggcactagcatccatacgtgaagatgaaacaataatttaccttggttttatatttttttaaaaagcattccattaaagtattatacaaaaatgaaaacaccacctttttaattttggcaactagggagaagaaaaaaaaacacacaaactttctacaccaatgatgtcactcaaaccgtcgtcatcagtttcaaagagccagaccgaaagcggaggatcttcttcttgaggttatgtgaggccttaattttgacaaaggtttttgcggggtggttgtgaaggtctggggccgttaccgtttgaatgggcagagtctggacaaactgggaccaaattaagcccccgctttcttcagagtcgctggtggttgtgctctcccccacgaactcgccctcgctcacactcgactcgctgtccccgaagcagttggtggtgtaattgctctgctcgtcctcactggtgtccaccacggtggagtggaacagggactcgcactcggccgagtactcggagtcgctagccacgtaggcgtaggggctggcgtagggcagaggcacaggcgcggggtacagccccacattctcccggcgaccgcgccgggccctcctcagggcctcttcgtaggaaatctcggccgaggacttccaccgccggtagtcagttcgcttgtgcttaggtttggccaccaccgcctcccgtccgtggccatgcgccctgctccccgccctgtggcccccgcccgcgggcctgccgggaacaccagcctcgggcccgcccccactcttcctccccttggaggaggctttcttgagtttcttatttgtatccaagtcatctgggaagcgacacttcttgctcccggcccgcgttttctccctgacggtgggcaagccgttctccagcccctggagggctgggccgcggtgcttcaggctggagttcttcacgacgcccatgttcctgtggccccggtggagcctgacactgggctgctgccccgggataaactgggccttgaccaggtgcgcttcctccaggctttgggaagagccctcgctcttgaaatccaaggcaggcctctcttccacggggaaagctgtagacagcaggggaggagtggccggggggacgccctgcaggctgtttttctgtgacatctttttcaggggctgtacaactttgttctcctgcggcggggcagggcctctgctaggactctcttttggagaggcccctgagagctgagcgctttccttaggggactcccctgtcccaatggcggaacaccgagcatgttcttgcgaggctggcttggccgtttttggcaggtgcttactctgaaggtcggaggcagcgcctgaggggcagccctctggcaggggcaccctcttgctttcggcttgttcggcctttgattctttcgaccactgcttcggtggggagaatgtcccattgttcagagaaggtatcccgccagagggcagacacgcctgtttcgaattcttaaggttcacactgttgccctgtgagacaccgcccggggctctgacacaaacgctcccgttcctcagaagccctttcgtggggtcagcgttcacgctggttcttggtttgttggtccttacagggtgtgtttttttctggaccaggctcagaatgtagccatccattttcttgctggatgaaggatgggaagcagaccacagactgcttggggacggtattccggaagcagttgaaagtgatcgcctactgctcccttctgttgccaacggaatctcacttccccctactgttttgatttttctttccctttctttttaaagcaggtgctggtacttcttcctccactagtgctatttcattatctcctttctaatgttgttcagccctagttggttcttttgctttccctggacacgcctgtctgctcagaaaaactgttaattgacactcagaaagtgtaccactaacgatggggtggacctgctgcctggatgatctggagagtaagataaagttgccagcatgaaaaagagtcttggctgaatatattacagtggtgttaacttatgcttgaagatctttcctgggcagagccagaacatgtccctcatatcacacagtctgatgctttgtccttaggcagaacagctcctaacagcacccccaccaaagtctgagcatcattctacaaatgccttgtccagcggtgaacattctattgcagccaagcaaagtaaggggcatcagttgcacattttgccatcaagcaaagcaacaaaatgatgccttgcagcttttatggccaaacaaacacaaatgatgtaattgggaaaagctgtctccgaataggaggaaaagagtaaagggcaatcctttgagctggagagatgaccaccattcgagggtctgggatcaaagccccagccagacatcaaagcccatttgagtctaatgccaaaaaagccacagtgaattaaacttcatatataaactaattatagcttgaccccacaatcaggcttcagtgagcacacaggggaaagaaagcagacattgaaacaaaagatcaagaaaaaagaagcgtggtagcaaaatggggcaacatcatggccctgaaaattttaaacatcttttgagggcagaagggaataggggaatagcagaagaaacagcaaatgtttgacaatgctggtcttgtttgaaaggctatgaaacaactccttccatcctctctggtgcacaaccaaacactaccaaat

SEQ ID NO: 4178 - DNA, 5939 bp, Homo sapiens
cctccccgcgcctgaccaggagcgcgcccctgactttacggccacgcccggccgagagcgcgtgccagcaaggctcgctctctctctctctctctctctctctcttcccctctcctctctctctctctctctccctctcctctctctctctctctctctctctgtcacacacacacacacacacagccaccggaggcgtcctgagcagcagcccactccctgtcccctgcaggcgtccgacccgaagtccacgcgccggaactcggaccaggagccagaggaccccagcgcagaatccgcggagacgcacggcttcgtcgaccacgctcccaggtggcgttccagcccagatccggccacgaagacaccggcgacctcggcctgggtttcctgttcgatgagctccagaaagaagacgatgcgaaggatatagagacttcagtgactgaagctggaggagacgatgagaagaaaatacggaccaaacccgagcagggagcaggagcaggaaaagaaagtcacgtgtacgcgggagctgcggaccccatgatccacgagaaccagaagggcggtggtggccaccaggagccctggcagcagcagcctgaggagttggcccaggactcctccgctgaggatccgcaaccccaagatcaggagcgtctattcagccccagcacgttcggcgggttgcacctgaaggagctagacagcattttctgaccttctcaatatccggacatgttcgcttgaaagcaactggcaatatgcatggatgtgagtgaagctgaagtggaagccagtaagcctgatgaaagcaattggtcagagtagccactctgaaacctgcctcagaccttggatactttgtcctacacattctccaattggcctggtaacttcaccggatgaagaaatctaggttgttggtgtttttctttgaacacctcttcttgctcttcgatagagacagtgttgcccaagttggtcttgaactcctggacccaaccaatcctcctgcctcagcctcctgagtaccttggattacaggcgtgagacatgtgtacttgtaccagtttaggggatacagaataaatttggttgcatgtatttaatgcatagtgtcaagtcagggtattagggtatccctcacccaagtatatttttgttaagtatattcaccctactctgctatcagacattgaatttattccttgtatcttaccgtatgtttgcacccttccaccgacttctcttcatcatcccccctccctccactctttccattctatgttatctatttttccactctctacctccatgtgtccacattttttagctcccacatataagtgagatcatgtgatacttgtgtttttgtgcctggtttatttcccttaaggtaatgacctgcagttccatccatgttgctgcaaatggcatgatttcattcttttttgtggttgaatactattccactgtggaatatatgtaccacattttctttatccattcagctgttgatgagcacaagttgcttccgtatctttgctattgtgaatagtgctgcaataaacatgcgaatgaaggtatccctttgatatattgatttctttccctttgggtagacccagtgttgggattgctggatcgaatggtaattctatttttagttttttgagaaatcactacactgtcattcatagtggctatactagtttacatgcccaccaacactgtataagacttaccttttttctgcatactcagtaacatctgttatttattgtcattttaataatagctattctgagtggcataagataatatctcattgtggttttcatttgcatttctctgatgattaacgaattcgagcagtttttcgtataccttttgtatgtcttcttttgagaaatgtctattcatgtttttggcccacctttaaatgagattatttgtgggtttttccacttgagttgtttgagttccctgtatattctgcatattagtcccctgtcagatgaacagtttgcacatattttctctcattcaacaggttgtctcttcagtccgttgattatttcttttgctgtgcagaagctttttagtttaatgaagtcccatttgtgtattttagtttgcctgaaacgcacagtcttatatactagatccttattctttggtggactgttgctttagaattatagaaaagtagtgatacctaaaaaagtaggtatctagggataactggaggtaactagaatgactagtatgagccaggaagctaaaaagcattcttcccaattctgacatcacgtttcttgttggcataatgtgttaatactacatgtaagtcatggtagctagggaaaaagcaaactgatagcttgtgaaaagtggaataattatttgaatgcaggaagatgagaaacattttctcaagtctactttctaatttcttgttggaataaggagttaatactacagatatctgggagtacctagacataagtacagttaaatagagaagtacatagtagcccaaaattgaaaaaacacatttttgtcaaagctaatttcttactatagtggaataatgagtgagtagtgcaggtatctagtgttacataggtaatcagttaaataaaggtgaagagaaataaccagaatgaatatacgacaccaggaagttagtaaagacttgtttttaattctttcatttattttaaaataacaatgaggtaatattattgatacatagtgctattgtggcaggccaattctccctgacaatcacacacaggcctgcataacacttcagttacataaatttccacagagctgccttaacattgagcaaatagttaaatctagggaaatcggtgtccagacatcaaagctagaaatgaaacacatggtcagtaggagccttgcataagcttgtccctaacctggagcaagtcaaaataatgcagacagccttaaattcctagtgccaggatctgtcttgggtcgatgaaatctgagacgagtcaaggtaacagaggcagctgttcaaacagatttattggagagtctaagacagtactccgggccaagttataaaggagataagacagaaataatcactccagtaccacaatagacatgccttgaaggcactgggcccctcacagcatactcggacttagcaagcatttttttgcctctgacctagttgaaacaaaattagttacctacagacttaggcaaatgctatactgcacataggcacataaccccaacctatgtaagcactaagaaaattttaacgctttgagttggtctggtggaatatctctgaccttctccctgtatccggttacagcaataaattcccttctttcctaatttgtctgtttgtccttattgggccacaagaaaacgcagccaaacccggctcgattctgggaataatatctatttatttatttaattagagataattagatatacctagaacgataatttgaaggcaggaaaatgaaaaaacattttttctcaacactaaatttaatatttgcaacatgtattagtgctatagacaaatactggtagcgaggtaactactttactagggatagccagaaataaccagaaaatctgcttgaatctggaagttgaaaaactgtttcataccaccctaaatcttggtttgcttgttggttttgaaacagagtctcactccgttgcccaggctggagtgtactggcaacatctcggctcactgccacctccactccccatgctcaagccatcctcctacctcagtctcttgaggagctgggatgacaggcaggagccactatgcccggcgaattaaaaaaaatttttttatagagacgaggtctcactgtttgcccaatgctggtctcgaactcctgggctcaagcaattcacctgccttggcctccataagtgctgggattaccaccctaaatcttaatctcctgtttgaataaggatttgttactatggataattagtagtaacagcttagctagttaactacagataactggctgaagctaaaaagtggaaccataatctactcagcatgaaattcttaattctggttgaaataatgtatcagtagtatagttaattagagggaactctaatcaagaattcccagttgtgaggattgtggtttccaccttctagctccaaccagttctctgtagttaactagtaatcttgtgaccagtagttaaccatagtactaaatatgtattcctatatgagataagaattaggggtgtgacgaatggtttttcaacttctgaattcaaatagatttccggattatctctaactatccctactaaactagttacatactgtggtggttaattttatgtgtctacttgactgagttaagtcgttacctctaaataaatagataccactacttatcaataatactaacactctattacaaaaaaataaaagtcagatttccaaataatgtttgtattcttgtttgtgatacttacttcttgttttatggtattgctcattattaatttatttttatgttaataatattaattttcataaataatcttttttaattctttgttacattcctgctgtcaaacgtttactctggttgtgtccaattacctaggtaccactgcataaccataccattcactcattattccacaagtaaaaagaatttagatttgaaaaaatgtgtttccagggtctgggtttctacaagtttttctgcttctctctacttatttctaattgtatatttcacaagggatacctagttatttctaatactaacccatcattccaacaagaaatgaggtaattctctggattccactaattattctacatatcacaagtgatctccagtttactcattccctaggtaccaccagttatttgcagtactaacacatcatgccaacatgaaataacattttagaatcaagaagaatatttttcttcttacactagatactttagttatctgcagatgtctccacatatctagtttctcaggtaccaatacttagctatagttctaaggcaaaattccaacaaggaacgagaacatagtactgcatgactttctttatcaccttccaggattacaatacttattttaattatctccagttattttgagttaaatctatttcactactgacataggtaccaccagatatctgtagtataaactcattatttcacaaaaaaataagaatttgagtctgtgaagactgtgctttcaaacatcactgcactccagtgtaggcaacacagcgaggtgctgtctcaaaaaaagaaagaaaaagaaggaaaggaaggaagaaagggaagaaaggaaagaaagaaagaaaggacagaaaagaaggaagaaggaaagaaaaaggaaggaaaataaaaagaagagaaagaaggaaggaaaaaagaagaaaaagaaagaaaagaaagaaggtatttatgagaatattttctcacctccttatctttgacgtaggacaggcaagctgccaaattgggattttgcccggatggaggatgagcaggtagtgagatagagcaacttttattgaactggtattgcttcttgcagaacagcactaacccataggcagtgcacccagagccagcagctgatgggctgttggcagctgtatttataccacttttaattatgtgctaatcaacaggcaggttattgagaactttcaagaaaacgagtgaggagtatccagaaaattcaagatacgactatagtgttgagaagaatattgtttcaacttcctggattgatcaacttttcttcagcagagaatttagtgttgaaaagaacgtgactggcaacttcctgccttcaactagctattctggctatttctggttatttctag

SEQ ID NO: 4179 - DNA, 6479 bp, Homo sapiens
gaggttcgtttacgcgccgcttcgccgtgcaggtggtggcgaagcgctcctccgaaaggtttcggaagctggtggtagctctgaagataacgctgcgttagggcatactgcggcggaggatggaactccgattgaaagcagttgctggagtggagcacgaatttcaacaagccgcatgttgaagtgtgaggcgtgaaagggtatgtctgatatttgctttaaaatgctccagcaaagaaattaagggatggatgaagcaaaagaggtaagtcttgatagtgttgactcagaggattgttgtaggctgggtatatagattttcatcctactatttcctttacttctgagtgtttggaaattttatggtaaaaataagtctaattacttttttggcacaaaaaaggttttgtaagttaagggtacatgctgcactggggaaagaatataacgattagaatgtgagacacaggccccaacttgagtctggggctgcttttggtgacatctaaacatgaataaaggccaggcatggtggctcacacatgtaatcccagtactttgggaggctgaggcaggaggagaccaggactttgagaccagcctggacaacatagtgagacccatctctacgaaaaaataaaaaacaagccaggtgtgtcggcatgtgcctgtagtatcagctaatcaggaggctaaggtgggaggattgcttgagcccaggaactcaaggctgcagtgagccatgatcacaccactgcattccacctgggccgcagagtgagactctgtctcaaaatcaaaacaaagcactgcatgaatacagcttacctcattttcagagtcctaatagctagaaagttttccctcaaattccaatttagtttctagctgtgtgactttggacagattactctctctctgaacttggtatctagtctatgaaatgcaataataaatcacaggggaactgggtgcagtggcacgcacttgtaggctcagctacccaggaggctgaggcaggaggatgggttaagagcctaagttcaaggctgtagtgtgccatgactgtgcctgtgaatagccactgcaccctaggcctgggcaatacaatgagaccctgtctcataaataaataaataaataaataaatttaaaaataaattacagggtaatattccttgttctgaagtttgctttgtctgatagcaaaataaccactccagctttgtccttttcttcttctttttagtgtttgcatggaatatctttttccatccttttactttttaacctgcatgtaccattgtatcataagtggcttgtatagatagcatataaattaggttttaaaaaaatccatctggccaggcatggtggctcatgcctgtaattccagtcctttgggaggccaagacaggcagatcagttgaggacaggagttcaagactatcctggacaaaatggtgaaactccatctctaataaaaacaaagaaaaaattagccagatgtggacatgcctgtaatcccagctactcaggaggctgaagcaggagaatcacttgaacctgggaggtggaggttacagtgagccgggattgtgccactgcactccagcctgggtgacagaataaatgagacttgatccaaaaaaaaaaaaaaaaatcaattgccatatttagaccatttacatttaatgtaattgttatttatttttatttttagggacagggtcttgctcagtggcccaggctggagtacagcggtatgatcacagctcactgcagcctcaaactactgggctcaaatgatctcccacctcagcctcctgagtagccaggactataggcatgcactaccatggttggctaattcttttaagttttatgtagatacggggcctcactacattgcccagtctgatcttgaactcctggcctcaagtgatcttcctgcttcagcctcctaaagtgttgggattatgggcattagccaccacacctggcctagtgtaatttttgatacagctggatttaggtctaccattttagcattaatttttcttgttgatcccttatttcttttacacttgttttccttgctggctttattttgaattatttaaaattccactttatatgtcggctttttaaacatatctccttgcatagttttttaaaatggttgctctagagatgatcattacataccaaactttttgtaacctactataatgttttaccactttaagtgaaatttagaaaacttaccatataggttctgtcactgtccccttggttagtatgcagttttcatctgtattacatctatatgcattgaaaatcccaaaagatgatgttacaatttttttatttcagcagttacatatattttaacaaacatgtaagtctatttggtttatccagagatttgccattttggttgctcttccttctttgcaatcattttccttccccatgaacttcctttaccatttctgttaaaggaggactactagcaatgaattattttagctttccttcttctgacaatgtctttatttcagccaggtatggtggctcatgcctctaatctcagcactttgggaggccgaagcaggcagatcacctgaggtcaggagtttgagaccatcctgaccaacatggtgaaactcgtctctactacaaacataaaaaaattagctgggcgtggtaccacgcacctgtaatcccagctactcctctggaggctcagacaggagaactgcttgaaccgggaggcggaggttgcagtgagctgagatcgcaccaatccattccagcctgggcaacagagtgagactccatctcataaaaaaaaaaaaagtaaagaaaaaaaagaaaatgtctttatttcattttctttcctaaagaatatatttgctggataaaggattctgtgttgacagttttgttgctttttaaaagcactttataaatgttgctccatggtttctgatgagaaatctgccatcactgaaatctttggttctcctatatacaaagtgttgttttcttccagttgttttcaaagtattttctttacagttggtttcatcactttgattatgacgtgcctgggtgtggttttcctttttgggatttgctgtgccagcagaccggctttaaatagaatgctatgtaaatgtatgtgaatatttgttttttgccagatgtttggaagtttttagctattatttcttcagatatttttttcttccaattgttctttctgggctcctaagacatgaatattagactgtttcatattgtcccacagatccccaaaggtcttctcatttttttcacttttttctctgtcattcagactagataatttctgctcatgtatcttcaaatttactgactcttccctcagtcatcttcattgtgttgagaccttccagtaaattttgttattgtattttcagttctacaatttccacttgtttctttttatagcttctatgctgagacttttagctttccatttatttcaacagtgtttccctttatatatttcctttggagaaatgtcttctttgtgtagcatgattaaaataactagtttaacggccaggtgtgctggcttatgcctgtaatcccagcactttgggaggcccaggcaggcagatcacttgaggtcaggagtttgagaccagcctggccaacgtggtgaaactctgtctctattaaaaatacaaaaaattatctaggcgtggtggtacacacctgtagtcacagctactcaggaggctgagacaggagaatcacttgcaccctgggggtggaggttgcagtgagccaagattgtatcactgcactctagcctgggtgatagagactgtctcaaaaataaataaaaaaaataaaataactagttttaagtctttttctgataattctgacatttgggtaaccttagagttggctcttgttcattgtcttttccctagagagttgcttaggtttcacaagttctttgtccaatcattttgggttgtttctgggatatatttggaatattatgatattctctatcctgtttaaatcttcataagaatgtttttgttttgttttgttttagcagaccatcaattcagttaagtttcagagcacacatcctggccactttttttggtggctgtggttccaatgttagttttcactgcctttgttaagctgttctttgccccagttgtgcaccatctagtggccaatctgaaacttggacagtggcctacactgtaattcagtgttcagaacctttgctcagctgcttctggttagtttcacacatacacagcttgtgagatgatcccaggattttattgacagatttaagggttccttttcttcagttccctcctatttgtgatcttacctatactctggtttctagaaccccattcttggtttttggctagaaagtcagggcgttagcctccccattgccagtgttctgccctgcaatgtctgccactagtgcaccagggggaagagaagagtgatacctctttactgctgcgggattgatgtagagcaaggaaagtccagaaggttccaagtcattacccatggttctcctggtggggcggtgggtcttactgcatctttcctgaggctctcttagaatactgcaattaaattaaaaagggttttgtcccatagcctccaacctcctttctggtcctctgactagaaacagcaaattgttccttggactatttttctctctgtcagctagcatttccagttttcctgttaaatgtcttttttctttttccttttttttgagacaaggttttgctctgttgcacgatcacagctcactggagccttaacctcctgggctcaagtgatcctcccacctcagcccccgtgaagctgggaccacaagtatgagccaccacacctggcaaaatttttttaattttgcagagacagtgtctccctgtgttgctcactctggtctcaacctgagctcgagtgatcctcctgccttggcctcccaaagtgctcgattacaggtgtgagccactgcacctggccttattatgtgtctatgtgtggattttctagtttattctgtttgggatttgtctggcttctagaatgtgtggggtcatgtctttcatcagtttttaaaattctgcattctatctaagtatttgctctgtcctattcttgcctctcctctcacagctaatgaagcacttaggatttttcactgtattctctacaggtcttctgtttttttttccagctgtttctcccatggtgcactgtgaatagtttctcctgagttatcttccagtttataaactaccccaattggctacattctattacatctatttactgagttttaaagtgcagtttttatgtatattcttgtaatgtttatattcagttcttttccagattagctccacaactttttatcgtatagtttcccatttcctgcaagtacattcacacaccttatttccttaaacaaagaaaacaaatctaatacctatatctgtgagtttgttttcattgcttcaagtaattcttgcctctggaatctagtttccttatatgactactttttactatgtgttactagacatatttgaaaagtaatttgaggcctacaatgaaattacttttccatgaaaagtatttacattttattttctctgtcacctggaggcattactagtgtgggaacaccttaaaggaagctcagtgcttaagattctttagatcactggggcaattctaaacttgcctgttcttttacattggttcttccacctctgattcattatcatcctaaaggtgaaagtatttgggagtctcagcctattgtgtggagggtctcctgttaggttcatcaccttatatgggccctgaactttaatttctgtccccctcactcataaggttgtcagagtaagggtacatgcttgcttctcttattctctttacttttggacttggcattccttattgtctggaaaatctctttgatgttttaagattattcttgtattttaatcaggaattgttttcaacaggaacatgatgtaaatatcctagcatgcaattttcagaaacaagtagtttcccacaattgaatctttgctcctacagggccaaatcctactctttctcttggcatgctctgcacttaagcgcatactacttgtggcatggaatccataaatgttgataaagaactacgcctaattctgtcagaacaattaatcatttttagaaatttttgcttagaaacctggtaaagtgctctgcatgtagcaagtatacgaacacacaaagtttgttgaatagctgcataaaacaaatgggctagattttacttcatatttcaaaattcagagaaagagagtagtattaaaagacataagccaaaaatagatcattgcagactgagt

SEQ ID NO: 4180 - DNA, 7869 bp, Homo sapiens
agcaaatagaaatggaaatccaaggctcaagaggcatctgtaagtttgagaaagtttgctatttcatttaaacagcaaattaaatatattttgtaaggttagcagaaacagctctttttaaaatgatattcataatttctattctaagaaaagaaatcactagcgagtgtgtatacacacacagaggaatgaggaagcagtgaaattaaaattttttaaaaaaccaacctttacatcaattggcgtatctcatgcagagaacctttaaattgaacctaggcactcccaaaaagaaaatcaatcaagagtggtatcttcttataggttaaaaagacattcaatattcatagaattgcttatctgcagaactttatttatttatttttttgagacagagtctcgctctgtcacccgggctgtagcgcagtggtgcaatctccgctcactgcaggctccgcctcccgggttcacgccactctcacgcctcagcctcccgagtagctgggactgcagtgccggccaccatgcccggctaattttttgtttttgtatttttagtagagacagggtttcaccgtgttagccaggatggtctcgatctcctgacttcgtgatctccccgcctcggcctcccaaagtgctgggattacaggcgtgagccaccgcgcccggccaaaactttaaagataagtatactcgttattagttatcccacaagttcaggaatactttgagaatatattccaatttttgcaattcttatttcttattaatttacgaggggaagttaaacctttttagcagaagtggtagttccagaaacatctggtgtttataaacagcagcttgtgggtggagactatgtctccctaatttgtcagcagttcaatgctgcattgatagacaaattgaagtggcctaaaagctagaactttgagaattatgttagcctagttgagctttggatccattgttctggagtattgattttcttttcccagggatcttaatttagtttagttttagttttcaataaattatttgttcattcatataatggtgctttgagagaggatttgatataacgtttcaggatctattcaaaggctcagaccgagcaggaacaaaacactgctacaaggacttcctctagacacacctcttttcatctctgcagcaattcacttttcacactatggactggactccctttgagtaaccaataaatcacaaaaggtgtgtgtaaactgtttttgcttcagtcatacttgactgttttattaggcatagatccaagtgtaggctacaatcatgattttttttttttttgagatggagtgttgctcttgttgcccaagctggagtgcaatggtgcaatctcggctcactgcaacctcgacatccgtctcctggtttcaagcgattctcctgtagctgggattacaggtgcccgccaccaagcccagctaatttttgtacttttagtagatacggggttttgccctgttggtcaggctgatcttgaactcctgacctcaggtgatccgcccacctcggcctcccaaagtgctgggattacaggcatgagccactgcacccagccttacaatcatgattttttaaatcttaaatttcatctcctaatttaagatttcatctcctttgaataaaataaaatctcagctactggagtacattaattaatgcaccacttcatacacataacagtttcccatgtcagtctgagatctgacttacattttccttcaaaacactttccatttttttcaaaatttaattatctatggagcagctaaatctctctgctcaaaagaccattagtagaatgtcaatgtaatttacagaggtgttaacaagatagcataccttacactctggtttcagattgaatttaaatatttattgaatttaaatattggttttattaattaccagctgtaggactgtgcctcagtttcctctttttttttggggagacagggtctcactccgtcacccaggctggagtacagtggtgctatcatcgctcactgcagcctctacctcctgagctcaggcaatcctcccactcagcctcctgagcagctgggactacaggcacgcaccaccatgccctgctaatttcgtttatttttttttttgtagagatgaggtcttgctatgttgcccaggctggtctcaaactcctagactcaagtgatcctcctgcctcagcctcccaaattgctgggattataggtgcgagccaccgtgcctggcctggtttcctctctctcatttttttttttttttttttttgaggagtctcgctgtgtcgcccagcctggagtgcagcagtgcaatctcggctcactgcaacctctgcctccagggttcaagtgattctcctgcctcagcctcccaagtagctgggattacaggtgcctgccaccatgtcccgcttaattttcgtattcttagtagagacagagtttccccatgttggttaggctggtcttgaactcctgacctcaggcgatccgcctgcctcagcctcccaaaatgctgggtttataagcgtgagccaccatacccggccagttttctcgtttttaaaaatgggtaaaggccgggcgccctggctcacgcctgtaatcgcagcattttgggagggtgaggcaggcagatcacctgaggtcaggagtttgaaaccagcctggccaacagggtgaaatcccatctctactaaaaatacaaaaataagcctggcgtgttggcgcatgcctgtaatcccagctactggggaggctgaggcaggaaaatcatttgagcctgggaggcggaagctgcagtgagccaagatagcgttattgcactccagcttgggcgacagagcaagactctgtctccaaataaataaataaaaataaaaatgggataagattagtaactaactcatagggtcgtggaagtgagtaaatgaaataaaacatataaagggtgtagtactgtgcccaacacatggcaaatgcttcacaagttgttgtttctgcctcagattaaaaccattgcgaatgttttcagtggagtgtagggtttcttttaaaaaaagatggaaaatttctgattttgagggcttcaatatttaaaggggaaaagcaggctggaggggaaagagggagggcatggtcacattactgaatttacatattgctagagaataggagcaggtaggggaatagtcaattatgtatttgtctaacgcttagtaaatcggcactttacataagataagctgaacatagagtagttacctgcggagatatttaaccttttatgtgtagctatttgcttcaaaacaaaaggaaaggcagtttcttgcatgactcagcttttagcttaattttttcctttggcagagtgaattgggtttccaagattttattttccttttacacagcacacccaaagtacgtgacacaatctaatttcatgtgggcaacaataactttcacattgagcatatgagaaatccggagagactcatggcatagactgtgatataaatagaatccttaaattgtggagtgtacccacctacacatgaactaaatctatttttatgagatcatcactgactccatattgagcatattaaggaacccagaaacatctgtggaatagagtgtaatatgaaaggtctgcctacagctgtgtagtgcacccaactgtatatagaataagtctacttccatggggtcatcacttccttccacactaagcaaattaggaatttaggaagatccctagtatagattgtggtgtgattgctgcctccttgatttgtgtagtcctctcaaccatgcatagactaggtctactttgatatgactatcactaaatcacattcacatatgagtagatctgaataatttatgatatatactgtgctataaatggcagcccttcagttgtgcaatgtaacaatctctgcatggtagacctattctctatagttatccattcttttttcttccttgaattttaaagtacagattccctgaattttagctgaagaaatgaccaccaaaataaagacaacatttctcagccacttttgtaacaaactgtggctatgtaaattctagaccatgtgtgtaagacatgtgaaacttccaggaagtgtctttaaagtgaggtagatgctcttccagaaaatttgaatgagattggatagttgagtctaagaagtcatattcggacatgaggcagaagctatgtgtggaagacagtagagcaacaaactggaatgggcctgtttcttaatgactggagggttactatgccattcctgggctgctgactttgactacttacttgagaactatcttgtttataagccactccttaatgtaagatgtgagtccaacgtagccattccaaatcccaactgttagggttatttttatgtgtcaacttggctaggctgttatgcccagttggtcaaatgccaatctagatgttgctgtgaggttatctttttagatgtgattgatatttaaatcagtagatttgagtaaacagattaccctccataatgtgggagggcctcatccaattagttgaaggccttgagagaaaagactggaaggccactgaagaagaagaaatgatgtttccagattgccttcagactcaggacgtcgacttcttgctggaatttccagtctgatctgtgggtttgggtctttttagcccccgcaatcatatgaggcaattccttaaaataaatctcaccatctctgtctttctccttctgtctttccgtgtgtgtgtatacacacgttctgtttttctgaagaatcctgactaatccatcaactaattcagtttttggtttattttagttcatatattctattctacttcaaagaccgcctgcttaaatactataaataaatgttgcagaaaccagctatgagccaacagtgtaacttttggacaagtgattttatacatctaaaattaggtacaaataattaggtaataatcctctgcatgtatcacagaactattttgaggacaaaatagctgtgtttggaaaacaaaggcaaaaaaagtactttaaaaaatgtaaaagactataattcttgatatccagaacaagttatatatcaactgttgtgcttaacaacttactcaacagctaaaaagaacagactttgcagcttgtaaagaaatatgactcaattttcaagtcaagcgcttcgaacagaacttgaaacgtatgcctgcaaaattccattcatgactgggatattttgtctggttattgggtcaagttaaatggataattactttattaggtgtgcatgcccggcagcccactattagggttttatggggattttggggtctgtagaagctgcatacaaggaggcacacttttcctacctttacctctgtagctgagccttagcatcaggagtttactagctagaagagaaagcttgtccaacccactgcccgcaggctgcatgcggccaaggacagctttgaatgcagcccaccgcaaatccataaactttcttaaaacattatgagatttattttttgcagttttctttttttagctcatcagctattgttggtgttagtgtattttatatgtggtccaagacaattcttcttcttccaatgtggcccagggaagccgaaagattggacacccttattagagcatctcttgttcttgacccaaatggtagcgtaagtgactattctatcacttatctttgttatgaagaaaccccttaagtaataaaacaaaacaaaaaacttttttcttttttgatgtattccatgtacataattatcaatatttggagtgttgcctcaactggtccttgtggcagccctaaatttttttttttttttttttttttttttgagacaaggtctcgctctgtcacccaggctggagtgcagtggctcagtctcagctcactgcaacctctgcctccctagctcaagcaatcctcctacctcagcctcctgagtagctgggattacaggtgtgtgccaccatgcctggctaatttttgtatttttggtagagatggggttttgccatgctgcccaggctggacttgacctccttggctcaagcgatcctccagcctccgcctcccacagtgctaggattacaagtgtaaaccaccatgcctggcctaaacttcttatgttataagtcttgattaattctatctggactccaaattcccctaacagataccatatttatctattctgttagccccattggtttctgccatataaatgttttcatcattcctcactaacaagtctttctcactatgccacagtgattatacactcatcatactaaatcttttattctctgggatatgtcactctttggcatctttcccgtgtctatctgtgtgttttttcttgcctttacatgttcataattactgtaatatctcctaagcaggaatcttttttgcagggcaaagctaggtttcagcttgcttaatcttaggtataattgtgactcttgtttctcaggccattcttgccatggggaaaaggttaaagaccatctcctgaaaagaggtatttggaacaagcctgcaacaattttttaaaatttattttttgggggaatatgtaatacaaatacatagtacaaaagggcaaaaagctccctaggcacccaattcctctctctggaaagtaaacaaaattgtcagtttcatgtgactccttccagagatattctagcatttaaaagatatacacaaaataaaaaaaaatagaaaaagacacacacacatatatacaaacacacacaaacacgagagagagagggagagagaagggaggagggcatactgcatgtacattatataactcctttttttcacttaatatatcttggggaatgttttatatcagtacacatagagccatctcattcttttaaatagctgcattatactccattatatagatgagccgttatttatccaattccttactgaggaacacttgggtaatttccaatcttttcctataataaaaaatgctgtaatgagtgtccttctacatacatcatttcacacacctatgaaaatatctttataataactaagagcaaaactccatagtcagaggacctgtgaagttacaattttttatagacatctttgaccattagtataaggggaaaattgaatctctttgtagtttccatttgcatttctctgatcacagtgaagttgagtatcttctcctagcaaattgttttgtttttgttttgttttgctttgagatggagttttgctcttgttgcccaggccggagtgcagtggcaagatctttgctcactgcaacctccgtctcctgggttcaagcgattctcatgcctcagcctcctgagtagctgggattacaggcgccagccaccatgcctggctaatttttgtatttttagtagagacagggtttcactatgttggtcaggctggtcttgaacttctgacttcgtgatctgtccgcctcggcctcctaaagtgctgtgattacaggcgtgagccaccgcacccagcctcttcttaggctcttaatgctgaaaatcctcaaggtatcaatatatcacttcattccctagagttcttgatatgcctatcaaagccaggtgctttttatatgcagaagtgatgagaatgtccatcctcgctcccctgctgttccttatctcctaggcattgacccaggcccctgtttgtgtctcagtgacatttgcttttttttttttttttttttgagacagagtctcactct

SEQ ID NO: 4181 - DNA, 8644 bp, Homo sapiens
gaggttcgtttacgcgccgcttcgccgtgcaggtggtggcgaagcgctcctccgaaaggtttcggaagctggtggtagctctgaagataacgctgcgttagggcatactgcggcggaggatggaactccgattgaaagcagttgctggagtggagcacgaatttcaaagatgaagtctcactctgttcccccaggctggagtgcagtggcacgatctcggctcactgcaacctccacctcccgggttcaagcgattctcctgcctcagcctcctgagtagctgggattacaagcacgcaccaccacgcctggctaatttttgtatttttagtagagacaggatttcaccatgttggccaggctggtctcgaacttctgacctcaagtgatccacccgcctcagcctcccaaagtgctgggattacaggcgtgagccactgtgcccggctttttttttttttcatttttaaaatttttaacttcaggggtccaagtgcaggtttgttacacaggtaaactgtatcataggggtttgttgtacaggttgtttcatcacccaggtattaatcctagtacccattcattgtttctcctgctctccctcctcccaccctccaccctccaaaagtcccagtgtgttgttccccactctgtgtccatgtgtctcatcatttagctcccacttataagtaacagcatgcagtatttggtttctgttcctgcatcagtttgctaagtttttatgacatattggtcacaatattacaatattttcatatattttacaataactgactcaaaattcctcttcactgtccttatttttagagccgcatgttgaagtgtgaggcgtgaaagggtatgtctgatatttgctttaaaatgctccagcaaagaaattaagggatggatgaagcaaaagaggtatggtggctcatgcctctaatctcagcactttgggaggccgaagcaggcagatcacctgaggtcaggagtttgagaccatcctgaccaacatggtgaaactcgtctctactacaaacataaaaaaattagctgggcgtggtaccacgcacctgtaatcccagctactcctctggaggctcagacaggagaactgcttgaaccgggaggcggaggttgcagtgagctgagatcgcaccaatccattccagcctgggcaacagagtgagactccatctcataaaaaaaaaaaaagtaaagaaaaaaaagaaaatgtctttatttcattttctttcctaaagaatatatttgctggataaaggattctgtgttgacagttttgttgctttttaaaagcactttataaatgttgctccatggtttctgatgagaaatctgccatcactgaaatctttggttctcctatatacaaagtgttgttttcttccagttgttttcaaagtattttctttacagttggtttcatcactttgattatgacgtgcctgggtgtggttttcctttttgggatttgctgtgccagcagaccggctttaaatagaatgctatgtaaatgtatgtgaatatttgttttttgccagatgtttggaagtttttagctattatttcttcagatatttttttcttccaattgttctttctgggctcctaagacatgaatattagactgtttcatattgtcccacagatccccaaaggtcttctcatttttttcacttttttctctgtcattcagactagataatttctgctcatgtatcttcaaatttactgactcttccctcagtcatcttcattgtgttgagaccttccagtaaattttgttattgtattttcagttctacaatttccacttgtttctttttatagcttctatgctgagacttttagctttccatttatttcaacagtgtttccctttatatatttcctttggagaaatgtcttctttgtgtagcatgattaaaataactagtttaacggccaggtgtgctggcttatgcctgtaatcccagcactttgggaggcccaggcaggcagatcacttgaggtcaggagtttgagaccagcctggccaacgtggtgaaactctgtctctattaaaaatacaaaaaattatctaggcgtggtggtacacacctgtagtcacagctactcaggaggctgagacaggagaatcacttgcaccctgggggtggaggttgcagtgagccaagattgtatcactgcactctagcctgggtgatagagactgtctcaaaaataaataaaaaaaataaaataactagttttaagtctttttctgataattctgacatttgggtaaccttagagttggctcttgttcattgtcttttccctagagagttgcttaggtttcacaagttctttgtccaatcattttgggttgtttctgggatatatttggaatattatgatattctctatcctgtttaaatcttcataagaatgtttttgttttgttttgttttagcagaccatcaattcagttaagtttcagagcacacatcctggccactttttttggtggctgtggttccaatgttagttttcactgcctttgttaagctgttctttgccccagttgtgcaccatctagtggccaatctgaaacttggacagtggcctacactgtaattcagtgttcagaacctttgctcagctgcttctggttagtttcacacatacacagcttgtgagatgatcccaggattttattgacagatttaagggttccttttcttcagttccctcctatttgtgatcttacctatactctggtttctagaaccccattcttggtttttggctagaaagtcagggcgttagcctccccattgccagtgttctgccctgcaatgtctgccactagtgcaccagggggaagagaagagtgatacctctttactgctgcgggattgatgtagagcaaggaaagtccagaaggttccaagtcattacccatggttctcctggtggggcggtgggtcttactgcatctttcctgaggctctcttagaatactgcaattaaattaaaaagggttttgtcccatagcctccaacctcctttctggtcctctgactagaaacagcaaattgttccttggactatttttctctctgtcagctagcatttccagttttcctgttaaatgtcttttttctttttccttttttttgagacaaggttttgctctgttgcacgatcacagctcactggagccttaacctcctgggctcaagtgatcctcccacctcagcccccgtgaagctgggaccacaagtatgagccaccacacctggcaaaatttttttaattttgcagagacagtgtctccctgtgttgctcactctggtctcaacctgagctcgagtgatcctcctgccttggcctcccaaagtgctcgattacaggtgtgagccactgcacctggccttattatgtgtctatgtgtggattttctagtttattctgtttgggatttgtctggcttctagaatgtgtggggtcatgtctttcatcagtttttaaaattctgcattctatctaagtatttgctctgtcctattcttgcctctcctctcacagctaatgaagcacttaggatttttcactgtattctctacaggtcttctgtttttttttccagctgtttctcccatggtgcactgtgaatagtttctcctgagttatcttccagtttataaactaccccaattggctacattctattacatctatttactgagttttaaagtgcagtttttatgtatattcttgtaatgtttatattcagttcttttccagattagctccacaactttttatcgtatagtttcccatttcctgcaagtacattcacacaccttatttccttaaacaaagaaaacaaatctaatacctatatctgtgagtttgttttcattgcttcaagtaattcttgcctctggaatctagtttccttatatgactactttttactatgtgttactagacatatttgaaaagtaatttgaggcctacaatgaaattacttttccatgaaaagtatttacattttattttctctgtcacctggaggcattactagtgtgggaacaccttaaaggaagctcagtgcttaagattctttagatcactggggcaattctaaacttgcctgttcttttacattggttcttccacctctgattcattatcatcctaaaggtgaaagtatttgggagtctcagcctattgtgtggagggtctcctgttaggttcatcaccttatatgggccctgaactttaatttctgtccccctcactcataaggttgtcagagtaagggtacatgcttgcttctcttattctctttacttttggacttggcattccttattgtctggaaaatctctttgatgttttaagattattcttgtattttaatcaggaattgttttcaacaggaacatgatgtaaatatcctagcatgcaattttcagaaacaagtagtttcccacaattgaatctttgctcctacagggccaaatcctactctttctcttggcatgctctgcacttaagcgcatactacttgtggcatggaatccataaatgttgataaagaactacgcctaattctgtcagaacaattaatcatttttagaaatttttgcttagaaacctggtaaagtgctctgcatgtagcaagtatacgaacacacaaagtttgttgaatagctgcataaaacaaatgggctagattttacttcatatttcaaaattcagagaaagagagtagtattaaaagacataagccaaaaatagatcattgcagactgagtacaaagaaccattctatttcttctcttaaaaaattaaaatttcaaattaagtaccaatgaccaaataagtaacaaacacattcagaaacatactatatgtctacaaagaatacttcaaaatgtgcctccaaacttcaggcacataattccaatttttattgaatatagagattttatgaaaacaaatccaaagctgtcccatcatggaacagccctctaccatttggttattttaagactgttcaattacttacatggcagaatacatacactatatttagaaaacataaattgggtttgatatgcaattgttttcatcttacaccatttcaataaatttcacaaattataacaggttgccattttattgaatatctgcgacactttacattgttcaggaagtagctacttccagaaggctgatattctcctccaaattgtctttggctaagtactacagatgtgattcagtccaaactatatgcccaaactgattaaaattctcagtctctcctagcttgagacctcagatcctgagttataactttgacttgatcttcaagttgagatgcttcataaatatttttcttaaaacagggctatttaacataatttctttttcttgaaatatatgagtgtttttgatacaaaaacatatattacacatgagaatgtttaaagcatcaaaataatgattaaattttttacataacttaaatgacaggactacaatatgccccccacttttttgctgtttgaagtaaagaggaaagctctgtaacaatttcaaatacataggatttaacttatgttaatatcctgttataaaaaataactaccatataaagaatttaaaatatgcaaaagtaattagttcatttaaatttatacttatacactggtgtcaatgaaaatatgcgaagttgccaagaaatttctaaggattaaagtggaagtaaaaaaacctgtttcaggcttcatttattgctacataatgactacttcaagggtcatctggcccgtcgtcagtcactcttagaagtggtaaatacagtggtatagtttggaaggaaaggaggaaaaaaataatgcattgtgatacaaaaatattacctacatataaattattaaagatttataaaacattcagaatatgttcttgctataaaaacaatatacttaaatatagaagcaaaaagtcctgaagcacccgcaattattttaatatccatttaatcagggaaaactatatatgtggatatataatacatacatatgtaataatttgagaagaaaaaaggcaaaattctgattataatccaaaaagagtttatctaattatggaggtaggtctccactccaattatacaaataagttatcagttttattcaaagaattataagtctaagacctcaaaactggtttttgtgccactgaaatacaatttgacagactttagaaaccagtattctaactggcatatacacaaagcagatatttccttcataaggttacatctgaaaagagccttcattaaaatcattattggcataaagaggtatacctaagtgcagatactttggcttagcatttaaataacacagtaaatgctataaatttcttaaaagaaatccttgtctttttagtacttaaattaattgtaaagctacagaaagtatggatctcttaaatttttagatatttaaatattgtgctaatgatttgaaaagatcattcctgcctaaagagcaaagcttatgtgtttcaaaaatcagacatatttatacttttagtgtttgtggcatttcagctttagtgctggagttagttttaacaaattaggttgcaatatgtaatatggcacattctttcactaaaaaagatgttctataatgaaaaacactaattctatttctaatggtaaactagagttggaggtcccaccatggatcacaggtatcagagcactatcaagatcatttagataatgctgaggcagaagttggccttcagatcctgcctgaaattcaacctagaaaaaaaaaaaattcttgataagaaaatgagcaatcttgtttaactcggaatgtgaatataaaataagtgaaatattttaaaatacagttcaagcatgttaaataaaatatttgatatatttataaaaaaattctacattctcctgtatcttttatctgtctactacataaattataattgttcctcctcatatatcataaagataaaattgccactatgtcatactttacgtttcctctaaatgaacacataaacaaattagagggatgaggctttgaataactgccgacattacttaaattaaaaaccccatggtattaaaaaaatctacttgaaatatttcaaatttgttgttgcaataatatttaatattagactctaacattggtgcaaattacattttaatacaattggctaaaaaaatttacagtgcttactccaataacaaatagtgagtgcttccttgaaaagaggacttttaatagtgagataaaaacaaaaccccttttccagtaagaactatgagtaaaatatatcctggctggagaaaagcaaaccctcagcatatgaactcacccacgtttagcttaaccattctaatgaattctctgatttgaaaatctatattggatgttggaaagttacctggatgtcagaaagagaactttcagttcaaagaaaaacaaattgtttttacatgcaagatgatcatcactccttgttaagagaaatacaaattaaaataatactggggccaggcgtggtggctcatgcctacaatctcaacactttgggaggccaaggcaggagaactgcttgagcccaggagttcaagaccaacctgggaaacagagtgaaaccccatctatttaacaagtaataataatattaataataatgtggtattatttttcacctatcaaattgtccaagttcaaaagtttgattatatacttctttgataaggatatgggggaggccaggtgcggtggctcacacctataatcccagcactttgggaggccacagatcacatgaggtcaagagttcaagaccggtccagccaacatggtgaaaccctgtgtctgctaaaaatacaaatattagcaaggtgtggtggcacatgcctgtagtcccagctactcgggaggctgaggaaggagaattgcttgaacccagggggcagaggctgcagtgagccaaaatcgtgccactgcactccagcctgggtggcagagtgagactgtctcaaaaaaaggatgtgagggaaagagctctcacaaattgctggaagaaataaatataaattgacataacctctatttgggataatatggtaatatctattgcgtatatactcaggcctggcaattctactcagaatttttcttatagatatacttacgcttatgtaaaagcaaaatattgtggacaacctgaatgtctatcaacatatatcaaatatgcatgaataattagttagataaattatggtacatttatataatcaactactatgccgctgttaaaaaagaatgtctgctagtattaatatctttaagatatattaaagaagcaaggtaaaaaatgtgtaaaagagggaagatgaaaaaggaggacacacacttatttgcttgtagatgcataaaatcacaaagaatacgtaagaaatgagtaacactgattgcttggccggagagggaggataaagaaaagtatgaaggtgaactgatgggttggatgtcaacagtaggaaagatatttccaaggc

SEQ ID NO: 4182 - DNA, 2326 bp, Homo sapiens
actctgttgcccagcctggagtgcagtggtatgattctgactcactgcaacctctgcctcctgagtttaagcgattcttctgcctcagcctcccgagtagctgggattacaggcatgtgccaccatgcccagctaattttgtatttttagtagaaacggggtttcaccatgttagccaggctgatctcgaactcccgacctcaggtggtccacccgcctcggcctcccaaagtgctgggattacaggcctgagccaccgcacccggccagttatttttataattagcaaagtaaagctacttctattttggaaagtgaaatcaagttaaaatttgattctctgtgagctcttcattcagcaaagattaaattacattattttaagagagtgaagaggaatttgaaatgcgtttagattttccacaggaatcaagggagttgttgttaactgttagttgagtagaaaactaaactcattaagcattgttttccccatagtgtcagtatagtgctgatctcacattgtgatgaattaggttccctcaaatttttcatgacgccatgaaaaatggtttaaagtacttgaatataggcatctttttttaaagccttattttaaatgacatggcatattattgcaacattttttatgatgcttgcttcattgttatttttgttaagagtttccattttaaaagtcctttgccatcttgtccttgccgtcctggctttcatctgggactgcagcagggctgagccaaaaatggctgctgctgcagcaggggcgggcatagtataggacttggctgctgtggttcctgtgaagaagcaggaggggaagcttggggagaatgtcctggctcaggattctcttaatggttgtggccacaagaattgggcttttcttgtggaagaatttccatactgtagattctgctgtttggagggaatgacactgagtattggaatttacagcattagtggggggacccacccattctctgcagtagaagaaatcttagctgatgctgtcattcactgagcaggattggctattttcagaaagcagcaaggcttacctgtctgtgtcagttgatgacagatacatgtccagaatgatggtgatttctagcttggtgggtgaacatacttaaatgcgaattatctctcagagatggagtgggtggcatatagtagaggattaaaaaggtcttccctttcgtgcagcttgtgtgaggaatactgttccatataaaaaatctgcttggtatgttaaggtgagagatggggagtggtttgagtagagaattaaagttgctgtgtgtgctctttggaccactcccaagaggaaatacactgccatttggatggggtgagtttgtgcctgagttcctgtcctttctgcctgtgactagagataggcatgatgtaaaaacaccaggatctgctgcttagcaaccagtaaaataccgtatatctggataggcagtaacacagtacttcattcatttctctttcagtgtgatgaagagaaaaggcttttttgcttgagaaacagaaaagccccccttctctagaaaagccatatgtgatcattatggaaaatacagggaaaaaaaaagaataacagtttactcataactctaactcattgatgtatttcgataaatttccttgaaggaattttttgtttatatatgtatacatatttttgtacatatttatgtacacataggttggcatatatgtgtttatatatatacatacacatttgcatagctgcaaatcatactgtaaatgtaactttgtattatttttcctattttaacatattgatatattaacatttctttctttcttttttttttttagagatagagtctctgttgctcaggctggagtacaatggcatgatcatagctcactgtaacctccaactcctgggctcaagctatcctcctgcctcagcttacccagttgctgggattacaggcatgagccaccctacctggccagtatagtcacatttcaaaaaacattctgaaggcatctttaatggctttatagtattagatatatgactgtgccacaatttactgaaaacacattccttattgttggattttttttttctttttttgacatgaggatcttgctgtgtttcctaggctggctttgaactcctggctatcctcccacctcagcctctcgagttgcagggattacagacatgcactttttttttttttttttttttaaatgagacagagtctcactctgtcgcccaggctggagtgcagtggcgcgatctcggctcactgcaagc

SEQ ID NO: 4183 - DNA, 1309 bp, Homo sapiens
aaaaaggggatccagggagaggaacttttctgaggactggggtagggctgaacagctgcattcgaggctggtggagggtgggctgggcatgggatgcacaaatggaaattccactgggtctgcagctcacacataggcatgaccagcatagagatagagaggccccagtgctgctgagtaactgtgattccccaggtgatggcatcagctgagaagggaaggaagcccatgagaggacactgaagaaggagtgagcagacaataagaagcccacagaagacagagaaggaacaactagagggagaagccaaggcaggcgtgtgtggtaacacataggaactgagggagaggacatttcaagatggtggggatgccatacaacaggactatgtgatggtttttggctgtgtccataggaagtcacaacaggcaagggaaagaaaccagaacccagtcatggagttaagaagtgagtcagagagtagatgggtagggacagtgaggtaaggcctctttctaaggaagtttggctgaaggatagactagctggacacatgctggctgtgtggggtagagggaggaatgatggagggtaggagagccttgagcctgcgagaagagtctcttagaatagagaagctgaagttaaagttgtggaagagagtggggataactgagtgacagataatcaggagaagaaaaggagatccagactcatgacagagagatgacctttgccaagagcacagccgtctttcacggtcacagagaggtaggacaaaatgagtggtgttcaagaattggtttgtagcacaatatttcaactatgtcctttaaaaagtttctccacagacactacccaaagcagtgcttcactacagtggcagacagacctgaaaattttcatctgaagcagcagagtgaactgcagaggcaggtcaccaaccagtgtggaggctaaaagcgggcctctttggggattccaggtggaagtgttggacatctgtagtattcctggtctcgaatcatcctgatattcttcattttgttattcacattggactaggagatagaatctcactatgttgaccaggctggtcttgaactcttggcacccaagcgatccttttgcctggaatcccaaagtgtcagatttactgaagaatatttcattgtaattactttttatactttataggtcaagagctctgttttaaatacaaaatttattgaatatactttttcaaacaaagtttcatgttctaatcattgtctgatttcagcattaaatgaaacacagtaaagaaag

SEQ ID NO: 4184 - DNA, 2043 bp, Homo sapiens
ttttttttaatttttaatttttgtgagtttataggtatatatatttatgacatatatggaatattttgatacgggtaatcagtgtaataattgcatcagggtagatgagatattcatttcaagcatttatcttttgtgttacaaacaatccaactgtactcttagttatttttaaatgtacagttaaattattattgaacgtagtcactctgtggtgctatcaatactagatcttattcattctttctattattttgtacccatttaccatctcccttccacctcccccactactcttcccagtctctggtaaccatcctactactctctatgttcatgaattcaattgttttgattattagatcccaccaataagtgggaatatgtgatgtttgtctttctgtgcctggcttatttcacttaacataatgacctccagttccatttatgttgttgcaaatgacaggatttcatttttttttaatggctaaataatactcctttgtgtgtatataccacattttcttcatccactcatctgttgatggacacttggcttgcttccaaatcttgactattgtgaataatacttcaataaacatgggagtgcagctatctcttcaatatactgatttcttttgggtatatgcacagcagtgggattccgggatcatatggtagctctatttttagtttttttgaggaccctccaaacagttctccatagtggttgtactaatttgcattaccaccaacagcatatgaagatgctgttttctccacatccttgccagcatttattattgcctgtcttttggctaaaagccattttaactggatgagatgatgtctcattgtagttttgatttgcatttctctgatggtcagtgatgctgaacacctcttcatatctgtttgccatttgtatgtcttcttttgagaaatgtctattcagatcttttgcccatttttaattggattattaatttttttcctatagagttatttgagctccctatacattctggttattaatcccttgtcagatgggtagcttgcaaatattttctctcattctgtgggttgtctcttcactttgttgattatttcctttgctgtgcaaaagctttttaacttgatgctatcccatttgtaaatttttactttggttgtctgtgcctatggggtattattaccaaagaaatctttgcccagtctggtgtcctagagagttttccccaatgttttcttttagtagtttcataggtcttagatttaaatctttaatccattttgatttgagttttgtatatgatgagagatagggggtctagtttcatttttctggatgaagatatagatagataatccagttttcccggaaccgtttattggtatctttctataggtttgggaagttctctgttatgatctctttgagtaaactctttgagtaaactttcgacccattatctctccctctacctcctctttaaggccaataactctttttttcttttttgagacagaatctcactctgtcacccaagctggagtgcagtggcacagtcttgctcactgcaacctcccaggttcaagcaattctcttgcctcagcctcccaggtaactgagattacaggcacaagccaccacactggctaatattttgtattttttagtagagacagggtttccccatgtcggccaggctggtctcgaattcctgacctcaagtaatccgccctcctctgccacccaaagtgttgggattacaagtgtgagccaccacatccagcctaataactcttagatttacctttttgaggctattttctagattttgtaggcatgctttatttttttctattcttttttcttttatctcctctgactgtgtattttcaaattgcttgtcttcaagcttagtaattctttcttctgcttgatcaattctgctggtaagagactctgatgcattcctcagtatgtccattgcagttttcaaccccagcatttctacttgattctttctaattatttca

SEQ ID NO: 4185 - DNA, 1933 bp, Homo sapiens
taatcaaccacataaatacacttgtttgcatacaggttcaacttctttagcacaaagataaagcaataagttatcatgatacccatctccaaaggttagttcattgatgaagtaaatagaatcttgggcatggtgtttgcttgataccgtgaatgctgttaccaaaaatcttcccaagaaacattaactttgcctctttctaggtaaaacaaattaaatctgtaaaagatcttatatgcttgagttagaaaaaccctgaatatatttgggttggtgacaaaagtgaaatataacacccctgccactttgaacaaaactacattgattgtgaactgtagtaaaatatgtcatataatcctttttgagaagccatctgagaaagagtattatgtttttcttcagtggtaaagagttgcagtatctaaaccaagttttctactggctacactcggctatttctattcttgacctctatggttgacagcagcagatgagaaaaatgaagtctgtaataagtttgtctgtaagagagctgcagtgctctttataactgatcctgcagccagggtgcaggatacccaggtcatgatttgggttctttagttcgattgcccagaggataccaactcatattcccagggagatcaaactgccaagtaaaatgaggatggcgaagctgtatcaattttacttctctcaggagaagaaaaggatggtgtagctacctctcaagaagaggatacctatgaaagaaggaaaaattaatccagaaaaacttagggacatccagaaaataccagagccctttttagcccaagatcaaccattaaaaggaagacctcaaaggtatttcatttcctatgtacgttagtgtatctgataagtatttgaacaagttacctctacctgaatatgctgtgtctctttgtcttgctgtgacactttggataaggtctctgcagaaaatatagaaacaactgaccaaagagttgttaatgagaatacagctcttatctctcaccaatgactacatggaagaatttagagcctatttcaataacaatatgttgttcatccttcagtcagatggaaagagaccagaagcaggagagagagagtacatgcgggccaatgatgttagtaatgaagaaggagaggaagagaaagaaagagacagatgagatggaaaatggaaaagaaagtgttgaaaacagaggagcctcaaactcagtctgcccctaatactgatgaggcacagaaaaccaaggacatttctataaagttcatgaacacagatgaggaggctgaagatggcccagatgctgatttctttaaggatctgaatccagtgacaagaaaaaagtgaccaaaatcacacgcaaaagaaatgagaaattttaagtgaataagaacataattcttactgacgaagggaagtaggttcagcgctggccaccgatgcagaagtgcatcttaaaggatgctaaggaagaggattgtagtggtataaaccttgaaaaatcaaaagaaaggcttcaggaagtggaaaaatttgacaaagaagagtagaggaaaaaagttaagacaaagcatatggagaaaatacttcaaaggggaagcaaaaagagaggccagcaaggccaaagatgaagggaatgtcttttaggatctcagtggtaataatgggaaattcgattaattcactcttagatcctcgtacatacagatgtctgaagaatcagatagtgaagatacggaaaataaaattagtagttcaggaaaacccatagaaggaagaaaaggagccacagtaaagtggacaatgtgaaactactattataacaagttgcaaatgaaagaaggccaagtaggaatcctcagagtctctggatacagttctgtctctagcagaagacaaagagcttaaatttta

SEQ ID NO: 4186 - DNA, 1639 bp, Homo sapiens
agttgatcggcatcgttcactgatcacatatttgtgaattcacctccttgctaaaatttatttgtaacattaatgtatacttgtggcgcctttgcagtcatctgtgcccatgcacagaccaatgacaaatttgagttgcccaactggcatgttccccagatgagattggttggcaaagtgaagttttgcctttttttttttttttgagacagagttttgctcttgttgcccaggctggcatgcaatggcatgacctcggctcgctgcaacctctgcctcccaggttcaagtgattctcctgcctcagtctccagagtagctgggatgccaggcacacaccaccacgctcagctaatttttgtatttttagtagagacggtgtttccccatgttggccaggctggtttcgaactcctgacctccaggtgatccacctgcctcggcctcccaaagtgctgggatgacaggtatgagccactgcgaccggtcaagttttgccttcttgtttcagctctcatactgcaaacctgtgtcctcttcgcagtatacttagtgccacatttttggcatttcatgctttttcccggtgatgttgctgtttaaaatggccatgaagggcagtgctgaagtgctagctagtgctgctaagtgatgtgccacagaagactgcaacgtgccgcaccaagaaaatcaccccagtggtagatgagctctttgcaggcaggagttacagtgctgttgcctgtgcggtcaatgttaatgaatccactgtatattaaatacggtgtcttttgaacaaaagccacacggaaaacagttatatattgattggttggtgaaaatgttgagactgcaggctcacaggaacctagccttgtacttcccctaaggacaatggttcagcatgtgctaattcagtgttcatggcaactttatagaacataactgctacaaaaaataagcaacagtaactgcaacaactgcaatgtgatgtgaaaatatttgtgacaaggactaattcagctgtgttttgttacctacattcattatgaaaggaaatgctaaattttagcattagcatttagaagacagtgaagacttattttttttcccattcaagtttacaggcactattaattctggggatccctaaggaccctagttaagaaaattttctcagttggattaaatcagtgacagagcagggagggattgggaagctggtgcggattctggggagattcaggtccggtcacattgtgtatcaatacaagtcccatatagagatttttagctgatctgctttttctggggggctgactttatttttgtcaccagggcctgaacccaaaaggctcagcatgaaatgaaaaatgctcatggtgggtggaaatagaaattttggtaattactcatgtggcaaatagtgagctctatttcaatagtgtagggcaagccaggtctctcctctgataacaggagagagtatctgtttctttttttttttttttttttttgagacaaggtctcattctatcccccaggctggagtgcagcggtgcagtctgggctcactccctcgacctcctgctgggctcaagtgatcttcccaagcagctaggactgcaggtgtgtgcca

SEQ ID NO: 4187 - DNA, 9114 bp, Homo sapiens
actatttccagaagcgtaagggtgaagaaatggaaacagagaagagacagttgcccaaaaaatctgtgggctgacagcttacatttggagaagagcaaaaattggctggataagcacttggatttggaactgggggcaatgggactgaagagaaccagtgagaataattgttaaggaatcaaaagaacaaggggatttcaagaaaggcatgatcaacagggtcaaatgctgctgggaggaaaaagaagctaaggcttaaaaactgttcattgaccttgaagagaaggacagagtaagagggcaggagttggtggaatatagcatcaaacaagggtttctgaagatggaagatttttgcttgtttacatgataactctcaaaatggccatgaggatatactggttttgaatgctccagtcgaaatgggacctgtggtgacctaatttatgctctgacagttcaaagaactcaaacaaataccattagctgttaaagatttcggtctcccattctaagaagcagatctcaagccttcaaagaaacctcccatttccttctggctaagtagaaaaataattactttgtcatgaatacaccagtgactacagaactcttcgctgttttgcaggctctagttaggatgaggagcaatttcactaatcattttttactcaaaatctcaccagacccttaaaaataaaccctctaggccaagcgctatgggattttgccaatcgaaatctgaagccttgttcagagtgtgaaaagcagttttaattaggagcacaggccagcctctttttaaaggaaagaaaacttcttaaaattacattaattgccctattattagtaaattaaaaaaaaacacaaaagtctgtagaactcagtgatgggtgaaactgattgcattttcccgttgcagcagcagaaaagccctctcaaggagaatggcatgcatcatgtgctggggtagataaggtttaatttcccccgggcagtgccgggccttgaacactgagaatattgcttcctggattgttccaaattactaccagagcattgcatcactgcattacatgctggcaaaggacagctgacgaagttacttgaaaggactcttgggaccagttggacaatgagattttggctcaaatgagtactgcgtgacttcgggcaaaccatagattatcttaattctgttatttttaaaataggcaaaatataattttttcttctcttaagagattttttttagaggaacaaaaagcaaaataaacaaggacatcaaaggcatcttgatttcttcaagtagttgagcagtgctgacccagctcatgcaccgaacattagttgatggcttatacttttattttaagcaattttttaaaatctgagtttcctttgattaactcatagaggtcattcatggggacacggtatcagtggacatctgggagatgacataattgagttgagcttaattacaggtactggagagaaagatgaagacagaaaggatgggactgagggaatggacaccaccaaggggcttgccccattggggcagtggggccatccaagggcaggctcagatgaaatgacagactcaggcaggttcgacctggtgaggacaaggaagcaagaggagatccaggtggtggatgtattctaaacccaggcaggtagaggcaatgaacctggttttatgttcattcatgcatgggcccggtgagagaacagtcagaaggtatgtggaactttcagctttaacccacttctgagtcatctgggaggcttgctgacatgacccttcctgatggactgtggggagctgggaggagaccgggcatccacacttttgaaagccgctaggttgtcctaatacaattgatcagatgaccacttctaaagcaatggaaaggaggccttgtcattccaggtgtcaaggtagcacgcaacagggccagattttacctgaggcccacctaaaaaggaagctagtgttctagagaagaaatagaagcagaatcatagttgtgtggatcaggcaacaggctgatgagcagaaaacgattaactcgggctagccagatgtgttcacctcatacatgttggccaaagccctaccacacttcctgcatgactatggtctgtgagatataaccctagaggcagggtttagaggcagatccaaccatagagaagcctagaaggtagggatacatcacatctagagtagcctcagtagtatttattaccaagtgatgccttcaagttgaagaatcccaatacaagagtcttggataaaatgagagattttgtatcccacattacaagagatttggggtggatggctccagaccaggttattcttgagcactcactgatggcagaactctagcttggtttccctgtggtctcatggccttcttttcatgactacaaaaagatgaatgttgcttcaattttcaggccatcacacaaccttctggagaggaagacaaagaaactatatcttcctggtgcctctttttatcagggagaaaaacatttcctgaagccctcgtgcagatctgcctttacatctcatttgacagaatgaatatttgttgattcctcagtccatcttagaagcattatagttcacactgtggctagagaagagcctcttttccctgagcctactcctcccagtacagaaaagtattgtggtgcagtgagcaaggcaagaattggcatatctctttaaagacaacacatagtgcctttaccctttgactcatgtggcaaggcttgaaacctctctagctctgatgccttatagtaaaattagtagttgtgttagattattgatgtttcatttgaacactgatgattttatgatcctatgctttctctcagcaactagtcttctggattttttcatttattatccagtcatcaggacttttacctaaattttagatacaatggctaagtgccaagaacacatccgtgcagagtttactgcatggattctttatggtctgcccattatcaaattatggcagtaaagtcatggtcaaagaactaagctccaaatacaactgagaagactgtaagtcctccttccattcatcctcctctgaaaaacagtaaaacagtgtacattcccagcacacagcctcctgtgcaggattctgcagatcttctctgtgtcattgcaacccttgttgtgatgcacttagcaatatttcataacttgaatgtttcctcactttttaaaaaaaaaacataaattccttcttcctacttcttttcattttatttttctcaaggcttatcttaagatatcgcacctctaacatatttccttcttcaagggaaagtgtcttaagaaatgctgcacaaaagtagtctgggttctgtttttgaaatgacatgaaatcatgtttttctatatgcccacaaggacattcatgcctaacgatttctgtgaataatgtaacttaaaaacatataggccaggcacagtggttcatgcgtgtaatccgaacactttgggaggccgaggagggcggatcacttgaggccaggagtccaagactagcctggccacatgtcaaaaccccatctttactaaaaatacaaacaaacaaacagacttcttgcttggttccatttatgtttcataattttattatctggtttgcacttttaaagctgtggcaagagaataaatactagcagtaagagtatcttagttggcttctgtattcctgcattcccttttctttggcaaggtacattttaaaaaatctcaatatcaaacaacttatgtttgaatattcaaaacaagcttttttaggaacaataaaaaatgttattgcagaacaatcagccattgtatctagaatttaggtaaaagtcctgatggctggatgataaatgaaaaaatccagaagactagttgctgagagaaagcataggatcataaaattgtcagtgttcaaatgaaacatcaataatctaacacagccactaatcttactgtaaggcatcagagctagagaggtttcaagccttgccacatctcacatgaaggaggatgcggagacaacccttgtcttgcttgggcttatatcttggacctgcactgcttaaggcagcagccccaagtcaaatggggctgaacccttgaaatgtggtcgtcctagttgagatgtgcttgaaggtaaactacacactgaattttgaagtctcactattaaagaaaagaaatgtaagatatattgttaatatccttatatggattacaagttgaagcgattatatttttaacatattatgttaaacaaaatgatatacgaatttcacctatttctttttactttttaaaaaatgtagttactagggaatttaaattttctcacatggctggcattatatttctattgtatttaaacttagatggttagctcttttggtcctgaatactaaccctattgaatgagaagggcatagtctggcctcatggaaggtttgtctcactatgatttaaggagttttgggggggagggggcataaattgtgatttttttaattggaaaaattaaaaaatcagctcacaatgggagtggatttgaggcaaattgtgcaagcagattttctttaagtggctaagcaaagtttaaaaagcaagtaacaatggaaaaaaaaatgtttctggtacaggaccagcagtacaaaaatagtgtacgagtacctagataacatacccattttgcaaagtgcaacttttaagtacactattttaatgactttatttgttgcttaatcctttggatcattataaaatagttttatgaatcaatcaatagccaggaaatttgaggtatatttcctacctctattgtttatcgtacgtgtgttggtctctagtcccacttaaactctacagcccatgcctggcaattagggactaacactatggatagaggtatatggttttaccagaattcctgactggaaaaaacaatcagctttaactggttagaagtcatcagtgctggtttatctattaaataaatcacttccgtaagtctgacagtgccttagaaagaagcacttttccctggagacttcacctatgcggagcacagaacaatgaactccagagccagccattgctgggagatggaacaacagtaaggaaagctgagagaagcatggtgtcagtccagggctattccctgcaagcagcagaaactttgccttggctgacattaaacagaaaaggaggttttgcaaggttattagttggttcacagaataattgggaagatgcagaactagtttctgaaaataggcatgaacggagggcagccagaaccacagcccaaatcaagactcagaacttgatcttagggtggtcaacgccgcactgcagatgctgcagattcccctgcagtcactgttgaccctgcacactgaggctgaaactgccacccccagactccagcagcaggtgacccacttgcgctggtatgctcaaaactctttgctggttttaaactgatagtctgggctcctgagaaccccctctgtcttcagcaaagcaggacagttggtcacactagtcggaataaattctccaccatccacggctcccatgttcaagtgctgggcatgtatgtctgattaggccctgctgggtcacctaagttctggctgccagagagatgaagagagagggtctggccatctatcttccctagtgggtggctgccccagctttccatcagaggcttataactaaaacataagcagactacttctcagtaatttgagttaaatagaggaaacggaacacaaagaaaagcagccaggagcaacaggaactggtggctctccttctgaggcagcgtcctgtggtcaaaggaggaggtgctttgctgggactcattttgttcattcgaaagttggagaaaggactctaaaggagctcatgtaaggaaagtacctagcccacatcacatgctcaaatatttctttcccctttcttctgtttttcactttcttttctcaccccttcattggaatctgatgtcactgctgtagaaactaaactgatttacattctctaccaactagccattattaaaaattcaagtaataatgtgtagaactcatcacttactagaacttatcaattactgtgttttatttatttatacttttgaagttacttatgtcttagttgcaagttgcgagttctacataatgctgtgtcactgcacatttcttcccaaatctgtgtttggtgacatcactcggatagcttgaaattggcctggtgggaattggcaaatactacaaatcagggctcaatttattttttattgactgtctagacttatggaagtggtagagaaaatgttgataaagcagattaaacttagaagtgtgttgtgtgtctgtagttattacactgaccagcactgaaatgaaaaatacagttttctagtattcaaccactattacacaattcaacagggaacttgctcacaccatggacaaaacagtgaatttccgagacgtgagtcttcattgtttgacttttgtcttacatgagataaacaaatgtgtcaactaacttattcatcagttgcaaacaaaggttggctatagataagagtttggtaaaaattaataaaagcattctgtgggaactaactggctgtatggaatttataataaataatattgtgtatataatatatatgcatatacacatacatacacacacacgcacatacatacacacacacacagaggttttttttagggagaagggaaccagttgttcaaaaattaccagtacaccacagtgagctgccctctttaaacgtgatctatctttacaatcatattattattgttgtttttaatttttattttactttaagtttctggatacatgtgcagaacatgcaggtttgttacatgggtatacatgtgccatggtggtttgctgcaactatcaacccgtcatctaggctttaagccccaaatgcattagctatttgtcctgatgatctccctctcctcctccccctacaggtccccatatgtgatgttcccctccctgtgtccatgtgttctcattgttcaactcccacttatgagtgagaacatgtagtgtttggttttctgttcctgtgctggtttgctgaacaagatggcttctggcttcatctatgtccctgcaaagcacatgatctcatttgtttttatggctgcatagtattccatagtgtatatgtaccacattttatttaaccaatctatcattgatgggcatttgggttggttccatgtctttgctattgtaaatagtgctgcaataaacatacatgtgcatgtatctttatagtagaatgatttatattcctttggttatgtacccagtaatgggattgctgagtcaaacggaatttctggttctagatccctgaagaattgccacactgtcttccacaatggttgaactaattcacattcccaccaacagtgtaaaagcatttctatttctccacagccttgccagcatctattgtttcttctgtcagttcatccatgtcatcctccgtccagttctgtgcccttgctggagaggtgttgtgatcatttggaagagaagaggcactctggccttttgggttttctgtgtttttttttattttttctcttcttcataagtttgtctagttttgatctttgaggctgttgatccttggatgaggatttgtggggacttttttgttgatgctattgttgttgctttctgtttgtttgtttgtttgttttttaatagtcagctccctcttctctagggctgctgtggtttgctgggagttcacttcaggccctattcatcaggttcactcccgtgcctggagatgtcactcgaggagactggagaacagcaaagatggatgcctgctccttcctctgggatctctgacctcgaggggcaccaatgtgatgccagtagaaatgctcccatataaggtgtctgacaacctctgttggaggatctcactcagttggatggcatgggatgcaggacccatttaacgaagcactttggctgtcccttggtagagggggtgtgcctcgctgtggggaaacctactcctctgggctgctccgattcctcagaactagaagaacaaaagaccaagtctgctggtccacggagactatggccaccccttcatgggctcaggcccagggagattagagttctgtccctgagcccctggttggagttgttggaattcctgcagggaggccccacccagtgaggaggaatgggtcaaggtcaggcctgaagaggcactttggccgtagtctgccacagccggtttgttaggctgtggcgaatacctcttgggacccaaccgtccagcctccttggctccagcagaggaaaagcgtggcctggagctatagagatggctgccgcccttcccctgccctgggagcatagtgtgttaggcagctagcattcccagtgttgcctgccgcccctcctccaaggagcccagaaggcttagacagcaggcagctgcagctgtggcgatggcctcccctctcctcaagaactgggcaagcttaggcagattctagctgagtggctgttgagaatctgcatggctccatagttgggacgctaggccacggtggcttgggttcacgagtgggatcttctgatctgtgggtcgctcagttgcatggaaaaagcacagtttcccaggctgggtagtgtgctcactcaccacctccgttggctgggggttgaggtctcctccgccccttatggctctcaggtgggccgcccatcacactgctcttccttcctctccgtgggtcaccccagcctcctactcagtcctgatgacagaacctggatatctgggttgccagtggaggattcgcacactgttttggttcttttcaatggaagactctgactgacactgattctagtcggccatcttggccctgccccccagtcatattattttccaaatcaaataaaaatacatgattggacagatttattttctg

SEQ ID NO: 4188 - DNA, 1676 bp, Homo sapiens
caaacaagttacagcatttattcaataaggaatattaaaataattcattagtaaaaaataaaataacttcaaccatatacatattataatttatcatgtacatactccaaaatccccataatttaattaggaaatttatagaacatctttttaaagtatgtcttaggaaaaccaaccaaaacaattggtgccttaactaaagagaatgtgcatacacattgctatttgacctatatgcaaaagtggaatgaaatacataggaaattaaggttactgctttcaaaaatttctggaatattagtacttaagtcaaaacacttacctgcagaataaaaacagcctgagtatttccaaagctgaagtaattttctgaatgttaaatatcacaagaatgaaaacagtctccattaagcacttacatgtggtttacagttgaggcagaagatgaaggtctgccaagcagttttcccatatcacctgaattctttcttcccttataaagtataagcttcaagggaaatgattacatataaaaacattccaagtgagttggggttcctgactgcaacattcaaccaaacggaaagaggaattttttaattctcctaagcaggacctacccaaccactgcagacatgagcattaattcttatgccagacaaggtaagcgtgtcctttgaaatcaaagctaagcttgacaaataactgtactggataaactggatacatgaaccacctcaacaaagatggtactttaagcatttatacacatgaaaatgatgaagtgtattatttagatatggtctttcttcatctttctctgaatcctgaaaggttagcaagtcattatactcatacatcttgtaatccctttctccacaaaatacatacacatatacagcttcatatgtcaatataatatcatcaacacagcataaagatttaagcagtagacacaagtcacatgaaagaggctctatgcatcatgtggcctgtccgaataaaaagcaaacattagaatgccatttcagcagttacagtgttgatatgatcaatatagctaatttttttatacccgtcatatatttttagaagtcatccgtagggaagaagcaaacaacaaagactgcttttttttagaaaagttatgtgccaacttcaaaatgacatactaaccagatatcagcattcgaaagctaggttgaataggactggccttgatgcacatgcagatgatttgctttcataatataaaattaaatggtaatgtcagctgtattactactgtttctatatttatgattaattactagcagtacaactcccagaaggaaggagatggatccaacagcgatgtaagcaatccccaaaaatggattttttcctcccatccatgaaatagtgctcaagatcatccgttttcgtccatcaaaataatgtacagggtaatctgaagagggttgtatgtgacattcaaagagtatcggccagctggtaatgttggatgtaaatcacttttcctttctataagacgatacaacttgcgaaaagtaggtaatgctgcagtacgcatccaaacaataaaatcctcatttatgaatccattattatctgggtcagaatccagcatgtaaactggtttaagccagttcacaggctttgttgtaccttaaaag

SEQ ID NO: 4189 - DNA, 964 bp, Homo sapiens
ggattagtgagttttttcataagacaaaattcaaaaagattaatggatctttactgaaatgaaattcaaatacgagtatttgtcagttgcataatatgcactgctattttaatgttccacaaaattttccatttttacaggccattactgagtcttataatttatttagacctgttctgttgtgtagagtgtcacatttgttttcattagtaagtataaacacactagttaaaagtgaaattgcttatacctgtactgataagtgccaccagtagagggcggcagtgaggcactagaaagaagaaccaactttactgtcagaaattgcagaaaaccgtcaagatgggggttgatgtgaatgacggcaaacatttgttggtgttggcatcctcattaacacccagactggcttattttatgggccagaagctttgacataaacattgtcacagaattttcagataatctgataatgtacttataaagcaaattttgtggaaatttctggtaagactgatgagaatcaacattaagagatattctaaaaattttacattatttcaaagagacaagagtatgaattaaaattaagcatgctgttcttgtcacttcaagagtgtaggcagagaatttaatactttagagatgacaaaaggcatcttaccttctttgaacactacagatatccctgaaataaaaagaaatatttccaacttatcaacagtaagcaatgcacaggattaatcaacaagataggttacccagatttagcttgcatctgcttttataaacatttaacaacaacaaatattttttgagcacctactatgtgctaggagttattcaaggtactgaggttatagaagggaacaaaacaaactcatttcctgccttcttggagtttaaattatagtgaggaagacagatattaaacaaagctgcataattaattcattagttacaa

SEQ ID NO: 4190 - DNA, 686 bp, Homo sapiens
ggcagggtggcatgtacctggagtcccagctactcaggaggctgagggaggaggatcccttgtgcccaggagatcaaggctgcagtaagctatgagcatcactgcacgacagcctgggcaacagagactctctatcaaaaaaaaaaaaaaaaaattagtaggaagggcaaacagctaaatgtaactactccacatcctttttttattgttcccctttctcacgaacaaaatttccatcctaagtagaattccccttcagaaggcttacattcaaggggatacagtactaatgaaaatgtaagtgctctgcctctttttcagctatcagtgatataggattctaggcatggcagtagcacatcgctttacacaggggttccactgacctaaaaatctactgttgaggaatcttaattaaattgataagttccatttctgttgaagaatatagccaacatgctaatgaactcttttctcagttaattccactaattagttatctcttcttgttctgccagaatcccaacccttttacaatctactcatcaaatccatcaggccacatattatgccttcctagaggaacacttttcgtgatgacactttgtaaacaaggcaatctgatgctgcctgttctatcttcccagatctagttgatagttcaaaacatcaacattaaccacaag

SEQ ID NO: 4191 - DNA, 2595 bp, Homo sapiens
ttcgatattgggagaaatatcctctccccattgggatattaggaacaatatcccagggggatgtccaccctctgcgatattgggagtaatatcatcctctatttccctggatgttagacacaatatcacaaaaaggtgtacaccccctgtgatattgggagtaatatcctctccttccctggatattagaaaacaatatcatcaggggtgaacaccccctgcgataatgggaataatattttctctttcacaggccattaggaacaatatcacagggggtgtttacataccttgcgatattggaggtaatattctctgcccccccccccccccccggaatattaccaacaatatcaaacaggggtggtgtacaccccctgtgatattgggattaatgtcattctctccacccctggatattaagaacaatatcacggcggggggtggtacacccccagtgatattgggaataatgttatcctctccttccctggatattaggaacaacatcacaggggggtgtacaccttctgtgatattggaagcaatattatcctctccccagctggatattagaaaaaatatcacacatgatgtacacccactgtgatattaggaagaatattacagggtgtacacccactctgactttaggagaaatagctccctaaaatatcacaagcagtatcacagggtatacggtaatatctccctagggtattacaaatactatcacagggtgtacacccactgtgataacaggagtaatatgtcccaaggatattacgaataatatcacaggctgtacacccactatgacataaggagtgatatctccttaggatattacaaataacatcacggaatgtacacccatggtgtgcacctaccctgatattaggagtaatatctacccaggacataaccagtaatagcacagggtgtacatacatgacgtacacccactgtgatgttatgagaactgtctccctaggatattacgaatgacatcacagagtgtacacacatggtatacacccactgtggcactaggaataataactttctaagatactacgaatagcatcacagaatataaacacatggtgtacacccactgtaacattaggcgtaatttctccctagggtattatgagtaacatctaagtgtgtacacacatggtgtacacccactgtgacattaagggtaatatccccctaggatattacgaataacatcacagggtcttcacacattgtgtacacgcactgtaatattaggaataatatctctgtagggtattatgaataatatcacagggtgtacagccactgtgatattagaggtaatatatctctaagatattatgaatagtatcacagggtgtacacccactctgatattgggagcaatatctctctaggatattacaaataatatcacagagtgtacacccactgtgatattaggagaaatatctctctgggatattacgaattatatcacagagtatacacacatggtgtacacccactttgatattaggagtaatatcttcctaggacattacaaattatatcacagtgtacacccactgtaatattaggagtcaaatctctctagcttattacaaataatatcacagggtgtacacccactgtgatattaggagtaatatcttcctagggtattatgaataatttcagagggtgtacacatatggtgtacactcactgtgatattaggagtgatatctacctagtatataacaaatcacagggtgtacacccactttgatattagctgtaatatttttctaagttgttacaaataagatcacagggtgtacaaacatggtgtacactcactgtgatatcaggagttgtatctctgtaagatattatgaataatatcacagggtgtacacccactgtattattaggagtaatagttctgtaggatattacaattaatatcacagggtgtacacccactgtgatattaggagcaatatctttctaggatattacaaataatatcacagggtgtacgcccactctgatgtcaggagcaatatctctctaggatatcaaaaataatatcacagggtgtacaatctctgccttccaggttctaagggattctcctgcttcagcctcctgagtagctagggttacctgccaccacgcctggctaatttattttcactagagactggtttcaccatgttcgccaggctggtctggaactcctgacctcaggtgatccatcagcctcggcctcccaaagtgctgggattacaggtgtgagccatcacgctcggccaagagttatatattcaattaatttggaaacacagctcccatatttgagtgtgcatgtacttttatgaagaaatgatgtcagaaaacctaaggatgataattaatatgaaaagtaactggcatgttaaaaggtcttccgattaagaactgtataaggtttgatttcgtttttagataatgctgtcctagctcttgtatcgtccttttaaatattctacatcaaaggaatttgtagcacagtgtcagaataaaaaaggtgtatttcactgc

SEQ ID NO: 4192 - DNA, 2675 bp, Homo sapiens
agcgcccgcctggcaggacgactgagcaaggctttggaaaaccagagagattagagcgcagaatggggaaatggagagagaacctgaaagagccccaaactcgaggacctattgctccccaagaataacatcttccagaactagacagaaactaagcgtctggaaaccctgaaatccttggaggagtagcatcatcctgaccctctgtgctccttttggcaaaggacttgcttccattgtttgtttgttcaattgtctgtttgttaaataaataaaactcttttcatatatctttaaaagtacgttggttctattattttatgattacaaacaatgctgcagtcatcattcttctacacttgtcattggccactggtatatttccatagggtggaggcctggagagcagttgttccagcatagtgcttacatagattttatttcattccgttttctttcctttgttgctttattagctataacccttttcttatttcagtggctgctttagggtttctgggatatgtctttaatttatcacagtctgctttcaggtgtcattatgtctccctttctggcctttatcctagtgttatgtaattttactttatacattataatccttgtgattcattattattacttttatttattacaccaaatattttttaaaagatttaaattctaagaaaatgtgtagtacatgctttctaaatgccatttccagtattcgtttctttgtataggcccacatttttatctggtatccttttgcctctgcctggaggacttttaataagatttcttgtaacgtgggttggtgaattgttttagcttttgtatgtttttcgatgtccttatttcactcacagttttgaaattttatttttgcatagaattccaggttaactttttttctctgggtactttaaaaatgttaccatttatgaagcattgccattataatatcatctttctttcctgtgtttgtaagaatggcataaagccggtttcttgcggtggttatataattttcagaatgtgtacttaaatttaaaatattaaattttactaaaaaactaaaaatattaatcatgaacatcctagattcatcttaaattccaccaacagtgcacttaaaatgtgcccaacctgagggtcaaacctacctgctgacgtgtaatttgtgtttgtgagacattctcaacagcatttgctttccctagctgagtgattttcctcacatctgaatgtcttcagtacaaaaggaaacctttgtctttgcaaaaatactttcaaatattcttacttcaagtaagtgcattaaaaacaaacttctcagttgcatccctggaatccgtggaaagcccgggagagacagtcaagtggttcaggatcaagagctaaacaagggaagacaaagcgtggcttcttcactaggagtccagccaaagtcaactgatttggtctccagtggaggtcggaactcggttcaccagcgacgtgaggacccggcccagaggaggcggactttctcttcctggtgccttcagataggaaatctagaatttctttctttccctttgatctacttctaactctcccgttctatttcttcaagacctttttcggatccctactgcgaaggacctaaggggccgatgcccttccctaacggtccctccctggctgagtgtcttcggagcccaagctcacctgtaaggttactgccctccggagacagcgagaggaccaaggagggcggcgggtgcggtgggaaccacagagtcaccgcgcacctgcgcctcgcgggctcctagcaaattgaataaatgatccctgaagcttctctgcaggtcacagggaaggggagggtaggggtcgacccgcggaagaagcttcaagaagcatcgggaggacctggccctgcctctgggccttgaaaacaggcctggccaggctgattttgtcgcgtaggcccaaagaaaagtgtcaagggcggcccaaaccctgacctcgagattaaggctcttaaatgtctgacggttttgagactcgtctgtagaatcgatcccgcctgtatccggagaccggagactcctttgccaaaattcagagaccaagaaagagaaagattgggcagatcaaagtctgtaattaacccaaacaggaaacgtaatttttctgacaaattgtatgtgtgctctgagaaaaagactagcctcaaggagaatctgtttttttggcttgagtgtagggaagaatggaattgccaccaacaatgttgcgttgaaacggcaggtgcatcaggctgtagatgtgaaggaattaaaaatatttcaccccaaaatacatttctttgacacattttgagatgtctgttcagaaagccagctgcagaagtagccctgcaaagttgtattttgttggggagatttgcatctgtagggaatctgcattgatgcagccaagtctttctttgcccagatctaggaaagattaactgagagtctgacagctgtaaaggtctcaaagaaacttttagggtttactgtctctgagagctgctacctgtaaggtttcatttacatattaagaccacctttgctagctaagcctcctcttctctccctcctataacctgtcttgcccacaataaatggatatacatctga

SEQ ID NO: 4193 - DNA, 304 bp, Homo sapiens
agtggtcagctgtaggtggtagaggtcaggcaggcaaggcccttctgctcgggaagggagcttcaggctagaactctccaggacagggaggctcataacctgggagcagagagtgtgtatctatagtctgtggcatctgtgttctgcggttgtgctggggggagggactaggaaagggctagtcgagagcagagtgggcagactttaggacagaccaagaggaggagtgagggggaagcctagggggtcagagggtgtgtgaggggtgtctggacaacagagtgggggaggggctaacagccat

SEQ ID NO: 4194 - DNA, 583 bp, Homo sapiens
ctggcacactcaagggcactgaatctagcaatgagtctgcacttctgttatgagagtgggtttttcggccaggcgtggtggctcacgcctgtaatcccagcactttgggaggccgaggcaggtggatcaccacgtcaggagttcaagaccagcctgaccaacatggtgaaaccccgtctctactaaaaacacaaaaattagctgggcatggtgtatccacatgttcatggtatacctcggccggtcctagacctagtatcagactctgctgctcctcactggcataaaggcagaccctgaactgggcatggggacacagatgggtaacacgcaaaccacagggccctgatccgggggatgctggccaagccacgggcagtgcaatgcagtatggcaaaggaaggtttcctgtccacagtgcccctcaaggcagggccccccaggagcccactggccaggcccagaggtggggttagctctgcagtgtgaactcataggttctggtctcccagtgggagaggtccttgtccatcatgctacgctcagtgaaggtcacgtggccgtccgcatctaccaggatgat

SEQ ID NO: 4195 - DNA, 2118 bp, Homo sapiens
attttggttttacattaaaaagaaggcggacgagaagatgttgtaggtgacttcctagctgtgttaagttgctcctgggctgtgaatggtgttaatttctgaagtgggcggctccaaaaacttaacaaggaaagctcaggtaacggaggccttggaaagagactctgcgtcaggtcacccagcagagatcagcaatccttggctcactgaggaggtttggtaagttggcatcatcttcaccatgactcaaatgcacataacccggtggcgggggagaaaagtgggtgaacatcacatagcgacatcaaaatgctaatccttgccacccccctttgtttttgtttttacaaacgtattgttgttgtgtttgtttaatttactaggccagagtgccctgtatgtttgtaagcacaaatgtcctcagaggactcccacagccaaaaagaatgacagaggtgtatttgaatgatttcagtgaaactcttttaatactgatttcatgaaaatgtctggtggtgggttcttcctgtagcattactgcatatcatcaactagaatgcatcccccgcccttcacacatacaatttaacatgtctgaaattcggtgcaccttatgcaaacaggtctggtgaaatacagcatttctctgataatccccaaatgaccagcattaagtattccctaccttctatttttcacacaatacaaatgttttttttttttttttctttttagagggttgaatttttaagggtaagaaatgcatagtctgatgagtagatgattagtaagaagtctgtgcttaccaaagaaagaatttaggtttccttttttgtttttgtttttgaaatgaagtcacattatcacccaggctggagtgcagtggcacgatctcggctcactgcaacctctgctcctgggtttatgtgattctcctgcctcagcctcccgagtagctgggactgactacaggcacgcaccatcacacctggctaattattgtatttttagtcgagatggggtttcaccatgttggccaggctggtctcaaactcctgacctcaagtgatctgcccacctcagcctcccaaagtgctgggattataggcatgagccaccacacccagccagaatttagttttctaatactgaaagaaaaacttttttttttggtgacttcatatgatagtcttgagatgagcaccccaaggaccttgtaaatagtgggcgctggcactcagaacagcccatgtgagataatgaagcagccttccagacataagatcccagaatcagacacttatccaaggttcccctcctgcaatcagcgggtaggagtttgcaatgaaaacactccatgctatgtcccagagtgactcgttcatttatccgtgaaagcagagtccaaatccatgttcatgttaaatgtgcagaaaaatagcatcttgagagttaatgccacagaatgggcatgattccctaagccacatttgcctgattgagacagactttaacatttgcaaaacctccatgttatgagaccctataggtgatagtacatgatctgtagggatacaagtaaatccattaacaaacattttttgagcacctgctatgtgccaggctctgtgctaggctctgtgctagatgtagcataattaagaagtaattaggacagaaaggattgctgtccccacagggctactttagtagtcacagaagatattaaataatacattaacagagtaatgagtgggctgatgaagaactgtaaggagttaagagtctaaaacaagaaaacctaagctagccagagtggctcacgcctgcaatcccagcacatagggaggccagggtgagaggatcacttgagctcaggagttcaagaccaacctgggcaacataatgagacctgtctctacaaaaatttaaaaattgtcatcccattctctactggaaaataaaaaattagctgggtatgctggcacgcacccatagtcccagctacttgggaggctgcagtgagagaattgcttaggcctgggaggttgaggctacagtgagccaagattgcatcactgcagtctagccagggcaacagagcaagaccctatctcg

SEQ ID NO: 4196 - DNA, 529 bp, Homo sapiens
agggtaggtttcctagaaaagcagtgtagggtggcgatttgggaagacggctccggtcgatattgggttcccgagcagcccgtggagcagtgggaaggatggaacggtcaattggaggcgccctatacacatcgtcatcgttactgtgccaagtggtcgaaactaggatagaggaatgaataacttccgagaagtcaccaccaatcaagagctgattcagaagagcagagggactcagtgaagttccagaactggcctgatagcagccactacatgattaagaaaaaaacaagcagctttgttgtaaaaaagattggcttcatggtttttataatcatgaatttctcctccatgttccaattgtcacctgatttttaatccaagaatatcaaacttgatgtacccctttgtttaactgaaggttgctttctcacttggtatccctttctttcaaaatttaactttcaggaaataaaggtaaccagtttgctatgaatgttaacacatagccttctggacacaattagaa

SEQ ID NO: 4197 - DNA, 432 bp, Homo sapiens
ggcgcggactttgtaaacacttcgccactgcaggggtggagactggctctgttcggatgccggccgggggggagaggtgcaatcctctcctcgcggctggtggttgcgaccacccccactccccaaaggcaggctccggaggcggcgggacagagcgcctgcgaccccagtcggtgctccggggaggtcacctgacgaggagttgttcttacagattcaagaatcacttttgaaagccttcattggatccttgtgaaatgaccgattgactgcttggatgaactcctgaagtgtttctatggaggacagaccaagaggaaacttaatatttcctctcaattttcctgtgaaactaaaactgtgctaaaaaacagtctatttagaaaaaaagaagaagatagttgcctatagaggaactaaagaatgttgtgg

SEQ ID NO: 4198 - DNA, 1776 bp, Homo sapiens
aggagctctacggtgactttgaagacttggaaacaggggacgtgcacaagggaaaatcgggccccgatactcagaatgaagatgtagagaaacaaggaagaaattgaccctgacgaagaagaaagtgccaagaaaaagcatttggataagaagagaaaattgaaggagatgtttgatgtggaatatgatgaaggagaaagcacatattttgatgatcttaaaggagaaatgcagaaacaagcacagataacagcatacaggtttccccccccgaccccgtcatgtacagctgaatcatgcagaatttgaagatcaagatgatgaagccagagttcagtatgagggttttcgacctgggatatgcgtctgaagaaacatcgctggtataagaaaatcctcaagtcccgagatccaatcatattttctgtagggtggaggaggtttcagaccatcccgctctgttatatcgaagaccacaatggaagacaaaggcttctaaacctgattttcggatagctgccacaggagttgtccttgatctggataaatccataaaaattgtgaagaaattaaagctaactggttttccatataaaatttttaagaacacttcatttattaagggaatgtttaattcagccttggaagtggccaaatttgaaggtgctgtgattcgaactgtcagtgggataagggggcagatcaagaaagcactctgagctccagaaggagctttccgggccagctttgaggataagctgctgatgagcgatattgtcttcatgcaaacttggtatcctgtttccatcccagccttctataacccagtaacatctttgttgaaaccagtgggtgagaaagacacctggtcaggaacgcggaccacgggccaactcaggcttgcccatggtgtcagactaaaggcaaacaaggactctctgtataaggttccctctcccagcctgtgctgactcagccatcttcccattctgcatcttctggagcatcagtcagactcacctgcatgctgagcagtggcttcagtgttggggacttctggataaggtggtaccaacaaaagccagggaaccctccccggtatctcctgtactaccactcagactccaataagggccaaggctctggagttcccagccgcttctctggatccaacgatgcatcagccaatgcagggattctgcgtatctctgggctccagcctgaggatgaggctgactattactgtggtacatggcacagcaactctaagactcacacagtgctccagacccatgaggaacaaaacactgcaaagtcattcgccaggatctcctgcagactggcattcagtgatggagaacagactcctaggtgagatccctggtcacaggatccagatgactatgactgcaagtctggaaaagaagagacagaacaaagatttaccagcataaccctctgagaatgtgccccagccatcctggagggaagagctccctattgacccagcactgcagaatccacagaggaaggacagctctggccaccagggagcagccacacgacaagagaggacccggtgtccccacagggtcctgggcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcaggg

SEQ ID NO: 4199 - DNA, 1172 bp, Homo sapiens
atgactaaatcagagaaggaccacataatccaaggatagggacaagggaagaggatgctctgccaaactgcccctgctgcgtcatagtggaccagtttcaatgatccagactgtcagtcaccccatccagcctcatcctcatctggacccatttctcaccacccaatcagtttcaatgatccagactgtcagtcaccccatccagcctcatcctcatctggacccatttctcaccacccaatcagtttcaatgatccagactgtcagtcaccccatccagccacatcctcatctggaccagtttctgaccacccaatcagtttcaatgatccagactgtcagtcaccccatccagccacatcctcatctggaccagtttctgaccacccaatcagtttcaatgatccaaactgtcagtcaccccacccagcctcatctggaccagtttctgacgacccaatcagtttcaatgatccagactgtcagtcaccccatccagcctcatcctcatctggacccgtttctgaccaaccacccaatcagtttcaatgatccagactgtcagtcaccccatccagcctcagcctcatcctcatctggacccgtttctgaccaaccacccaatcagtttcaatgatccagactgtcagtcaccccatccagcctcagcctcatcctcgtctggacccgtttctgacgacctaatcagtttcaatgatccagactgtcagtcaccccatccagcctcatctggaccagtttccgacgacccaatctgtttcaatgatctggactgtcagtcaccccatccagcctcatcccagctcttaactccttctgcatagttcagtttcctttctggcaactaattcccaatttcctagaaaaccctgattttctgatttaacactgattcgaatccactttaaaccaaaggaaacaggccgggcgtggtggctcacgcctataatcccagcactctgggaggccgaagcaggtggatcacctgaggacaggagttcaagaccagcctggccaacatggtgaaatcccatctctactaaaagtacaaaaaaaaaaaaaaattagctgggtagctgggtgtagtggcacatgcctatgatcccagctactcgggaggctgaggcagaagaatcgcttgaactcgggag

SEQ ID NO: 4200 - DNA, 547 bp, Homo sapiens
atgacccaccaatcacatgcctatcatatagtaaaacccagcccatggcccctaacaggggccctctcagccctcctaatgacctccggcctagccatgtgatttcacttccactccacaaccctcctcatactaggcctactaaccaacacactaaccatataccaatgatggcgcgatgtaacacgagaaagcacataccaaggccaccacacaccacctgtccagaaaggccttcgatacgggataatcctatttattacctcagaagtttttttcttcgcaggatttttctgagccttttaccactccagcctagctcccaccccccaactagggggacactggcccccaacaggcatcaccccgctaaatcccctagaagtcccactcctaaacacatccgtattactcgcatcaggggtatcaatcacctgagctcaccatagtctaatagaaaacaaccgaaaccaaataattcaagcactgcttattacaattttactgggtctctattttaccctcctacaagcctcagagtacttcg

SEQ ID NO: 4201 - DNA, 6109 bp, Homo sapiens
cctcacaaaggcggcggaaggtgatcgaattccggtgatgcgagttgttctccgtctataaatacgcctcgcccgagctgtgcggtaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtttctctttttcaggcttatactcatgaatcttgtctgaagcttttgagggcagactgccaagtcctggagaaatagtagatggcaagtttgtgggttttttttttttacacgaatttgaggaaaaccaaatgaatttgatagccaaattgagacaatttcagcaaatctgtaagcagtttgtatgtttagttggggtaatgaagtatttcagttttgtgaatagatgacctgtttttacttcctcaccctgaattcgttttgtaaatgtagagtttggatgtgtaactgaggcgggggggagttttcagtatttttttttgtgggggtgggggcaaaatatgttttcagttctttttcccttaggtctgtctagaatcctaaaggcaaatgactcaaggtgtaacagaaaacaagaaaatccaatatcaggataatcagaccaccacaggtttacagtttatagaaactagagcagttctcacgttgaggtctgtggaagagatgtccattggagaaatggctggtagttactcttttttccccccacccccttaatcagactttaaaagtgcttaaccccttaaacttgttattttttacttgaagcattttgggatggtcttaacagggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttattaaaggggaggggcaaatattggcaattagttggcagtggcctgttacggttgggattggtggggtgggtttaggtaattgtttagtttatgattgcagataaactcatgccagagaacttaaagtcttagaatggaaaaagtaaagaaatatcaacttccaagttggcaagtaactcccaatgatttagtttttttccccccagtttgaattgggaagctgggggaagttaaatatgagccactgggtgtaccagtgcattaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaaacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccgaaataaatgagagatgagttgggatcaagtggattgaggaggctgtgctgtgtgccaatgtttcgtttgcctcagacagaaactttgtctgcgaacactctttaatggaccagatcaggatttgagcggaagaacgaatgtaactttaagaggcatttcatccttcatgaagccattcaggattttgaattgcatatgagtgcttggctcttccttctgttctaacttcacagagaatgcagttgtcttgacttcaggtctgtctgttctgttggcaagtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgaagggccagagaagccagacccagtaagaaaaaatagcctatttactttaaataaaccaaacattccattttaaatgtggggattgggaaccactagttctttcagatggtattcttcagactatagaaggagcttccagttgaattcaccagtggacaaaatgaggaaaacaggtgaacaagctttttctgtatttacatacaaagtcagatcagttatgggacaatagtattgaatagatttcagctttatgctggagtaactggcatgtgagcaaactgtgttggcgtgggggtggaggggtgaggtgggcgctaagcctttttttaagatttttcaggtacccctcactaaaggcaccgaaggcttaaagtaggacaaccatggagccttcctgtggcaggagagacaacaaagcgctattatcctaaggtcaagagaagtgtcagcctcacctgatttttattagtaatgaggacttgcctcaactccctctttctggagtgaagcatccgaaggaatgcttgaagtacccctgggcttctcttaacatttaagcaagctgtttttatagcagctcttaataataaagcccaaatctcaagcggtgcttgaaggggagggaaagggggaaagcgggcaaccacttttccctagcttttccagaagcctgttaaaagcaaggtctccccacaagcaacttctctgccacatcgccaccccgtgccttttgatctagcacagacccttcacccctcacctcgatgcagccagtagcttggatccttgtgggcatgatccataatcggtttcaaggtaacgatggtgtcgaggtctttggtgggttgaactatgttagaaaaggccattaatttgcctgcaaattgttaacagaagggtattaaaaccacagctaagtagctctattataatacttatccagtgactaaaaccaacttaaaccagtaagtggagaaataacatgttcaagaactgtaatgctgggtgggaacatgtaacttgtagactggagaagataggcatttgagtggctgagagggcttttgggtgggaatgcaaaaattctctgctaagactttttcaggtgaacataacagacttggccaagctagcatcttagcggaagctgatctccaatgctcttcagtagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgactactaatctgtcttcaggactctttctgtatttctccttttctctgcaggtgctagttcttggagttttggggaggtgggaggtaacagcacaatatctttgaactatatacatccttgatgtataatttgtcaggagcttgacttgattgtatattcatatttacacgagaacctaatataactgccttgtctttttcaggtaatagcctgcagctggtgttttgagaagccctactgctgaaaacttaacaattttgtgtaataaaaatggagaagctcta

SEQ ID NO: 4202 - DNA, 1759 bp, Homo sapiens
agctctggttctgacaccctcagacacggccagctgaccccagaagaaaggtaggtgttgggggtgcccatctctttgggaaatttgaaggaatcaaagaaggtggaggaggggaggtgacctggagcccggcatgtccttgtggccgggccacacccaggctggccccagggtgctgctgctgaagcccaatgggaacaacagatttcttttgagacacaaggaactcagaggttgtctcactcaccctgagtctgagcacctacttgtgccaggccctgtggggaaactgaggccctgggaggggaatgacttgccagggtcccgtgtcaggaggctgagcaggcagatcataggacttcacgtctctggccctcacctctgtccctctgttcagacctctgagctgatagagaagaaacaggctgtgctgtgtccctaatgggaaacatggctgagacaggggagtgagaaggtcgcattgcagaatggtacctgtggcatgatgccagctttgcaatcatgagattcaaaagccacactgtggaattgtgagtataactacaggagtgagagcttaggtctctgtgtttgtagaagcagaatcaaacctggacactgttggattattaaaatcacccatttttgcttcaatatcagagtcacaagggcagatgttggcctcccctctgccctccaagagctgtgtgactctgggcaagtcacctcccctcccagcctaagatttttcccctctaaaaaacttgatagagctgccaaaagtccatgaaatcaggggggtaatttctgtgaaatatgagtcatggtcttatttgttcttcaccaaaaagagatgcccatcaagatagaaagaaaaattaaattcaatttctcaactgaaagtgaaactgaagctgggccatgtcatccagaggctggttgcttttagttcaagtaatgcctcctgcacctgggatttcagccaggctgtgccagggagggcggagggcatccaggtcagtcgtagggggtgcagctgggaacacaacagtgtccccattgaatgttcagagtctaaaggggagacagaggcccaaagagccacatacaggtagagctccctctggaaagcagagtgctcagggagcctggggagggttgggggccgccgcatggaccaggcagctttgggtgggtctctgaggacaggtgacttgcacatggtggggacagtgggggggacattccagggcgagggagcagctgagtgaaggcctgaggctggggatgggagtgggaggagtagatgggctccaggaggcaccgaagcagggcgtcagtgggtgcctggacctaaggtgactgtggtggcagggagcggtgaggaaggtggggtccagagcatcagagggcctgtgtgccctgctatggggtttgaacttgaccgtggcttttcactgaagattcctcagaagggtgcagtgccacggctgaggcctgtaattcagtgctgtgggaggcagaggcgggagaatcacatgatgctaggagctcaagacagcttgggcaacacaggagatgctgtctctctgaaatgaaaaattaacaaattagtcctgcatggtgccgtgtgcctgtagtcccagctacctggaaggctgaggcagaaggatcacttgagcccaggggctctaggctacagcaagctgtgatagccccaaagcactccagactgggtgacagagcaagacagtttctc

SEQ ID NO: 4203 - DNA, 44696 bp, Homo sapiens
agaccagggcatctacagctgcagaggccagggtgctctgagacaaggatgagatgaatcctcacaggcttagggaaagcagacactgaggaggaggccagacacagacatcatgagaggactgtgcagcagctcactggagcatctcaggcacccaaggaactcgtggaaacaactgtgcaaggcccaggtggaggaatagagaacctgcagttattctggaaggtctgcttattcactctgttcctgagcacatccccattcagccctgcatggtgcagtatcttcctctcctcccctggactgtacactactgtcaatctcatctgtccagtattagatgtcatatcttgggccatccccataaccgtagtgtggaatccctccctagtcaatgggatgaagaggagacaatcaaggtatctacatattttacatttttcctctcagatcaattagtacaactgcatgagattttttacatgtcttttatttccagccaatttactttggtcaggagaatgggaatccaaaaatgtacatgcaaaatgtgtttcattatctgttgctagttgaaaattaatcaataggtttttgctttgaactttctattagtcataggtaaagtgattgaaaagtgagggaatagggtggcttgacaaaggatagaaaccctcggtcagaagccagggctccctgaagatcattcaccaagaatattcagaaactgaataatggtgacaagaatgtctcatcacatgatataaatgtgaacaataccaattaaatactttataaccagcccaacatataaatgataaagaatcgtcacatcacgagcattgtcagtgatcctgccatgatgtcactgtgatcgcctgctctttggtgcctcgttggccacaatgatatcactgaacaatacatcacaggctgcaagatgtggcagatcattcctcaatcattacccttatgtgacttttaaaaaagatcaatctttaagaaaatcagttagaatgttatattttagggatgtttcttgtgttttgaatccttgatatataacacttcctttgagttattttagtaatttcttttgtggccttggacagttgcaatcgcaatttatgtttcaaaagtgcttccatatctgcttaattcattctgacatcataggtgagtctagacttataatttattcacaccccaaaatagtgatagtaatagaacctagagaggttaaaatgatttatgccccaagtttacaaagtcagatgtacacattcttgactgaaagagattttctgattcttaaattcagtgttctttctactactcagattattttacattttacctctttatatttcagttcttaataaattgactagactagcaaacgtctgggaaaaaatggaatgttgaagcttgaaaggggctttagtgatgatcccaagtgtcaaagcatataaaagaaggaagaaatgaggtttattggataatgactgggattgaggaatattaataaaagcacattgttgatttcacagtgttctgtctgatccattcctatatgatggataacattctcaaactatactttgttccatccaatatgcttaaaatacttttcacactgaagttttaatttgcaaagtgctaattaaacaaaagttagcgcttggaatggctttatggttaagaaagctgatatggattaactctgcattaaaaatagaaaaattaaaataggatggagttttagaatatacttgttccagttcagctggctgatgaggcttcatccttgtcccatgcagtgctggagacagcatctttggtatgtattctcagctggtactcttccccttatgtctttcttgggcactgtcgtagtccatttgggctcctgtaacaaaataccacagactgggtagcttataaacaatgtaagtttattaattacagttctagaggatgggaagtctataatcaaggcactagcagattcaatgtttggtaagggctcactctctggctcatagatggtcccttcttgttgtgtcctcacatggtagaagaggcaaacaggctctctcaggcctcttttatagagggcactaatcccatgtatgaaggctccaaccttattacctaattatctccaaaagatcccacctcttaatattatcacactggaaattagatttcaacatatgaattttgagggaacacaaatattcagaccatagcaggcacgaaggggcatcagatgcccatgggtatccttctaggactacaatgaaactcctcaacaacactacacacaaatctaattcagagctcttaggatattataattccagctgttcatttaagctggctgatggcactcaactgctcagttaagacaagcttagaggaggagaagagttagcttcctttgccttgggtagtctgtattctttgcttagtataatgaagtcaagttttctgtcttctaattccatgacaaggcttgccatcatgattgcttctattgaagtaattataatgtgtcctaaaaagacttatgtttctgagcaaaccagaataaaaggagctagatttactgtcctactcaagacagcttaaactctgaacaaaaatatagaaaacaatggcactcaagatattagacatcaagcaatgaaggacaatgatcactgaaagatgggaaacaaatcagatgaaccagataattgcccaagaaactttctctattgcatgtgagaagtttccaggttgcagcgcagggagagagaacccaggaagagcccagttgtctcactgagtttaggagacatagctcagaatccaggaagccaaagtggctagaatttacaaggcagaatactggaaagaagagagctccccagagacccaactccagcgatgtgaaaagagtcctcctagagtattcaattgaatgcatgtgtgtgaggaaactacccaaggccagggaaagacccatctgaaaggactaaagacagcagtccttagacttcacaaagcctgagaaaagtgccaattcccaacagcctgagtgggaaagatctaacaatttggacagaattagagtattataaaggatgttgcatcagtaatggggaaaaattgaccctaagttagatgcagctctggttgagcctaatgatagtcaaaagcaaggcctgaaacataaaataacttaactgcatccaaaagaaaactcaagaataattacacaaattaaaaatatccagcacccaacatagccaaattcacaatgtctgtcactctatcaaaaattactgggaaaaaaaactaggaaaataagacccataatgtggagaaaaggaagtaatcaaaacacacccagaaatgccacaactggtagaatcagtagacaaaaacattaaaacagttattattaatatattccatattttccagaagctagaagacagatttaacatgttaaatggagacatggaagatatacaatagacccaaattaaaaattcagagatgaaaactataatgtctgaaattaaaaataacctgaataggattactagcagatttgacattgtagaagacatcagaggggattaatagacttcaagacaaaacgaactatccaaaatgaaagatggggaacaaataacttaaaaaaaaccccaaaacaataattgaactctggcgcaaatttaagcaaccaaatacatgtgtaattcaagtccctaaagaagtggtggcagggaggctaaataaccatttaaagaaataatggtcaatatttttccaaatttgatgaaagctaaacccacatattcagaaatctcaacaaacctcatacacgtgaaatatgtgatgaaaactaaacttagttaggcacagtataattaaattgcttaaatccactgatagagataaaatcataaaagcaaccagagaaaaagacatgttacatacagcacaaagataaaggtgacctcagatttatctttggaaacaatgcaagctagaagacagaggaacaacatgtttaaagtgctgaaagaaaaacaaatactatcaacctataatatttttattcagtgaaaataactttcaaaaatgaaggcaaaataaaggcttttccagacatacaaagctgaaagaatacatactggcagacctacactataagaaatttgaaagaaagtttttatgataccatatggaaacctagatttacataaaggaaggaagatcaccagaaatgatcactacatgagtaaatataaaaactttttcttattatttaaatgtctttaagaggtaatccactttttaaagcaaaaaaaaatgtattgtgaagtttcatttttgctttaaataatgacaacacattttgaagtttataacatacatataagaaaaatgtatgactgccctggcacaaagcttggaggggaaaaatggaagtataattttgttaggctcttatatatgtgaatgagtataatattacacaaagttaaaatacataataaaaatgtataataaaagctgtaaaggaacacagcaaagaatttcatttgataaaccaacaaataagaaaaaataaaattattaaaaatattcagttgaagagaaggtagaaaagaaggaaaagagacaaaaaaaatcaatgggtctaaaagaaaacaaatagcaagatggtagacttcaattcaattgtattagtaatcacattaattataaatggtctaaacattccaattaaaaggtagattgctaaattggattaaaaagcaagctccagctgctggtgatctccttgtaggcaaggattcatgtcttctttaacttggtatttcttgaatatagaagagtgctagacacataaagctcaataaatgtttgtaatattagtactgtgataacatttacttattcaggcaaggctttgcaaatataatacgccattcaaggcttacatcaatcctataagataaataaggtatgtattttccccatattacagatgaggaagtgagatagaataaataattgcctacatattaggctgctgagttattaattctatttctgcactaaattctgatcataatttagggatgattcagtttccaatcattaaggtactccatgaggcagatggtgcttcttatctataacttccatttttaggtatatgagatctgaataagcttctagatgaatttctggaagtgtcaatttaagagttacaaaaaaaggagacatatattgatataaattcttggttccaaagatgataagtatttttaaatttttctccctatttcatatgaccaagcttttgagtctcatgttgctccaaataatagattttcaaaatccctgagatattaattcttctaccatcaaatataatggtgagaaaactacaatagcatctataaaaatgtaatccaccatattaggcctaagcactgtaaacaacatataatttctttcctctcacatgtatatttttcttctgaaagtttcattctgaaagataagatttccacttctctacacctgcattcttttttttttttttttttttttttgtttagtagaggtggggtttcactgtgtcagccaggatggtctcgatctcctgacctcgtgatccgcccgccttggcctctcaaaatgctgggattacaggcatcagccaccgcgcctggccatctcagggtaatctttttttaaaaagaatttttttttaattatactttaagttccagggtacatgtgcacaacatgcaggttttatatacgtataaacatgccatgttggtgtgctgcacccattaactcgtcatttacattaggtatttcttttagggctattccctccctccccccaccctacgacaggccccagtgcatgatgttccccgccctgtgtccaggtgttctcatcgttcagttcccacctatgagtgagaacatgtggtctacacctgattcttcatatggagtttaatttttgaggttctcttatggccagaagttagaaaaactattttcttaatctttgattctataatctgctttgaaagcaagaataataccaatgtgcttcacaaattccaaattgtgactgagtgttctttagatttatttaggtcctcaaatagccattgcctgccggctcccgttgaaatctgtgatgctgatgaaagccatgagcccaggaagtgctggtctggccaaaagatgctgctgtcagcagcagtgggggatatctgttgtgctcatctgagttttaaatcctgaagcttctttaagtgaaaaggtgccaaggtgctggaaagattcttcattttcactcagtaagaggtaggttctataactatttttttaaaaacactttccagcacggaaaaccctatctctactaaaaatacaaaaaaaaaatagctaggttttgtgggggtggggtggggggggggacctgtaatcccagctacttgggaggctgaggcagtagagttacttgagcctgggaggcggaggttacagtgagccaagattgcaccatctcaccattgcacttcagtctgggtgacagagcgatactctgtctcaaaaaaagaaaacaaaaagaacaaaacaaacaaacacaaacaaaaaaaaacactttccagaagaaaagtagagtttcttcatcatgatggtaatgttctcattagtcatatagatgtgactgaagtacgggagttgcagacattttgccttttggttacagagaaaactaataatgagaccaaagactggagacagaaaatagggctaagtttagaaagaatggaaccagatcttctactcttggcagtgcccttgccagttccccaagcaaccttcttgctctctcctcagaacccctagaaccatatggggaatgtacactaaggatccatggtcctgaccaccttccctcttcaaagtcaatgagttcaggggtcttatctctttagaaagttgatttctatcatgaaaacgacccagttgtccttatagtgaacacataaaccagtgattaacaaatggaagttggagatacgtttgagaccaactcacatgctggcttgaaaattgtattctgactaaactgatttacatcttcttttcaaatacctttttattcattatcgtatactcagcttggctcgggaatttagtgccaggcttctatagcaaatgggaatagggattgctgaagttaatctctgctaatgtgtaaattaataaataagcttttctgaaatgcttaaatcttttgctaaaggctcctaagaagtgatactaataggaaagtgcctatggagcaatgctaagaaatttcagcaagaaggagaagctcagacctaatgcaagagcatggcagacatgattctggtcagttaaatgctcaaatttactaatgcactttcacatgtagccagttacatttaagtggcttttaaaaaaaaatcaattctataattaagtttcacagcatgaagacataagctagtagttatgttttaaattaataaagtgatgaattattgcttagagtgagcacaccaggagagactaatgaatgttttgttgaggtaaactagtgtaaaaggaaaaagacacaggacatggcttgccttggctcagcaaaaaagggatcaggggaggccaggctcagtgtttgaagagtctttcatttcataaagggttttagagtgcttaaagagagaaatgcatctcttcctcttccttcttcctccttccctccttatccttcttaaaaaaattggtctgtggttttggacaatttaaatttgtaataactgttacaaactgtaatgtagaaaaagaaacagaacccagacaaattggttaatgtataaatgcattttttgcaatattggcttgctccagtattgtttctggtgtggcaagcctatggagctcagtgggaagacaagctcttcctgctgcccacaccctgttctctcacagacaaagatcttggaaaggcagaccttggcaggtgtctgctctgcacacaacgaaggcagatgacctagttgaagtctgtggcaaatgccttccagcaatgctaccaaattagcattaaaacaaacaaacaaacaaacaaaaactctaattcaattttttttcccattaggctgaaactctgatcattgcaaagcagatggcgtaaagcaatagagtaggagtgggattattttctagcatgaattaaattgcttataagccaattcctaggtaatggaagtctgtagagcatcatcatctgtttgtttgggatctggtcaagtaacatgccaacaatggtattaaaaagaaaaaaaaagaagcagttgatagaaatcaggaggaataagatttcgacacaaagactgatggtctgtttagtgaaatgaaaagagacctgagagttagaagacttgggctcaagtcctgactctatttactacttgcttcctaactgtgccttattaagccacttaatctctccaatcctcagtttcttcatctataaaaataataataataatggtgagtatttccttgggttactgtgaagatttcacaacaatttctttaaaaaaaagctattttgttgtaatatcggaatgattaatagacactaatatctttgtaaggctttagtcttcctatctttctataagatgcctactttagattatctgacctgaatgtttgacttaacctttttgaaagaagagataaacaagtcttgtgattattcaggcatctttagtttaatgaactcctagataatttgggaaatcactgcaactaactagctacttcttgtttgtcttgttctacattcatttccaagatatcctctgtccaaacttgggaagaagtcagagctgatagggtttctttgtaaacggaattgtattctgtatagtttaagagaaagagtgagcaattaagcaacagtaacttactccaatatctgagctgataaaaacctcaatagtagatgagattatggtcctctcatacgctattcattctgtttttacaagccagtggtttaggatgttctaagtcccaaatggagttggaatattattttctagtgtgtgactttctagtcaactgaaggtatatctgtatcccggagacttatttgattatttgggagggcttattataaaaggattgcagaaagcatttacacgacttgcaattatatctttttttgaaacggagtttcactctttcacccaggctggaatgcagtggcatgatctcacctcactgcagcctccgcctcccaggctcaaaggatcctcccacctcagcctcccgagtagctgggaccacagatgtgcaccatcatgcccagctactttttttgtatttttggtagagacggggtttcaccatgttgcctaggctggtctcaaactcttgagctcaagcagtctgcctgccttggtctctcaaagtgctggattacaggtgtgagccaccatgcccagcagcaaccatagctcttacgagatttgttcccttgagtttcatcaacattttcagatttgttagcatctgacattgaaaacaagagttttctaaaaatatttgaaagagattcatgacaaagaaaggatttccgaaattctttatctctcatttaacataccaagaatcacacctggaccacatttctctataacaaggaataagcttttggatcaggtaaatgttctgccatgatggccaggccatgaggtgtgttccctgaatagaaggaggatttcatgtgcaggaagcaggaaaagtctatcccttttatctccaggagacaatgaaaagaagggagacagaggtaggtaaagaaggctgtcagacatgtgagtcctgaattccctttgatgagctttaattttacttcctgctagaaatctgcaagaggcatctgtgcaatggacatcatgccaacaaggcacagctcagctaagagagcagcaggctagacagaggatctggattacactcctgagtctctcctgatttctgtatggcataaacaccaagagagagccagggggtcatccttagggccatcatggttggagtgagataatcacataataaaggctggggaagaacaatttggtctggggctctggaaggacataacaaagactcagagaagtctgccctgcaaagttaacagaaagtagccacaggatcctgactcaactgagaaagaattcagcagctgcccactgcaaagcagactccctacaggcaaggccacctaggattgggaggacatcaggtgggcttgagactcttttactccagtgtttttcctttcatatcctagacactacgtaggagaaagaaaagttaatattaataacagcaattattccaacagtacaggtattactcagaggttatttacattgtagcagtagagaaaggtttacctggattcggcattgagtcatcctctttggtatatcccaacaaacaagcaagggaagcatcatgagaaagattaggcccagaggtatatcttctctgcacatctgaattgttatgtgagtaaattttgcaagcccatcacacaatatttcctaagcaatatgagataataaaaatttatctgttgaaagcttcatgtatgccaagcactaggctaggaactgtagactgaatgaaggatgaggcgtagtgtagtctttgccttcaagaagctcatggtttaataggagagccatctcaggtcattaaaatgatccgtttacttgtctaagtattatagttaaagcaagcacaagaggatgataggagagccatctaccaaatctatcaagattatggtctagaaatgtccaatgagcatcatacatgactaaaaaggtgctgctagtagctatcagacttcagaagtttagtggcttaaagaaaagagctattctttctcatgaaagagtcatggagggtcttctggtaggaggagcagctatcctctccttcattcagggacccaggctgagggttgctctgtcatattcaacatgtggatctcaaagtcaccttgagcatccaccttacagtcagccaacagtgagagggttttatggacacacataactacaagggaagttgggggagttaagctggtcaagggggagacaggattttgtaggacatctgtaatgttccacaaatgtaagcttcactgactgtagtggaatggcttgttgaagattaaaaactgatggcttttgtttcgaactgtggaagtgaggcatggaagatctttcagtagcatttagacagtgactcgagacattcttcttccatctcttgccacaaaggtggggttataaacagatctattgtttttgtaggtgagagctctcttgaaggaaatcatattttattgtccaaaaagaaggtaggggttaacattttagagtttagaaggccagaaagaaaagaagcttccaggtttgtactcagatccattgcacccacagcaacaacctgtaaacaggccattttgtgttttcttcagcagaaaggcaatccaggtctcttgtcctggaaagcatttagaatgaggcatttgtgctttagggcatagcgaaagaggtatcagcattctgaggaatgagaaggggcaggaagtttgttgggtgctcagcgtgagagccggtcttgggatccttctgtggctctagtgggtccagggctggtggactgaggaaaggactgtagtgagtggacactgcatggtgcctgtggagtgactggaccagaccatcagtcacaaccttgtgtttcaggagggctcttgaatgacaggctgctgatctgtagttgaatggagccttcctcttctctgaagttcagggaccctatccagtagtgtcttttggagataccatccatgaatgtctcagcccctgtgatatggcattgctcagcaacacccctgtgctggagggacactctttcagaatggctgcacttgctactccacgggcaaagagccaagtgaatgcctccatgtacatctaatctctcaagtggaaaagccagtagcaattttctgcggagctttcttcctcatcttctacttctattctgttaccaaattatgagaattttacctcttaagtattgcttgacactcttaactttttccaactttggtgtcaccacataagcttaaatcatgatcatccttctcacctatacttctcccatggactctttaggtcgactattccttgctcttccctccaacacaatctgttgccactgtattcaaagttgctgtcttcccatagttacctgaattatagctaaaaccccttagtattccccatgaaatttgactttgtctagaaagcccaactatcttttctccagcccatcatggaccacatccctcactcatattggcttcatcctatcacattggccttcttccaggtcctggagaaactagccctgctccttcccacctttggacctttgcaaaggccatgcactgggcctggggtgctttttcacagtctgcctgggcagaatttgctcccaatcatcctccagttctcagatacatcagggtgacccctgactcctcctaagactggatcaagtgcctactccttactacatggtatgataaaacttttcttcatagcactaggtataaaatgagcccagtggtcattttatacctaatcatataacatttgattaacacccatgttctgctgtagactgtaagaattatgaagccaggaactgtgcaattttttttccctcccttccttccttccttccttccttccttccttcctttccttttgcatcttagaccacactatcttgttcacattttacctctaatgcctgacacacagacgtttctcaataaattcttgtttaatgtgcaagaaaacaaactgtaataacagcagggacatgctttaaaattttcaaaactgcgctgggcacagtgactcatgcctgtaatttaagcactttgggaggctgaagcaaggggatcgcctgagcccaggggttctagaccagcctgggagacacggcgaaaccccgtctctacaaaaacaaaaacaaacacaaacaaaagacaaaaaaaatagctgagcatggtggaatgtgcctgtaatcccagctgcttgagtggctgaggcaggagaattgcttgagcctgggagcttgaggctgcactgggccatgatcatgccactgtgctcctgggcaacagagtgagaccctgtctcaaaataaatataatataatataatataaaatgaatttcaaagccttttcatatacatgatctcacttgacaaatgagagggaaagggggagttagagtcccttctcagcatgctgctctgcctgccttacatagaatctgctatcagaggaagagctttaaacaagcttttggggccagggtatagtgtgggatgtgatgaatggtgccttgtaagatgcttcctgtgaagcttgcccatgggaatgagttatatgtataatatatatacatttgtatgaactctgcacaaaatacgaggtaagatggaaaatggctggaaaagtgccaaagagacgtgggaagtttgtagaaaggtgatagtcaggaaagaataagtagttaaaataagctaatgtgtggctagagaggaaataatatttagaggtaggctagataaaacatcatggctagaaagaaaacaggaagaatattactgaagaaaattggccaagaaaaaaatgcaaactctaaaaggtcagagagccatttgaaagaagggggttgagagatcaaggcctacgccagtgccttccaggcagccgcccttttgagtagaattgatttgtggatatatttaggtgcctggttgaaagacaaaacacagcactcagatactttctctcatcttatttcatcttgacgttggtcattattgctaaggagacagggacatggaaaaccacttagggaaagtaaagacagagattttaaggtgaaaaataatttggtcataggaccctttaaccttcctttctcaggtctctgagaataaaaaaatggtctttggcatgctaacctttagctttgtacatttgattctgcaacctagagggagaaagagagagagagagcacatgattggatggtagaaatgggttccatacttcccctttggagagaattttttctttggccctgccattcacttcaatattgtcctcaccttcttaactctaaattcctgtacttatgtctcctcagtctcacctctcattcaccctttaatcccttcattctcctaaaattgctctttgtcattccagaatatgttatttggagtcttttactgcatctagcactttctgcatgcattttctatcatttgtgtatacacttcatttgttgtgtatatagtagattataggtacccagaggcacaaatccttatctacggggatgtatcatgttcatttctgactctgtaaggcacttgctcaatgtcttatatatagtaggatgtcaataaatatttattgctctgaatggctaaaaccacattaccttaaactattcaggggcatatgcctcctgtttttccttctatttcaaatatgtcacaggaagaaaaaaactgccttatccggtataatcttccaaggattttataaaaattcaaaacacatactgtatccaactcatgaactcatcaacttagcctgcatccaaggattttcaggagactggaaaaaaggaaacacactaaaatagaatatacttttttatgtttgatgtttttcttccttgatttttctgggaatatttctagataaaagagtatacttttcatacataagtgttatatatatatgttttgtgtgtgtgtgtgtgtctgtgtgttatgaggtatacttcattgaaaaactgaaggccagggactgcttttgaaagccacaatgtggccatgtggctccttaagacttacgaccagtaatggagatggtgaagataaactccttcagctttgggatcatgatgccacggctttgttctggctggctgtcctctatagatgtctaccagttcctattagctgattacagaggtacacattggcaaggcatgtatatgcacacatgtgcaatacagaggtctacctggattctgccaccctgggcttctcatatcctcattactagagcctggaagggcacattggagatctggctctggcttggatcccttaggacttcacgtcttggtggcctatctcatctgcagggagaagacatgggaggctgtggtgaccaccattagggtcagctcgcagggtgctttcactactctgtcagtcaatcagcagtcaactaatctttattgagcacctactatatgtaatgcatgaatggcgctgctctaggcaggggagatacaaattcttcagatacctgtgactcagctctggcctcagaggaggtggggggtccctccttcatccttcccgtctcatcatgggtcacagagagtccccagcactatctttcctgtcttgttataatagtcttagagtacctcttcattttacagctaaactagtaatgatcctaggattaccaaatttacaacaaaattcactcttgtaatctaacagcttgccaaaatatgggtgattttttagattttgaagtggaaaaaggaggaagtagagatggggagacaacttaccattcgttttgacaaagaggaaaattaaaatgaagagattcacccaggcccactgttttttccatgtccttgtgtgaaagtgtagaaaggtttgatgggacagaaagaacactcagattgggtgtgcttactcatgccttcaacaacattctatgtgctgggccctctgccagggcttagaaatataacagtcaataagacaggcacagtgtgtcaggacaccagggttttgatttgactcttgccaaatgaattttgtgaccctgagaagacacttcacttttcttgctctcagtgtccacatctgtaagctgagactgacactggaggtggccaacattctctaactttttcctagctccgcctggaacctctaggaccagggacacaaactcttatcttggaaatggaggtactggtgccggtcacttttccatgaagggctggggagatgcctctggggtccagtcccctctagacagtgagcatccagattcctgaggatcaaggggaggtgtgatgatctccattgtcctgggccaggaaatgccaaacaggagtttcacattcagctccttctctggactaccctgggaaggagcccacctcctgctgctcagcccagcgggtgctctgtgctgactctcacacgggctgtcagcacattgactgcattcctctgcattctcccggcttcagggttgtcagccaattaaaagagcaattctgacactggatgaaaagggaagggagagctatgtttggtgcaaagtgtgggcaggaggcactgctggtgctggaggagtccaggctggatgcagaagctgctcctccctcctgtggaggaggacagccctgcccagcccaccaagctcatccctgtccccacagcggacagctggccccaacccctggaagatcctgccgctgtggtctgtgcagaatttaattacacctttgggaggtgttttttgtccccctgcacatcaccaggaagaaactatgacttgcaaattcagggttcttaacctttttttgtgccctttggctgtctggtaaagcctatggatcccctctcagaagaatgtttttaaatgcaaaaatttaaatacatacatagaattataaaggacataaaggacaccagtcatattaaaatcaataaacaaaatattttagtgataaagtgatagaatcacaggtactgctaatactacagtgtttgctgcctatggtgttatttattgctgcataacacaacttagcaactcaaaaataacaaatatcacactcagtttctaagggttgggaatctaggaggggcttagctgggcgtttttcctctgagtctcccatgaggttgaagtcaagttgttggccaggactccagccatctgaaggcgggaagattgacttccaacttccaagctcactcatgtggctgttggctggtctcacattctcactggctcttggctggatgccttagttccttgtcacatgtcaagacatggcagctggcttcccttagagtgagtgatggagaaaaagaacaagagtcccagtcagaagctgcaccctttcataacctaatctcggaagtaacagccatcactcctcctgtgccgtatgtcacaggaccaatgtggggctccaagggagggactgcacgggtgtgtgaacatcaggaggggggtccctggagccacatgggaagccaactatcacacctacattcatgacagagggacaggctaaattttcattatagcttagtaaaaatagagacataaatttttttctcatccagtttcctggaacctgagatctagccacagaccccaagttaagaatccctgatagattgaaagcatttttgtttccaggcaatttctagtctttttattcatgactttttttagcttttttgaggtacaataaaaaaattgaacacatttaaggtgtacaatttggtgttttgatatatgtatgtattgtggaatgatagccagaatttattgaggtataattaaaacttgtacacatttaaggtatacaacttggtgttttgatttacacatgtattgtaaaatgacagccacagtcaagctaactaacgtatcttcacctcacacaatttacccatagtcacattgacgtatgttagatgtccagaacttactcatcttgcaaaactgaaactttataccctttgatcaatgtctccacatttcttcctccccgccagcccctggtaaccgtcattctactctccacttctatgagtttgactattttagattctacatataagtgagatcctgaaatatttgtccttctgtgtttggcttattttacttagtatcatatccttcagattcatccatgttgttgcaaacggcaggatctccttctttttttaggctgaatgatattctgttttgtatatgtatacatatataccacatttttaaaaatcacttatctattgtagacatttaggttgtttctatatcttgggtattgtgaataatgcttcattgcacattggagtattcatatctcttcagggtactgatttcatttcctttgcatatatacccagaaatgagactgctaagtcatatggtagttttatttttaactttttggggaacctccatactgttttccgtaatagctataccaatttacatttccaccaagagtgtacaagggtttccttttcaccacatcctcaccaacacatgctatcttttgtctttttgataatagccgttctaacaggtgagaggtaatattatattgtgattttaatttgcattttcctgattattagtgatgttgagcacctttttatacacctatcagccgtttgtatatcttctctgataaatgtctatgtcctttgcccattttttattgggttgtttgattttgccattaagttgttatgaattccttatatattttggatgttaaaccctcatctgatacgtggtttgcaaatattttctcccacttcgtaggttacctttcactttgttgattgtttcctttgctgtacagaggctttttagtttgatagaatcccatttttctatttttgcttttgttgcctgtgctttttggggttatatccaagaaaaatcattgcccaaacaaagatcaaaaagctttttccctatgttttattctagtagtctttctgattttagatcttacttttaagtctttattttgagttgatttttgtatatagtgtgagataagggtccaatttcattcttctgcatgtggatatccagttttcccaataccatttgttgaagagacaatcttttccccgttgtgttttcttggcacctttgtgaaagatcagttaatgagtgtatttatttctgggctctctattctgttctattggcttatatgtctgttttatgccagtgtcatgctgttttgattgttatagctttgtaatatattttgaaatctagacagctgttgcttccaacttggctcttcttactcaacattgcttggactattcagaggtttttgtgatttcatataaattttagaatattttttctatttctataaagaatgcctttggaattttaatagaaatgtcattgaatctgtagatcactttgggtagtatggatattttaacaatattcttttgatccatgaaaacaagatttctttctatttatctgtgtcttctttaatttcttcatcaatgtattataattttcagtgtataagctggccctaggggagcggagttactcaggtaaaatgctttctatacttttctatatggctgtcctcagtttttgtgctccactgggtggctgtagcttcttaacctcactccggagctctcccagtgctctttcagtccctggataattgccaaattgttgtttatttggtgggggaggagggtcagagcctcctagtccaccatcttgctgatgtcactccttagacaatttctgtgtctaaagagaaatgctgtaggataataaatattacagaccatcctctactcatcaaagctgcagggccagtgcacaggcctgaaaagcttccctttgattagttgagctcagggttgctgacactcttagccttgcacagagcctaatgtatggaagatggtgtatatttatgggatgaagagatcttattgattagtgcatatcagatcaaaatatgttaaagtcaggcaaattgctggagaccatcagtagattactttttacagagagactatacatgccttgctcctgcctggaaaactctgcctgttctgttccctgagcttggaatgctcttcttccagatattgctcttttcctgccttcctacatttctttactcaactaccactttcttggcaaggtctccaatctgcttcttctataataggagtttctcagatagccctgaaagatcctcatcccctggtctttgtgtccttctatagtcttgtccttgagtgtgggagggacctagtgaccaactcctaaggaaaagaaaatagcaagagggatggcatgtcacttccaagattaggtaacaaagagtctggcttatttccagcttgccttcccttcctctctcacttgctctctttggtgaagccagctgccatgttgtgaactgccctagagaagctgatgtggccaggataggagggagggctctgccaaccagctgataaagagctgagaacctcggtccaacaaacttccagaaattgattccttgccaacaaccatgtgagtgatcttggaggtggatcctcccctgttcaaaccctgagatgactgcaagcctggccagcaccttgattacaaccttgtgagacctgagaccctggcccagcctgtgacttcctgagccagaggaccctgggcacacctaaactgtgcctggatttctgagtcatggaaactgtgatcataaatgtttcttgttttaagccgctcatatttggggtagtttgttattcagcaagaggtaactaacacattatcaacaattataacatctcactttcacctggtatttcctatccttcacttccactacacgccattgttcctccttaccacttttcactatataacacatattttttacttacatatgttgttgtctgtttcccccaatagaatgtgagttctatgagggcaggcatttttggctagaagtatacctagaacagtggttggtgcacattcagtgctcaataaatacttgctgaataaatgaaggatgtgaaaatgggaatgggaggagcatgcctagagttccggtggcatttgagagagcagccccttagatgtgctatctagacacattcgactcacccttcccaccactgtgagattattctccatatccctgccctacctcctatacttcccttgacctgggcaagcagggcccctgtcccagaccccgtacctcatcagggatctcatcttggagtgtcttcctcatatttgtctaaatcctcttccagcatctgagaacagcctagattggtagtgcctctgttggggtgccccaagtccagactgcctcccatgtagacccagtcgtcattgctcttgttcaagtgctctcctgccaccaccccctcagaaccctgactacccccagtgagaatcattacagcaaggcactgttagtgacaagaatgtgctggccaggagagtaacaacaacaataataataatgaaggttatagattgaaggagaactaataaaataaattttagttgaatcctggtttgaaaaaaatcacatccacaatgctcttccttatatttttcccagctgtaaaacaaaggcctcatcaaattgatgagtcaggaaagatataaaggacatagccctctgtccccagtttgctgggggcaggaatttttgtcaatttcaaacaaatccacagttgatcggttttcctagagcctatatacttgtcaacatgaatgggcttctacatgatttaagccacttcacaacaacaaaagaaggatgtttcttcctttttcattatctaagcctttaaaaatagtcgagataagccttcagcaggaatgcagtttacatacgtgaggcctctgccaaggggtgacttttgccttattttgttcttggctcttagtcatcccagccctaatgtagcacaggatctggttctaaacagcctgggttgaaaatgcaactctaacccttaggtgtatgaccttgaacatggcacttctcagttttatcatttgtaaaatggtgtatcagttcattttcatgctgccgataaagacatacctgagactgggcaatttagaaaagaaagaggtttaattggactcacagttccacatagctagggaggcctcacaatcatagcagaaggcaagaaggagcaaaccacatcttatatgaatggcagaaggcaaaggaagagcttgtgcaaaccatcagatctcgtaacattcactcactagcatgagaacagtgcaggaaagatctgcccccataattcaatcacctcccactgggttcctcccatggcatgtgggaactgtgggagttacaattcaagatgagatttgggtggggacacaggcaaaccatatcattctgccctttgaccctcccaaatctcatgtcctcacatttcaaaaccaatcatgccttcctaactgtgccccaaagtcttaactcatttcagcattaactcaatagtccacagttcaatgtctcatctgagacaggcaagtcctttccacataggagccagtaaaatcaaaagcaacgtagttacttcctaggtacaatggggatgcaggcattgggcaaatacagccattccaaatgggataaattggccaaaacaaaggggcttcaggccccattcaagtccaaaatccaacagggcagtcaaatcttaaagctccaaaatgatctcctttgactccatgactcacatccaggtcatgctcatgcaagtggtgggttcccatggtcttgggcagctctgcccctgtggctttgtaggatgcaacctccctccaggctgctttcatgggctggtgttgagtgtctatggcttttcctggtgcacggtgcaagctgtcagtggatctaccattctggggtctgaaggaaaatggccctcttctcacagcttcactaggcagtgccccagtagggactctgtgtgggggctctgaccccacatttcccttccatactatgctagcagaggttctccatgagagccctacccctgtagcaaacttctgcctggacatccaggcatttccatatatcctctgaaatctaggcagaggttcccaaaccccaattcttaacttctgtgcactggcaggctcaacaccacatggaagctgccaaaccttgaggtttgcaccctctgaagccacagtctgagttctatgttggcccctttcagccacagctggagcagctgggatgcagagcaccaagtccctaggctgcacacagcacggggaccctgggcccattccctgaaaccaccttttcctcgtaggcctctgggtctgtgatggaatgggctgctatgaagacctctgacatgccctggatacattttccccattgtcttgcaacttaacattcgactccttgttacttatgaaaacttttgcagccagcttgaatttctcctcagaaaatgggatttcttttctatcatattgtcagcctgcatattttccaaacttttatgctctgcttcccttataaaactgaatgcctttaatagcactcaagtcacctcttgaattgctttgctgcttagaaatttcttctgccagatactctaaatcatctttctctagttcaaagttccacaaatctctagggcaggggcaaaatgctgccagtctctttgctaaaacattgctctagttcccaacaagtgcctcatttccatcagagatcacctcagcctggaccctgtggccacatcgctatcagcattttggtcaaagccaatcaacaagtctctaggaagttccaaactttcccacattttcctgtcttcttttgagccctccaaactgttccaacctctgcctgttacccagttccaaagttgcttccacattttggggtatcttttcagcagtgccccactctactggtaccaatttactgtattagtctgttctcatgctgctgacaaagacatacccaagactaggcaatgtacaaaagaaagaggtttattggccttatagttctatgtggctggggagagctcacaatcatggtggaaggtaaggaagagcaagtcttgtctttcatggatggcagcaggcaaagagagacatcttgtgtaggaaagctcccatttttaaaaccatcagatctcatgagactcattcactatcatgagaacagcacgggaaagacctgcctccataattcaatcacctcctactgggttcctcccacaacatgtgggaactgcgggagttacaattcaagatgagatttgggtgggaacacagccaaatcatatcaaatggacacaataatagtgtgataggaagaataatggcccttaaagctgcccatgtcctcatcttcagagctatgactatgtcaccttacctggaaaaagaactttgtgtgtttaaggttacatgcagactttgtgtgtttaaggttacatgcagaggtgagagattaacttagattatgtaggtgagctaaatacattcgcatgagttcttaaaagcaaaaaacatttcctaggggtgatcaaagagaaagatgctatgatagccaaaggattttctgggtaattgtggaaaaggacataaatatctctgaaaacttacttcatttgattaaaaaattatgtgaattttctggtgaaaagacatcaccagaaagtactgaagaagcccttcacaaacctcagaattttatattagccacattttaaaaaagtattaaacatactttaataatatattttatttaatcctatgtgtctaaaaataatcccagctctttgggaggctgaggcgggcatatcacgaggtcaggagatcaagaccatcctgcctgacacggtgaaaacccgtctctactaaaaatacaaaaaattagctgggcatggtggcatgcacctgtagtcccagctactcaggaggctgagaggcaggagaatcacttgaacccgggaggtggaggttgcagtgagccgaggttgtgccactgcactccagcctgggtgacagagtgagactccatctcaaaaataattgaataaataaataataaataaataaataaataaataattctaatgcatgatatatatatgaattattagagatattttatattgtttcatactaagtatttgaaagtattgagtgctttacactggcagctcatctcaatttgaactagtcacatttcaagtgctcaatagccacaagcggctgatggctactgtgttaaacagtgcagcttacagagcataagtggccaagtttgtagctttaagacagttttttttttttttttttgagaaggagtcttgctctgtagcccaggctggagtgcagtggcgcgatctcggctcactgcaagctccacctcccaggttcacgccattctcctgcctcagcctcccaagtagctgggactacaggcgcccgccaccatgcccggctaatttttttgtatttttagtagagacggggtttcaccgtgttagccaggatggttgcaatctcctgacctcgtgatccgcccgcctcggcctcccaaagtgctgggattacaggcgtgagccaccgtgcccggccaagacagttcttaagtgagggcaggtggcttaaaatgaattgtcagctgctgggagccatgtgggtcctatggaagcttctccaacagcctcagggcagcagcagcagcacccagagtagctcttgttcctctacgaaacctcctcaaaaaggtaccatggccatgaataaagcattcaagacagtcaccttccaggagggtcccacgaggagaaatgaggggaagaacacaagaaaggctttgtctgactacagggaacaattcattggcagaaattgccctgagattgactccccattgccttgggtcccaaggtcctgggagagaaaaggtcagttcattttttattaactcttaaatgtcagtgtctttataattagtaatgtaacaaaattacatgggtgtaatacttggtgccatgggatcttggtttttcccccagcttgtgagctggttatcacagttccatcaacccgtgggctgtgggaagttctaccagactctcagcaaacaaaatgctgtgtcctagacccagatgcggctcctgttccctgtcaattttacaattagcaggggagggaagatggagacaaaccattataaagcagattagcttttgatcagcgctatgaaaatgctcctaataaccaatactataagagttgaggaacaaaagatctcactccttgctgcattaattacagaagacatcatggctgaggcagactcttagaggcaaatgcaaatttcccataggcaaaaatggtgggagatttcagccaataagaatagcttgagtcaagacacagatatttggaaagacaaaattcagttggaatgccaactatgtgtcattatcaatatcagcctcatacggtgctaaagaccaagcttccccttctgtaaatctacccagaatcacatattagtctgtggcaggaccaagattcaaaccctggtctacctatgcaaaatctgtgtgttcctaccatcctgtgctgcctcttatgtaaacataacacagtgtaaagctatcggaaaaataattttgggctccccccaagccagaccagataaaactcaagtgcaagtaatttattttgcagttgattccaggaaactttagtaaaggaatggggaaaagagacagagaaggaaagagaactgataaagggttctttattaagagagttgccactatagctagagctcagtccagctgcggaattcagggattcagtgcacacaacctgctcctcctggctatacctccccaagtgggtgaggggcctggggtaattatgtattccagctactgactgaaggatgctgaggggggtgttaattctctaacactttaagcagcctgccatatgtgtgacaaagtaagctctgtggcccagagaaaaaccccaggcaaaaaaaaatgcaagcactgtaagttggacagacatattgaagtggtgagaggagatgggtaggggatcaacgaaagctccatgaaagcagggactgtatctgttctatttaccactgtacatccactgcctgacacatacaagatgcttactaaatagctgtggaagaaaggaaacgagggaaagagggaagaaaggacagaggattagcagagtcagggcaaccacattgcacatctccaggacactagagaagaggccagaaggaagagcataaaggtcctgaaagattttgttcagtgtgcatggagggcttgtgaaagttttgcaagtttgaaagtctgcaagaactttggaaagtagagcagaaatatgacatgaccacagcagagttttagggaaatgaatctactactcttctgttcagcaaatacttaccaatcttttggagtcaagaagtgtttcatttttagtaaggatggggcaaaaagtagaagatctacattgctgcagaacatttttaagttatctcaattgttcatggaggagaacagctgccgaatattgtcagctttctatctatttcttagagctggtgtgaaggtgtgaagagtagcacttaccaagagactgggtactgtgaggacagagactggcagggccctctgatgcaaagatcaaagaggaggcaacaaggagcaagtcccaggtgatctgagggttgtctctggcagctggtacatctcagagtcacacttttttccctcaagttgtaaaactggaagaggagaaaacaggaggtgacactttaggaaatattgggaatagaatgagtgtgaactccacaaggggatggagtctacatggggatatttaattttgttatatcacctccctaataggcaattcacttagagcccccggtgaactgcaagtcccaaatcccttctccacacttcaaaaatcccaaaactctaagcactgatttacttttataaatttgcacaaattcatttgacatcaaaacttgaccttgctgtgaattcattcatagtcttccttttcttctcccactttgggtgagtactcattttcctctagaaaattttgcggctctgaattccaaaacacatgtggcccccaagggtatcaaacaagggattgtgaacctgtaattaaacatgaatttttttgatgttgaaaggcaagtcatggagcatctgttttactgatgttgattataccaaatgtggcatactcctggcacttggcagcagtagggacatctcctgaccagggaggctcctcaatggctgcagtgatgacaatgatgatatggtttgggagccagcattttcccgatcttaagaaaggtagacaacttcttggaggcctagtcttggggtagagttttgggagtcactattggaagtacaacctgaaatttattctcaagcctccattttacaccctgtaataaataatttcttgctcgaactagctagaatagagtctgacttgtgcaactgagcctgaaatggtatcccagccacacagcaacaccgatccaaccgtgctatcattccaattttttttttaactcaaactattgtcagttgcataactgccagacttggtagccataaagtaaaataacaaaataaatgtaaaaataagccgggtggcatgcgcctgtagtctcaagtgcctgtagtcaggagctgagttgggaggattgctcaagcccaggagtttgaggctgcagtgtgctgtgatagtgcctatgaatagccactgtactccagcctgcagaacatagagagaccctgtctcaaaaaaaaaaaaaaaaaaagtctgctcacaaaacaaatatttcctactaccaaggctgagactgcccagtagaagttgatgcagacaaagatcttccagcaattgttgaaaccattacattgcctccaaaagtgatcctgttaaaacagaactattcatttggatgtaggctttctgtcactgtgttagttagtcaatataaatctatttggtaatcattggagagaatggaagtaatacagagaaagataatacagagtatttatttccaaggagtttcttctctcctgggcttctggtcagacacccaaccaagcattatgcccactctaagtgctgtaatgggtatgcacaaagtgcaattacttagccatttcctccactcacatccaggcatttcacagcttgcacagcctgaatccacagcctcactcctacagacagatgcttaatgtaaacacttaatatccatgtgtctgtaacagtaataacgtcatcagaaccctaaaggcaaaaaggctttaagaagtagctaggtagagagtaatagatttataccatgaaaatgtgtttaatcaggagtctgagtacatgaaaataacatcaaatcaaccctatctctaaaaatgagagaaaaattaaataagtaagatggatacttgaaatattagtgtttattagcagagtttttagtgtgtaaacatacccaccctaattttgtcttgagaattggattctgaaaaaactgtgatcagcacaaaggcatgttgataccctggcaccatgaaagcattgaaagggagaaaaatgactggattggcaaaagtcttgacaagagaggccaacagaaaccaaaagccttcacgactgtaactcaatttgttttctgagctcagaagagaatgacactgtgctagatggatttcagttgtccttccagatctgctctccacttctccacactggccagcacccttcatgtgctgctcacaaagccgagagccacagaggagcacacggggtgagctgtgatgaatgattttcatttacctttccagatcctctgtccaccctgctgtgccgataggcatttacggaccatagcgacaagctcctttgtcccctggcttctggttagagagccaatgagatgcacgggcaaagactgcatggagagggaaaagtgaggttggggcattgcctgccctccctgcagggctgtgagtctcagagtccatgttccacgatctaaggccaagcgcccgtcaagcaggcagctctctttcatagcttccaggtccaatgaccttccctctaagggtggtaatagcactccatgcttaacaatcactattccttttaacccagtacatctttgcaaattagccctttttgaaactcttcagtttccctcatttgactgcatcacttttttctcatggaaaccctcacttggggattattgtttagggagagtttccccagtatttttacagagctaacaggaagttaatttgcctgccctttgtacagctcagttagatcagcttttgtctggaaaggagccttgcagggcttggctttgtatcctgttgggatgatcatctctccagtgtgatgactaagggttgtgtccagttagtgcactagcaactgaagttaggaaggctcgggtggacgctgccaaccagcaatccaatctgcctgatggccaaccctttgactgctgggagcctggagctttctgaatcagacaacttccagacttcacatgtgctgccaagcacaaggtatgaaaaaggtttcttttctttagattctgctttttcactaaagctgcatctttatccaattaattagagaaatgttactcaaagcatagtctggggaccactgctggtatgcacactggtggagcttgcaccagaataagttcactacgttccactgacaggctttttttcttttttttttttctcggtagcaagactttttgatgacttgttgatttacaatttcataagctttttttctcatcacagatgaggaacaaatatttaccaacctggtatttgggtacttgcagtagcactgaattagaggactgtgaaatcagacctaggcaataaactaggtcagcatttcccatgttgtgctccatggaatcctaatcttgtgacagcttgtctattaagaggaggaaatgcttagagagtcacaaaggacatgaccatgttaatggctctgataagtcctgcagttaacgaatgtgcttatttttgttcagcacagaatttcccatacttgtttaaaatgattatgttatgtcatggctattgccacttgtgaaatgagtgttctgtggaactaacactgttggcaaggaaatgcttcaggaagtgctcagccagaggatctctagagtctcttgggaagatatttatcttctcagggcccctgtttccttaactatcaattaatgtctaacatctgactagtggttggcattttcatatgcatgtcctcaatgagactcgggttatcctgtgagaaatcgtgcaggaatggtacatcccagtccacacaggagtaattgaagggtcagacagattatgtgacttactcaaagtcacacaacttgtaaaaggtgaaactagaatttgacactcaggtcttcaaattttaaaatctattatttcctactatactgcattgaatctttgagctggaaggactcttagtggataatatgtctaatcaggtaagtaatactttagcaaaggagggattcaatgtgaattcagtgctggtcatttaacttttagctgaagttcaaacctgtttctttacatcattttgacatcttcctcttgttatggtcaaagacagctttccaatgtcctatgcactcaccatctcagggaatgggtcacattgtcatattcgtcttctgaagtgagtagaagacggccttccacaaacgttggacctctgggtttgttcacagagcaaggcaatgacactggggagataggagggcactctatatttatattctgtattcctgagtcaagaaaaaggagcgtgagatttaacagcacttggctaaaacaattaagtcacagcctatcttcttgtggtcaactaaaagaaaagaaaagaaagtgagattatttttgtatttttaaaaacaaaggctaagaaataatctgctcacaatgttctccattctgtatgtgtgtgtttctaactagtttttaaaattcgaatgattcattaattcatttgttcattcattcagtaggcttttcttgagtacttactctgggccaggcaatgtgctaggggttgaggaaacagaatgaataaaattaatttgtcacccaagtcaaacatgaatcatcattaccatcacaaacaaatactgagcatcttctataaaaggggccagtactgggcacttccgggatctataataagacataccaaggcagggtccttgtcctccaagagttcagtctccttgaggaaatagctatgcccataaaaggctaagcatcattgtgcaatgctgagtgccagcccagtagcatgaagaacaagagtaaccagcattccagggataagaagtcactcttggtccaggcaggtgggagctgtcagagtggcataattgtggtcaaagctaataataactctattataaaccacagcattgcaaggaagcaggaataatttttctgagagaatgaaatctttttggtttaaattgatctcacggaaataaatctggcacttaaaagagttttgggtttcatttatgtcatgagggtccatttgcgggtgactagttcccgaaataaagaactcgtctctctaggctggagtaattttgaatctgagagatgaaagttcattattcttttggaagttagtcaacattaattgtgtttggcactttttaggtaaggaaaattatcctacactggatggttacaattacattgttatgtctgagaggattttctcatgtaattactatgtgccggctctctaattacaaggagggcctgaattttcttcctgtcactgcaaatgatgtctctactatattgaaaaaatagcggactttcttttcctcaaataaggtatcaaaactggtaagccatgaagaacttaaaaataccgttgacgatatagatatttctacagctttattttaaaagtttaggtatcatatcctattggatttagagaaattttgataatttgattaaaatcttatgtttatgttgttacattctaagtagaaaatcagatccatgcttagtgtgggttttaaattttatttattctaaattcttagaaaaatgcacagctaatatatgacttacttgacctcaacttcaatgagcaaaagaagcttgcaaatttaaggtatttaataaaatgcctcccccacccaccttgaattctcatagaaaataccacagggtttgactacaagcaagaaacactagaggtttcttccttcccaataaggacagttattaaaaagctgggtgaaataattttcttacattatttctcttaaaaaatccaagagttaataagatagtgaagatttaatctacaacagtacagaagacaaaatcccgggaaagtaagttgagcacacaaagctgctttgacctcaatagcattttccaaacctgaagaaacatgcaaaactgaggtgctgtctcggtggcctcacaaagcaagtaggaaaaaagtgaaaacctaggcccacccatagtggggagcccattctctccatagatattaaactgagatccaaggtttatgccctcagggaaatagaaagcctaaaggaaaacaacttttgcttggatttgcagcccaggtttgcatcaactggatggtccaaggagcctcaagccttgaacttagactaagcagatcccttactggtaaagctccgggagcaaataagaatggtctccagagaaaaattctgtcatctcagagtttaatcactctcaaattatttttcaaatacaacaaccagtctacagtcaaatatgacttgttgcataaacatgacaacataaatgagaactagcagaaaaaaatagacaatagaaccagaccataaagacctaaaatgttaaaattataagatacagactacaaaatgtttattatgtttaaagaaataaacatgtttccaaggaataagaaactacaaaaagtccaacagcaccacccaacttttgtaaaaacaaacaaacaaaatgcctttaaacacttccaaatacatttcaacagaaaaagtgaggccagtgattgccatggagagctccatggccaaagtcacatacatttcctggggtgaccagtatccaacaactgatcaatactggttatgaagtcctggccaattcctggtcaccacagctgcataagttatcccatcctcaaactccctgtgagtcgcccgacacttctgttgagtcttattggatgataagctgtggttgttgcttgggcactttagctcctcatggcaagggacaggtaggtatggagaagaatcaccatcttggcagaagtaattgactcctgatgttaggcaataagggcacagaggaatatagttagcaaccagttgattcccctgggtgcctcctggtattcctttccttaattgtgacagtgaatggtcaaatgcagcaacctggcctgtgaaaggcatggtgatcaggggctcagacccttccaagtctgactcacaggaccacataagccagtgagtccacagaaatgttagagaaatccagaatggagagaaaaggagggacctgatgagtgtttgttttggccttgagatcatcggcagctgtagttcatcccactaaccttattctcctaaatttccctctggaagagaggcccactaaaatcctggaggcattgctcccagaacctgtttgaagcactgggtccaagtagtgcaatgtgtggattatgatggatgtggttatggtcagcctagatcaccctttaggatttgaggcacttccaaactgatgagatgaccctgagccacctagcttaaggactcacttccttcctgggtggctcatatccagggactaatcaacatggggacataatatcccctttctctcctcttctccatggggggcaccactgaaggtgatttcaccttcagaactccctgcagggttgactgtgtcttccattgagatatccatcatcacagttcaactgtgcccagtcctactttcttctcttctcttacacatgttcaatctgcaaagcactcctgcgtaaacctcctgtgttcaagtctgttattcaggagacccagcctgtgacactcggatcttcactgagttgagcttctgtaccttactggggtccagatatttcttcttcagacattctctaattttaagaacctcatctaagggacaggaagtctttgttctttctgacaatctggacaagctttcaggacatttcctagaaatcacgctgcaaggagtggcaggactcctgatatttgatatatgccctaccaaactcatcccagctcttcccatatttgacaatgacttcagagaaaccaacaaagtctagattcttaggagggggaagctagtgcccatccctcttcacagctgaaaacactcaattgattcaaagtatttgcattttaactttaagagcccaggccatttatcttaatgatagtgggccactgtagtgccagcagtatctacaacaaggtggaaattgtaggaatagcactaaaatagggacgtgggggacaagctgctggctatcccatggagagtttcagatgcggtgcccctagagaaggccactgtatgaccaagttgctttagttaaaatcactaagtgactaagggtcacttactatgagtgtcggtagagacaaagttttattccttcaccacagcaatgccccattccccaaaccactgaaaatagactctgattaaattagcctatatttgaggacactcacattggtatcattttgagtttaacgtaatcaagcagaaacctcagctgtgggaaccattttaatgcagagcccatttgtatttgtcccctccagatcaatctaaatgcaatttcttcgcattaggttctttgctggtttgcaagtaagctttttgatttttttattttaacaaatactaaatgtagaaacatctatttttaacaagaaaaatagacactcttaaaaacagagcatgctattttttggttttgggagtggaggtagaagagcagttggggaagtttaaccgaacatggcctattttactggttccagtataacataagtgttttcagttatgagctaccttgatggatttatttacctttagatgtttttattggcttggggagccacggggttaaaggaaaagagggaacaaggaagttaaagcctttgaaagaagacaaccagtggtgtcatccaagcatcccagcattaaaactaaataggattctgtaaagtttccctataaattggttacttggaacccagagccctggagaaagagacttgcccaggctgccagtcaaagaaagacatatgcatatggattccctgaaattaatgcgagggggaaagtctactaggattgtaaatgatctaagtgcttaatgcactttcttggcagatccgaagcaaaattgtttcctcaaattcaggcctcagaggctgtgagccaagcagttgtcagtgggtcttgtagttagtagatacttcttcctctccccacaccaacgcttattgggccgtcctttcccagctctaaagctgagaaccctgcccttttgtgctcctctggcctaggcctgctggcagcagcagctccacacttctgcctggagggcaagaaaaggaggggcttgagggtgaggggactcacagagttggaggggcatgccactttgcccatttgcttatttcatcagtgattgatttttctttcatgagagaaggaaaaacgagaggagagagtgaaggtaaaaaggaagttctgcagccctggaagaatgtctgagggacattctgattcaggagtttatagcttgggcagggttggcactgatactcacatgatgcataagaaccaggctgatgagttgaaaattagcttctgttttgattttgtcccagaatacaaaaacattcactttccttgatagaaagcagagttgagaagactttctatctggcaatatttataaactttatgggatccttacataatgagatgaaacgaagttttattatcttaatggctgttgcttagaaatgttttgggaccccgagggcttgagtgtttcttggccacaaaacttcaaagtataatgtgaaactggcttgcactggatatgagagaaattcacattttgctctgaggataaagggagaagatagacaagaagagaagaaatgcaaggaggaggaagacagagcatggagccaagtggacagaggagaggaccaggtgcgggtactggcaggtgaagcatgcagtcatgggggcggctgaggctgtgcgagaggcatggtaaggctgctcttccacatgaagttcctggccttgctgtgtcatgagactccatttctgctccagaatcacccataaagactcctctgttcatattttcttttccgtggaactcagaaagggggcaggtgttctgtggtatggtcctcatggtatagcacatagttgagacaagcttaggaggaggacctcatgagaaagtgaggactcgtgggactcatgggctcctgccagtggtggatttgggagagcaggattgagttaatttgatccagatctccaagggccagggactcagtacacaacttttgagtaataaagatgatggaaagtaagatattatttggtaaaatctgcatgacgtcccaaacagtaggatccagaatacatgggaacactctttctcttccaatgcatttagatttgcagtctcatcagtgctgggccctgcctggcacagagtagaaggtcattgaccctgctctcaagtgagggtgggtatgtaaataaatgaatacaggaaaatgagtacgctgatacagcaatgaggaaaaatgcagcattcgttgaaggcaagtcatgccttatcaggtataaaaacactacagtggtcctcagccttgatgggtcaacccttcttagtgtgaattttgttaacggcctgtgtctgaagtacctttctaggcactgcaactttctgagtgtttcccttcaggactctatgttaaaacaaacaaacccaaacaaaaaaacacttctgtatttccatggaagtgatttttaagaaaaacaaataataaaaatgcatgacttttgggttgccatatcagggcaaaaataaaggaaatagtgcctagaaagggattgtgaaggcagtggcaccctctgcaaatggcacctgttgctacaggtgcaggatttctgggagaagaagaggatttcttcctgacaggcaggtccacagtgcagcgcaggccatgctgatacaacctggagcatctcaccattaagggaaattccacattagggaacatggacatttagagatttttttttctattcttctgacatttataccttgcatacttttgctttagaagatataattgacataatttttaaaatggcttgctgtgtgctatgatgacaagacaggatttagagtcaaaattcctggatttttatcccgacctcttaacaaaccagttgccagaactcatacaagccactgctttgtgaggcctcaatttcctcatttataaaacaggctgctaataacatctgacattttcacaaaagcctttctctggcttaatgctaagtgtcatgcaattgacagtctttaaatcacacctcctagaccttgggaaagcagtttgttagtttattatttatgtaatcctctctgtctttctgaacactttctatgcttcaggcaccatacccagtgtttgaattgattgtcttctttcttttcaccaccactctacgaatttggcactatcacgaccccatttttacaaccagggacacgggctgagaggtcaaacagttggccgtgatcacccagctgagatcctggcctgacccagagcccacacctcagagccccctccaggaagcagccagctagttctgtatctgtcttgagtttctgtctaaagctctccttacccctcctccttctgcctggaatgaagacagaagttgcccagcgccattcaaccacctgcatttactgtaactatgtcaccagcatctctactttctgaaacctctgagtggtatcatcttgggccctcagtgcatagatttgctagagaacccccagcatccttcagtgtttggagagttccgtgtgatgaatggtaccattggtctttgtgtgcttggcgctggagcccctgatgttgattagaccaggactgatgagctgcttggctcctgcccagctggcaggccccagcccccacttctcacacctaattgaagcaacacagcccaggctctccaagaccactcgctgccaaatgatgaaaaatcctctgacctccctcctgattgttttcaaattaaaaggtactttggggacaactgaaattcccccaagtgcttgtctgagcaattttggcagcttctcccaaagtgctctggctcccagcacaaccacccagcctcagactctccacctagcgcagggcccaggtcctgtctgttttctgagctcagaccttgagcacagtgccagctccttgcctgctgggggcttcttcctgccccaggggaactgatacctttgcctcacattgatacgtggaaagaagagcaaggggaagggccctggaatctgctctgggcttccgggggagcagcttctagtaccgcagctgaggagcacaaccatcagcactgggcatgggatgcttgggggcctttgcttagttctatctgtcagggaggaccctcactgattgagggatgcacagaatcattagttttcctccccacctacaaggataagatccacagagagttagagctgaaaggggcacagaggagcttgcttttctcattcaaccttatgttttgagatttatatctgtagacacatgcatctctttatcaattgtaactactgtagatgtgtccattgtgactatgctgccatttatttatttatttttctgttgatgtacatttattttcaattttttacaattaagaatataccacaaatgaactttctcataaatgtgtctttatatgtgtatgggagtctttgaggggtagataaatagaatgaaatttctgggtctaagagtaggcacatctttatctttctgtgttgtcaaattcttctccaaattgattgcaccaatttggatcacctcccacattgtgtaagagttatcatttcacactcattagattgacaaaagtgaaaaagtctaacatcccctagtattggaaatatcgtggggaaatgggagctcatggctgttttaatttgcattttccaactcttagttgatttcacattctggtttctgtgtgcacgtgtgtgtgtgtgtgtgtgtgtgttgctggtttatatccattgcccatttttctattgaatattttgactttttatcctactgatttgtagaaattgtttttatgtgttggatacttttcctttgatgattacatgaagatcagttatcttcccccagtcagtggctggtttttcactcagattacattaaattttaaaacttacaacaacaaaaacactataagtaatcttttgctttgcaggtgctgcttttgtgacttatggaaaaaatccctctctactttgagatcatattcttctttttttatatacaattgtaatctgatccgggctgaaaaacgaagtatagcagtttaaatagcaggaagtagtcaacaactcattataaaagcaacagaaaacacggaaatgtgcatcagaaagtcccaccggtttctcccaagtgtttgaccttgagaagatcactgaacttctctgtaaagcaggcaatatgtgtccctgtgtttctcaccagttggttgggaagccctgaacacatatcaagtagggttgctattcatgtagcctgccctcagctgctattgtagtcttgtcctctgggattttctggacttgtaaaacctcaagctgcagttaaaacaccatcctccacatcctaggccagaatgcctgggctcacctgggtgactcagctgagacatggcaaaaaaacactcaaaactttgaatctgagccggcttctttcattcaagtaagggccagtttacagagcccctccaagggagatggtgcttggagtagggaggtaggaaaaggttgatatagtttggttctgtgcctccacccaaatctcatctcctgttagggaggggcctggtgggaggtgattggatcatgcgggcagtttcccccatgctgttctcatgatagtgagtgagttctcacaagatctgatggttttaaagtgtggcacttcccaccttgctctttctctctatggccaccatgtaagacgtgccttgcttcccgtcaccattttaagtttcctgaggcctccccagccatgcagaactatgaatcaattaaacctctttcatttgtaacttacccagtctcaggtagctctctgtagcagtgtgaaaatggactaatacaggggtccacaatgaagtcctggattcctcagagggaggagtggggagaaatgaaatattagtccgcactgtctccctcagccagattcctgtaggttttctggagtaactgatcaggactaagtctaggaaaactggaaaaagaagagatgaaatttgttttgaactgaacttcagttttgctattctgcaactcttagttccttttttgatgctctttctctttctcccacgtcacgctcatagtactcccacccccaccaccaatctcctattctgcctaccaaaacttgcacttggaacagcatctggcctagaaggcctcaataaatgtggctattattagcaaagaataaaggagtggcatccttttgtaatgtactttacatgtaggtacaatgatcatcacccccattttacagatgaagaaactgaagaaaaagaggatacattagcagccaagttcatggaaatattaattaaagaggcagattcacattaaggtggagcccacactctgaagaactctggcttctcaggccttgttgacctgcaggtgcctagttccctcctagggaaatgggtgagttatttttagtggagtcccctcttgggatgtgtgtgtgtgtgttgtgtgtattcaaacagaggaacagggatgaagggaaatgagagagcagtgaagacagaatttgagaatgtgggctctctaagggtcagctttgaaaaagaatttttaaaaataatgggaaaagaaaggctttatcttatttaaaaggcattctttaaaaatcaccatcacccacaataacaacagataaggagaaggcagtaactactgatggatttcagaaaaacttgggaaaatatttaggaacagggagtccatcctcatgcccctactgaatctacccacattcatatcaccagccagttgtgagcaattgccccagagcctctctgcagggagccctaaaggaccagaagacagatggaagagcaagctcctcctgccctgggttcagtggttcagatggtagtcactggttctagaagcctcatcaggaactcctaaaggagaaggagccaaagtccattcccagctgagtgattccaggctgtggaaggtgggaagtttgaggggaagaaggagcctcaccaactcttaaatctatcccaagactctaactcttgcctttcccatgtaaagacccataacagagagcatcacaacatggaagagagaaaacatccacctcagcctagagaaagcttgatttagagatcacaaaacaattgtgtgtgtgtgtgtgtgtgtgtgtgtgtgtgtgtgtttctttttaacaccactatagttgaattctgactcattttataatgtgggatgttcattcaatattttaaagtttaaaaaccagtgagtggggcttcaggttttcagtccagcacataaggaacttagaattcatcactccatcctaacaataagcaaaaagctgaactagctgaaaaattagcagccaaagaggtgaggtcacaaggaaaaccactgtccccaaaattaaagagacagacaaacatctacagagaatcacaacttattgtggcagaaatccagaagtagaaacctccataggaatcagttctgggtagagaaacctgaactgtaattgataaattgctgtagactagatgtgaacaagtctgaagattaaaactccaggaggacccagtcgtgagggaggtggcacactttcatgagttttacctccaggaactctaccaagttatcactgtaaatattagagaaaaatcctcttgggcttctggtcagggaaggggaaagggaaccattttaacatataccagagcattttgttcttcttaacaaggcctgtgcccgggagaagctattgtactagagcctcacttgctgtggttttgtgagagcctaaacctactggaagaaggaaaataagtcaactctagccagctctagccttccacctggggaaagggaaacatacaactacagttctttctagcctttcacatgtggtgaggtaattacccaactccagctcactctagccttccgtgtggaagaaaaatacccaacttcagttctttctagcctttcatatgggggaaaataatcactcaactctaacccactcttccccactagaagagtggaaaaaaaaaagagagaaaaactaagaagcactggcgaagttcacagtccagggtcacagactcaccaaaagactgagacctaatcatagcactgtaaaatacttcccctcccctcacaccttaccactacattactaaagacctacctaccatagtttcctttacccagcacattgtgtccctttttcaagaaaaaattacaaggcattctaaaagccaaaatacacagcttgaaaagactaaataagcaatggaatgagagtcagatatggcaagaatgttgaaattatcagattcaaaatgttttaaacctatgattaatatgctaagagctttcatggaaaaactagacaacatgcaaggacaagtggatgatgtatgcaaagggatggaaattctaagaaaaaacaaaaagaagttctagagaaaaaacattgtacaaggaatgaagaatgcctttgatggactcattagtggactgaacacagctaaggaaaaaaatctctgagcttgaggatatgacaatagaaatttctaaaactgaaaagcagagattaaaagaaaggtgggggggacctaacaaaatatccaagaactgtggggacaact

SEQ ID NO: 4204 - DNA, 1770 bp, Homo sapiens
ttcaacaacatttatacatctttttaattagattagctttacaagcaacttgagagctctttcataatgaaacactgcttttcaaattacatgactttatagtctatctgtatatgaatcctgaaaatctttgcctactcttgataaaggtctgtgttttacagctggttaatgtgttgaataaaaacagcattatgaagctttatctttaaccaggattaaacacatataggccacaaacagttttaaattttgtttgaaatagagtcctgcttggtgacaagttaatagtcccactaacatgaaatgaatggatattaaataaatggccatcctgatttcttgatcttttcacaatgattcctaagagagtatataaacttttccaaaaaatatacaatttaagacctgtctggcaagcacaacccacagatagtagaatctaatactttttacgagactaaaattgatgtctgaagttgatgagtttttgtgactttcttaatacttatttcaactacttattttttgcaagggaactgcagatcagaaagagacaataggccgggcacagtggctcacgcctgtaatcccagcacttcgggaggccgaagtgggtggatcatgaagtcaggacttcgagaccaacctggccaatagggtgaaaccccatctctactaaaaaaaagaaaaaaaaaattagccgtgcatggtggcacatgcctgtagccctagctactcaggaggctgagaggcaggagaatcgcttgaacccggggaggcggaggttgcagtgagccgagatcatgccactgcactccagcctaggtgacagagtgagcctccctctaaaaaaaaagagagacaataaaagggtaaaagaatggctgttacagaaaaagcacattatcaatagcacaagtactaaaagaacagaaaagaaacagataaaaggactcagggcattgcaggctaacagtttcaacagtctctggggacatcactacattatagcaaagagtaatgatggatgtttacaattataaccttgacagttaaattatgctaagaatttttaaggattttaatcaaagcaattatactgtgttttgtgtttaaactttgtctaaacttcatttttctgaaaatctgacttagaatatttcattccaccaataagtgaggcatctctagtttattaaatactacaaaagacatactttctgatacaaataatggggaaaatgtataaacgctataggaagtgaaagtacgctacaaatcaccagttcctgggcagaatatagcaattagttcaaatatattgtggattgtggccagtggacacaggggaaaaggcaacatttatcagacatacagccagtaatatgacagaatgaaaaatcacataatgtattttgaagtaaagagtctgggagtttggacaactgggagcctgacgtttacagaccccaccactggtgaatcacagagctgaggtctaaggaggtctcctgacttccagaccagactctgctctttccagagttccactacctttcttaccatgtggcttcttctacttttgggtggccttggaaataggaaagggctcagatacataattttatgtatcttttgcccatgccctaaacttttagtcacttagcaatcagaattctaatatctggatcaacaacttaccttatgtcattctaactttccagccttatcacccattctagataagatcagaataggattctactt

SEQ ID NO: 4205 - DNA, 2361 bp, Homo sapiens
gtgcatcattttaggggttacatgatgttgaatatgtcttaggattggtagtgttaaccatgatcatttggttaagatactctctgctgggttttttcactgtaaaattaccgtttttcccttggtgcttaataaagattttagaagagatatactctgaaactgtgcaaataccctgtttttcttcaaactttcacccactgattttagcatccattggtgggtcttgctggcatcagttactgcttaatgtttgtctaatgttgattttctgttttcttcatttcttttacatttattgattggaaatcgtctgtagggaagatctgtaccttcctgatatatttattgatgattattaattatttatagctgtggactcattattaataaatgagggttttatgagtaatacttgtaaaccttaggagaggaatgttgatgtatttaacttgtaaactttgttttcagcttcttttgtgttaggtaggtacatgtatgcttgggtgtaggataaatagcaatgctataataatactgtatatattgttatatgaagattgcattttatttcaagatttcctttggagataacttttaaaacattgagatttcaaaccacaagatcactaattacttgcataacacttagcataattttctcctaaacgatatcatggtctttctatagttaacactcaaggtgattttctttattgttctctttgccttctttattttgaatttgaggcacttagtatatttttttataagttatagccacatatcagtacttaccagcatgataagcagttctttactataaaattaaagtttgtaaaccattaagtgtaatttttggtcagaccacaagtcctgttgcttttttatttagttgctttaaaaattttttctaaacatacagaataacaaccgttaagatctcatttttctctccacctactctctcatttgtttcttaaactcccttttttttcagcctgttttttgtatccttgttagagagaacagacatatattgtccctgaatgtacatttaattatattcttcatgtaattacattatgtaattacaactcaatcacctaatttagcactgcttaacacatgttaacttttgctttttgttcgtttttgagacagggtcttgctctattacccaggcttggagtacagtgacatgattatggctcactgcagcctcgacctcctagtcttacatcattctcccacctccaccaagtagctgggactgcaggcgcatgctgccacatccagctaattttttgtattttttatagagataaggtttcaccgtgttgcccagtttgctgtcaggcttctgggctccagcgatctgctcgcctcagcctcccaaagtgctgggattacaggtttgggccactgctctggccacatattaactttcaaccagtcatggtagctgttgttaatattttaatatataactctccagatcttttctatgcacatatactcatttttaaattgatacataatattcatactgtatgtactgttctgtatgtaacttgctttctgactttatgatatctagtttttacactctcattaaaagatgacagacatggaaccagcatggaaaacacaattaaaggaagtttaagaatcaaatgcaccagctatggtagttcacacctgtaatcccagcatttggggaggccaaggcaggaggatcgcttgagcccaggagtttgagaccagcctgggcaacatggtgaaaccctaactctccaaaaaaatataaaaattagccgggtatagtggcgtgtgcctgtagtcccatctgcttgggaggctgaggcaggaggatcacttgagcccagcaggtcaagattgcagtgagccacaatcgcgccactgtcctccaacctgggcaacagagtgagaccatatctcagaaaaataaaaagaatcaaatggattcttaaatttatggaggacttccttacaacttttttttgacctcgtgatccgcctgcctcagcctcccaaagtgctgggattacaggcatgagccaccacgcccagctgcaaatttttatattactgtactggtacgtgctttttatatatttgatctatttctttgcatcagatccctagaaataaaatttgggggacaaatgatatacagatttttaagacttgatacgttaatgccaaaatgccttgtgtggccaggcgcggtggctcacgcctgtaatcctggcactttgggaggccgaggcaggtggatcgcttgaggtcaggagtttgaaaccagtctggccaacatggtgaaatcccatctctact

SEQ ID NO: 4206 - DNA, 3043 bp, Homo sapiens
ttgttttgcagggtgtcctggaattaataaaactcgaggagtggggctgcggctcctctgtggactaagtgtgtggtatcactgcttaggtcaacaagtgcctgtcagggccggaaatgcccgtggagcagagggcctttgagtcgcggggaaagacaccgtgggctgcacctgaagctgcatgtttgtctggggttacatgagtttaacagaaggatttttctaccggaaaagaacgaagacgcaagccttggttaccccatttcagaggagattttaaagagggatctggaaaactgttttttcctttttttcactcatcatcatgttacacagtttctaaagacctgatctcaactttcctctcagcacaggctataattttttttgctaagacgatccttttctgtcattctcttgaatgtttctcttcctgggtgactgggagaattccttcaaaaggatttctgagactggtgtttcccaaacaacagagaacatcgtacccctagaaatggaggaccaagtggcttttgtgataagcaagacctcacctgcacttcgcagacactcccagcagaggaaaaataccaaacagaaagggaaagtggtcatggaacagattctgctaccaagaaatcagggaataaatggccagggatgagtttcataagacctgaattatacaattcagagaacaaaattcataaatttatctagttgtttcctgacaatttcattcgatctgcctaagttagctaccccatagttcacctagaaatgtttcctagttcccttacctattggtgcataaaagctgctttcacatgtctccagtttccaacctacatatcagccagtgatttgcataatccttaaacccccacccccattccttttttcagccacctaatgcaaacaagatctggctcaggcttccctaaactaatccacggaacaccatttagaagggagactattccgtgtaagttggcacggccgaatgagatctctattgtataaggggcagtcccagtagaaagacattaatgaatatgccagtggggagagcctcagcttcccagttgcttgctggaccctaaagctgtaagaactctgtgaaacttgaatgtttctttttttaaccaaggtaaggaatttaatgccactgccctgtctgaatccttacagctcatcaagacccaagtcataaacaacaacttcaggaagaatgaagcctagcctgagcctccctccaaattctccttttcccactcactgcttcacacttgaactaaccagtctgtcctctaaactcgaatatgcttttctggtaatattttatgacccctaccttgcccataaaaatgtaagttctttagaggctgagactgtgtttaagcatctttgcaaaacccgcagcttgttagcacaaataataaatgcttcttgaataaatacatatgtttttaaaaataacttgttattttaaaacagttatttagtgctgtttttccccagtatctccaggtttcagctcactctttgtattctccctccaaaacccctcccctctcacctttcagatctgctgagaccagcgctactgaacagacacgatggaaatgttccttatctatgtgggcccatatgctagcctctgacctcatgtagttattgagcgcttgaaatgtggatagtggaactcataactgatttttaaattttattttatcttcatgtatttaaaacttaacctagccacaggtagccactaggctactgtattgaagagcacaggaccttgactcttctgagaagtcttgctgaagaaccactctagacacctcccagccatcagtatgaaggtagattaggagcttaccttgtgcttgactttatcataatatttatcacaacatacttagttttctatttatttacctgattttcttattggactgtaagttcttgagtcttaagttatagcttatttatcattgtatctctgagaaccaggtgtaatactggtattttaaaagtgctcaataaatatttcgggaggaaaaggatgaatgaatgaactgattgctcagtggacggctagagacattttttaatatataagaaatctacaaaacagacttgttggaacagtgagctgggaactaagagatgaatggtggtgatgtgacaaattatctttgtctaaggagcatacgcagttctttagctcatctttcctcacaagctcaggccctgccttctgcttcactggaacacaggaacaactcgcttgtagactctctggtcattaagccatgactttgtccagacttgccctttaagaaaattcccaggagataaagttcactgcaatgacggagtgagataaacatgctttttgctgtgatcccatgttctcacataccccatactggtctaccgaacagctgaactcattcatcagatttgaaaataatcaggttttttacactctgttatcatgggtacggttgttccagagggtgtgttggcaaagagcctactgaaccatgtcctcgagaccgaaccacatccatccaagggcctggggagttcttgctcctttgctagctttattccaagtacacttgcaaagcataagggaaactcttatgcaaaccaaaaatgatcctaggtgtttaggaaaaaataatgccaaaagttggcatggcatgattcatgtcattttagggtacctagataattaagtctcagggctagacgtattccaaatatttggataattcaaagtaatttgcacagacatagtaaaaatctattttaggtggtggaatttaatatatatttcttggtgagaatttagtcttctgtgcaattttagccctaatattttaacattaacaggtttaatgttataaagtgtttttgtacttataagcttgtgaactaacaaaccataaaacaataacatgtgtttacaatttgaaaatatactgcactgagctctgttttctaaaataaattttgaactatttgt

SEQ ID NO: 4207 - DNA, 4533 bp, Homo sapiens
actgtatgtcacatgaaagggcaggggtcttcagattgctgatgttccctcagccatagaccatgcccacttttgacgtgctctagccaaagctgcatgaaaatatttttcagtccctactggatttttctcttatgaatggttaacagtgcaggttctggaaccaaactacctggattcagattctggctctgccgtttattcgctgtgtgttgaccttgaatgagtgatttaacttttccgtgcctcagattcttcatctataaaatgggcattatgacataacacaccttagaggattttttaaaagattaaatgggtttccagatataaaacgtttagaaactgtctgccacattaagtattcaataattgtgagccctttttatagtttgtcagtattgtttactcctgttctggttttgaggatctttagcttccatcctctacctgcattcctagtgtttttttttttctccctacttcttaaagttgtgctcaaggtttggtacttggccccttcctcatgcttttcactttttctggttgtgtctgttagtttgtcttcttattctgcctccatgaatcacaggtcattgttttctaatcatacccatgtgagttctaaaccaatacatatttgcagttgtcttttcatcacatatacctggatgtttcgcagacactttcgacttggcacatctgaattcatcactttttcccaaatctgattgtctcatactcccttgatgaaatgatgtaataatcccaaaatgaattattctcaattctacttttacctcccattgattaccaagtgtcagcatgtcagattttttaatactccttagtactatggctgatgaggtccgtcatctcttagtttgactgttagatttgtccctgagtagcactgtctttgattttgcccctgaaattcatcttcacactgttgacagaataatcttttaaagtggtttgttttacatgtctgtcttccactgctggactgagctcttaacaggagattgtatctcttgtttttgtaatcctagcacctgttaaaataactagcaacttagaggtgcagtcttgcaggttttctgaccctccagtcaccctagacctgcactgatacagttttcgttagccatttaaatttaaataaaattgaacattctgttaattagtaatactagctatatttcaaatgctcatagccacatgttactgttgactactatattggacaacattttagaacatttcgattatcataggaagtttcattggacagagctgccccagcagacctttgctgatgtggatgtctttctgtattaacatccttttaacattcagacacctcccaaatgctaaccttaatagattggccttcagcatttatgtctctctatcttgatcctgcaattgatgactttactatgtctgctctgcagagagcaccactaccagcatgtgtccaatcaggaaagccgacactacatatttcaacagaggagatgtgagtacagaggcattagagagtaacccggggatcacaactgtaggatgcagctactagtcctaagggtaagaaaacaaatgggaaaaaattggggctgccagagccttaaagctccaaaaagggtcatcatggcattagtgctcagacccctgaggaggcttaccacctacctgctcatggtaattctgaggggtaaagtaacgacagttctagaagtttcgaagtagttgaaggctggaatttgctgccgttattacaaagctgataggactagccatcagagatgaactagatcttttttcatcttcctgccaacttccctgtagtacttcctactggcagaacctaataagcagcagtcagaggggtcagagaagtgtagtttgcagagtcccggcctcagcacacagagcagaggacagaagggtggaattggagctgagaaacaatagatgaagaaccagcacactggtttccttcaaagactcatttttatctaaaggtattagtccctaaaacgccagatactcaggaatttgtagagaaattctgggccctcaagaataagtgtactagttcgaattgaaatcttgttactcttttctgttaaacgagactgtaatgctgctatatagtgcttaacttttaaaattgacagtggatgaatctgcatattatagtcaggtgttcatgtccatccattcatttattgagtgcctaccacatgccacacaatctatcaggtggtatgtatataaaataaaacttagataataagacaaaagtaataattcacccaaattcatctataaatccagacttagggactgttgacatttttgtgttcgtgcctgtggacatctttctgtgcatatgcatgtacacacatcacaatatcataaaaagtttataaatgcagatgtttccaagaaagtgtgtattcatctacctctctcctgctgtatagtatttgattataaggagaatgctccattactatttacctgtggacatagagcataggctgctacatatgtctctatatactttatgcactttgtctttccactaaaatttctcaaggtataatttctgtctgggtcactgaatatgtagatttaaaattttgagctacatttttcaaactgcccttcaccaaagatgttacagtttacactgccaccaatagtacatgagactgttctttcatacattcaataacagaatattattgacctttaatttgtttgatagccaaaagtgtgttcttcgcatttcaaaatttttagtgagagcatattccaatatgttaattgactatttgtatttcttgtatagttaactacctgtttacatcctttacactttttcttttgggtgtttatgtctgtaacttggcagtagctcatattaggaatcattattatacacgttgcaaatatttttacaattagtttatttattattgcattataaccatgcttacgtagtggtgctctactatttctgccttaggtataatgtttagaattttctctggtcagggttataaaaatactcatgtttctcctgatatttttatgatttcatttttagatcagtctttaatgcagttgacagttacattaaagtagtgaaatagtcaacattttctgtcagtattatctggttgtcataataccatttataaaataattcctgctcttcctcattgatctaaaatgtaacttccactagataatcatatttatgtttgatatttacaaatactattcagttctattttgtctgttcagctactttcactgatttaattattgttgcttcttgtttgactatatatttaaaatatttgttttataactaatacaaggtttcatacctaataggtcaagtattacttcccaacacatacacccttatctctttcataattccatactcttttacagataaactgtagaattatttaatcttccttcaaatacaggttctattggtattctgattataatacaggatacatagatacatacgacattgcatgggtcacataaattgtggcaccttttcaatattaatattcttattcataaagaatattgtttgtcctattaggttcatatgcccctcagtaaagtttttagattatttttctttagtcaggtatcttaatgtgttttaatgttcttgtatttatgaatgtgctccttttttctccccctttacaaaaatgttttctaattgaatattttcattttttaaatctcagaacctcttcacacaaattagtaagggcctcagagaacttttatgttggcagatgctgattgatctaatctcggcttgtggaggacgaacctcttgcatacacttacccaaataatttactgtgattaggtttcttaggtataccgatgcaaaaacagaacgaaattcatcttgcaagcaactgtctctcattataggttagtaaatgagtgttttgtttaataaacatatctattaattttattaatccaaactagttcacctaatagtactcaaaatagcaaagataaatggttaagctagaggcttccctaacatgaaaattgactaataattttgttaaatgtctctatgctgtcaccagtgtgtatatattggccattcttttgatcactttattgatatattttgcttgcagttgaaaaaaagatagttatacttagataacttgattgctgtcttctaaattcccagtaggtggtgtcataatactgtatttagggatttttttttatttatttaataaagtggaaaaagaaagtgcaaatgtgtttacttaagtatatgtacttgcattttaaaagtgttttggttttattatgagatgacactgttataaacaacttaattccttatatgtttcttcaattcacatttttactagaaaatatgtactgacagttttattcttttattctctagaatgatacaaaactacctagtcaaaagaacaa

SEQ ID NO: 4208 - DNA, 665 bp, Homo sapiens
atttctccatccctctctcccttgctctccttctgcagcaggaggagctgcagacagaacccctcagacaccgagttgtagaaggaagggctttattcagctgggagcatccgcagactcacgtctccaaaaaccaagctctccgagtgagcaattcctgtccctcttaagggcttacaactctaagggggtccgcgtgagagggtcttgatggattgaggaagcagagggtacgtgactgggggctgcatgcacagacaacgagagcgaaaccacagagaaaagaaacatcccgtgcatcacggcctgatgatggattcctgtttcctgcaaaatggggagtctccaatatagcctgtttgaaaactggaaaggagagcaccgacacgatgctggtcttccacgcattcctggaagtttctggggccccacagagctcgcgaaacagtcaacatggtcacgctttcggggggcagaaacttgagcaacaggcacctttacagagggcaaagaaacgtggaatccagaatcacgcttcagttggcctgagtgtgactcctgtgtggatgggactatccgcctcgagctctgttgcagggctcaacgtggggatatgtcatctgtgaaccatgtggatgaaaaacagacaactacctgggtctcgg

SEQ ID NO: 4209 - DNA, 513 bp, Homo sapiens
tctcactttgtcacccaggctgcagtacagtggcatgaccttggctcactgcaaccgccgccccatgggctcaagcaatcctcccacctcagcctcctgagcagctgggactacaggtacacaccatccgcccggctattctttgtctttctaggagagacacggtttcaccatgttgcccaggctggtctcaaactcctgaggctcaagcaatctgccttccttggcctcccaaagtgccgggattacaggcatgggccagcacgccctgcagccttatctactttcttaattgtctgttgcagtttcatgtaggttaatctcatctgtctacctacccaatgagagacaggaactaaaactattagagcatctgtatactactacagacttcataggtaattttatacaatactgaaggccaaagtaggatatgtgaagcaacgtcagagatagtttattcgcttaacctaatagggaacttggattggaatccagatgacttcaaaatcc

SEQ ID NO: 4210 - DNA, 1217 bp, Homo sapiens
acacacagtacaggatgaggcccaggaacacgaacacatagttgctctggtagtactccacgttgcgtacgaggcgctggcacagctctcccaggttgcggggccgtgagaagcgctgctggtccacgaaggtgctccagggccggatggtcgcgcggcgccgctccagccactcccggcctgcaccggagggaatcagcttcggcagcagggtcctgcggggggtggggccgggtcagtggtggaccgggatggagccccagacccccgcaaaagaaggggactaagggtgcctggactccctcccgggaccccagattcctgtacagcaggcagggaggggactaggggcccagactccagggtcccattagaggagaccggggccaacacttctgcggctcggggctgggactccaggctctcgagggaggagggaggagggggccgggggcccggactcccgggtctctggtccgagggcctagagccagctcgctcacgtgccgctcagcccttccgcctcggcatctttctgctggtccttctgcgctgccatgtctgcgtcgtgaggggtagagctgctgtaaccagcccggtaccctgaagaccccgccggccccgcccgacgccggccccacccagcggagtcgacgtggcgcagccccggagcagctggggactgtagttctgccgccgagtattgtgggagttgtagtcctgacggtgactaagaggatgggcgctatgatggcggtctgactcgcaaaacaccttgggagatataatcccagaaagtgacggcgcgcgcctctgggtattataggagttgtagtttcaggagggtgcatgtgggctgtcaggagcgagggcgttatgggaactctaacggcagaagcgggcgttgtgtactctcccagggaaggcacaatggggaccgtgcagagctgtccttctgactctagagggcataaaaaaacacctggagggcttgctaaaacagattcctgggccctagcccagatgttttcattcagcaagtctggggtggagcccataatttccatttctgagttcccaggtgatgctgatgcccctggtccatggactacattttgagtagaaagatttagataatttgtgggaattgattccttcctcaagagattgaggctagtgagggggccatggttgctggaggggtatctgaggttgcc

SEQ ID NO: 4211 - DNA, 12006 bp, Homo sapiens
gctaccaggctccggggaactggcgccctggtgccccgccgcggctgtcgcccctggggactccaggcaccccggccgaggacgccctcgagggaagccctgggccgcgtccgtcgggggaggcgcgaggaagaccgccttctggagtgcgggctccagcggccctgtccgcggccccgaggcacctctgccgaaattcgggggcgccgtccaggcctgggcccggggtggcagcagctgtttccaggcggggagcagcgggactcggcgggagcagaggccgctggcctaagacgcctcctcggtgggtgcgctccctggattaacagtggcgctggctgtcacaccggccgtttcccgagctcagagcgggacagtgccctgggttcctagggctgctcggcggcccttagctgcggcccggcgggattcggatggctggagttcaggtgctgcggactcttggccgctccacctggtttcatttggaggcctcggactcaagccacttccgcgaggatgctggcagaagccgctgcgagcagcaatcaaggggaggcccgggtcctacagcgccgggcagaggctgtgcagtcttcaatccagtgggggccgctccgtgtcttttctgctggctcttgagggtcgcagctgtgcgcagtctggctctctggttttgcacgtgttttctattgaagcagtccgtactgctggcccgtatggcctcggctctgtgcggctccactcgcctccggggcaagggggcattttcttgattgacgccctcctgcggtcgtcacacctcgcggtgagccgtttctgctaaggtcctccattaatcatggaaatggaaagacttccctgctttttctattgagacttctcaggttttaaagtttataatttggaactatttgtccaaacacagcgggaccacagtaggaagaggcgtggactgtgagcctgaccgcctgttcgagtttcacttcgcacatttttgttgagcaactactgtgtgccagcagtgaaaaggacagatgtagtccctctcctcatggagacaggaaacaaattttaatatatgtatgtgctaggaaggagatgtacataatggtctaaaacctgtaacaaggggacatcacctatctgggggacattaaggaagggaaaagcttcccaagaattgatgtttgaaaagtgagtgggtgtcagcaagcccagggtgcttggacattccaagtccggagaatagcatgtgagcgttgttagttaatgcaacttccgtcaagtcaccatccctgagtttttctcatctgaaacgtttgagacttggcctaaaggctcctgatctttttagggtattgttaataggtatctttcagaatctaatgacagacaagagctacaagcccagacaaactcagaagtgtactacactatcattcgagttaaagcatgttgggggtaggtaagaatataattgctctattatacagtacatataaatcataaatttttatattactccatgatataaactatctctggaaggataacgaacattggctgactatgaagaaaggggtgggattggagggggcatgtatagctgtgaatatctggagacttgcactagatggatgtatgacctattcgtcgtataagtaagtccttgaagaagtggctgattctagatctagggcaagaaaagtacaaggtaagctcaaagacatcttgtgtcagaaaccgtgaaaagaaaatagggaccaccttggagtggtttccatcggcaaaatttggggtgatttaagctttaaaaatacattagggattataccactttgaatataacaattcgtgagtccatagtggtactcagagagagaaaggtgcagtggatgtgaaagctggaagaatgtcagctaacagatgtagaaaaattggtacaatcgaaaaacgtaataattcaagaagaatcatcatcaactaacacgtgaaatgttgaggatgaggattttcacaaggcctcatatcatcccaattaactggattctggattttaaaaaactataaaggagccgggcgcggtggcttacgcctgtaatcccagcactttcggaggcagaggcggacggatcacgaggtcaggagatcgagaccatcctggctaacacggtgaaaccccgtctctactaaaaatacaaaaaattagccaggcgtggtggtgggcgcctgtagtctcagctactcaggaggctgaggcaggagaatggcgtgaacccgggaggcggagcttgcagtgagccgagatcgccccactgcactctagcctgggtgacagagccagactctgtctcaaaaaaaaaaaaaaaaaaaaaactataaaagacattgctttttattggggggggggataatggggacaaactatgaagtatatgttagttgacattattaatcttttagatgtgattggtattgcaggttactttggaaaatgcgatcttgggagttgcaagctaaagtctttaggagtgatgggtcatatgtgcagcttacttttaaatacttcagtatatacatatatgtgcatacacatctacatgtatatttatacacacatatctatgtatatgttcatatatgtatatataaagagggatatatcacaggttcagttctagaccacttcaataaataaacatagcaataaagcaagtcacatgaattatttggtttcccagtgcatgtaaaggaggttatctttacactttactacattcagtgtgcaatggcattatgtcttaaaaagcaacgtacataccttaatttaaaaatactttgttactaaaaaattgctaacgattggcagggagtggtagctcatgcctgtaatcctagcactttgggaggccaaggctggcggatcacttgaggtcatgagttgaagaccggcctgccaatatggtaaaaccctgtatctactaaaaatacaaaaattagctggaaagtgcttgaacccgggaggcagaggttgcagtgagctgagatcatgccactacactaccagcctgggcaatagagtgagactccatctcaaaaaaaaaaaattgctgacaatcatctgagccttcagcaagtcataatctttttgcttttgaggggtgttgccttgatgtggatgagtgctaactgatcagggtgggaggcacagaaggttggggtggctgtggcaattccttaaagacaaccatgaagtttgccacatctgttgacccctccgttcataaaagatttctctgtagcatgtggtgatgtttgatagcatttttatccacagtagaactttcaaaattggagttcattttctcaaaccctgtgctgctctatcaagtatggttgtgtaatagtctctcttttttgtccttttttttttttcttttttcctttttgtagagaatggagtctcgctccattcattgcccaggcatgtctcgatctaccgggctcaagctatgctcctgcctctgcctccctaaatgttgggattacaggcatgagccattacatccagctatgtaatattctaaatcctttgttgtcatttcaataatgttcacagcatattcaccagaagtagattccatctcaaaaaaccactttctttgctcatccataagaagtaactcctcatccattcaagttgtatcatgagattgcagcaattcagtcacatcttcaggctccacttctatttctcttgctgtttccagcacatatgcaattactttctccactgaaatcttgaacccctcaaagtcatctgtgagggctggaatcaacttcttccaaacttctgttaatgatatttttacctcctcccatgaatcatggcctctggaatggtgaatcctttctggaagggttttacttgactttgcccacagaggaatcactatctatggcagctatagccttacaaaatatatttcttaaataataagatttgaaaatcaaaatcactctttgattcatgggctgcagaatggatgttgtgttagcaagcatgaaaacaacattcatctctttgtatatctccatcatagctcttgggtgaccaggtgcattgtcaatgatcagtaataatttgaaaggcatatttttttcctgggcagtagatctcaacagtaggcttaaagtgttcagtaaaccacacagtaaaatgatgtgctgccatccaggctttgttattttatttatagggcacaggcagagtagatgtagcatagttcttaagggccctaggattttcagaatggccaataagcattgctttaaacttaaatgtcagctgcattagcacctaacaagagagtcagactgtcctttgaaactctgaagccagcattgacttctcactagctatgaaagtcctagatggcatcttcttccaatagaaggctttttggtctacgtgtagaatcagtttagtgtagctacgttcatcaatgatcttagctagatcttctgggtaacttgctgcaccttttctattaacattttctgcttcactttgcacttatggtgatggcctccttccttaaacctcgtgaaccaacctcatctaacatccaccgtttcttctgcagcttcctcacctttctcagccttcatagaattgaagagagttggggccttgctctggattaggctttcgtgtaagggaatgttgtggctggttagatcttctatccagaccacttgcactttctccagatcatcaataaggctgtttcactttttagcattcatttgttcattggagtaccaccttaaatttccttcaagaactcttcctttgtgttcacagcgctgtctaacttttagtggatcttaactttctacatggcctccttgctgagcttaatcatttctggcttttgattgaaagagacatgcaattcttgcttttccttgaacacttaggggctgttgtagggttattaatttgcccaatttcaatattgttgtctctcaaggaataaggaggcccaaggagagaaggaaagagactggggaacagcctgtgagtaggacagtcagaacacacgacatttattaagttagctgtcttatatgggtgcagtttgtggtgccccaaaacgattacaatagtaacatcaaagaccactgatcacagatcatcattacagatataacaataaatattatgagaattacccaaatgtgacacaaagacatgaagtgggcacatgttcttgggaaaatggtgccaatagacttgcttgatgcaggggcgtcacaaaccttcaatttgtaaaaactgcaatatctgcaaagcacaatgaagtgaagcacaataaaatgaggtatgcctgtatcgaaaattattaattggtgaatttaggtgaagagtatacaggtgtttgttgtactataatttcagagtatacaagtatttgttgtactctaattttagcttttttataattacacatagcaattaaattaccataattcctgtagatttgaaagttttcaatataaaaatgagaaaaaatgaaaacactgtttctttttttaatctcaaattcctttttaccatactttttttgtgtgtgtgtgtgagacggattcttgctctgtcgcccaggctggagtgcagtggcatgatcttggctcattgcaagctcctcctcctggattcacgccattctcctgcctcagcctcccgagtagttgggactacaggcgcctgccaccacacccggctaatttttttgtatttttagtagacagtggtttcaccatattagccaggatggtctcgatctcctgaccttgtgatctgcccatcttggcctcccaaagtgctgggattacaggcatgagccaccgcgcccggcctaccatccattttttttaaaggcataatgttttgaatgatttctgaagattgcatacaatttcaggtagtgccttgcccctggaaactatcagtgaagggttatttgggaatcattgatccctctgtgggtcagctccagtgttgtgccatctccaccgtcatcattctcatcccatggcctgatgaattcaatgtgctcttctgtgttccaaggacagagacaagctctggggacaaagaaagaacagttattatatgaagttcaaacctaccttcacaagttatgtttgggtcttgaaagattgggacctcagtaaactaagcagaaaactgtgctaattatttttctcacaaaatgtttcccctttgttttcattgtgcacctttttcctgccccttctactctgcgagtaacagatgatgactccaattcatttagtgctttcacagtaaatcactagccagcctttattacccatcttcagaaacagtattagtttatggtactggtttattctgtgcatgattcagccaccagccaaaagatctaaatctacaaatattttaaatatatatattaaaatgctagggaaataatcactagcatagagttattaaataatcactaataaaagaagcatcctctctttctttgatttagccacagatcctgggaagtagatggagatcttaaaaggcattggtaaaacattccaactcagctacataatcctcactggcaaactgaagcacttaattctgttaagctatataacactaccttttctacatccaatcgtcagatccatgttcacttagctaaagttaaaaaaaaaaattacaaccacatttgtgaatgtcacatttattgaactacataatttttaatatcacttgtgtacgttttatagtttgttttattgttttaaaagtcatttggggccctaaaagaactagatttttccaaagttgtccttatgattttttttcgcacagtcagaactaataaaacaaaactgttgtagctatttaattcaaaatctctcggagtttcaatattttttctctgctggatactaaaaccaataaagctccatgagattttaattatattctgaattaaacaagactttctccaaaaatttggccccatttattttagccattgctgttgtgcaaaagaccaaatttgtaagaagagaaggtagttctcatttgtaatttatctagaaggaatttaggtaaactttttgcaacttacttttaataaatgtatgtagaggtaaaaattcaagttagctatagcttgaaagcatcaatggattttattataacaacttggttctatttatacttacactaagttttattgtcttcaactgttgggatgactaaatcatttattaaatttcatatcaaatcatatatttttcaaatatttgagaaaatctaattagtgctttagtggtttactaacttacaaaatactaatctgatcaaatagagatgcctcatccccatcataaatggaatcagagcccagaaatacataagcagtaggcatcatgacattgcttcagtgacgttctttttccaaattttttttttttttttttgagatggagtcttgctggagtgcaatggcgtgatctcagctcactgaaacctccacctcctgcattcaagcaattctcctgcctcagcctcccaagtagctgggattacaggtacctgccaccacacctggctaatttttgtatttttagtagagacggggtttcaccatgttggccaggctagtcttgaacacctggcctcaggtgatccactggcctcagcctcccaaagtgctggaattacccacatgagccaccacacctggcctttttccacattttacatactacaaggtgcctcacataccactgtcatgtgggtgaattttactgaccatggagctttaggtagagctttaggtaactgctcaatttaaaaagtgatgatgaattcaataataaaaagagcacccaattctttaaatgagctaaaggtctgaatagatatttctccaaagaagttatacaaatagccaataagcacatgagaagatgttcaacatcattagtcatcagggaaatgcaaatcaaaaccacaatgagataccacttcacacccactaggatagctataataattttaaaaacacaagtgttggtgaggatgtggagatttagaacccccccatgctttgctaatcgcaatgtaaaatgaagcggcagctttgaaaagcagtctggcaatgcctgaaaagtttaaacaaagttaccacatgacccaatgattctacccttgggtatattcccacaaaatgaaaacatatgtccacacaaaaacttgttcacaaatgttcacagcagaattatttatgatagccaaaaagtggaaacaacccaaatgtccctcagatgatgaaggggtatgttaaaagtggtatatccatacaatggaatattatttggtaataaaaagatacatctgatacatggatgaactttgaaaacatttatcttcaaaagaagtcagacgcaaaagcccacagattgtatgtatctttcaagcttgtccagcccatggccatgggtctcatgtggcccaggatggctttgaatgtagtccatcacagattcgtaaactttcttaaaacattatgagattttttgtgattttttttttttttagctcattagcaatctttagtgttagtgtattttagtgtggcccaagacagttcttcttccagtgtggcccagggaagccaaaagattggacacccctgctgtatatgaaatgtccagaataggcaaatctgtagaaatgaaaagtggaatagtagttgccaaggctggggaacttggggataaatgaagggtgactgctggtgggtacagggtttctttctggagtgatgaaaatgttctaacagttattgtggtggttgttacgcaactttgtgaatagctttaaaaaaacttttttttttttttgagacaaggcggagttcactctattacccaggctggaatgcagtggtgcgatcttggctcactgaaacctctacctcccagattcaagtgattctcctgcctcagcctcccaagtagctgggattactggcgtgtgctaccacacccaactaatttttatatttttagtagagacggggtttcaccatcttgcccaggctggtctcgaactcctaacctcaggtaatccacccacctcggcctcccaaagtgctgggagtacaggtgtgagccaccacacccggccaaaaaaaactttaaatgggtaaattttatgatatgtgaattacacctcaatacaactgtgtaggtttggttttttggtttttttttttgagacggagtctcgctctgttgcccatgctggagtgcagtggcacgatctcggctcactgcaagctccacctcccgggttcacgccattctcctgcctcagcctcccgagtagctaggactacaggcacccgccaccatgcccggctaattttttgtatttttagtagagacggagtttcactgtattagccaggatggtctcgatctcttgacctcgtaatccgcccgcctcggcctcccaaagtgctgggattacaggcatgagccaccgcgcccagcctgttttattttttgagacagaatctctctctgtcacccaggctggagtgcagtggcgtgatctcagctcactgcaacctccgcctcccgggttcgagtgattctcctgcctcagcctccagagtagctgggattacaggtgcccaccaccatgcccggctaatttttgtatttttagtagagatggggtttcaccacattggccaggctggtctccaactcctgacctcaggtgatccaccagcctcagcctcccaaagtgctgggattacaagcacaagccaccttgcccggccattttttgttttttgagacaggatctctctctgttgcccaggctggagtgcagtggtgtgatctcgactcactgcaacctccgcctcctgggttcaagcgattctcctgcctcagcctcctgagtagctgggattacaggcacgtgccaccacagcccggctagtttttgtatttttagtagagatgcggtttcaccatattggtcaggctggtctcgaactcccgacctcaggtgatccgccagcttcagcctcccaaagtgctgggattagaggtgtgagccaccacacctggccagtactattaatctcaatgataaaccaggactcatgctgtctggaccacggacacctctattcaagaggagcagcctgttcctcttgatcctgtgcctcttaatttgcatgtttttcaccaaccaggtgcccttctcatcagcaccgagaaagtaggggaagagggacttactgccagagaactcaaagtctattggaaaacctgaaagccagtccaaattctgtccctgtttttaaaattttcacaacgtcctctcagatcatatggccacaaaattccaccatccttcactttaaggagcactgtaaagattctattttgagagaaggaaaaggcaacaaaatgttgtgatgcgacattttgaagtcgcaagacctgtgttctgcagggctgtcagagagagcttggttcagacagaggtggaagggaagtagtgtggactttctaagtgtggggatctatgagagctgaggatggccgcctcctagagaaacagaagcttcatggtaaagacattgtgaattaacctacaggaactcactctcccgttccacaaggacttcatctcagttcaaacataagctggcttcctgaggacacgtttcccccagacgtgaaatgggcctgaaacactgaattatttaagattggcttatcgctggctgggcatggtggctcatgcctgtaatcccagcactttgggaggctgaggtgggtggatcacgaggtcgggagttcaggaccagcctgaccaacatggagaagccccatctctactaaaaatacaaaaattagccaggcgtggtggtacatgcctataaccctagctactcgggaggctgaggcaggagaatcgcttgaacccgggaggcagaggttgtggtgagccgaaatcacactactgcactccagcctgggcaacaagagtgaaactccatctcaaaaaaaaaaaaagaaagaaagaaagaaaagaaatgttaaagagagttcttaggccaggcgcggtcgttcacgtctgtaatcccagcactttgggaggccaaggtggatcacttgagcccaggagtttgagaccagcctgggcaatatagtgagaccttgtctctacaggaaaaagaaaagaattagccaggcatggtggtgcacacctgtagtcccagctccttgggaggctggggtgggaggactgcttgagcccaagaggtagaggctgcagtgagctgtgatcatgccactatgctctagcctgggtgacaaagcaagagcttgtctcaaaaaaaaaaaaaaaaaaagttctttaagcaagaggaatatgatatcacagaatctggtattatacacaaagcaaagaaatctacacacaaaaaatgaagatttctggaaatgactaaaattaaatataaaaacttttttacttttatttttgatctctataaaaattattgactttcaaaaagaaatatagtggaatgtattatgggtttattgcacatttataaataaaaacaatcatagaaaagattaaagagaagaatttaaagtgtactgttactaggttcttcttttttttgagacgaagtttcgctcttgttgcccaggctgaagtgtaatagggcaatctcagctcactgcaacctccgctacccaggttcaagcgattctcctgcctcagcctcccgagtagctgggattacaagtgcctgccaccatgcctggctaaatttttgtatttttagtagagatggggtttcaccacgttggccaggctggtctcaaactctcgac

SEQ ID NO: 4212 - DNA, 1547 bp, Homo sapiens
gctgtttgaaaggactttatcgatctctttattaacatcctagcttcggtttgttgtgtgcttattgtgtgctgggcctgggctgagtggtttacatgtcttctctcctttaacactgcatttccccaaggaggcgggtgcggtcttattatcccatcttaaagacaggccagtggcctgattccagagctcatgctttaaccccacgttgcactttctctcactgctagtgtagacggaagctcctttggtgccagattataaaggtagaaatttgtggaggacatcgaggagacagaagacatgctttatacatgtttctttttattttaaaaagctttgaaatacatttgaatgaaaaactaagcagttgcttatgctgtcagtacctgtctctgctctttaaaaagtaagccactgcctcttacctaaaggtcagcatgggctccatcatacagcggtcaggtccatcatacggcggtcaggtccatcatacagcggtcaggtccatcatacggcggtcaggtccatcatacggcggtcaggtccatcatacggcggtcaggtctgtaactcttgacaggaaggtgcagtagcagaatggcgagatgcactgagggtaaccagatgatctcatgggacttacccagtgttagcaccaaagtcccatgaactgaggtgttaaaacagaaaggcctgtgtcctcagaacccctccaagtcactggccaactatgactcatgtttggtgatgttggatgccagttaataaagtccagaacttaagcccaagaagagagctcagaagtgtttgtgttactctttattgaggaataatttacagatagtaaaatttaccccttatatctgtacagttttgtgaattatgacaaacttactcaggttgtgtaaccaccagtgcagtcaaggcatagattatttccatccttccagagaagtctctgggaccttttgtagtcagtcccctcatggaatgttttgatcaacgtagaaatgcctggaggctgctgggtgggaggctgatcactcagccatcagagcgtcctgtgtctctgagccgtgcaccccattgtggcatggcactggttgctggacattcttctgcgggcccactcacacatctgcctgcctgcggcctgtctgtgtttgtcttactcatgctcttggagccgtagcgaatgtgtctaatattccttccacgtggtagattgaaacttcaccaaaatagccctgtgcgcctactttgctcctgaacatctctgatttctccggctgtccctgtgtggagttctggcagatctcaccagtctacatgacctattggaaatgccagtgggtcattgtggcattcagacacataattcaaaactgcaaatggtgggaccgcactaaagaatttttagtaattaaagtacaggaggctgaggtgggaggatcacttcagcccaggaggtcaggtcaaggcttcagtgagccatggttgcaccactacactgtagcctgggtgacaaagtgagaccctgtctc

SEQ ID NO: 4213 - DNA, 333 bp, Homo sapiens
ctccatggtggaaatttcagaggagcccctgggaaccgtggcggatataataggagggacaacatgccacagagaggtggtggtggcggcggaagtggtggaatcggctatccataccctcgtgcccctgtttttcctggctgtggtagttattcaaacagagggaactacaacagaggtggaatgcccaacagagggaactacagccagaacttcagaggacgaggaaacaatcgtggctacaaaaatcaatctcagggctacaaccagtggcagcagggtcaattctggggtcggaagccatggagtcagcattatccccaaggatattat

SEQ ID NO: 4214 - DNA, 683 bp, Homo sapiens
cctggaagaggcacgttcttttctttgttgccgttggggtgctggactttgcacaccacgtgttcgtctgtgccctgcatgacgtccttggaaggcagcagcacctgtgaggtggctgcgtacttgccccctctcaggactgatgggaagccccgggtgctgctgatgtcagagttgttcttgtatttccaggagaaagtgatggagtcgggaaggaagtcctgtgcgaggcagccaacggccacgctgctcgtatccgacggggaattctcacaggagacgagggggaaaagggttggggcggatgcactcctgaagagacggtgaccattgtcccttggccccagatatcaaaagcatcacacagggacacagtccctgttcgtgtctttcgcacagtaatatacggccgtgtcctcggctctcaggctgttcatttgcagatacagcgtgttcttggaattgtctctggagatggtgaaccggcccttcacggagtctgcgtagtatgtgctaccaccactaccactaatagctgagacccactccagccccttccctggagcctggcggacccagctcatggcatagctgctaaaggtgaatccagaggctgcacaggagagtctcagggaccccccaggctgtaccaagcctcccccagactccaccagctgcacctc

SEQ ID NO: 4215 - DNA, 4479 bp, Homo sapiens
actatttccagaagcgtaagggtgaagaaatggaaacagagaagagacagttgcccaaaaaatttgtctaccctgctccacccagagaagctgatctatgtgaactacatcaacaggctctcttgccttctggcttctggtgaattcagccccaacaacaaaagatttgagggatggagaagaataagattgtgataagtattccaccggttgatgctctgtggtgttgccttgagatggttgcgtttctgaacctaagatcagagcgtctttcaaagcagctctctccacattattccctctttccacctttgataaacactcactccctttgccattcaggcctaggaatattgatagcactgctgttagtagtagtgtggtacttcactattgtttgtggtttctctatgctgtctccacacttttgtaactagcctcttatccttgaattattttgatttgtgaggatcatctgtttcctaatgggcccttgactaaataaaggctgggagtttttgatccagctggcatcccctttctaagcctgaagattatagatttggtattaataaagtagataaagagtttatcctccttgtagttccttgtgaatggagcatctgatagtgaacttttatgcacacaattttattaaagatttatttgctataaagtgaaaacatacctggtgaaggcggaaaatatcagagaatagtaaatcagtgaatcaaaagatctgtatttgatccagataatgtctgagatctgttctgctctccaatttgataacgttcactctgaagtatcaatgtttatcatcatctagattgagaggtgtttgcacaatctcacatctgcccaggttgtgagatcattggctattctctgttatgttagcagcttccatcctaggcagagtctcataaacagataaatgatacttgaggacagaatattagatttcacagattcaagctctcattctttgcttaaagaaagttttgatttataggtaaacatacacaatcagatgacactgattttttgctctcaaatatttggtgaaatgggcagtggcatatctgacagagaattccatagagacaaattattatgtaacaagggcaacgatagatgtctctacaaatatgtttgccaagtatctgttggcaattttcctactgtatcttgatgctcattttgtttttaattttattgtttgctaaaggcttggaatgaaaatattaaaagggaaataccaaaggaattaatgcaaaaataggatggagccccagatagtgtatgagagtggtgatggaggccttgggaaaagaaggaagggttaactgagctaaggaagcctgcatatgcacaagagctaacaataagtaattatccagagtctaaaataattcctgtttttaactcactctgaagtgtactgataagttaccagtatgcagtgccaactattctttggacttgagaaacttgaggagctcattcggtgtgtacctacatcctttgtctcagggtacgctttcagtggttgctgccctgaatccgggctttaaatgtagctgataaagtgccagcacttaataagctttagcctgaatagggagagtaaggggaatagaagaaaaagcagtaagagagccttcaacggaaacaaactatgaaggaaaatctctaagaagttgcagtgaggcccagatacaggcaactgaatccttacaatgcattccagctaaggtgaataagaaaagctacagagtaaatttttacagcataccaagccagtatttttcctccttgagtgttgtcatcaccgttgttatcatcattgtcatcatgtatttagtgtggaacctggtgatgtacaagtactctagcattctgaggtcactcttatttcacaaccaaataaaatgattcaaaccattgcagaaaactgtacagcctgtggtgattcactgacttctcaaatatttccaaaaattctccaaaatttagaatttcctggacactttatgctctcatttccaagagtcagcagaattctcattttgtgtcctatggctcctgttgtctctctattccactttattgtattcattcacccaaagcaccaataacctaagtgttaggctacttaggttaattttcacatagaaaattccaaacatataattttctatgtgggtggcatgttttgctgtggtaagagcatggagtgtaatctctctccccagaagaatgttataacaccttatcagaccacatatgcgagttattggcctcaactactccaaaacacatataaacccaagactttgacagacattaagagcttagagtgtggcagggtactttctgccagcctttgagctactctctacagctttgcccaccaacaccagcactatttgaaagcactgaaggagcttacatatcattgtgttcatcaaacgtctctttcaagaacctcttgtagaaaggttaagtgttaaaagaaaagcttcagcagaattaaatttaaaggcgtttaattgagcaatgaatgattcatgaattgggcagccttcagaatcacagcagaatcagagacactccagggatgcctcatggtcagaacaaatttatagtccaaaaaaagggaagtgacatacagaaatcagaagtgaggcacagaaacagctggattggttgcaggttggcgtttgccttatttgaacacagtttgaacacttagcagcctatgagtggtttaagtatgacccctggggttggccaagactcagctattgttacaggcgcatacccttaagttagattttcaattttgtctgccaattaagctaggttacaagttcatccacaaggactcaaatatagaattacagagtccttctcaggccatatttagtttgctttaacataagcctcaaacctccattagactttacattcacagatgcctgcttccatcctaattgagcagctagactttaataattgaactctaaacaaaattggaattcactcactatgtgcttaatgtaccttgtctattaagtgtgttctctgtgaggtttattctccttattctccctctctttgagtgtggtggaaaaagcagagcatttttatgtggcaataaactgtatgattgtgatgaataaaatcatactttgatcatctccttattttaaccatacaaaacaccaaggctgttgtgtaagaatgctgtagagaagttttaatatcaataaagaggcaaacacaacacaacatggtacagaaaatagctcaaaataaaatatatgagctgtttccacatgcaaggagattgggtgttgcctctccaacctgacaacaagtaaaaatctgagcaaaatgaaaaaaattaacaattcttcttagatctctaagagaagtgaagtcatagcacaaactgctgctccccaaattggagagacagacaaagaggcacaaggcattacaacttttctcaagcagaaattcatagaaatctccacaggagattttcacagtaaatatgagacaaaaattcctttggggttccaacagtaaatttcagagaaaaacctcacatttttagcagggggagggtaaaacggacatttttaaatataccacagcattctgttcttaacaaaaactgttctcaggagaaactgaagagcctaacctgctgggatggtatcaagcctaactaaccttggggaatggaaatacccaactccagctcactctagctagatagagtaagctcataagttatcttcatcctgtctcaccaaaggagagaaaaaaataaaacctgagaatcatgtgtaaagttcatagtccggaggcacaggctcactacgagactgacacctaatcataagactaagaatgtatttcctcccccaacaccttaaccactacattactaaaggcctatttatggccatttcttttacccagcacatcatgtctacctagatagcaagaaaaattacaagacatactaactggcaaaatacacagtttgaagaggcagagcaaacatcccaaccagacccagatatagcaaggatattgaaatgatcagacccagcatttaaacaactattcatatgctaagagctgtaatggagaaagtagacagcaggcaagaacagatgggcaatgtaagcagacagatggaaatcctaagaaagtccccaaaaggaatgcaaaccaaaaacactaacagaaatgaagaatgcctttgatgggcttattggtaggctggacatagctgaggaaacaatctctgagcttcacaatgtctccaagaaatctccaaaattgaaaggccaatagaaaaaaattcataaaaatgtagcagaatatctcagtactgtggaacaactacaaaagtagtaatatatgaggagggagaataccagaagagaaaaaaga

SEQ ID NO: 4216 - DNA, 1204 bp, Homo sapiens
caggcatgtgccaccacgcccagctaattttgaattttttagtggaaacagagtttccccatgttaaccaggctgttcttgaactcctggcctcaagtgatccacctgcctcagcctcctaaagtgctgggattgcaggtgtgagccaccatgcccaactcactgaggcctctcaattcagcttttctatgccaggacccttcagctcactgggcgggggtgcagggcctgacctcaatctcttgtgctgcagagtgaggctgtgaatctgcctcctgctggctctgggcacagtctctacactgcctgggcactgcccctggcttccaacttttctcagatgcccttctttgggctccagggccatggctgggatctgggggcagatgagacagaggctgataccatgggggtcagagaggcagggcagggggtagcttccgctctgtccagggatggggaggccagctcaggaatccatttagaaccagtaaaagcctgagctggaagggcctttctagccttctgtttcccctctacaacctgcagatgggaaggccacgggacagaaaggaactgggcagaggtcactccccaccccatctagagggtccacatatgctaccttcaggggctgcaaggtggaggtggctggaggctcctgtcctggtgctggagcccttggtgctcagacctgcagcagctcccactccctgaggacacaattctcagcctgaccatcagaactcttagggtctcctagaccccatcggcggctctgaccctcttttatgaaagcacccaaagagcacctgaggcaaaggacagcatcccccaccctattgagctcctcattgcaggagctcaaagatgatgacctcagtcagaatgaaatggtatttaagcacaagccagtagctgttgccatcctggggaatgtgctgtattgtctgtcactggcagcattgcattacatcaaactattgcctgaatatcacaagaagtgcaaacaaagccttatggattgaacattgcataaaataggccttgtgtgtggcgcagtggctcacgcctgtaatcccagcactttgggaggcccaggtgggtggaccacctgaggtcaggagttcaagaccagcctggccaacaaggagaaaccccatctctattaaaaatacaaaattagccaggtatggtggcgcat

SEQ ID NO: 4217 - DNA, 1550 bp, Homo sapiens
tttgatgttgttcactcaacgtttctatttttattcaattataagcaaacagcagaattaacccaacattcagcaactccagatcagcttttcttacccccatgaagagctatcaatttaacaaccacagttgtaaggattcttaataagctgtcaatgagcactgctgccggtctagatggccatgccccaacaaaagcaaagccactctccctaatgctttttccaggattgctttttaaaggcaccagagcgagaagattgcatcattacactcaagcctgggctttgcagtgagactttatctcaaaaaaaaagataaaattgacaaacctttagtcagactaaggaaaaaagagtggagactcaaatgcgtacagtcagagatgaaaaaagagacattgccactgatacttcagaaatttaaaagattatgagatgctactatgagcagttatatgctaatgaattggaaaacttagaagaaatggataaattcctagatacatgcaacctatcaagattgtaaaatgtctcttgatagagctgtttaaaaaactacaagtctttacatgggggttaagattttctcttaatttcatttattgtagggcttttagtaatctaaattttatttttgtatagtctagctatattttctacaggagaaacagacttagtctatatatctccgtaggtcttcttaggtttccatggtattactaattgttatgtctatagagtgctgtgaaacaatcctatcaatagtttctggccaaacacttgtttgactaagccacaaaggcacctgctccatagatatgaggatatatttctagattgatgcctatctggctacattctgtagtctgggtttactggtgttaattaactcagtttgtgtgtttcttttgttatctaaatgtagatggttctttatacctggccatagaattatgacttatgcatcttatggtggttaccttgaaattagaacaaacctgagctctaatctggggctgactttcctcagtcgtctctctacattctgtgttgacaatgctaccatgtgaaggcctaaggaatacaatgttcatcaaataattaatcagactttgctcacatatgaattagttctgtttgctggcctatcaagcagaagtattttaaacagttgtgagaatgacctttaccaaatcattttaaacacaaatccaaaaagcttccacccatgcaactgcttaggaagttgaactggctggagctggtagacacacagtaaaggataagtacatgtgtcttaacctatttattaggcaattattctcacagctaacctagcatgtagttcactataatttcagagagtttgcatagctgtcctcaaattgctcagttgtcaaaaaaatgttttgtgttttttttgttccacctatgatttccaggttactgagtcattccataatctaccaaactggtaaattcagagtttctaaagaccaggagtgtgcttttaatcacatgcagaaccatttaatgtttaggatcaa

SEQ ID NO: 4218 - DNA, 581 bp, Homo sapiens
tccaaatgcggtgttgaaagtcaccaactccggcttttcagggacattaaactgaggctcagagtacaggtggtactacaacaaatggataggagaaaaccagtaaaaccttatttgttgaagaaatgactcataaaaaccctctaagttggtaacagatttggctatggtcaactgcagggaatctcctaggaagcggataaatctggcaattggaagtaaatttctaaggaaaatgtggaggaatatgtaacatacgtccatagcatctctcatctcctctctctcccttctctctctttccctctctctcagttaagagccaaatacccccccataaaccccaaagtccgtaagctttttttaaatttaatttaattttatttttctgagacggagcctcgctctatcacccaggctggagtgcagtggcatgatttcggctcactgcaatctccacctcctgagttcaagcgagaggctgaggcaggagaatgggttgaacctgggagtcagaggttgcagtgagctgagatcgtgccattgcactccagccgggatgacagagccagactctgcct

SEQ ID NO: 4219 - DNA, 3922 bp, Homo sapiens
gagaaagggtcttgctctcttatccaggctggaatgcagtggcatgatcatggctcactgaagcctcgatctccggggctcacaggaccctccctcatcagccccctcagtagctgcaaccataggcatgcgccaccacacccagctaatttttttaattttgtgtagagatggggtctcaccatgttgtccaagctggtctcaaatccctgggatcaagcaatcctcccaatcagcctcacaaagtgttaggattacagccatgagccaccacatctggccaagtgtaattttaaactctcagattttaatatgaatttcaatttatcacaactgttgttttggtatacacaatttcccatctttggcaagaaataatccctttaaattggctcctagtccttaaaaatgcagtattttttaagggtttcctttatttcatgttcaacaagatgttttcagctcatctcatacattcgtcatttctccaaggaattcttattccttttagcagaaaattgcatttagagactataatctgcattctaagggtgctcattactgattttcaaataacagggctagaaaatgtgcttctgtaaaggaaatacattatgattttataatgatatttccaattcaaatttgtaattataaacacaatttataattttatttagcagctttgattttatatatatagtttcttgattcctaatattaacaaaattgcatgttatttatcctccaaaatgtatataatagattcagagtaacaatattaacatatattattattcaatattaatactatttgtaaattaattttatttttaattttttatttatttttaatttagtttcatactttagggcatatccactaaaaatgcatagacaagtgactgtgttttaaaaatacttgaagtaattctcctctgtgtgtttaggacaccaacacaattagtttcatttatttcatttagcttttgctttggatatatagttacgcacctcataacattgtttcagtcaacaatggaccacaatgaaccacgtatgcaccagtggttccataaggttgtaatggagctggacaatttctatcacctagtgacactgtaactgcagtgacatcatagctgtcttaatggtatagcgcaatgcattacatatgcaaatctatgaataaaaaagaagcaaattgagtaaaccaccatggacatatttctgaaaagagtgacactgcctcaaaaagagcctcaggcaggtccttcaggaagccttccagaaggcattgttatcataggaaatgacagctccatacatgttattgcccctcaagaccttccagtgggacaagatgtggagatggaagacactgatattaatgatcctgaccctgtgtaggtctaggctaatatgtgggtgtcttacatgttttttttaagctttaaaaaaaaaaatacatttgaaaatattttaaaaagcttatagaatgacataaagaaaatatttttgtacagctgtacaatgtgtgttttaagctaagtgttattacaagagttaaaaacttaaaaaacatttaaaaagtttaaaaagtaagttacagtgagctaactcattattgaagaagaaaatgttttttataaatttagtgtagcccaaatgttcataaattctacagtagtgtagaataatttcctaggcctccacattcactcaccactcactcactgactcatacagagcaacttccaacctctaagctccattcctggtaagtgcccttgcaagtgtaccattttttgacttttatactgtgtttttactgtaccttttctatgtttagatacacaaatgtttaccattctgttacaattgcctacagtattcagtacagtaacatgctatacaggtttgtagcttaggagcaatagactacatcatatagcctaggtgtgcagtaggtatattctatgatgttggcacagggacaaaagtgcctaacggcaccatttctcagaatatatccctgtcattaagtgacacatcactgtataagtattttttatcttgattataagtgtgacgtgtgtaaaacattgacatggttctaaagttctagctacaaaacaaagtaaatttagagaaatctaacttccatctgtgtccccttgctttcttctaaaaaatcattttagtggtttcttattctttcattttctaaataaaagcaaaatacatatttatattctccctttattaaataagaggtagcatactctattaactattctacaccttgtttttttcacttaacaatatatcctaaagatcattttatgaaagtatacaaatttcctacccctgttggagctgcttagtattccacggggtgaatgcactgtagtaggttcaaccactcctgagttggtggacatctgagtcgtttccagtctttaactattataggcaatgcttcggtgaacatgtcttttcatgtttgtgccattgtatctttagttttgtatcagttagcttttgctatgtatagcacactgcctcagaacttaatggcataaagctacaatcattcattagctcaagattctgtaggtcagcaattttggcagagctcagtgctgtccttctgttgttctcactcatgtgactgaagtcagctggcaactcagctggagctggatagtctaagacagactcatccatgtgtctggtgtaagcaggctgtgagccaaggtttctcaagtgacctctcatcctccagcaggctagctagtgatcatttatgtggtctcatggcagtctcagggctccaagcacttcaagagagagcaagctcaatgcccaagcacttttcaatcttctgtggccatcaagtttgctattgtcattttgatcatgcaggacacatggacaagcccactgtcagtagaaaagaagaggactaaccaaagacgtgcaaacatatttccctgcttccatggaatgggtataccaccgtctatttgcaaatcatctaccatggagagacattcctaaacgtgggcgatatggtttggatatttgtctcctcgaagtctcatgttgaaatatgatccccgctgttggagacggggcctagggggaggtgtttgggtctaggtagtggatccctcgtgaatggtttggcactttctcagtagcaatgcgttcacatgagaactggttgcttaaaagagcctggtatctctcttgcttcctctcgtcatgtaatatgctggctcctcttctcttccaccaagaccaaaagcttcctgggcctcatcagaagctgagcagatgctaacagccctgcttgtatacagcctgaagaaccatgaaaaaaaatacctcctttctttataaattacccagcctcagatttttttatagcaatatgaaaggaataatatagcaggattgctgggtcacaaggcaaatttaaatgtaaaattgccaaattcccctataacagagattatacagttttgcatttcctccatcagtgaatgttcctattccaatagtgttaccaagagaatattttcttttttgagacagagttacactctcgtcgcccaggttggagtgcagaggtgcaatctcggctcactgcaacctccacctcccaggttcaagcaattctcctgcctcagcctcccaagtagctgggattacaggtgcgcaccattatgcccagtaaatttttgtatttttagtagagacggggtttcaccatgttggccaggctggtcttgaatgcctgacctcaggtgatccacccaccttggcctctcaaagcgctgggattacaggcatgagccaccacacctggccaagcaagtgtgttttcaaactttcatttttttttttttttttt

SEQ ID NO: 4220 - DNA, 1297 bp, Homo sapiens
caaggcaaattagtgatagtacattttttaaaactttgtattttccttgtgcctcaacatccccacaaacaggccgtgaacactctgccctggcaaccagatgcaccagtatgataaggctggtccctgccacaagttccccttcataaccttccctggcagtgccctagtgaaatttaacgaaatcacctcatgccttttgtttgtgtatcctgacccccaatacaagcatttgcctacaggtcctcactctatcagttatacctatttggctgaacccattctttgggcttctcccatatggttccctgcatggtgtaccttgcctccctctctaggacctttgagtataataaatcctttaatttcatttacctctccaagtataattcccacagctatgttggagtgatccttgaggaccccacagggagacttactccctcccccatttaccacacagagagttatagatgataagctgattattggtggttgttgccatcagcagtcaaagaaaagagaatgcccagggtttttttgtttgtttgtttgtttcagaggatagagaagaaaggcattttgagtttcatgggacaagagtcatttgaaatgactctataaatagtgtgtcttaccatatgtgatatattcagtgattaagaaaaactaaacctaaatctgatcaagactctagctccaactgccagtttgcaggacatacaaagaactaggcacatattctaaatgatgtgatggggatacaaccagcaaaatccagaatgtggaagattctacaggacatacaacccagtttctttagcaattaaattagaaggggaaaaaaaggaaaggggatgggggaaatcctataaattaaaagagatttaagagttatgtcggccaggcgtggtggctcacacctgtaatcctagcattttgggaggccaaagtgggcagatcacttgaggtcaggagttcgaacctagcttggccatcatggtgaaaccctgtctctactaaaaatacaaaaaattagctgggcttggtggtgcacacctgtaatcccagctacttgggaggctgaggcaggaaaatcgcttgaacccgggaggcagaggttgcagtgaaccaagatcatgccaccacactccagcctgggtgacacagcgagactccatctcaaaaagaaaaaaagagagagagatgtcaactaaatataatgtatgaaccttgtatgaatcttcattcaaacaattcaactgtaaaataaatttggaacaatggaaaattttaa

SEQ ID NO: 4221 - DNA, 1399 bp, Homo sapiens
tgttcatgtttgtaaaattacatatttatatatatataagtatttaaaatataatgcaatttatttacatattggatttttctcatttctccacacaatctcttgtctctctgtctctgtctctctctctcaggcacacacaaacacacactctcacacacatgcacacacacacactctctctctctctctctcacacatacacacacagagacaggagattttttattagtggctttatacaatacataacacaatgccctttacagaagcactgaataatcttgacaattacaaatggattcctttgaaatattgtatgaacattaaaccaaaaaaatttatttgtgttaagaatagggtaacaaatatgaaagtgattttaataaaggtcttcctaaattttgctaatcaatgtatgcatcatagaggggtattatcttcctcaatcaccactaggagattaggagaaaaaaagaatagtgactgaacagacgtgtaagaatgatacacaaaacctcatagtaaaagtggaaaagaagaaacattttgtaaacctgaaatgtcttggaatataattttccatgtggaatctggctcaaatggcatgtcagatgccaactggagcagccacaggcatgtgagctacagcactgtctaaaggatgccactagtctcaatatattcccagtaacagtgagttggtggaaagagctgttctggcctagtaactgaaggcaactaccaggcagttaaatgacagggcttcatgactgagactgctattgaaaaagaagaaggtttgtgtgtctgatgggtgaactcatgcaataatactaatatgggggcgggcatgggccgggggagttgaaaatgagaaaaagcattatatgaagatatcaagcaatcaatgtgaataagatagactcagagtagcaaaatgaaaagtaacaaggaatacaagaacagaagtctaggtgagacttcagtacatgatttaagacagaaatcttacacttttaatcaaaatgttgcaatattaagagttggaagaaaaaatgtaccttgttttgtgctgctaaaagaaatatctcagttttcataactggctctacagacttccatcactttctaaattggtaatgcacaaacaaaaatggcaaggaatttattcacttatttatttatttatttagagacaaggtctcctgctgttgcccaggctggagtgcagcagctgcaatcagggctcactacagcctcaacccctctgctcaagcgatcctctcacctcagtctcctcagtagctgggaccacgggcatacatcaccatacccagctaatttttcattttttgtagagacaaggtctcattatgttgcctgggctagtcttgaa

SEQ ID NO: 4222 - DNA, 1450 bp, Homo sapiens
gccccttgtttgtcgttttgtatgaagggggtttttgttgttggattttcttccccatctctgtgtcctgttatgttctttggcttatgtttcaaaaattctgtttcctaccaccaacctctgtacatgccacaacacatacaatttgtactttcacagtttctgtgaagtaggatgatctgcagttaataatcaactgtttgggcattcttggtatccaaggaaggttttacttagaaggaagaacctggaaggacctgttggcaattagactacttctgcgtttattttacattttcccttattaacgtaggctgttgagagttgacttgttttataagagaaaccagattgacagagaagacccccaatcagatagagttattttaaaaataaatgtgtttattatggtaacatttggggtagaatctaaagggcatatttttaaaaaaacttttagttctaaagacaaaagagtttaacctaaaacagaacaaagagaagggcctttgaagcagtatgattgattatatgctgaatgtagcattagaatgttgtatgaaagcataaatttttattttctcaatttctatggtacaaactactatgcccatggaagtatgtgtttatgcccacagcctgaaatatattcggtggaatgccttaaaaaagaataaatctggccgggcgcggtggctcacgcctgtaatcccagctacttgggaggctgaggcaggagaatggcgtgaacccgggaggcggagcctgcagtgagccgagatcccgccactgcactccagcctgggcgacagagcgagactctgtctcaaaaaaaaaaaaaagaatagatctgaggaaaatgtaagagcaagtctaaaattttgaagtcctttttgaaatgctattttttcctagacaaatttagtgttatttgtggcaaatagaactttaatgtcgtaatttagtaatagaacaaaataagggtgggtttacatgtccctgcacattttaggatggagctaaaaattataatgtctgcataccaaattgttacacattttaatattggggcttttattgaaaaagtttacccaatatttagaaacctttaaaaacaaagtgacataaaatattcacagataaatcaggtagtcaccttattggtggcatattatgtaagtgtactaaagccagatatttagtgttaatccaaaaatatgaaaattatgctaacatcatatacagatctcagaagttgctgtagccagccaggcgtggcggctcacacttgtaatcccagcactttgtgaggccaaggcgggtggatcaccttaggtcaggtgtttgagaccagcctgaccaacatggtgaaatgccatttctactaaaaatacaaaaattacccgggcatggtggtgcgagcttgtaatcccagctacttgggaggctg

SEQ ID NO: 4223 - DNA, 1790 bp, Homo sapiens
agaagtgaaacaagagatgaaggaatgttgcttgaaagaaggaactctcaaagttcctcagccctaatctaacacaaattgcacttagggttactggggggagggtgcggccgggagggttcaattgtccagcaagggcaacacgggttaagtgaaaggtagagacaggacctccactacaccccgggactctcacccccgagtagtagtggaagccctaccgcccactcccaccccctacaacagcagactgagaggccggcaagaggtccgagctgggaagtcctgcgcgccgcccccgtcactcagccggcggcgccatccgagcagagcagctgggggagaggagacgtcccctcgccccgactggtgacccgggcagggggcgccccctgccctgaagtccccgcgtctaagtccgccggccgctccgccagtcccggtgaaaagcagggaagttgtgtgtgctgggagggggggtccgtcggctctcccagggaagcctggcggggcccgggaactcagcggcttcacctcgaggggactcccgtctagagtctcgtggcgtccgaggcagagtacagcggctccccaagtccgcaggccgggggcgggatcagcgcggggctgggggtcaacgagcacttcctcctcccagccggggatccggggcttctccagggattctccgtggcgaggattccgggtgggggtggggatcccgcgcggttccgcccccgccaggccaggggcagctggcgactcgctcggtctctggtggtacgcgccacggcccccccaccccagctctgcgcgccccctcccctccgggcaccaccccctttccaccgccccgccccgtccaggcaccgcccctggcttaacccattcccggcgcgtccggctgcagcgggagaaacgcagggaaccgagagggagaggcggcatgtggacaggccgggcctcatttgcctaatgcaatgcggctgaactctcgctgaactcgcctggcggcgcctcacctccgagtgacccacccaccgctgcccgtgacatcacccgctcgccagcccgcccgcggggctcgcccgccagccccctgcccggccgaaccgggccacctcccccggagacgcggagagcggcggcaggaggcgtagggccgggtcgcgcggggccaagtgtttggcacccgggtgtgacattgtgcagctcggacgctgtgtcggaatgagacaccggcttgtgtcattgtctgtgacatcatgtgtgactccggccgccggaacccgacgcggcagcgcgggtgctgttggcacaaacacaggcagagggggccctcctccccacgctctgcgtgcttccggcgagcaaagccccgcccaaggtgtctcctagctggggaaccagtaccggcccctggtgcactgtccagctctggagagataaaaggaagagctggtgccttccagtggactacttcatcctagaagccctcgggatgcacgtttcactggaagaaaggcctagcttgggtaggtccctagaaagaggggatacccctggaggagggggtatcctattacccccactctctaaaaggaaggatggaaatgtacatgctacccaaggacattcttctagaagaagcctggctctttatatatgttgtcattttatcctcacagcaactccaagagatgttttacaaataaaacaggtctcagcaaggctatgtgggttgtccaagatcacattactaataataaagagtagagcaggtatttgaa

SEQ ID NO: 4224 - DNA, 495 bp, Homo sapiens
gggcaggagaagagactcgagcggcacccgagccgcatccacgccgcccgcccgcccctggggtctgggtaggtaacgggcccggcgggaaggaggggctcccaggccgtccctcccagcgctcacctcagctcctcgtcgacattcccgcggggctgttcggccgacgccaccatagaggaagtcgtagaggtcttgttcttcaagatccccttgatgggccggtgcgaggccgtcgaggccgccattgccgggcgctccggctgtcggctcagggtcgctgcttggcgtggggtccgcgaagagaagggtcggcacagcagagactcgcaggcagccgcagatcccgctcagggctaaagcggccgcaactgctgcctcggaaacggctaccgcagcggttgtcacgacacaacgaccccgacgccagagccaacgccgaacgggtggcggctactcgcgcacccttagccactggcacttgacccgcggctc

SEQ ID NO: 4225 - DNA, 2543 bp, Homo sapiens
tccccggggtggttgatcctcgactggcccgggaggcgcctgggtccgcgcgggacctctctgcctcctcctccgacccgtgcggggcggtcgggggcgctcccgagggggtcccgggaaaggcggggtctggcagggggtcctgggcgctgggtcgttcagaagcacggctttactccagttaccctctttttatccaaggccggggttccccgggtgcctggtagcagtgaaaccccaagtccctcggttaggggagccgtgaccctgggagcttttgagctctctggtataacatccttttacatcctaagagacacagttctgtgcttgcttaggacttttttcgtatgcgccctttcttcccccaaaaaacaaaaaaccgaaaaaacttgtatgtctctcccgcccacccgtactttcactattcatttacctcatagaagttggtcaaattttccattcgaagacgagttttatgctgcggtagcttcaagcaataagtcgaacactgtgttgaaattaagtcttggatccgactacttccagcgaagtgaggagttggtccaatagaaattattttccaaaatgtgttgtaattctcctgttgctccacaaataaggggttatcagagaggaaaacgttgactgacttcgcatttctgaaagctggtttgtagtcgccttatttcatccttacccttctctggaaatgtgacattagttctgtttgtgcttaagacaaaggaaacagctggcacctttcgggaaggtggctccagtacagttgtttccaggtgttaagctgtatgagaaagtagaaaagtaatcagaaatccttactagttttcatttaatcatttaattattaattttaaccatcattatttgtcgtctacttgttttgtgtaaaatgagtaatacactcaaagttcttgttaataggaaattattgtttgataaagctggctttatggcttggttattttgatacctgctatgaaattctatgtccagaagagtgcagcatatccaagcagggtaataagttcagaaggactgaaaaagaaaacaaagatgatttttctttaatgatggaaaggcaatttttatttcaaacgattatgcatttgtaggttgtgcataggctgaaaggtttgaatcactgtgaaataatgtttctaacaacatccttaaaactgagttacctcttgaatggatagataaataggaactgggttaactaccccaaacgctaatctctttatgatcatccttttttggaatgatttattattttaaaaattatgttgtaagaatggaattatagccccggaaatatttagaagctttatttcaaattaatgttattaagtattccagcaaaacaataaattccacttttaagtatatgttaaaatggtgataaataaaagttataacttaattctatttctgacactttaattttgataccaaatcagtttgggcatttaacttctgtagtggaaatattaaaaatttagtacgtgggtttaaggattttttcccctaaaaactttaaatttatctatgttgtttctacatcttttaaagtaactattctttttaagttcatcatgaagcttattttaagatttttttcttattttccgtatttcttaaatgacagggttatacttgcagcctggctttgataatatgttaaacaagaagttaacatgggtggttgattataggtacatattaaagggtgtctgtgtacattaggtgggataagaactatataggaacaccaatatttgggccagagcaaatttgaaaaattcacaaagaaggtatctgaagaggcatagcaatcgaattatgcatcctctttaaaataatcacatgaagccctgtgtgctcatggtaagggaggagtagaaaatagtcaacaagtaaaattgtgcattttgtagaagcaaaatcggacactttcctctgatttcagtactacaaagcacttgacattctaccattgaaaaaagtactttgtaccctgagataaaaataaaggtgattggttcttgtcttttaagtaatgaaaccttgactttgtcccctaagtcaagactccctagccacatctacctgaaggtaatgtcaccatctttatgaatgcaatgatagtgctgaaattgctgtttctcattatggatggtctaatgtaaacctaagaaccttagtaattttgtgggatttttaaaaaaatacttgctatgtttttttatttggccagccagtccttttgaagtataactctcttgtaatttttgcaggtttgcttgcaaacttaattcttacattttcctttttcaatacttaatgtttttgtgtatttctttgataatttgtaaatttttgtgtttcaagattatatctttgaatcaagtaattttttaaaaacctgatcatcagtgataccacaaaacactacaaagaaatccccaaataaatgttgttgcttagatttttctactttcaaaagaaattaccaaaag

SEQ ID NO: 4226 - DNA, 931 bp, Homo sapiens
agacaacctccagagcagggcagcaggcagctgctagagatttatttctccacttagtcgtctccgcttgcggcttcctcccatgagtgaggaccaagagaagccccctgtctctgatgaaagtgggggatgaacactgaaccaaacccacactgctcagcacatttgatgcggccagaaacagactgcaaaggctgagaaagcttttcaggggccgtctggctgtgtgggtgcgaagacctggctgtacttggaatcacctgggaagacttacaaaaatggtttccgagcctcacccgcaaggattctgacttggtgagtctgaatcaccaagattctcggggtgaggccccagaatctgcctgtatgtagccagcaatgctgcatttggacctgcatctggggacctctgggccaccctggcccccttaatttataaagcagaaccagccccagggtggagaatgaatgaggtgcctgtcacctggttacacaatttaaggtgtccttagttatgcccagctgactcgagcacagatcttcctgggcactctcttctacaccagcacagggtggggcgtgggaggggagtacgtgcccatgcgggcatctactgaatgtgccaggcctgtatctctattatctcacctctatcctgtgaagtagatattattatccccattgtacagatgagaaaacctagactcagagaggctgagccatttggtcaaggacacacagctgctgaaatgacaaggccaagtttgaacccaggtggtcccttctttggcccatgcttaactacaccagggcaccctcttgatagtggtctccttggggttctgttgcagctcagagcacaagcttctccctgatcgctgccctatagcttatttccaatgtttttttttttttttttctggtttttagt

SEQ ID NO: 4227 - DNA, 2715 bp, Homo sapiens
tgagagcaccatatgacaggcttgtggaaccacatctgatgccaacttggatgctgtcctttttctccaataaaaggaacttttcacttgtttttcagacaccctttaaaaaaatgtatttaaagaggctggttcctatccatccgactggaggcatctcagtgcaagagcaaagctaagtcctgcacacgctcctcccctcctcctcctccttctccccccaggttttcccgaatgtatctactccggttacaactagacgcggcccctcccccacctgcctccccccttccttccctcgatcgtggagggagcgttctctgtgccttcccaagtccccgtgggggaccttctatgttggagtggggggagggggggagggtcatataacgaaggccagaaagaacaaattagataatcaaaagaattatagtaattgctttcactttcccccgcccgctcagcggattccctcccccgcccctcccctggtttttctgtctgtcgggaatactcggtctttccgaccccctcccctcccccaggttcctcctctcctctccccttgctcgcgcgttccctctcttcctccgttttctggtgtgctggaacgttcagcggaatatgatgaatgatcacctgtcacagcttgtttattataatgcaggcaatcaattacacatccccaatgctggccggcccgcaggaaatttatatgctcagcacaaaccaatgtgaaaatggaatctcatttgccaaatgtctttctccccgtacagcacgatgattacagtctgtgtttgtttcaacagtcgtgtacaactgacagtgccatcatttactgcctggctcaggtcacgttactctaaggctttatttatggtgttacgaagggcagcacaggaaaaggacaagggtgtctgtcagggatggcactgtgttaaaaagtgggcgtgcaagggccgcattcccgggcagccgctgcaacctcagcccctgggcccttacctccgcagcctctcccagcatccagctacccagactccaaggccccaggcgagagccagctctcggtacctggagctccacaggtcccagaatcggggtggatcagagttcaaattctggttctgctactgtctaattgcgtgctgcagggactcaatctcttcatctgggaaatgggagtaataacccttggcaggaatgttgcgatcctctgggatgtcagaggtgttgatgaatgttagttcccgggacttcggaaagaggtcccgttggaagagatgtgaattggaattcacaccctatattaaaatctcctccaatcttcacctctgagacatggctgtctcaagactgttttgtttcccttcctggtggaattttgcacttttatgtcctgtgtagcagcaggtagtgtggctttgagaaaataaaatggccaccttgctccgctgttctttctttgtaaaaaaaaaaaaaaaaaaaaaaaaacggcatagcaatcttggcctttctagctgtgtgaccccaggccggtcaatccctcctcctctccaagcctcggattcctcccctgagaagtaaagaaaataactcctaaactgcctcccgaggcttgctggcaggatccaaggtgtccagagatgttaaaaaaaaaaaaaaaaaaaaaaaaaagcccagtaaatgggaaagtgaggctgtcactgctgagtggcatcctgttttcaggagttctggttggtccccagagttctgctacacaaaatgttgacccaaatttgtacccccacaacacttggtgtcaagtgggagctcagaaactgaggggcaggcagatgcttttatgtgtattaggttgtcttttattgtattgtatagttcctttttttttttttttttttgagatggagtcttgctctattgcccaggatggagtacagtggcacgatcttggctcactgcaacctccacctcctgggttcaagcaattctcctgcctcagcctctcaagtagctgggattacaggcacgtaccaccatgcctggctaatttttgtaattttagtagagacaggttttcaccgtgttggccaggctggtctcgaactcctgacctcaactgatccacccacctcagcctcccaaagtgctgggattacaggcttgagccaccgtgcccagcctgtactatatatttctttattatttgacacgtgtatttgtttaatggccctctgctccaccagtatggaagctccaaaaggaaagataccagattgatcttgatcacctctgcctccccagcacctagtcttccttggcacatcgtgagtgctcgggtcaggctgtgccacatccacccagccttgcctggggtcatttatcctacatgtactcagatcacgtgaactggtgatgggccacccatgtgcctgcctggagactcctattcacccttcagatcaatatcccccaaataaactcccagtcactctggcatcccatgttgctttgtgatctctgcctctctctagaccatttggctcctatgcacaggcagctatgtctttttcatatttgggtccccaaaatgcacagtgcggtgcctgcctcaaaacaaatgcttttcaatccgtcaatcaatcagttgacatggatcatcttttctcagcactgatgtatggactacaacttggaattccattaaag

SEQ ID NO: 4228 - DNA, 8672 bp, Homo sapiens
attgtgaaaggggccgccgccgcctcgaggggggcagggaggggaccgcgggggccgggggccggcgaggggaggccggggctgaggggcgaggaccgaggagcgcgcggaggagcggggtgaaggtgggctgccgagggaggggcgagccgggggagggtctggagggggaagaagggcgagggcggccgcgggaagaaggggaaagcggaggctccccgggaaaaaagcgcgagagaatggagttgagaggaaagaaggaggatacaggcggccaatgtgtggcctacgtgggagcgccccgagcgctccacgtccccggcctgcgccgggcggccccttccccgggcatcttggcaacgcgcctggcccaagccggaggggccccgcggccccgcacgcctcctggaccagtcaggatccaggctcctctttgagcccgcgggtgtttcatgggggtagaagtctaacccctccaccccctctcctccccagcagtcccacgcgggtatgggagagaatgaagttctttgtctctaagggattcaaaccagaaacggagggacctctggttcccagagggaggaaaatccatgatgtctgctgcccagggagctattgccaccgcctccttgggatgaagtattgccagctaccaacagttccttcccaacggccatcttccagccttcttaaacgactcctagcatcttcgggaggctcctgaaggactgaagcaaaggaaatctctgaagggatttagtccttgaaagggagtagggatacttagggtgttctgtgttgagcgcttcttcctatctctccagcttcatgtatgtgtgtctttatgtccaagcaattgagccaacaagtcctcagaattccttgtgaaaaaaacgttttttttttttgagacggattctcactctgtcgcccaggctggagtgcaatggtgaaattcagctcactgcaacctccgcctccggggttcaagcgattctcctgcctcagcctcccgagtagctgggattacagtcacgcgccaccacgcccagctaattttgtatttttagtagagacaggatttctccttggtcaggctggtctggaactcccgacttcaggtgatccgcccgcctcggcctcccaaagtggtgggattacaggtgtgagccaccgtgcccagccctgaaatagtcttaattgcttgtttttcttttttgtctgaggtgtgctttttaaaatctctatggagatggagaagactgacattctctggcctgatgtgaaaacctctcattaaaactgtgtctgtgctttgtgggctgaaagcatgaaacactggaaattttaaacaaacgtatgtgaatgtgttaagaagccaagagtccggccctctttcaccagactgtatggcctcagatcagcaagggaagtattgagcttagggacaccaagtaatggagtgagcagggatgagagggcacatagaatgtggtgatctctttccatgtcaaggcttgtgtgtttgtggcactggggtcttgctgtgtccccaaggctagagtacagtggcacaattatggttcactgcagcctcaacctccagggctcaagtgatcctcccacctcagtctcctaagtagctgggacaacaggcttgggctgccacacctggctaactttttatttttttgtagagacgggcctttgtaataccagcctttgttgcccaggctggtattgaactcgctcaagcgatcctcccacctgggcgtcccaaagtgctgggattataggagtgagccactgtgcccagccttcagcgtcaagactttctgcaccatctctacgctgacagctccgtaatttatatttctttctggactcatcccctaactccagaatcatatatccaactgtctagtatacatacccagttggatgtctaataggtatttcttttttttgaggtggagtcttgctctgttgcccaggctggagtgctggagtgcagtggcacgatctcggctcactgcgagctcctcccgggttcacgccattctgcctcagcctccccagtagctgggactacaggcgcctgccactacgcctggctaattttttgtattttttagtagagacgtggtttcactgtgttagtcaggatggtctcatctcctgacctcgtgatctgcccgcctcggcctcccagagtgctgggattacaggtgtgaaccaccgcgcccggcctaggtatttcaaacttacatctaaaaatcaagctcccgaattcctcccacccaaacacccaaataccacttctacagtcttactcttttttttttttttttttgagacggagtcttgctctgttgcccaggctggagtgcagtggcacaatctcagcccactgcaacctctccacctcccgggttcaagcgattctcctgcctcagcctccagagtagctgggattacaggcatgcaccaccatgcccagctaatttttgtatttttagtagagacggggtttcaccatgttggtcaggctggtctcaaactcctgacctcatgatccgctcacctcagccacccaaagctgggattacaggcgtaagccaccgcgcccagcccagtcttcctctctttgtcaccccattgcctttcaaaatgtatgtccaaggctggacgtcgtggctcgtgcctgttaccccagcactctgggaggccgaggtgggcggatcacaaggtcaggagatcgagaccatcctggctaacatggcgaaaccccgtctctactaaaaatacaaaaaattagccaagcatggtggcgggcgcttgtagtcccagctactcgggaggctgaggcaggagaatggcgtgaacccaggaggcagagcttgcagtgagccgagatcgcgccactgcactccagcctggcgacagagtgagagtccgtctcaaaaaaaaaaaaaaatttagccgagcctggtggcaggggcctgtagtcccagctactcgggaggctgaggcaggagaatggggtgaacccgggaggcagagcttgcagtcagccgagatcccaccactgcactccagcctgagtgacagagggagactccatctcaaaaaaaaaaaaaaatacatatatatatatatatatatatatatatatatatatgtatatgtatgtccaaaatcccacagtttctcaacacctccacaacttccaccctggcctctgccacacaatcctatctcacttgttttaattgcagtaactgtaattggtctctcagtttcaacctttgccttccatcacttaagtctactcagcagccacagtggtcctggtaagatgggagtaagatcatgatctttctctactcagaaccctctcatggcttcccatctcacttggagtaaaagtaaaatcattaaggcttgtaggatctggctccctggtactgctctctgactttagtttctactgttattcactcctttctgttggccccttcaggcccttgcagttgctgttccctctacctagatccctcttccttcagatgtccacatgacttcctccctcacctccttcagctctttactgtatgtcagctgagacctttggcccccgctatgtatactcacagccttctccaaaccgcctcttccctttttttgcttgatttttctccttagcatgtattacctctaatttaccttattaccttatcctcccccactacaatgtaaacttcatagttttggggggtttgtttgttttttaagacggagtctcactcttacccaggctggagtgcagtggtgtaatctcggctcaccgcaacctctgcctcccaggttcaagtgactgttctgcctcggctgcccaagtagctgggattacaggcgtgcaccaccacgcctggctaatttttgtgtttttagtagagacagggtttcgccatgttgaccaggctggtatcaaactcttgacctcgagagatccacctgcctcagcctcccaaagtgctgggattaaaagtgtgagccacagcactgggctgcttcatgttttgttactgccatatcctcagcacctagaaccatacctgccacaaagtaggcatttaataaatattggttaaatgattaaatgagctgtttagatatattaagagaaagcatctacctacctttgacctttagcttgactgagggtggcagttctattaaaaaatagggccgggtgtggtggctcacgcctgtaatctcaacactttgggaggccaaggcatgaggatcacctgaagccaggcgtttgggacaagcctgggcaacatagtgagaccctgtctctacaaaaaatttaaaaattatggctgggtctggtggctcacacctgtaatcctagcactttgggaggccgaggcaggcagatcgcttgaggtgaggagtttgagaccagcctggccaacatggtgaaacccccagtctctactaaaaatccaaaaattagagtaggagaccgtgtggccttaatggataaggtgtctgacttcagatcagaagattgagggtttgagtccctttgtggtcataacgtttggtcgggtgcggtggctcatgcctgtaatcccagcactttaggaggccgaggcaggcggatcacctgaggtcaggagtttgagaccagcctggccaacgtgatgaaaccccgtctctactaaaaatgcaaaaattagctgggcatggtggtggatgcctgtaatcccagctactcgggaggctgaggcaggagaatcgcttgaacctgagaggcggaggttgcagtgagtcgagatcgtgccatcgcactccagcctgggcgacacagcaagactcccatctcaaacaaacaaacaaacaaaaattagccagatgtggtggcgcacacctgtaatctcggctacacaggatgctgagacaggagaatcgcttgaacctgggaggcagaggttgcagtgagccaagatcaagtcactgcactccagcctgggtagcagagtgaggctctgtctcaaaaaaaaaaaaaaaaattagccgagcattgtggtgcatgcctgtagtcctagctacttgggaggctaaggcgggaggattgtttgagcccgagaggctgaggttatagtgagctatgatcacactgctgaactccagcctggttgatagagcaagactctgtctctaataaaatagtgaaacctagagaagagtaaatttgtctaggaacaaatttgaacataccatctggaaggaattaaggaggaagtgacaactgaggtgggccttgaaggttgagatcaaaggacatttcaggcagaggtaagaacattgcagctgggcacagtggctcacacctgtaatcccagcactttgggaggccgaggcgggcagatcacgaggtcaggagatcaagaccatcctggctaagacggtgaaaccccgtctctactaaaaattaaaaaaaatagctgggcgtactggcagacgcctgtagtcccagctacttgggaggctgaggcagaatggcatgaacctgggaggcagagcttgcagtgagccgagatcgcgccactgcactccagcctgggagacagactctgtctcaaaaaaaaaaattagctgggcgtggtggcatgtgcctgtagtccctcctaatagggaggctaaggcaagacaggagaatcactcaaacccagaaggcggaggttgcagtgagccgagatctcaccactgcactctagtctgggtgagaagagcgcaactccgtttcaaaaaaaaaataggatgtaactgtagaaaatgggagaagttcattggagtgtagttctggatagtggggcatgtaggggataaaacagattgagaccagattatgaaggtctgaaggcccagttaaggaatgtataatttatcagccttggtgaaacatcagaggatttccaccaaagtatagaatgattagatttgtgtatctgaaagctaacttcaatatttgcgtctctgcaccaaaagccggaggccaacttgaaggctgttagtgcaggtgtgagatgatgagtggttaagatactagtagtatggggatatagagggaatgacaggaggagactcagctgttaagagcaaagtttctggtgtgaaactgcaaatagcaatcacagttctcccgtttagtggctgtgtgttatttaacctctacctcaggttgcttatctgtaaaatgactatactaataccttacttcacagggttattgtgaggattaaatgagataatccatgtaaaatgtttatcatagcatgtggcacctagtaatgcttgataatgtagttatcacattattactaattggcagcatttgttgatcaatagaaagtggggtgagggagaaggagggctttaccgtcaaatttctaagactaaccagctggcaattccatgaataaattatatgttttcttcctctctagcccaattgtggttccaggccagcaccttcagtatcacctggaaacttgttagatatgcaaattcttggcttcccaccttagacctaatgaataagaaactgtggggtgagatgcagcacgtggtgttttaacaagccctccaggtgattctgatgtacttcaagtttgagaaccactgcttgggactctacaactggggttggttgacttttttttttaaacggggtctggctgtgttgcccaggctggagtccagtagctgttcacagacattatcatacctcgaactcccaggctcaagtgatactcctacctcagcctcctgagtcaccggtactacaggtatgcaccaccatgcctggctaatttttacatgacatggggcctcaccatgttgcccaggctggtctcaaactcctgggctcaagtgacccatccgccttggcctctcaaagtgctgggactacaagcatgagccactgtgcctggtctcaacattttttttttctggaaactttacagctctgaaatccaaagtctaggatttcactgctccagactaagtaaacatgcttttccccaccaaagccaaagctggaatttttggattggaggtctgatcttgatctcaatacacaggatgacctggctaaaccaccagaaaactgaaacctgagaagagaaggtcttctaagaagggaaaggaattcttgtttccaaaccattaagttttaagctgtggtgatccctgaactaagaaatgtaaagaagggagctctcaaaggcccagaggggcaaagtggagttgccagctgtgagggagcctaggaaaactgtgtttaggaccataaatcaagtccttaagtcttttttttttttcttttttttgagacgaagccttgctctgtcacccaggttggacagtgcagtggtgcaatctcggctcactgcaacctccacctcctgggttcaagcaattcttttctgcctcagcctcccgagtagctgggattccaggcgcctgccaccatgcccggctaatttttgtatttttagtagagacgggggtttcaccatgttggccgggctggtctcgaactcctgacctcaggtgatccgcccacctcagcctcccaaaatgctgggattatagtcaccgtgtccggattgagccacagtgtcgggcctccctaagcaattctgtccctaatgagataatgaccattctttttgccttctggctaagagtatggaaagagttaaaagccaatactttcaccacccctctaaggcttatagaatggcagaattccatttctatgacctacattctttgaagggaatgcctatgtcgtggaaagaggatgcagcaagacttttcacttgactgggcttggttttcccagaccaaaaaataaaatggaaataaatcatctttaaggtcccttgcagctttatgactgtataaagctacgttttccagctaacagtggggcagaagtaggtagaaaaaagaggagacttgttttggccactccccagggaaagaggattcatctgggtggtttcctgaagctctcggaaaggtaaatagagactggagttgtgtgactggtattaccccagtcctgtgacactgaaaggacaccacagttggagaggccacctttgccttctccgggaggatgggggatgggaagccagcgtggagccacagaggcttccagctccgcagcctggcctggctcagctctttctggcagaaaccatgtcctgcgttccaggcttccgcgagcaggatgctagtgtgctgctctcctgctcccctctgcgggggcctctcagagggtaggacacaccctccttgccttttttttttccccctattaaaaatcacaactcaaatttgggtatttttctccctctgctagccccgccaaaactttcagcgcgttccgcccactccacgtggacctcccttccctgtcccagcagcccctgcgagaaccctcaccccaacatgtgaccaattgttatgtttccttcctggagctcgctttcagctggcaccagctaacgactgaacaaaagtgcccccttcagggtgaatgtggggcagcagcttgagaggaggaaagctgatgaggg

SEQ ID NO: 4229 - DNA, 369 bp, Homo sapiens
atatgtgtgtgtgtgtgtgtgtgtgtatatatagatacttttcaaaaataagttctctcttgaaaggatggggaagaggcaagaagaaataagcccacaaaatctattctcaagctccaagatattgctagatggttattttgagcatcacaatcctacctagtttacacttttttcttatcccccaggatttgctcttggccgctttggggatgcagaagagaggcccataggaaactcaggttgaggcccctttgttgcttttgaaaaagtagaggttaaaggaaaatgcccaccttaaaaaataaaaacaaaacaaaacactcaagtggccaactgcaggacgagggcctacttaatgttcagttc

SEQ ID NO: 4230 - DNA, 584 bp, Homo sapiens
attcttccaaagagagattgttattattcctcacgatgacccgacagtctctgctttctttttcctttcttccagaaggagatttaaccatagtagaaagaatggagaactattaactgcctttcttctgtgggctgtgattttcagaggggaatgctaagagatcttgttctcagaggccattcccagacccacagcaagagggattatggctgcaggcctcatgctcctttgttttggaagaaactgttgaggagttagtatttactgagcagctaatatgttcccgtcactattgtaactcataataattattgttaagtaatacacgaaaagttttaaatttaaagcattccaatattttaaaagtaaagggaacaaaaggccaagtgtcccttcactcactaacctctgatcttcagattagcatgcgtcttttttgagtttttcaggcatttacataaatagttatgcagaaatggatagctttgcttctgttcttcaattgaatctttagtatagttgtgcaaggtgttttttgatcacttagtgtgtctccgttatctaggttcatgacaacaaat

SEQ ID NO: 4231 - DNA, 1857 bp, Homo sapiens
cacagtggtgctgggattctataaccaacaacaaaagcaacaccctcattaccgacactcctgcagctcaaactactttgcctttgtgcgttggaaacccaacccaagcccattttccccactggaattatttgtgatgatgtgaagtttttggagatgcaaccatcccagaacaggcacgctcagatgagaagacgtgggagacacagttctagcaaacagttctaccgctcagagcaaagcctacgtcacacagcctctagggtctgggcacagtgtggggacaggagggctggccgccctgcctcttgaaaggaatacgcagctctgcaggttcaagccacccagctgaagtcctcaaactgggtaacacgggccaagatgccacctgcacgtgtcctgctacatcaccatggatctggccaaggagccaccaccccctcggagcacgcatgctggggttgtcaaggagaccagtgcacaggacggccgcacccagggctggagaccggcagcgcaggacagctgcatccagggctggaagacagactcgagttctgacccatctttcaatgggagagaaagaatccaatcccctgctagggccacaaggacatgatgggtttggatgccataagagatgagaacactccaagctgaaggcaagaagtgattaccctggttttaggcagtggttggggggtggaggtggaggggaactcacctagtccttctttgaaagacagtcaggctacgtgctttgcaaagggttaggaggtggactgtgtgggaaggcaggcgagagggagtttcttttcatagcctgtttccatggtgtctcacggcccttggcaaaccccagctggggaggcttggacggccaggaggccccaggtccaccctccaaggactatcccctagtcctctgggccccaagagtgacagaggccacaggcaggcggctactctctcttgcctccctgggggaaggtggcaagaggccagcgataaagggcagagcagagaaagaacaactccaggggccagggctgcggctccctcccttccacgtcccctcctccccctcctcccacgagcccacccaaggggaaagttttctccctgaagacctgcagggctgtctgcacaggagaccctctcacgagaaacacattcttgcctcccgcctctccgcctggacaacccagataaccagataagggcctctttgatttcccgtgtgtttacacaagctgtggccccaagtcttggaaagaatcaaccaccgccaggcaagtcaggacgcctccaggtggggtgaggggagacggccgccttacctgctcctgggaattcatcactcgaagcttcatctgcttcaggtaggtggaggtgaggggcatgttgtaatcaataatcccagagaccagtggagatggaggctcgttttctggcagaaagaacaaaaggaaagccctttcagtctgtgctgcgggcctgttgcccacatggagcatttaacagagcccgtggaagaggaagccaccttggaggagaagggacaggtcagaggtcgcagactctgtggctcacccacatctggcccagagatgtggactgcatggtgtcaaaaatattttttttttattaaatgccagtgttctatttagagatttcacacgttaaaaaacaatgaggccgggcgtgctggctcatgcctgtaattccagcactttgggaggccaaggcaggaggatcccttgagccccaggaggggacacaggccccaggagttcgagaccagcctgggcaacacagggagatctcgtctttacaaataataaaataaattagcca

SEQ ID NO: 4232 - DNA, 289 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctc

SEQ ID NO: 4233 - DNA, 2808 bp, Homo sapiens
tctgtttgctttcgcctacccatctgcttgattgagcctgctccttgggagctccttccacatggcttcctgcatggcctgccctacttctgtctctaggaactgtgagtatgcctcttcatatgaacttttcatggccatgttagagtgatcctctaagattcaaccagcaggagtcactctaacattttctatagtaatggcaatgaggatgggatcattctaacccaaagcacaggcaacaaaagcagaaataaataaatggcactacaacaaactaaaaagtttctacacagccaaggaaacaatcaacagagtgaagagacagcctacaaaatgggagaagatattttcaaaccatacatctgatgctctactaaaaatacaaaattagccaggtgtggtggcgagtgcctgtaatcccagctactcgggggctgaggcaggagagtcacttgaacccgggaggtggaggttgcagtgagctgagattgcgccattgcactccagcctgggcaacaagagcgaaactccgtctcaaaaaaacaaacaaacaaacaaaaaattattttaactgatgcaatagtgtcaggaagatggcaggatccgtgcttggagcagcaagttgccttcccaaggaaggaactgtcaaggagttctcaaggaactccaatccttcaatgaagatatgctagatgcatagatgcttattcaagtaaaaaatttttgtagaaatcacgtgcagaattcattttcaactttagattgacttggtgcaacatggataaaattggaatatttgaaagaacggggagcctggaagtccatgagctaaaactccccccttcatctaccatatttcgcccccactcacgacattagatgcagatgacgagggaagactttgggacacatgaggaactgggagcccatggatgcctctccagaagactaaagattaggcctgtgggcttaggattaaaacttcctagtctgaaatcaagctctaccagctcccaagtgtgtgaccctggggacactattaacttctctgtttcttgagtttcctcaactgtaaaatggacataataatcacaccaacctcataagattgttatgggaattaaatgaactgatatatgcaaagtgcctaatagtatctgactgtatcctcaaacctagatattcagttttactattattattatacatattagctagacattattgttgttaggtagaattttagtaatagcaacaattttaaaaaacagatcctctgccctcaaggatttatgatgttatgtgacaacctcggccaatgtctgggggaggtgggggtaccatggtgatgagctgaggtcatgtgcttagccctagaatcatgggtgctgagatcatgtgctcagcaccaaggtcatggtgcagccatggcctctggggagaatcactatgactagggcaaggtgcatcctaattagggtctacacagatgctcatagaaaaagtgctccaaatcttgcctcatgctgggataggagacaagaaaatgctcccaagtggaaatccagaggaacaggagagatggactgagagggagaggagacatcacatagaaatacacctgtatagagcaggctgcacacaactgtgagtcctatgagcagagaaggtggcagggcctgtccaggtgagctgggacacagggctggggatatctgtctgaatgactctcatgaagagacctcagactctatgctctgcaggggaggagaagccccaccttgccatgatgtcccaggagggaagttgctgtgggaggaaggggccatgagactggggccatcttccattgtgaaagaggaagtggacacagttgccactgctaggaagttgctgacgtctgtgcttggggttcccagacctgggagccttggacagtactggagagaggttgactgacatagagcctgctctatgtcccagagactcttacctcatgccaggggtcccatgacccttcctaatttgagagttcagacctatagggttctgtagccaaggattgagcttgcagcttcagagaccataattccaggtgtggcacatttgagggcttgtggctacagaagcctttgggggtggaaccaaatctcctgggtgacccctacaagaagtctctcaaaccaacaccaactaacaagctgagcaaatcaaaaaacaacaactgctcttagatctgtcggagaaatgaggtcatagggcaaaattagagagacagcagggtgatatggagaattacaacttcctgaattagaaacctccatgggaaagagtgctggggtcagaaaacctgcaccatgaatggtgaattgctataagttcagtgaggaccagtctgagctaaaaactcaggaggacccagtcatgggaactcccacacttctgtgaattttacctacagcagcttgattggtcctcatagtgggtatgagagaaatattcagtagtgcttcctgaagaggaaggagaaaggggaccatttcaaattataccagagtgttctcatcatcttatgcttgttccatatcagaaatatacaagaagacaagcactgttccaactatccttgctatgttttacaaagaaataataatttaatcctcaatgtttctaatcctttgaattaccataaactaaatatttttcccttctgtccacatttgcaactgataatattatattttctaatattttgacaaaaattatgaggaccacagagtagtcattatattcccctttggatgt

SEQ ID NO: 4234 - DNA, 3812 bp, Homo sapiens
ccccttctctgggcccaagccaccttggctgaggagggggcgaggaggtgtgagcccctgccaggaaccccctgcccggaccaagtgctcggcccccaggcctgcgttcagtgaggcctcccgtggcgtcagcatgttcgtgtggaggaatgtggaaggtcactctgcggccgtgttctcctggtactccatccccttcctgacccctccctgcagccacacgaggcccagcaacctgccagtcactcagtggcctccaaccagagaaaacaacctgccaagttggcagctgttgctcatgagcgtccaccaggtgggacagggagtgttgaccctgggcggccccctggagccacctgccctgaaagcccagggcccgcaaccccacacactttggggttggtggaacctggtaaaagctcacctcccaccatggaggaggagccctgggcccctcaggggagtccctgctggacagtgagacagagaatgaccatgatgatgctttcctctccatcatgtctcctgacacccagttgcctctaccactcagatgatgtcaggcccagtccctcagtgccctgcgcaaggaacaggactcatcttctgagaaggatggacgcagccccaacaaatcagacaaggaccacatccggtggcccatgagtggcgctcatgatcttcagcaggcggcaccaggccctggcggggcgcaccagggtcaccccaaccaggataaccggaccgtcagccagatgctgagcgagcggtggtacaccctggggcccaatgagatgcagaaatacaacctggccttccaggtgaaggtggcccacttgcaacaaggaccgaaagaagtccagctcagaggccaagcccacaagccaggggctagcaggagtgtaacaagggctcgtgggagcggagcatatcagagacgggcactgccactgcccctggggtgtcctctgaactcctgtcagttgcagcccaaacactccagagctcggataccaaggagcagcttctgtggggcagaacggctgcacacagtcagggaacctggctcagcctggcccaagccttctcccacagcggggtacacagcctggacggcagggaaatagaccgtcaggcactacgggaactgacacaggtggtgtctggcactgcatcatactctggcccaaagccttctactcagcatggagctccaggccactttgcagcccctggtgagggaggtgacccgtgggcagccctgctgccgcccacgtgagctgctcattcccagcacatggccagcgaggtcatagcgagtgacgaagagcacacggtcatccatgaggaggagggggtgatgatgtcattgctgatgatggctttagcaccaccgacaccgatctcaagttcaaggagtgggtgaccgactgagagtggggacaactctggggaggagccagagggcaacaagggctttggtgggaaggtatttgcacctgtcattccttcctcctttactcctgccgccccttgctggatcctgagcccccagggtcccccgatccacctgcagcttttggcagtctatggtcacaccctgtcctcctcctacacatactcggatgcttcctcctcaaccttggcacccacctccttcttactgggcccaggagccttcaaagcccaggagtctggtcaacgcagcagagcgggccccctacggccccaacccctggggatgggggcccagggacgccttccaaggtggcctgtttcctcccaatggatcctgccaccttctggtgcaagagacctgaaagtgtgggcgacctggagctaccaggctcctcagtcatcagggtccctcccaacactaaggctttcctaggcaggagctgggctgagccacccggggggcagagcctgaagagaaactgactgggctttcggggtcggggcagagggaaccccacggacatggaccccacactggaggaccccaccgcgcccaaatgcaagatgagaagatgctccagctgcagtccaaagcccaacacccccaagtgtgccatgtgtgatggggacagcttcccctttgcctgtacaggtggagaagccgaggacaggctcagggaaccggagaccaagaaggcgctgtcctcttcactgcatgtaccctggaccagtgccggccctgatcatgcagctcttccaggcccactgcttcttcctgtccactaggccacagccgccctccaggcccactatgcacacatcttcccctccaaggtttgttctgcccctgccctgactcccagccctgtgggggtcctgaccgcacctcacctggctcagactcttgacgctgccctggctgccccaccagtgcttctgcccgagagtcacgtgaggctgagagtaggggcaggggcagcagtggtgccagttggggggcggtccagtgggaggagcctcagcctcgcaggctgctccgtgggactgatgactgcatgatcttctgggcacctcacggatcttcaactgcaggtgaaacggatgctggtggtgggtgcagggccgctgggagctgctgcatggttcccagaggctggactgaggcaggtgccaactgaagctgctggggcagcatgggcaggatgttctgcacacaaaccttggagaagaagatgtgtgcatagcaggtccactgctgctgcccctgccctgactcccagccctgcctgaccccacctcaacctgctcaggctctggcacaaccctggctgccctgccactgcctctgccccagagttggtgccttgacagcctggttggaaggggacaccccagccctgcctcaacacctgggggtctccataactagcacaggcaggtgggcaaccccaaagatcccaggactcacagtaccccctgagaacatggacagtatgtgggggtagcaatggagggcaggatggttatcttctcccaggtgaagccatttaatcctttcagtttgggacggagtaaggccttcctttttttttttttttttttttttttttttgagaccgagtcttgctctgtcgcccaggctggagtgcagtggtgcgatcttggctcactgcaacctcttcccgctgggttcacgccattctcctgcctcagccttccgggtagctaggattacaggtggacgctaccacgtccggctaatttttgtatttttagtacagacggggcttcatcatcttggccaggctgatttcgatctcctgacatcgtgatctgcctgcctccccctcccaaagtgctgggattacaggcgtgagccaccacgcctggccaaggcctgctcctcttatctataccccctacccctgcagctgtgccgggggaaagctgggcagtttccctcctccgagcccctgtacataccatgaattgtgggaccttcagagcttttcacttttcggaaaatagctcctgctggggctacaagatggagtgtgaagagggccttgggccacagggaggcgcctgtggactagggggagttcatgcaccccttctttccccagaggggctggactcaggtgagtatgggggtgggggctcctgcacttcgacacaggcagcaggagggttttctccccattccctctgcactcccaacttgagctatactttttaagaaagtgattcaccctgcctttgcccccttccccagaacagaacacgttgatcgtgggcgatatttttcattgtgccaaaaagttgccatgaccgtcattaaacctgtttaacac

SEQ ID NO: 4235 - DNA, 5738 bp, Homo sapiens
gaggagattttgggccttcataggccaccaggaggcagcagttgggactagagagtctgacttgagtaagttttgggcccggagatgatgtcctgggacaggagttggccgtggagaggccaccgtgaggcataagctggatgtagagaggccagtgtgaggcaagacctgggcctgtctaggctgctgggagacaggcaggaatctggccagggaaggttgccatgagacaaaagttgggcctggaaaggcccttgtgaagcatgagcttggcctaaagaggccactgggtggcaggagctgggtgtgtagaagctgctgaaaggttgggagcttggcttggggggtccacagtgaggtagaagctgggcgtgaagaatctgctgtgaggcagacgttgggactgtagaggctgacgggaggcagaggctgggcctggaggggccaccaagatgcaggagctgggcctggagaggctgcaaagaagcatgagctgggcctggtgaggtcaacttgagaaagttcagggcctggagagaaggctgggaggcaggagctgggtctaaagaggccattgtaacgatggagctgtgcctgtggaggctgttgtgaggcagtagcctcatctgcggaggctgccgtgacgtagggtatgggcctaaataggccattgagagtcatgagcttggtctgtagaggctgactggagaaagttctgggcctggagaggctgccgggaggtaggagctgggccaaaagatgtaagcacatttgcatttattaggcactttatttccattattacactgtaatatataataaaataattatggaactcaccataatgtagaatcagtgggcgtgttaagcttgttttcctgcaactggatgttcccacctgagcgtgatgggagaaagtaacagatcaataggtattagattctcataaggacagcgcaacctcgatccctcacatgcacggttcacaacagggtgcgttctcctatgagaatctaatgctgctgctcatctgagaaggtggagctcaggcgggaatgtgagcaaaggggagtggctgtaaatacagacgaagcttccctcactccctcactcgacaccgctcacctcctgctgtgtggctccttgcggctccatggctcaggggttggggacccctgctcaagtgcatccaaaacgacccttcccacaccagtcttcacagtggtcaagggcagcaaccacttagctcccaaggcatgtgcctcagctggcatttcgtcacaatcaacagtaagtggtagcttgagtcactgtgaggtcacctactggaaatcaccagcatcccatttcccactggcaaagagctcagcactgccccctgggaaaccaaacctatgcccaaatcccatctgtgtgggtttacctcctgggacccttcctaacatataaccttcataacatacttgagaggctgaggtgagacaatcgatttagcccaggagtttgagatcagcctggacgacataactaaatctcatctctacaaggacgaggtgggaggatcacttgagcccaggaatttgtggccagcctgggcaacaaaagaagaccccatctggccaacatggccaacctggccaccacggtgaaactctgactctacaaaaatgatctgggcatgggtgacatgcgtgtgtagtcctagctacttgggaggttgagatgggaggattgcttgatctcagaaggccaaagctatagtgagctatgatcacatcactgcactccagcctggatggcacaggaagattctgtctcaaaaaaaagaaaagaaatatatatttaatctctgtccctggttcctggcacagagcttctaaagctcttacaaagacctcagtgatagatgtgacaggagcatcttttgttttaatatttggtcttggtcccaggtttctaacacaagagcctctaagaactttgggatctccagcatggtaagaatgcatttggggatgttgttgagatgactgggtgactgcaagctcctaaatttcttcaagaggagggctgattaccatgcaaccacatggtaagaggcttggaactttcagcctcatgcactgaactccagggggaagaggggctggagactgacttaatcaccaacagccaaaggttttatcaatcatgcttgcataataaagcctccataaacaccctgaaaggggtttgcagagctttcagggttgctggacacaggagatgctgggagggtcgcatgttcaacagagggcatgggagctctgtgcccctccgaacttaacttgccctgggtatctttcttttttttgagacaggatcaggctcttttgtccaagctggagtgcagtggcacaatctcagcttactgtaacctaagcctccccagtccccagctcaaggtatcctctcatctcagcttccctagtagttggaactctaggtgcacaacaccacaccagttattattattattttttaattttttatagagacaggttttcaccatgttgcccaggctggtctcaaactcctgagtttaagcgatcctcccaccttggcctcccaaagtgctgagattacaggcatgagccactgcatccagcatgcacgtctctttcattgactgtttctgagatgtatccttcacaatgaaccagtaataggaaatgaactggccagatgtggtggctcacatctgtaatcccagcactttcagaggctgaggtgggaggatcacttgagaccaggaatttgtggccagcctggccaacacaacaagaccccatctatacaaaaaataaaagaaactagccagatgtggtggctcgggagtgcggtcggcagtagagcctggcggtgtcttggcttcggcgctttaaccctgtaggggcgtgcgactgcgtccttctcaagggggcgcccctcgagcggcgggctgagtggcgtccagcggcggggaggcgaaaaccctgggggactcagaagcgggtggcggtgtagggcgtgtaaggaggagatagccaggcccctgcggggggggcgggccctccttagcgtcccagagggcttgtctgctacaggggctcccagcggcctcccgcaccgaagggaccctgggcgtctgaggccctgatccgggcgggccttcaggatgttagcagtccctgtccggttgaaggtaggaagccgaaaacccgagtgggggacgaacagacttacctcctgtcccgcaaaagatccactagatcgtcgtctccaaaacctgagagaccgcgaacgggttccagagccgcagcgttctctcagacctggcgttcaggaagattctagagagcacgggcaggtcccggaggtctcagacccgcaggtagatctcgaattcgtagacttgcaggcgaagcccagatatcgtaggctgatcctaaagactcagattcccgaggcctcagactcgcaggcagctcagaaaccacaggctcataggcagatccctgagaccacagaggctggccgagaaaccaccagcaactaagctgcattcagctggagttcctcggaacgggaggactcgcagctctccctttccccagccaggatgagggaattagacaatggaagtcgagcactggggaaagcaggcattctgcgtggggaagagctcccagctcgctgtagccttggagagggaagtgatggaaaaagaatatagcagcttattagggactcccaccctcttcaagttataaatatccccagaaccttggctacgtgcccggaagcctgttgtctctaactgtacaggagacttctctgcctgggctgggaaaggggcctttcttttgttttgcagatagatccacccactgaggaacttgaaaatttttttcaaacataactccaggccttgcttttattagtgagtgtcctgttcccagtgcccggttatttatgattaaattactgaagtgtctaaaaagaacagaaggacccaccccagccataatgcagactttcccattccttctctttccacccgcaactgtggggctaagaattcttaagatgtcacagaattataccatcctacctcatctaaagtcgatccgaggctggtccgatggtagtgggttaccagaacttaataacattaataactctaaagttagtatacaaccccccactgctaaatttggctataaaaataaaattgatctgagcaccatataaaatggaatcctggagggtcccctagaggcagtatccccagtggaaagagcgtgggcctcaaggtcagacaagcctggtttggaatccaggctgtgtatcctttggaaagtcattgaatccaggcccatttccttttctctaaaatgagggtcatcatacctaaggatgttgtgaggcgtgagtgagatgattaaagcgttccagagagtgcgctcttggatgatagccgttactttttattaaccctggctttggtggtaagggaaacttccagaaatgcttgtgggtatattggatagctcagaaaatctgggaaatcaaagtggctcaatagctgtgaggaactgtgggtgactttatcctcacatcgtgtttcttccagaaattcagacgcaacagaggttaggccagtttggtgggttccagtgagcggtgtgttgagcctagtagagcataggtacttggggttgccaaaaccccagcaagttgaggcttcacgctcagggaaacttctgggtcagaggttaataaccacgctccttggagcaaggaggaggggagcctttctgactagctgaagtaattgcaggtttctaactgggcctaaggtgagctgagggcttgagcccctcagcccagcgggggtcccttttcatcccttctctgacagattgctttgtaaactttcttaggccttccccccacccctttgccccagtgctttaagcccttctttgtcttcttgctgtttcttttattcctcaggcctgcggggcgggggcggggtggcgcccaggacgactccccgggctcagcttggctgcctgcctccttctgtaagtgctttttttttcttcacctgggaccctctagaggttggaaagagaagagaggctgggagcggatggaaagcatgactgcatctggagcccctggggggagtggggaagagggagtggaaggacagtggctgaggggcttcctgttgcagccttcagctggactcagggttggggtcactggaggaggaggtggcttcctgccccattgttctggactgcagtgtttcttgggaatacttactgtatgtggattttcagtaaccaacttggaaagctgtatttgttcccatgattcagcaaacaatgagtacctactgtgtgtagaagcagcaggacagcctgtcatcactgggaaagaggccagaagagccgtttggccagggtctccaatttaggctttcaacattatctctaaagaaggttatacattatgtcggctccactggctgatgggatcaaagaccctccttgtatatccttaaacctgtactctattaccaggccactgtgcctgtggagcactgtaagttcctaccttttaataaattttataattatcttgtgagcagcacaattgtcatagttttttgtatcagaaacattaatttgttaaacattttaaaa

SEQ ID NO: 4236 - DNA, 21178 bp, Homo sapiens
gccaccgtgtcggaggcgaggcgaggaagggagctggaataacaaaggcaagttggggagagcgcaagggggcgcagccccggccgggctgcggggggagccttgcacggccggggcttcggaggctgcagggtcgggggcgcggggagccggaggtgggggaggaagggtggggggagaggggcggggctgaggcgtgacgtcagagaacaatgacaccgccggggggcgggcacccggaggcggcccaggcgggggtctcccccggggcctggggcgggccgaagatgtccaggcctggccggagccgcctcctgattgacgaggcccgcatgggagtgcggacgtgcagcacagatttgcgggtctcctgggcctcttgggcggtgatcagcgcggaccttgggccaaccggggaagcaggccggagcactaccccccacccccattttagaacatccttctgagggcttcgctgacctcggcttgaactccttcagagccggagagatcactccttccaccaccgagggagaggaggcaaaatgaatttgccagctttgaattcattctcaaggctccgctagtctcacagccagtgaactcagtctggaattcctgaaagctcagaaaactgctgcttaggtccacccgggcgtgggggacggggtgtgtgggggcgcaggcggcggagtgggggcgttattttattttccccaggggaaattctgcctccctatgccattgggtgcaagaaaaggcactcctttggggcctcagtcttcctacctgtcacatggacatggactgtgatgactgctgctcttccacccccgccctccctgtaggtggcagctgagcatccctggagagggtgggtggtatgaaagcacttccagacctctagggacaccagggagtcatggtcccagcacattgctgtgtgattgagcccctcctcagcctgtgggtggcctaagttcacaggtaggtacaccagggccacctgagaaacctccgaaggtaggaattaagcttgcagaacggtggctgcagccacagctgtcccactcccagcaatccacagcattgcagcagtggcagcagccaccccatacccaggtccaaaatcccaaaagagagtttctgggtatttaaggatttgggatgtgataatccagcccagcccacaattagaccagttcttgttgccttaatgaccagctaggtctggacgcccagccctctcaacctttctgtccagattcctcaataagtatccagggcctgcccacttccaggaattgggggatgcaggtgacctcggaggtgaccactcatgttcaaagtctcctgtccagaagctccaccccctaccccacatcccagccccctactctcccaccagtatttacatctgaaacccaggaagtggctgcagagggcagaggagccaagtaggctcaacttagtagcatggaaccagggatcatttcaaccctccccttctgtgcaagcatggcagcaagtcagaaagcccaccagggtcctgggtcttccctaggctccagtccttgggtctctgaggcccttgctctctttgttcatcttccagggaggtaatggggtagattggatacctctggggtcttggaagaagctatgacttatttactgtctactatgtggtgagtactgtggtgggtcctcctaggtattgagaattcagttccctgattgaactgtcacattgtcttaagttaggtgccgctaccatccccctttcagaggaaactcaactgtgaatgacttgcccaagattggtcaggatgggaactcgggcccccatgaacagagtttcctgttgtcccctcagccctggctctgttcatccatagactgtgtagccccaagcaagctgctttccccctctgagcccctgtaaggtccatggtgccatcaggactcactgggaactgtgtgtccaacaacctcacccccaaagtctcagcctcactgggcctggagatctgctggtgagacaagagaggacagtgccatcacttcctcgtggcccagagctggaagatgcatcctgctcagcccctgcaggcccagaagtcacctggctccactaggagggcatgggcagtgtggggccgccaggttgtaccaaccttcagagcacactcaagtgctgttaatttccctgtcctgtgggagccaccagcagattggggagaggaccattgctggggcctgggcccaggtttcaggaggcagaaaatctggaggccagcaggatggtgggggtgggaggcttgaggtccctgagggaagcaaaggacttgtgtagggtgcggcgagtatggcctcctaggctgggctgggatgggggcgggtacacagtggggattcccacctgtccaggagctgccttctctgtccccactctccacctctcacttctggaacttaagggagccagggaacatctaaaattgagactagagaggtgggaagaaaatctcattcattgagtacttactgtatgccacgcactttggaaacattcgttgtattctctccacaagccaggtgtcattccctgctaagggaagaggctcagagaggttaagtgacctgctcaagatctcatagctggctgagcatggtggctcatgcctgtaatctgtgcactttaggaggccaaggcagggtagatcacttgagctcaggagttcgagaccagcctgggcaacatagcaagaccttgcctctacaaaaaatacaaaaattaaccaggcatggtggcacatacctgtagtcccagctatttgggaagctgaggtcggaggatcacttgatcctgggaggctgaggctgtagtgagccatgattgtgccactgcactccagactgggcaacagggcatgaccctgtctcataaaaacgaaacaaaacaataaagatctcagagctgctaagtgggtggagccgagattgggctccaggttgggctgggccttgaggttgagaatagggacttgccctcatctcactgccaggttatggtgcagataaggtaacctaccaggtactttggggtgaagtaaagactctcacccacttgccagggaatgaccagggtgcctcccatggcagtgaggtaatggagattacatttagagttcaccccttggtggatacaggaagcatttgggccctgcccagctctgagccctgtgcctctaagaggtgagtggttgggtcaagcagggaagatctatgtccttcagcgaattaggctcccctgctctgcctccccctcatttccaatcagatggcccctccattctctgagcccacaccttcccatcctccaaggcttgactctccaatgtccttccctcaagccagccgtcttctcactttctaccatggagttctgccctatggttcgagacccagttcaaccaccaaccccttcttcagatgggagtcacaagagaataggctgggagcctgcctcaggagccgggacacctatgtgcccagcccgccattgcctgacttgctgtgtggcctgagcacatcacaaactctccctgtgcctgttccccatctgccaagtgagagagtgtgggatatccaccagcacttttgcctctgattgtcctaagattctgtaggtctgagcctttaacccttggactgagctacagttcactttagagtttgagggcggccctgctttagggagggctttcagagggggccatttagtggagtagggacaagaaaatacctggagggagctgctcagaactgtgactatctaggactgtgaataggtaatgaccctaacgcctcccttcatgaggcacctctcaccctctgagcctcacaacagcccttttgtgggtgactaagctgagccccaaaaggaggtgatggctttccctgactgcaccactgggaagcaccagagctggaacaagagccaggtctcagccaggcatggtggcacatgcctgtagtcccagcaactcggtggggggacaagagggggtgcaagagccacatctcctcatgcagtgtcccctcacctgcgtcagggcccctccagaggagcaagtacatgcggcactgatgaggaagtctgggacaagcgacctgaggaggaccatgcctcccacttccttcctgatagctcctgcaccccgagaggggtgggggaaggtctcagatcctcagcatctctcctccttctggctgtgcagtcctccagcctcaagactcatgcttccttgccctcacctcatcctgtggccatgcagggtgacttccagaattgccagcattatgtacatactcttacctctgtgccattgctcatgctcttcctacctcctgggacacacccctcccagtcaccaaggccacatctgcaaccacttgcttggaagcctaccctgatacctccaccagatgtgccgtcttccttgtcttaacccccatatgctgctctcccagcctccaacatcagcataaccataggaattacttgtgaagttcctgctatgttccaggcattgagtagctcatacacatgaactcctcccatcctctgagctattagtattctcattttacagatgaggaaactgaggcacagggagtttcatttcctagtatgacacctcacaggctagggaggtattgtgttacatggccctcttctgtcaaggctgcaggtcataggatggctcactgctacatcccatcacccagtgcaaggccttgggggctgacaggccatccggagcaggggaggtatagaggcccacaggatggaggatgaccagaaccagccctctgggggctcacagtctctcaggaaggactgcccacaccaaatgccattcttttttttttttttttttcttgagacagagttttgctctgtcgcccaggctggagtgtgcagtggtgagatctcggctcactgcaagctccgcctcccaggttcacaccattctcctgcctcagcctcccgagtagctgggactatgccaccatacccggctaattttttgtgtttttagtagagatggggtttcaccatgttaaccaggatggtctgcatctcctgacctcattatccacccgccttggccccccaaagtgctgggattataggcatgagccaccgcacccggccacccaatgccattctaagagttcggggaagaagaagagttggcattgagtgggtcctggaaggcaagctctggtggggctgtggggaagccagagtggggcatggacctgcctaaggtcacacagcaagcaagtatgagacagcagcagggctgggacctggagctcccagtgtatcatgccttcttgcaccttgcagccagctgtggggcccctgcgactgtgctgttttcaaggacacacggtcccagatgcctccacaattctgagctgttcaatgagtggctctggtccttctcccccctctattaaaatggaaaaaagaaagaaagaaagaaagaaatccaggcattgttcctgactgcagctggtgccaaccagaatcccactgaacagaatggagccgagagcccggctgcccaggggcctggctgctgacacagggcctttctattttgctttccactgggggcccaggctgacggtgcagcccctccacggacaccctctccacctgcctccctggccctggctctgagcctcctgctgccttcaccctctttgcaaaaatcagatggcacttgggggagggttggaggagcacccccaccccctgctttccttcttcatccactcacagcctggggtgcgctgggcctccctccccgccagcctgtcctcccaccctaccaggaggggacttgggatgcttgtctgggagagcgacacaaatccctcttccaaaatcgtttgaaacacttgtctgattctaggacatatgaggattttccaccccacccccacctgacttggcaggtgccagtcctcagctcacacattaaggcctcttgcaatagtgaaggtcttgtgggggaaaggggaacatgatgaacagctctacagagacaaaaacagttttttaagttgctagtttgccttctgcctttggtcttaggaggaaaaaggacttctccaactctcccttaccatcttcatttcatcctctgcttcctgcccctttcgtgagctgtctggtactcagacctcctctccacaggctattggctagtttgacccagattaccccaagcagcagttctaagagagcagcatcctggccactgtccagtgtccaccagggacccttgggttggcactgccaccacagccagctctcctggcacccccttcctcctgtggacacagctctttagtttgtaaaaagtacttgacgtctcacgcaagtgccacagcagcctcaagaggcaggcagggattgctaacccacttcgtagaagaataaactaagggttcaggaggcataatggtttggccaaggtcaaaggaggtgacagagttgggatttgaaccctggtctcttgattccatgtcactaagctgcagtggggactcaggaagtgacggtgtcagaggatgacattcccagcccccaccacctccacccgaccaaatgctgccaggagacaggatctcagacacatcgattcctttaaggaatatttattaaatacttgctgtatgccagatctccaacagtgaacaaaacagatttggtccacactgctgcagagcttatattctgagacagacaccagacttcgtgcagaaagatccccctcttcctagttgcccagcccatatgtcctagaaggaaccgtgagatgggcagccagagacataagttctagtcctagcattgcccctgactctccatgtcaccttggaccgagttttccacctgagaaatccaagcatgtggcccctcacacattttctcaggtctcttccctactcccagtctctgggtctagtggttcatgatttcccggcatgaattatcctgatttagttttttttcttaaacccgacttttcctaggctcttagagccagaacagggcttctgagatcatttgctctgagcccttcactaagaaagaaccccttagcctcgttcctgccaggaggagactgtctttgcttgtactcttccagggacgggctgcttgctccctcacatagcagacctctgccagtggtgtgctggtaaatgtttaacagctggctccccaaagtggggagaacctggtttgtagtatttgccgatgtctacggtgtaaatacccccaccatggccagtttcaagctgccgaccagagccagctggcacagctggttggttccatcaaccagctcgcgcagttcctgaaaatttaacaatcggcccttgtgagccatatgaacaggctccaacacaccatttcccctgccccgcagagaagtcttgtctagctttactcattgggaagttctttctggtattgagcaaaacatctgattgtcaggaactctggcctgaaagtcctgaactacttctctggggtgtcacaggacaatggggaccccatgaaggccttctctaattggtggcagctcttgactatgtcttcctgtgagaggagcaagttcctgggccaaatggggtcagagcatagccaccctcccattctgcctttctctctccctcttcacctcccttccttcctctctttctttcacaaatatttcctgggcccctgtgacaatgtcagacactgctagatactgtggattcagcgacccatgtcttagcttgcgcagagatgctgcccactctgtgaagcctgtcctgacccccaccctagcccctcccgcagtgggcagtctcctcccctcccagagcctttatcgcccctgtttggcacttatcactttctacctgggattgcagctatttgtgtacacggcttatctccctgccagactgagaggcaacgtgggcctgttgaaagagcgtggactttggagccgcatgacctggccctcaatcccaaccctgcgactcagagctgtgagccctcggggagctcacaacacctttgggagcctcagtttccttatctgtaaagtggggatggtgataactacttccaatgtggttttgagcaactggtaggattagaaatgtcaaccccatttcctgctcctgtctggactcccatcctcttggggacagagattgtgtgcaatacttctctgtagcctcctggtaataataacataacaatattaataacaatgaccaacacttacacagcaataccatacataaggtaagagcttacatatgttagctcattcattctcacaaccttgtggcattggaagcattattcccattaacagatgagcaatctgaggcacagaggggttaggtaacaagcccaaggtcacacagctagtgagtgagagagctgagatttgaatccaagaaaatccacctcaaagccttagctattgaatagtatggcttctggaggggtgtgagtgtatgtgcccatggttcactgcagcctttgagcatccttgccctgacctgcagggtgggggtggagtgatacaaggaagaccctggtctgcgcattaggacatcctaacaggtgagtggttagtgctgaagaaaggagtgtccccaggtatctggaggccaggggactagaaggtgataatcaataaggcaatcagaggaggcttcccggagaggtggcgcttgccaccaaatgaggatggacaaggcagggcgaacaggaggaccaaaattgtagacatgggagaggtatattagggtttcacctaggtgtcagactagacatattcactggttctggtgggtgggatggagcagagactgtgaacttggggaggggcatgttggtttcccagtctgtgattcaatagggaatggaggacattttcaggggccttgagagccagtgcaggcccaggagagctgagagtcacctgtgctgccctcggggccatattggcattttgcttctctgcaagctactctgagattccaaagtcctgggttcccgaattcagctgtgccagtcccatccctccatttcttcaagcctcaatttctccagttcagaatgggcataaagggtggaccttgcatgccgattaaaggatgagatagggctgtgtggggatgggcctgacgctcctggggcaggaaatgggggaaaggtactgcggggagggagagtgggaagctgggagagaaggaggtggtgcgaggagccctgtgtgcttggccagtgaatccaggtctgctaagctggccctagctgggattcttccagcaccccatactgcattttcccaaggctgcctgactctgctgcctcaaagcagtcttcctcctgggcttctgcaaggatagttctgggttagatcctgttcctctggccaacccagttgagcccagccatgtcccttggagagcactcttcatgttccaagggctgttttaaatgctcttccctcatactaactagttcagtcctcacagccacgctgtgagttccctcatttcacataaggaaactgaggcacagagagggtaagccaggtgttccacagggttccacggcagggaaggcgaagtctaagggatgggaatagcccatggagccaggaaggcgggcccaagggatgggcctctgaaccgccttctcaccctttctgtatgggaaattatgaccattgtgagtcgtccctctcacacgtttcttttctgctcatctcaaggttctcaggtagctgcagaaccacaattgacatccctctgcccatacaggcgcctacatgtccacacactcaacaccatggctgcccaacgtctcataggcacaaggctcacacttttgcacacacaaccatcaattcagagccacaaatgcatctgcaggcaccacacccaccctgccgcagatgcacacatagggcacgtgtgggctttgggcctcagactgacaaccaagcaccaacaagtcccattcccagaatgacggatacacacccacgcgttcacacgggctccagtgtgcctgacacgacatggtggggtctgtggactcacagtgcaccccctggacccatgtccaggctccagcctctgcagatgtcccttctgcccaggtgccttcattcctatcccttcaagactacggctctggaatgtgtgcacagcggatccgcttctcatggcaggtccctgccctgccgtcttctgtaagaactgggcctcaggtgtgtggtaggggattggggtaaaaggtgacccttcctgcaaccctggcaggctccctgggctgcagaagggacagcagggagaggagagtgaattaatcctggcctcccttcttgggttcactgtcatgctaattttctccgcctttgatccatctctctagccccagcccctaactctgagcaggagcaggcgctgggtctggcctgagattaggggctgccttggtgaggcctggggcacatccttccatgtggcagactggggtttcgcccttgggaggggcttgggggattatagccctggttactgacctgctgtgggcaacacactctccttcaccagactcatcctctttcttcctgaccgaccttctcctctccaaagggggctctgctgttcccattttgcacaagagcagagtgaggcccagggttgaaaggtctccggaggcttctggccactgagaggtggagccaggctgggagcacacatcttccagactccaaccccgccctgtttccgtggtgggtcttcgttctggtgatttttttgaaaccagcatctacggcgtattcatgacatgccagggactgcgccttaacatacattgcctcatgcagtcctcagcaatgctcttatgagtcccactttataggtggggaaagagtcctgtgtaactatctggtgagtggtgaagtctgaccaaatccaggacacaggtggccaaagtcccctccctgtagggggtgacactgagacccaggcaggggaaggacatgcccaatcccacacagagagggaattggctggacatgcatctcctaccttcctgtatgctccatctggttccagaaatgactggactcttctatggacccagtggagctcagacaagggtccaggccctgacactgccccagagcaggggtgccagcacctatgaggatgccaagctcaggtcatcgccctgcggtgtctcagccaactgggcctcgaacagccccataaacttggacataaacacaattaaagttttttattacattatattttgtacatataaaagactatttgtaagccatgaaacattacaatgaatgctcatgactactctgctgaagaactagagtattagggacacttgtgaagctccgaccttcccagccccctacttcccagaaggagccactatcctaattgtcattactctctgctgtttttgtttgtttgttttttaaggagtctcattctgttgcccaggctggagtgcagtggcgtgatctcggttcactgaaacctctgcctcctgagttcaagcgattctcctgccttagcctcctgtgtagttgggattacaggtgtgcaccaccacgccaggctaatgttttgtatttttagtaatgatgagggttcaccatgttggccaggctggtctcaaactcctgacctcaggtgatccacccacctcgcttcccaaagtgccgggattacaggcatgagctaccacgcccagcctctccctgcctctttttaacagaaagttttagcacctgtgtggagaccccttcactcactgcacttttttttttttaagaggtgggatctcactctgtcacctacacccgagtgcagtgatgtgatcctggctcattatagccttgatctcctggctcaagcgatcctcccacctcagcctcccaaatagctgggactgcaggtgcatgccaccatgcccagctaatttttttttaatttttatgcaaagacagggtcttgctatgttgcccaggctggcctcaaactcctggcctcaaacagtgctcccgtctcagcctcccaaagtgctggcattacaagtgtgagccaccacatccagctgctaactgcacttttgagatgttgcattctattctgcactcccaattattcattcccaggggaagtgcattatttaaagggatagagagagaacttggaggagccacttgcaccccatgtgcctcttcgcttcagtgctgtgagtgctctgtttggccccctcattccagtgagtgccctgaaacaggacatttcttcctggtacggccagtagaaggagggtgggggccttccggcagctgggcattctctgaacatggcatgctgccttgcatttgcgtaagccattcctccacctggaattcccttcgctagactgttgtgggaacccagttccttcttccaggtccaactccaaggtttcgttctggagatgccttccctgtgaccccttgcccctctcccccagcagagctggatctgtcctcttctcccctgacagagttttgggcatccttctatcagcccttatcccagggcaggaagaacagccttgatcctggatcccaggcacagctgggtgtcagacctggaggagaagctcccagagtgaccaagatagaatcggcatgcagctgaagccacttgctcagagccgcacagcaagcccaccaccctgaacctccagattaccaactcagcattgtgtcctgacagtgtcatcatagatggtcaacaccgtcacctgggcagcactgaagcccagagcgggagagactggctcaagaccatgggtaagtcagcagcaaagctggggaaaggaaaccaccaacctgagagcccctggctggttcccaaatccaggcccttacttctcttccccaccatccagggtggggggcagacacccagtgaaatggcctgccccaaaggaggggagccttgccgagccaccccaggccacctcagacccacacccccagctcagcggttggaggggctgaggaggggctgagccgccaccccctccccaccccagtgccagggccccagccttgcagcgcttgtccccagcccagatgagcagggcgcccttatcagatctccgtttctgtttctctcctctggctgcttctgcctggccctgcccccaaccccggtggccttttcctctctgaagtgatgttccttttcctgtcaccaacacacacagcacacagagaagtttgtttctgttgctttaaaaaagtttccttctggggaggagggcaaggggttgtttactgggcctgcaaagcctcaccgtgggtgtgggcatgggtgtggcatgggtgtgggtggcaactgggtccctgctggatttggggttggtggaggctgcacccacgaccctgggcctctggatcctgtgcaaaagccaggaacgtggaaggaaaacctcctgtgcaccctgctcagggctgggctggttcacccaccgtccagccacactcctgcagaaacctgggaggtcaggggttttgttttccattttccacaggagacagctgaggctcggccaaggttgccagggtccaagcctatggatttgtggtctgggctctgccagtggcatggcactgtcttcaaagctcccaccctaccatttttcttacccacacagggcaggctcgacccagctaaggaacacagcttcctgaagcatctgtcctgggccgttggcccttctgtggacagggcttgagctctgtaggctggatttgaatttcaagtcctcctgctgtgtgaccttgaacaagttacttagcctctctgagcatcaaatggcttaactatcaaataagaagcacagagaagtccccaagagccagtagactctggaggctgtgagaccggggactggggctcctgcatccttaatgaaggtttcagtcttgagtcgcgtctgggagacctgctgaagcaatggggagctactgtaggtgggtaaacaagggagagtgtgatggaggccatgttctaaaaggattctataggcagcagaagggaggagggctcaggggagaggtggaggagctgcaggggagaggtggaggctgggaggccaacaaaggaggctttgacttccttttcagaaaaataaggccacccacctcccaccaggagcaagagtcatggagggagactgtctcagctggcctggcctggctcctgcccaggacagagatcccggcccctggactcctccagcagcccagtgtaggggaggagtgccttcctccccatgcccagggtagccccttgtctgagagtggtggttgtggcaggccctgctgagaactgcagtttcatttcccactgacctccacccactggactctcccaggctcttgtttcaagctgcctagtgctaaccccagcccttgagccagctcgctccagcctttacctcagaccagggcactggggctgtgtgtaggactcacacctcccaggtctgtctcttaccttgggacccttagggcaggaacacgggaggggggctctgatgtatgatgtcagggaactccgagggccacctcctcctctgacaaaagcaccttctttgtcaagtgagtaattcctctgacacatgtcgctctgacatggcacaggtcttcttaaagatgaacgtcctccatgacctgtgtgggtttcctgggaataacccacagtagtggtcaaggaggccaggaaagaagaacttctactgtttcccccttttccaaatttgttggatggagatatagagggtggggccaccttattcttcaaaaggatttttaacagcagggaaaaggaagggttgagtctcacagtccacactgcagccaccataaccatttcccagacaagtaaactaaggcccagggcgagatcccaggcttccttactcaacttccagccagggcagagtctctcgaacgaaagaagggacgctgctgcatggctcacgtgctcagccctggtaatagaaatacgtctccagtgagatctaattgtaactctcattgggacctgcgtcacctacaaggctggcagccagacaccctgagaatgcaccagctttactcttttttttttttttttttttgagatgaagtcttgctctgctgtacagtctagagtgcagtggcatgatctcggctcgccacaccctctgccttccagattcaggcaatctcctgcctcagcctccctattatatgggattacaggcatgcatcaccacagcctggctgatttgtgtgtgtgcgtgtgtggtatttttagtagagatgggggtttcacgatgttaaccagtctggtctcaaactcctgagctcaagtgatctgcccacctcgacctcccaaagtgctgggatcacaggggtcagccactgcacctggcctacgagctttactctttccctgggtgatagggtgatggcagtctctggggcagggggaggagtgctgtgccacatgccctgggcacctgctttgctgcatgtccttctccaaggctctgatcctctctgggcctctttatttcttgcagtgcctgcctcatgggattgcagggaccaaaggatttgggtgccggcaattggagggccgttctgtgggccagcattgggcaggcgcctcccacatggttctctttttgtcctcccagtagccctgtgcatcagacgcagagctgtgctgcatgcacccacttgccccactcgcctcagaggagcgttccttgcaggaggaatttgatagattttaataccagggtcccctgctgaccaggctttgcatttccttacctaccctcggctctaactttggcctggcgaagcagggcaccacaggacatcagggtcacacatctcagaccacaagagcctcagcagtctccaagacaaagtagagattgaaggccctgcttctccttccagagtactgaggagcctcctgccttcctgagtgaggctgggggatcaaagctcaacaatagtgggttgtcagaattacgtttctagaaaggaaaatcaagactgatttttatggggagtatagcattatgctccagtaatagtactattagctccattgcacagaggaggaaattgaggcttagagaatttctgattgtctaaagacatctttcctggaactggtggatcagggacaagaaccctgatttgttgatgtcaaagcgtgtgtagtttttccttttttatatcttctggatcagcaagaccaccgcatttggggaacagaaggcacaatggggggagtggcacagctgcaacgtgaagggctccatgtggggccttggagacaccaagctgccctcctcctggtccgagctgcccacttcccatccctcatccctcctccttcagcttagggccagctgcacctggctccaggccctccactcagtgtggagaagtcctggccctcctcaccaccttcccacagcccctgctcagctgcagagcctgccgtgggccttctaaagctgtgtactgctcccaaaggtggcagcaggcagagccaggccttgctgggggctccttcaccccttggagtctgggcctcagagtgacgtcccaggctgaggctcattgggaggggtcagcattggcatcaggagactggggtcaagtctgagttctgacagtgactgtgtgaccttggacagtcacttgccctcgctgggccttggttttcctgttgtgaagtcatatggtcctgggatgtgggcaagggtagagaaatgagacacttcagctccccactcacaagccgtgccccctcaggcccaccacttaggttttcttagcccctccattttccccggcataaaatggggataatgaagcccattccttctgatcgttaaggaaaccagcatttactgaaggctcggccccgtgcaagatgctctctgaagcattttctctcatggactcccatccatccaacaatgaaatgaaatgtcttgcttttggtctttcatacaatgtctctttgcagcctctcctggtctgacagtctcagatgcagtcatggatggctttctggaggaggtggtacctggtctgtgggaagtaggggtcagcatcctggtctctgggagcatctgctccagatggtttccctggggcccccagaagcaggtgtttgcgctaacagctctgcaagcagagagcttcagtgcatggcccttcttgcccttgttcccaggcacatgctgttcccctggggctgaataccccacttacttgtaaatcccagtgctctcctgttcattctgcagtgccagcacaagtctcctccttggggaaggctttctggacttcccagcccactggccattgttccgtcttgcaggtgccccctcagggtgcctgctgtaaccgtcactcacatatctcccccacccaacagagggccttgcttttggtcctggacctgcacctttgactgtattcttagtgatttgtccaagcccaccctgggagataggggcggtgccaggctagcacccagttctcctgggttctctgagaaagttcctaccttcttccctggctcacaagtagtacttaagcagttttggttgttaaagaaaatactgaatttattcttccaaccactcatatatatatataaatcagtgttattgagaaacaatttacaaaatgcacccattttcactgtacagttcagtgaattttaacaggtgtgtacagtggtgtaaacactgccacacccaagatatcacacatttccatcacccctcaaaatctcctcataccccttcctgatcaatccctcttcctgcctcaggcaacatttgatttgattttatcaatatcgattagttttgcatgttctagaatgtcctataaattgtgattaggcagtatgtactttctgtgtagtgccatgcatgttgtatcttgcatgagtagttcggccctttgcattgctgggtagtattctggagaatggacattccacaatttgtttatctgttcaccaattgatagaatttgggttatttccagtttggggattttatgaataaagctgctatgaacattcatgtgaacatgttttcatttaccttgggctaatgcctggaactggtattgttgtattgtcagggtaagtatatgttttactatataagaaattgccaaattcttttccaaagtgtttgcaccattttagccaccaggagtgtataagagttccatttgttccatatcttgtcaacacttggtatcatcggtctttgagcaattctagtgagtatgtaatggcaactgttgctttaatttgcaattccacgacaactagtaatgttgaaaatgttgatcatctggttatgtgcatatgccttttttggcaaagcacctgtttgaatcttttgcctagttttactggttgtttgtcttcttattgagttctaagaattcttcatatgaattcttgacacaagtgctttgtcagatatctgtgttgcaaaatattttcccagttggtatcttgccttttcattttcctaattgtatcttttgaagagtaaaagtctgattgatcagtttttgcttgtctagttagtgcttgacatgacttgtttaaggaaactttgcctgccaacaaggctgcagatattttctctgcagttttcttctagatgttttatagttttagcttttgtgttcagatatatcgtctgttttgagttcctttttatgaatgatgtgaggtggaattgaggtccatatagatatccatttgctttctctatcatatttgttactgttttctgttattgcccttgtttttcattcttggttttgctttccactctttttctgctgtttgtggttttaatcaggcattttatatgattctatgttatcttctttcttagcatatcattatactttttttttttcttttcttagtggttgccctggagtttgcaatatacatttacagctaatccaattccattttcaaataacactgcactgtttcatgggcaatgcatgtaccttgtaataacaaagtattccttcccctctctctcttcccttgtaacattgctgtctttcattttaccaacccataaactataatcattgaatacattgttgctgttattttgaacaaactgttatctgttgtatcaattaagaaaaagttgctttttttttttacctccatttatccttctatgcattctttctttatgtagatctgagtgtctgacctgtatcattttccttctctctaaagaacttattttaacattttctgcaaggcatgtatactggcaacaaattcactcaaattttgcttgtctgagaaagtatttacttttgaaagataatttggcagcatatagaattctaggttgatgggttttttggtttgtttattttgtttctctctcaacagtttaaatatttcaatctactctgttttttttgtgtgtgtgaatggtttctgagaagtctggtgtaattcttaccttctttgctcttcaatagataagagttttgttttttttttcttctgccttctttcaaaatttttctttatctttgattttctgcagtttgaatagacagtcctaggtgtggattttttggaatttatcctactcactgttctctgtgcttcctggatctgtggtttggtatctgactttaattttgggaaattgtcagtcattattacttcaaatatttcttctgttcctttctttcttcttcttttgacattactattatacacatattataccttttgtagtcctgcttggatattctgttcaattgctttcagccttttttgctctttgctttctagttttgaaagttctattgtcatatcctcaaacttacaaattctttcctctgctgtgtccagtctgctaatgagcctatcaaaggcattcttaatttctgttacaatgtttttaattcctagcatttctttttgattctttattagaatttgtatctctctgcttatatcacccatctgttgttacacgttgtctactttttcccttagagaccttagcatattaatcatacttcatacttgctttaaagttctggtctgataattccaatatccctgtcgtatttgtgtctaggtctggtgcttgttatgcctttgctgtatttttttcctttttgtgtgccttataaattgttgttgaagctagatctgatgtaccaggtaaaagtaatctggtactagttcccacagagggttctactgatgggtttctgctctgataagttgtaattctctgttttcacttgtctatctctccagttttggaggcattagtttgccccatggcctcaattctctgatgaatctaagaagagttgttggttttcagtttgtttagctgttttcttattgtgaggatgacagcgatgattcccaagctccttacatgctggaatagaaactggaagtctggtatttttttgttttcatgtcttttcttacaaatataattctttgcccactgaataaccttatcacttttgtaaaaaatcagttgcatagtcccgctacttggggactttcttctgttccattgatccatatatctttccttataccaataccatactctattgactactgtagctgtgtagtaaatcctgaaatcaagaagcataagttctccaaatatgttattttttaaaaagtgttttgggtattctaggaagtccttttcattttcatataaattttaggatcagtttgttgatgtctgttttttaaaagagtctgctgagatttttcattggtttgtagtcttcttatattgtgtttgcctggtgttattaagcacagtactgctgagcttgtgaaacaacttgggaagtattccatcctctatggt

SEQ ID NO: 4237 - DNA, 1588 bp, Homo sapiens
ataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagtttt

SEQ ID NO: 4238 - DNA, 1088 bp, Homo sapiens
gctgggcccgccaaggtggtcccaaggaggagtggggggttgcggaaaggaggatgagagccagccacaaggctggaaaaggagtgggcaccgcagaggagggaaaaagaatcttgacactgtcaccgccagggatctaggggggcctcttaccttggagaataacaatctctgatgtctgctaattacagaaatactttcagagctctttcattcatcctgacaatggccagagaaggtaggtattggtagccttattttagagatggggaaactgaggctgagagtaggtaagtaagctgtccaagggcactcagctaacaaaggacagaagcaagcctcctcactgtctacctccaaaacctacactggcttggagttgctgtcctggccctccactgcccatctcatgtaggacgggagagtatggggggctggggtcccatctatagcctgaatttgagactttcagttgctcctctcattccccatttaatttgtggggatccccaactgacccctccctacacttccagggcactgaggagggagggcccgctgaaggagccccgaattatctctaggccaggtcaggagccattagtgtcccctcccctgacagcatcctcctccttctgccctcacattcagagccactgacaagactttaagcaagagacggagagttaacatctaatctggaggaagaccctggaaggagccagccccttcccccaggctgacctggtttaagcctttcttctgccaaggtcaccagcaccccagatgggtgagagatgtgatcactggtttcgtggcctgaccaaggacctccaaggaggtatctttcccatcttggcccacagaggaggaaatcctagaagggatgactgaagcttgggactaacacattggtggatctgtgctaccccctgctggccgtagacggtatgacagccaagatagggcaaggcttcgaggggcgatggatggattcaccgcagcggcgacatttctggactgttgtcaccttcagtgcagtcactgggaatattcagaacccaggtgattgataaggttttcccagg

SEQ ID NO: 4239 - DNA, 1136 bp, Homo sapiens
acaatatccaaaaaactgggtatgcaagtttaggggatctcaagaccccttcttcaatcgtaggaatgtgccatctcaagacgttatatttaaactataaagaagttcaaatgtaaaggaaaaagaaaatgcaatttcttcataaacattctgtgtgtctcttactaccaatcacatactcttttgtaaaccctgaaaaatttccctgtaaataatatatatatatatagtgtgtgtgtgtgtgtgtgtgcacgtgtgtgtgtgtataaagtgttggtagctcccttccccaaagatcagctgttttccttaatcatctgtattagtgtcaacaaacggctacagatacatatttctttgagaattaaatacataattgtgagattcaaacaagccgaagggcaagaggaaaaagcactatgtggatggcacatttggggtaaattaccaaaacatctgtctttctgagtcaccggttccctcttttgcagactgcctttccaggaaattctttattgcaagcacagccccaaaggcactgggcagtctcctcactgccatcgcacccggtggttccagtattgctatcagcaaacgtatcggctccctgcacagtccgggagccatcgcacctgctctgcccagcacgctgagtgcccaggacacgggcgctgccgctgggtggccttaggctcgctcctgcgctcacaggtgccctgcgtctttttaaagaggggttccatgagcgggaacgagttgaatgcacgagcgccacttccgatggaaaaggaataatgtgaactcgccctgctcctcccctcctctaaagctggccggccgggtgggctcgagtgtgggtgtgaggcctggatggcaaatgggagacgaaccgaccaagcgacctgaacataaagagagactcgcagagaagccgtcggggccgtccccgcgggaggagcctctgccacaaggccgggcgggcagctccaccgtggggcccgggaggcgagtgtggggccggggcgccgtcactgcagggccctgacgaggtagagcttctccccgtgctcgctggtgaagatgggcgcctttttgtagtgttccaccagctcgtccatggtgtggaagcgccgctg

SEQ ID NO: 4240 - DNA, 2635 bp, Homo sapiens
ctggttggtcacgtcccccgggaggccccggatcagtatcttgcggcggttacggaactggcgctcggtgtgttccaggcgtttccggatctcttctggatctagaggcggcagctcttcttccggcgcccggcgctccgcggcatcgccggcttcgacttcggccccagacttagggctcagcgggggccggtgagtaacggacacgtccgccgccatcttgggaaacccggcgccttctgggaccagcgagccggggcggagcggcatagagcggcaacgagggcgcgcccgtcgattggctgggagaaaccccacctccttcccgccccccttgccccgttggctaagccccagcccacctctcaagagttcaagctgcgtctgcgcgccacaggccccgcccccttccgtcgcagcgacgctactcagtggatgtgcacctgggtgggagagacttgcagcgcgggtggaatcaaaccacagattagggagtttgaaggctttattggtgcggaatctgagggcacagccaagcccccgccaactttgatcccggatcccagcgtcactcagctctggacggttcttcccccattgcttctgtcggctgcatagacgtgaggggcagataggtgctctcctccctaacatggtaactgccgctccgttggtgctccctgaagacgtacattaaggccagtacgatagtcaccacgcccagggtcagtaacaccgccacgaagacggggacaaagtgggagctcccagctgtgcagagaaagcgctaagtcaatatgcgtcccttctgtctccaacccccccgccccccggcttaccggtccagacccgcagccccgtgttagctcaccctcaatgtccatcaccacgaccagggtgtatttgcctcgtgagctggacgcttggcactgataagtaccattatgtgttacgttgacgaagaacgggatccccaccggcacctcccggctggagccttccttcaaacaccgcagctcggggtacgggttgcccctggcttggcactgcaggacgtgtctcgttttatctttccatttcaagtgctgggggcatgtggctcggtcaattttgggaccatctgtggaaccaccatgtgtgatcagacacccaacacacccgaggcacagtggtgcagaggagcgtctaatctttccagggcaggggtggagggattaaaggtcagggtgaccgactcacacaggactcgcagctggacgctactgttcctgtgcaagaactcgccgtccacctcgagagtggcactgcagaagaagctgcgtccgtcgtcactctcggtagcatttagctgaagttgagctggctgccccggggccgcggccggaactccgtccagcgtgacctggactcgagccccagccatgcaactcacggtcactgtggacccctcatgggcggtgggctcgctgaggttcacaatgggtcctaggaagcctaaaggcggggcattgcccaggagcttaatgaacaggaccttcctgtgggtcaagccgctccctccgccctcccctttcctctcgggatatccgggccacgctttcggccgttcaagcctcgccctctttccgcgctgtgtccagcttcgggcactcaggcccaacccacgttgcaactgctattggggcaagccaggccccaccttttcggctagtctccgccccctctgccacgcccccagactgctgaggccgcgcccccttcccacgcctcctcttactaaagaccgtcaagttctcccgggcctcccgtctctcgccccctagggtcacgttgcagacgatctcccgggcaccctcctgatccgcgcgcgccgtggctgtggctgtggccgttagcgtgtccccgtggttcatgactgtcgcattcagcatctggtcccccagcgccaggacacacacacagggccatgaaaacggccttcttcaaagatcccacggctcgggcctcccttccggggccaccttgcccagtggccgggggctttccttcccagaagcctgtgaggtccggggtaccccactctcaggaaccccaaggtcagggcaccgtctaccctggctcagctcgtcacccaccgtctgaagccccttctctcaccaaaggttcggagctggcggggggctgaggtgttcacgaacagtcccagcccctggggctgcatgtccagttctgtgcggcatgagaaaggggctccgtggtcgtctctgctggccagcacagtggcagtgacctccgctggctcctccactgcgggctgccggctcagctcctcctcccagcgaagcagcaccaccgtgaggctggtccggggcgacccatcctccacttggcagcgcagggtgaagttctggcccaccggctgccaaggaggcaggggtgccagctccacacgctccgggagccctgagagaggaggggaggatggcacttagcgggtcctgcaaacccacccactcaccccagggactggggaggagacagggtggtcctgccgagaactgtgagctttgagttaataaacttagagggcttagagctgggccagtcgaagcgtttgctattatcattagcgcag

SEQ ID NO: 4241 - DNA, 1854 bp, Homo sapiens
cggcactcccaacctccaggccccatggccacttcctccctcctgcgaggacagctggcaactggggtgcagtaccctccctgccccccgcccccttctttgggccacacgctgtgagaaggggtctagatcctcgagggggggatggctgccctgtgccggctctgcaggcacatgatagccgactgccactgctggggcgaggagggggggcctctttccacccgacagataccgacacccaatatagaaaccgagaagagccaggcaggaaaacacaagctctcacccgtctggaggctccgcggcttggcgcccagatatgccaggttcacgttggccttgcggccgtcgatgatggggttcgggtctttgcaagccctctcagctgccgcccggtcggccatggtcacctggtggagcagagacacatcaggggctgccgtggggggaaccaggggcgaaaggggcagacggctccgccctggcaccggatgctgccacccctctcttcccttcctctgagggtgcctgtgacccagggtccttgagccaaagctcctctgaaccctacctggggctctcccacaaagatgcctcctggattccagctcctcccgtcaaagttcaaggcctgggaaatgtggccttcaaggacaaaaataatcccctgcggggatagggcaaaaatgaaccccgaagggagcttggggggccgcctggacttgcccaccagtgagggccgagactttcctctgagaaggagtttgcgacgctatgcttggaaggtaagcaggaaagtgtcttcaagacgtttttacttaagctgatgtttatttggggcggctgagagggctgttaaaaatatgggggaggccgaagagctcctaacaccccggggtggagccattgctcctcaccccccgctgctccaggaaatcccgagtgccctctggctccaaaacctccccaccaacttaggagtcctaattgaacacagcggctcttccttttaaaccgggggtgggggtgggggtgggggtgggggtgggggccggggcctggggtggtgggggcgggaccggcaggagcgcgcccgggagaggcggcaggtgcgggcgccggctggaggcgcctggggcgggggcggcagcgggccgtctgggcgtgtgccccggagtggactcggcgcccgggccgcgataaggtgtgcggcggggtgcgggcccgggcgcgggggccacttacgaagccgtagccgcgggacttgcccgtctggcggtcggtgatgaccacggcctcctcgatgtcgccgaagccctcgaagtacttcctgagcgaggcgtcggtagtgtggtacggcaggccgcccacgaagatcttggtgaacgtggtgtccttctgcgagccgtgcatggcgccgggggcggccaggggccgcgggaagcccgcgctcggggcgcacggcgcgggctgcagcagcatggggggcagcggagcacagatcatattccctggccccacggagcgtccaggactgagaattcggctagtaaacatacagcatacgaccccggagggagctacaccacggtgccgcgatagaagcgggtcccgggcggtctcagaggccccgcgggagatgaggtgggcagaggaagcaggtgtgggctctttccagctccaccccgttctgggctggtgtcagggacccttggggcgagtaagagcagacccgggtccctcatccggcccccagccatagaaaggcggcgcatagtggggctctgtgagcttcacaccaggcagggccagccacagaattttcggggcccagtgcaaaatgcaaacgcg

SEQ ID NO: 4242 - DNA, 4934 bp, Homo sapiens
agtcggcggcgcaggggccgggccagccgccgccactcccccggcccccgggcccgggcctcccgccgccgccgcgaccaccgtccctgacgcggccccggagcctggccccgcatctccgcggccgccgcctcctcccaccactgggggaccggcgccgccgccgccaagtgctgcaatggctgccgggcctggccccaccactcctctcagctccgtcgccgccatgagccgccgccgcctggagatacaagaccggaaccgcctacgagagccgccgtcgccgcccggagcgccccacacggctaccgcatcagccaccgccgcgcagcgtccccgccccgcccggccagccgcggggaggagggctcggccgccgggaagaaggacgtcgattggtgccgctgagtgtcacttgaggaagaccccgcggatattggcatttctctcgggcctgtcattctacagcgcccagtgagagcctggggtgggacgcgtccgccagacccacctttgattggttcagataaaggccaatcagacttttggggaagctcattggtgctttcctgaagtttccagcgctcagggaggacgggagaatgcggaatgcccggccaatctgatcgccgattggctgctgtttccgccattcatttcagtttatgcgcctgtcactgccacgtcaccccctcccatcgctcttctcatcatccttttccgccctcatggattggtggttggtatcagctgctccaccttttctaccatttactgaacgagttgaggaaaaagggaaggagtctcgtctttacatccttattttctttttttattggttggcacctatgccactcacgtggtggagaggcggggcaatagttggagatgattggttctgagaattggctgtgaaagcggcattgctgaccagtgagagagacctaatgaggagcaggccggggcaaccaatgaaatcggagaagagcgcttgggggcgtgtccgcctgctttcagcctttgctaaaatcagtcatcttcctgcgaaggcatgaggaggaaaagagaggaagtaactgagcgataatatgctgtatgagcctcctgctctgctgcccattacctgcgtcacctccacaagctactgaacctcaaggaacccatctcctcatcaggaaaaaaaataagctttatgtagcagggtctgaactctgtaggtcttcaccacggctcaggaggatgaggagcagtgacaggccaaactacgagaaaagacagagggaatcaaactcaacactgtgtctaaacctcctccaccactgttgaagggatcctggcatcagatggggaacagctctaaatcaaaataacctcactactgtgcttttctgtaaaaccaggtaaagatcagacaagcatgagttgaaaggctatgtctctctccaggctttattctgccatagcagtgaccaggcgcagccaacagaaacggaaagtcatggtgtccaacacgcctctctgttccccatgctgaggttaaaagatggtttttccttgccatggataatgtagaatttgacttttctcctatttatgagaacagaaataggctaaaaaagaaagtaaatgaagaccaattttggtacagaaattaaaaatcaggaaaaaataagaaaaaagcattacagtaagatattttgaattaagaaacaaggtgtaaactgtaggaaaatatacaaataaacacaactgaaataaacatggtataaagagaaactttccattaaaaagcacatctctatctggaaatacaaagtcttagacagaatgttaataaaaatctaaaaaataaaaagagagaaagggtaaacagatgtatacaccgtatctataattaaaattcagcaacatgctttagagtatgcaatatataaaaatggtcaggtgtggtggctcatgcctgtaatcccagcactatgggaggccaaggtgggtggatgacctgaggtcaggagtttgagaccagcctgatcaaaatggtgaaactccgtctctactaaaaatagaaaattagccaggcacggtggcacatgcctgtaatcccagctacttgggaggctgaggcaggagaattgttggaacccgggagctggaggttgcagtgagccaagatcgcaccattgcgctccagcctgggcaacacgagtgaaactccatctccaaaaaaaaaaaaaaaagtaacatataaaaatgtgttttatttagtggacagtaaaatcaggaaatgtagtctttggggcataggattaaaatatgggacgggcgtggtggctcatgcatgtaatcccagcactttgggaggccaaggcgggtggatcaagaggtcaggagatcgagatcatcctggctaacacggtgaaaccctgcctctactaaaaaatacaaaaaattagccaggcgtggtggcgggtgcctgtagtcccagctactcgggaggctgaggcaggagaatggcttgaacccaggaggcggagcttgcagtgagctgcgatcgcgccactgcactccagcctgggtgacagagcaagactctatctcaaaagaaaaaaaaaaatgaacagggggctggggatgggcatggtggctcatgcctgtaattccagcactttgggaggtggaggcagtactgcttgagtccaggagttcgagaccagccagagcaacatagtgagaccctgtttctgcaaaaaatataaaaatcaatcggaggctgggtgtggtggctcacacctgtaatcccagcactttgggaggctgaggcaggtggatcacgtgaggtcaggagccccggaccagcctggccaacatggcaaaaccctgtctctgctaaaaacacaaacattagcctggtatggtggcgggcacctgtaatcccagctacttgggggctgacgcaggagaactgcttgaacctgggaggcaggggttgcagtgagacaagatatcgccattgcactgcagcatgagtgacagagcaaggctctgtctcaaaaaaaaaaaagtcaatcaggcatggtggcacatgctactcaagaggctgaggtgggaggatcgctttgagtacagaaagttgaggctgcaatgagctgtgactgtgccactgcactgaagcctgggtgacagagtgagatcctgtctcaaaaaagaaaatacaaatagggacaagaaggtttaggttaaatgtatgactcatacctataaatggatcataaaaggaaggctggcagtactttgggattccattccaactttctagactcactcacttttccacaaaatttcccttcatggccggttgcagtagctcacacctgtaatcccaacactttgggaggtcgaggcaggctgatagcttgagctcaggagtttgagaccagcctggacaacatggcgaaaccccacctctacaaaaaatacacaaattagttgtgcgtggtggcatgtgcctgtagtcccatctacttgggaggctgaggtgggaggatggcttgagcccaggaggcagaggttgcagtgagccgagatcttgccactgcactctggcctgggtgacagagaagaccctgatttaaaaaaaaaaaatcccttttcatgttattctcagaaaaaaaatactactgcctttactaaaattaaaactaagagaccaaataacagaaaggcacattccggatcactccagaaccccagaggcactgtcacctcttcttcctctgatacactgacctttagagtcatgctttggtaggttttctggtgcaaaggagcaagaggccttgagaccactttttcatctctactgtacatagaatggcccttaatgagtaactactatgtaccaggcattatatcgaaccacttacaactgttatctcatttaagtaccaggacaactctatgaagtctacatcatcacctccatcttatagaccaggaaactgattcagcaatgtgatatcatctgtccaaggtcacaaagctagacagtagcagggaaggactaaaaattcatattctttatttcatattatgtttcccctaggaatctctgaatctttaaacttgatgcaaataaaatatgaaatggatgattctactattcatagtgttatgacagagactgctaattgcctaatatgccttcctacccattatcagaactcttatgtgtcatgacaatggcataaactaaaagatattttccagccttccctgcacttaggtgtggccatgtgacaatgtcctggctattaacagtaagtagaagtttctggttagaactcctggaaaaggtctcaataaggaagatggacagctggtccacatctttttgccctccacatccacctgtccttcttgatgtaaagctgaatcatgaattccacagccatcttggaccatgaggaataatgaacatggaagccactggtaagaatggcagaggaaaaaaagtgaaaaagcctggatccctgatgactctgtcgagctactaaatcaaatttatttcacactagacacataaaatcccattttgttgaaaacactgttatttctagccggttactaggagcttaatgtaactcttgactgaaagaagcctttttcccaagttgctagagatacagcagccattattttaatctataacgcaaattaagacatttcacaaagttcaaggagttaaaagggcaagatcaccttgttctggagcacagcagtgaggtgaggattggagagtgctggtgtagctgcactttgaggtaggttcattagctgtcgcaaaaggctggtgatactcactgatggaagatgatagagaaggagagagaagggactcagtaagcatggcagcacctacaaaaaacaaataaaag

SEQ ID NO: 4243 - DNA, 2334 bp, Homo sapiens
agaaaaaggataccccgtcggctccggacccggcaaatgtacctgggctccccctggaggccacattctccgaggtcgcctttcggtccccaatgttcctcaaaggtattccgttgtaatcccggagaactgatacacactagtgctctgaaacttggcctgtgctcgaggcggcaacccctgcccctctgcctggcgatgccggaacacacccatctggccaggtcctgttcactggccaagaatgcagcattgaacactgggcattggggcgggggtgcactctgcgctgacaccgcacccctcccctcaacttgctgactagaggtaatcgcttcctttcatcgattcacagcgttagaaaaatgcagcattgagaggcagcgcggaggtcaactggaccatcacccttaggttgtagggaagaaaactgagacctagaaaggtgaagcggttgtcccaaaggcttccagctgctcccagtactcaaggacttggagcacacttggggaaatgctcactgttgtattcccgttcctcactatccaggaggcctgaactctcaaactccgaatctgatttccactctcccaggaagtcttcggaaatcactgtggattgtcaatacaggagtccatactgactgaatccctaattttggcctgtattcttctccctctgtgaaccatcttcttagaagtcactgaaccaagagtgccagaaaaccatcccaagactcacacagagttgttcttccatagtggatgttttggccactggacatcagaaccacattttgggtttgaagaatcttctacatggtgagccttggtgggaagaaaagaatatcccttccttatagaagctgaaattacagactcttgctttccttgtcagacttaaaagctagtgtagccagagttaaatacagggcacattgtctctggaggctgcagctttagtggtgggtacacagttcagttcctgacccaggaagtggcacatcagggcaggcagtggtgttggttgtggtataattgagttcctggttcagaagtgacaactgtacacatgagttgtctagggtttggtgaaagcaatggtattgaaagtggttttctcatcaaattagttcctgagtcatgtgtcggacactgtttctatcttgagcagcttctctagcctttctaaatcctgtgacctgcctgtgatccttttaagatttctttctgtttaatcagccacaaacagcttctgttgcttgcaacccaggctcctgagaagagactggagaagcagatcactttattaatgtgcttcatgtagagggagtagagatttccacctctaccatacccaaataactggtattggctgtacctttctaatgtgagcaactttaaaattgaacagaatatatgaaacctctcttttcagacattgaacagcatgtagcacagcaccgtgattcctgaaagtagggaacaaatggggcaaaccctatcactctaactttctgctgaaaaatgctgtctaaattgcagcacaatgagggggaacccaagcagagcatagtggtcttgctgagttgaggagatagttgagcagacttttcaaggcagagtatcagaaaggagagaatataacagcaaaacaggctcctggaatccctgtgaatctgttgctgaatactaagctgcacatgcataaggtgaaacttcacagtgcgatgcaaagaactactgcggagctgtgagctgattggttcccagggctcactgggcaatgtttgagtttcaactcgccaatgtgaagaaaccttgctgactgtccagggaattcagtagaaatcccaaaagggtaaggcattaggagaagggctaactaagccgaaaagtgaggtaactctagacttcctccaacaaggtttagaaagcagcctcaaaaagaggaagttcatccgctactaccgtaactgccagccaaaacaaattttaccatttttaaaacaacaaaatacagacatttaacaacattaaattcagaatgttaaaaatactagatatgcaaataagtaggcaaatagaacccaaaatcaggagaaaaatcatttaatagaaacaaaccccaaaatgacagagataataacgttagcagacaaggacttaaaaaattaaaataaaacaaggatttaaaggaaaacatgaacatagtgaagaaaaaactggaagatatagaaaataaccaaatggaacttctggagctaaaaaatacaacacctgtaatgaataattcagtggctgaacttaacagtaggttagacattgtggaatg

SEQ ID NO: 4244 - DNA, 3250 bp, Homo sapiens
atgccccgcgccgcgtcccttcccccggcgcagccccgccccgtgccgccccgcagccgccgccattttaagtgatctggaagcgggcggtatcgaggggcgtgcggccgccatcccgacggcgggcatggcctttggaggcggtggcgccgtcttgggactggcagaggggaggtccccgtgttggtgcggtccggcgggctccaagctcgggcacaccgagctcggggccgtcttgtcgcggcgtagtcgtggccgccatcttgggcaggctccgcatttggggtcttctggccgccgtgctggggacagtcacccccgctccctgacccgggctggatgcgaggactgtcgccgctcagaggggcttatgacctgtgaagagccctgggggctgctgttgggcttagggatggcccgggcgaactccttgggctagaagaggaggcacgggagcggttggcgaccgctcttcgcaggaggagggaaggggcagctccttgccccaggagccctgggcgcctgtccgccttcctgcttggctgcatttcggctctgaaaaggcctagagacttgattctcctggctggccgctctttccaccaaggccctgtttcctgaatgctggacactatcctgcatcgccccaagttacatttacatgagagtgagggccccccacttgacctctcccttgcagagacaccccaggctgggtcgtgctgggcgggtgtcggaggcggcgttggagagatgagccagagggtggccctggacgccaaaccgccctgcagtcctccgagctgcgctttgagggctgttgagagaggggtggaaggtggaggtgcgatttttgcctcggcatctagagaggcgaaggagcagccctgggctccgctgctgactgtggccatgggccgttaacctcatcaaagcccagtttcctcctgttgtagatgggagaggaacagtttttgaactgcgtagaacctcggcaagtcttagcgctgcatttgtgttttctaagctgtaattctagttattgctacttttgacttgtggaatgtggctcctccctggggagtcctccaaagtcccttccctcgtgtgacttccttcactgcggttcactgcagcccctacccccgctcccagggtcctcagcatcgcagtccctgcagaacctgtctcttcttcatgacgtgagtcatgaggcattggacaggtaattgctgggaagagctcttggccaggctaaaatttctttctcagtcgcagtgtctggctgggggcggtggctcacgcctgtaatcccagcactttgggaggctgaagggggtggatcacttgagcccagaagttcaagaccagcttggccaacaaggtgaaaccctgtctgtactaaaaatacaaacaaaattaggtgggcacggtggcgcacgcctgtggtcccagctgctcgagaggctgagccaggaggattgcttgaacccggaggcgcaggttgcagtgcgccgagatcgcgccactgcacatcgcctggcgacagagtgagactctgtctccaattaattaatcccagtgtctttacctacatagaactggcaactttaaatcctgtgcttctgtggagggagagcgaaggaagagtgtggacagtgggggccaggaagttctcaggtagcccagcaggccacgcagaagtcaaggggtgtgtaggtacaggaggggccgtctccacagggagacgcctggatccatactccatccaggcttcatctgcagagaccaggggtggacacctcgtttgtgggggccgtcacagctgatgccccagctcaggatgtccaccagaaaccaggagtcaccatcctcttaagggtggtgcctgtcctccagagagcatatcactgggttcaaaccccagctcctaccggcaaagcccggggcctccacctgggtgttcccatccatgaagcggggatacacagtgtggagcccttgggaggttggggagtgtgcctgccctcaccgcgcatcagctcataaatacaacaacagttgccttcacgtgctgatgctcagtgagcagtggcgcagttccccagctggcgcagtcagtggtgtctgtctgctgtcagaggtcacctggacccagcacgagtccttgcccctagagggagtctccacacaccccacgacgctgtcctccctgtgggataactacacgaggagatggcaggccatcgtatcattcagtgcagcgatacctcctgtggtgggaatggggtcaggagggattttcccggagcagggccactcgctggcctagcctggggtctccacttttggaagtgtggtcttgtggggtccaggttctccttaagggcctttacaaggaatgggagcgtccagtggtggagaggagctggctggctgcgcctgctacccacacgggaatgtcctcctgggctcctctcttcaactggccttcacctctccgcctcacagatttcactcggagaatccgccttgcagcctgtcttctgctccctcccatctaccttttgtttttttttgagacggagtcttaccctgtctcccaggctggagtgcaatggcgtgatcttggctcactgcagcctctgcctcctggattctcctgcctcagcctcccgagtatctgggattacaggcatgcaccaccatgcctggctgtttttttgtatatttagtagagacggggtttcaccacgttggctaggctagtctcgaacccctgagcttgtgatccacctgcctcagcctcccaaaatgctgagattacaggcgtgagccaccacgcccagcgtctgtctaccttttattcccatcactccccaccccagacagggtgttgtgttatgatggggaaggcccttgtgtcttttgggtgtgttagacctgggaaacaatctgtcttctcctttcacgtgccccaaagcaggactccaatcttccccgggcctttctgattgggagtcttaagaccctccccagagagggccccaccctgttccctgggaaaggaatgctgacaaaaccctacaggacggtttggagacagggttagttcaactcgtgtgtgtccccagagggtgacaccacagggatgaatgggagctccaggcccctccccagcacctcaacctgcacattgcttcatctggatcctttgtaacatcctttataataaaccagtgaaggtgtt

SEQ ID NO: 4245 - DNA, 2373 bp, Homo sapiens
agtcacagccatctcgctcccagcccccttagccccagttttccaaccggtctcccactttcacgtaccctgaaggcaggcatttaaagcaaaaaagaaatctcaagtcacctcacatacggaaggagagttttaattttggccagtggcaccaaaacgggcacttaaaagtatatttcattttacttgtggtatgtgtatgtattcagtggggcagaattctgtgttttaaaaaatcggtcacataaccattttgctgcacaaacgtattattcccggcctctttatcctcttggtaccaagtcagatatctcctgaaataagcccatcaaccactgccaacgttttttaaagtcgtgaaccggtgaactaccttttttcccccattggaacatttttgttgtattttaaaatcttgtttctcttactggattaggttaacactccttccttctttggcatccttggtatcttgctgtcatcctgggggaaaatgctcaggttttaagtgtgtgttttgccaactaagagacatctctccctgttaccttcaagtatagttgccaagaaagaagttaaattcaagaggtggaaacactgtccacaatacctgttttttagaaatctggctcaagattcagttttcccattactgtgattattatattttgtgtgatatgtgatgtgctggtggatgaggttgtgaagtccaagcactttaaccagattttgtgtgtcctaacttaataggtaatccatttgtgagatactgagtttacatcccagttccaaagcacttaaccgcctatgctgacaggatcagaaacattgtatggttactttgctcttaattgtacaaagatcaaatttccagggaattaacctaaaaaccacaaacatgcggaaacgagactcaaaattctgagtccaagaatagggttcatctcttctaatagtccttgtagtctcatatttaagtggaaaagtcactttcaaagttgagtcgtataacctatgtactattttacaacaaaaacttttaaggaaataaaagtcacaaaataacctgatttggggtggggaaaatggaaaaagagatgggtgccttgaagagcgggacaggtgaaaataagtggactgggagggaggaagggaagtcactattatcactctgttcctacccggatctcttgggtggaaggtagctctttccctagaaaggatatttcaggcattttcagttttgttttgttttttttttcaggagtggggatatgttctacgctatcgccataccctttttgcaaagtgttagtccagccaccttgagagcaaagtacttggccacaggagttaaattcgtttcttcattgataccaattggcaaatgatatgagacatgaattgtcttttttctttcttttttggggggtggggacggcacgtccgcagaccattttgacaagcaaaaaaaacacttctgaaaaagaaaaaaatagcctagctgagcgtggtggctcacacctgtaatcccagcactttgggaggccaaggcaggcagatcacttgaggtcagaagttcgagaccagcctgattgccatggtgaaaccccatctctacttgaaatacaaaaattagccaggcttggtggcgcacacgtgtaatcccagctactcaggagactgagacgggagaatcacttgaacctgggaggtggaggttgcagtgagccgagatggcaccactgcgctccagcaagactgagactgtcccaaaaaaaaaaacctacctgaactaactatactgcttttgatgcgatgcttttaagagatacatatggaggtagggtgacagaggttggttaattggtacaaacatacagttagatagaaggaataagttctagtgttcaatagcacagtagggtgactatagtaaatagcaatatattttatattccaaaataactggaagggaagatttgaaatgttcccaacacaagaaatgacaaatgttcaaggtgacaggggagagggggcggaaaaaaaatgtccaaagtgatagataccctaaacactctgatttgatcattacaacactgtatgcatgtatcaaaataccacatgtaccccataaatatgtacaaatatgtatccgttttttaaattttttaacaaaagatgcatataccaaaagcatcactcactactttagtcagattcagagaaccctcttagaccacacttgagttattgtcatggaatagctttttaaaatggctggaaatgaagatagtctcttgaaagaacaccttttcctacctatttcagtattgtagtcaaatcttgaaatacaaattttttttttcaatg

SEQ ID NO: 4246 - DNA, 1688 bp, Homo sapiens
gtaaatcccatgatgtaaacctacctcataagtcatgtgacataaaagttaaggtagtggagtaggtggtcttatttctttcacctgctcagagtggactgaaaatcctgacttagaaaaggtacaaagttaggggacttatggtaccttcactttttatgtgagaatagaaattatggaaacagtaatttgctcaaaactgaaatctggggtgatgttttcatttcatgtatttgattgccatccataaactcatacttggtgttgacattctagctgagtgttgtggaaatagacttgattttgattcatcgtagcttgcatggtcaagagacatgattctctactaagggtggggctagcaccatagctcataaaagaatccttcttacaccagtacttgttctgcctgtgagttggcacagacttacctaataaccatagtgtctttaagtacaacttaatacatattttttctgtgtatttttttcaaatgaactcaacaattcttcaggtattatagatcagagatcctctccatattcaagcattatgcttctctttcttgggggtacatttcactagtaatacttaggaagttattttgtctttcctgtatttccctagttaagtataggggtaaaaacgttattcagctttcagaagacattgttctgactccgaccctgccgtgtatactcaactatatagacttcaccctgggttttgcctaaactgttgaaagacgagaataaatagacatagacaggctagctaagtcaagactaggggctaaggaatatagaatcacccaggtctttttttttttttttaatttttctctcctcagttgggaacatctatcatgctggaggactactgtgatggggctttacattttactgttttgttgctagcttattgtttcatacttgggaatcagtcatgtttctgattgtggtataaagtttgcttaagtgccccttagttaaagctgttcaatgaatgtaagcacacacacacctacacacatattttgaatagtcgtgtgttcatgcctgttctcagtcttgtcccctttaccgtttctcatgcaggttatttcttgctttttttttttttcctcttttttaaccggagaagcaacaaattacgtagttttttttgtgtttctttgattactagtgagcttgagtacttttaatattttattggatatgtttgtgactgactttaatttcttgtttgtgtgtgctgtggctgcccgatccagcacctacttccttctcccaccataccacccccacccccacccctgcaaacaattggcatgtggtttgggtggcattgtcacaccctcggctttctagattaacccagttaccttttagcagtgccccacttccccagtagcaatggttcaggggtaggcacctgacccagaccagactactgagataaagatgtttgcctaggctttttcaggagcaattgaagacatcttgttggagatagtgtgctgggaggagtcacattctgaacttgctgcagctcgtttttctaatataaaggaaccagcctgaggcagtaccagggtgagagggagtctattggagcccttgggaacttctggatcaaattggacctgaattgagatctatttctcagctttcacttatgtgagccaa

SEQ ID NO: 4247 - DNA, 1666 bp, Homo sapiens
actgctcagggtaagaaatatgggatttcagaaccacaaacaaggatcctcatacaattagttataaataaacccaggctggtattaaactcctgacctcaggtgatccacccgcctcagcctcccaaagtgatgggactactggcgtgagccaccgcgccgttgaaagctcatctctactaaaaatacaaaaattagccaggcatggtggtcccctgtaattccagctactcaggaggctgaggcatgagaattgcttgaacccaggaggcaggggttgcagtgagctgagattatgccactgcactccaacctgggtgacacagtgagactcagtctcaaaaaacaaacaaacaaacaaacaaacaaacaaacaaacccagctgtggctgctgtaagttgtagaagttaggggaggtaggtgggagcaacctctccccacaacttaacagcaaaacacacaacaggaaaaaccaagattttgaattcagtactaagaaggttaatacttagcagcagctttcctctgcaaatggttatttctgaactttggttacagccttaaaaaattacataaactggattttggagaaatcactttcttaatgagaaaatcttcacggaagctatctctgattagctccttcatatctaaagtattgaccttcactggtaaccctgaattcgttaagccaatgtggccccttagaagaataatatttcttttttcttttttttttgagatggagtctcgcaccgtcacctagcctagagtgcaatggcacaatcgcagctcactgcaaccttcgcctcccaggttcatgtgattctcctgtctcgctggtcttgaactcctgacattcagtgatccatctgcctcaacctcccaaagtgctgggattacaggtgtgagccaccatgctcggcaagagaagaataatatttccacattcattttgtatttttagtagagacagggtgttgcatgttggttaggctggtcttgaaatcctagcctcaagtgatccacccacctcgacctcccaaagtgctgggattacaggtgtgagtcactgcacctggccaacccttttctctatattcctaaaataatgatttggaaggggattacaggtgtgcaacaccatgcctgcctaattattgtatttttagtgtagacggggtttcaacatgttgggcaggctggtctcaaactcctggcctcaagtgatcctcccacctcagtttcccaaagtgctggaattacaggcttgagccactgtgcccggcctcatttattccttcttattagttgctattttggttcagtttgcaccactatagtcctctactagtacaaacattaaggatgatcatgggaatacagatttggctggttagcaaaaatatgataaaggcatatcagtattagttgtgaaacttaaattattcttggctgctacaaaaaagaattacatacattcagttacatattctgaatctgacaaaaatatttagatagctcgtaatgaaataagacattgaacttcttatttatcaggttccatgaggactttttttgaaagttgtaacaagtcttcttagcaattaaaagaaaaaatgataaactcttgtatctcctaaaacaaacatttggaatgttgtg

SEQ ID NO: 4248 - DNA, 2278 bp, Homo sapiens
aggcgacaccaggctccgcataacccgggagtggctcaggtagggccgtcggttccagtgcctgcgaggcagcagccaagctgaaaatgtctccctgcgctgagacgctggtgacaaccgccctttgggactacctgccaaacaaggagaatgcgctctttgacagataattccctaagagggaggcactgcctcggtcggtagacaagtaatgaatgaccgaaaaaaaaatcacattagaagttatcaccagcacgggtgcgaaggcagtgcattaaatcaacactcattttagagcgccccagacagcccagccggaagggaggagatcagagctgtcaaagcacagcagagccccaaaccacaaaggcttaatgaaattcaacttcctgagccaggaagtgtcacggtctcgcccgcactcgccctaagctcgtcctttccttttgaggaggcacaggcagagctgaaacatcttaagtaaagtttccaacacctacaaccactgggattccgtgagactggagagaagagtcccgcgcccgccctcgctcgcgcttccaattctgtcgctcccgagtgtggggagctggcggggccgccgagcacctcctctacccagggggccaggtccctgggcccggggcaccgcagacccagagccgggctcacaccggggggcccgcgagccccacccacctcggcacctccggccgccgcgcgccgcgcgacccgcgcaggtgaagcagccgccgcccgccacgagcgcccccctaccttcttcactttgttttccaggtccatgttaacgcgtcctatgggtcccctcctcctcctatccgggatcccacggccgggttcagctggcctccggctccgctgcgaacacgggaaacctgcggaactcccgcggcgccgctcaacagccactcgcccggcgccgtcgaacttccgccgcccagtccgccgcagcgggcctgcggcccggacccgggaacaaagggggccgggcagccaatggcagccgggcagctccgggccgccgccaatcaccgagcgccgcacgcaccttcgcggcccgagcgcggcgctggcaaggtgagaggcggggcggcgtccgaggcggcgccctgctgggcaagctcagtgaccctgacctggtctccgaagggattctctgggcgtccacgggccggcttctaaagagctgggatccccagcctccctctagctgaagatggagaagaactttttccatttggcaatttgtacctgtgtttgcccaggactttttatttgggtcaaggggaatagttatcccaatactaacttctcagtttattttcagggtaaagagagaaaaaaaagagagagagagagattgtagggatcgttagggattcctgtgatggaccttgggcactaaattcaatattgcgttgtggagatgccctttcctcaattgcttttttccacaatcccaaatactgtcaagaaaccgtatcttacatccctaaagtcagcgaagattcttagattgttttctgagcattgggttgttcaaaagtaaagatgatgtgaatcacttcagaaacaggttgtgtcattcctttggaagcagagggttgccctttgtctctgtgtgagatggtgctaggcctatcgcgtgctcaggctttgatgaagcagagtcatcacattggtgcaccaaagctgaattcatttcatgccctaattcaggagcaattgcatctaataccatcagattggtcggtctggaagggagcctaacgattacttagtctagcttcctcactttgcagggaactgaggactccagaggtgcagggacctgcctaatgtcttagcctgttggggacagaggcattgctcatgaatctaaacaacttctcaaagatgtttggggctggaagcacagcatgttgactaaggaaaaagagcagtcaattttcttcaatttgtggttatggcaaaaaataacattgcccagacagcaggtgacctaatttggcacctacttttaaaaataacaaaacaatataaaacaaacaaacaaaaattccctaataatgcagatattcaggtccagatgtatgtctgccttgcctcgagaaatttggtagctaaaaatatccaaaattcattttagccaatacttgcaactctgcttacttgattatttgttaacacagagcattgatttataatgtgcatgtttcctttatcctattaagaattaaaactgaaattaccaaaa

SEQ ID NO: 4249 - DNA, 6681 bp, Homo sapiens
gcccgcccgcgtcagctgacctggcttccgcgggccctgcgccctcgcgctcccgggccccggccgcccccacgccccacgccgcgcccgccggcccggccctccctccccagctggcccggccgccgcggcctcttccgcccggcgcccgcgcattcctgccattcccccgagtcggcccgcgggctacggccgcctgcggagcgcaggaaccttcacctcccgaggacaggcgccttcccctcgggacccggctcccctgctgcctgcgccgctctgtccccctgccgctgcccaagcctccagcaggggccaccgagggctccaggagcaccccaggcccgttcttctggcccacagcgcccctcctgtgaccctcagcgaccctcctgtcctgccctccggcggcgcggctgtctggagactctgcaccgtcgcggcctcgcagcctcgcagccccgcgccgggtggggaggggagggtggcgttcctgagtccgcggaggaaagggtcgcagctgcagtcgcgccagccctcgggcctacatccgctccgccgcgacgcggctcacaaactagggaggggagaagggaagaaagacccgattcgggaacacggctttgtccctggaactgtacctcatgtcccctcacttaatcctcccaagacctgtggggcgtgtcgtcattttagggctggagatgaggaaaccgaggctcggagagatgaagcgttgtacggccaccgagcggctgctttgcaacgaagccaaagccaacgttttgttcttagcggcggtcgtttgagccacgcctcaccgcaacgagtctgccatcagccaagaggtcacatcttttctggaactcgctcccccctcacatcatgggagcagtcagtctactcttccagtagaaactgttttgccacttttggggggaatcttgagctaccagctcatcgctcaggtcttagatgacactttccttgaccccaccgggtgctccagcgcctctgcttccggttttcatagcccttataatatcacctattgcaattgcccatttccttgtctgtctccctctgcagatggagtgaaggtacctgagcgcaggaaccatggtcttcattgctgcctcagcattagcggaagtgccacgggccggctcccagggggccagagtttcccaggaacaccattgagtaccactgaactagagtctgcaagttaaagtaaggcaagaaggaaaaccggaaacaactgtaaaaacctgacctttcgtcaccttaatactggccatcatttatcgagtgcttattatgtaacagacattgttctcagtgtgtgagtgcagtgttcctcaaacctaaatgtgggcctgaatcgcagcggatcttggtaaaatgcagtttctcattcagtacctctggggtgcggcctgagattctgcatttccaacaagctcccaggatactttgtatagaaaggctttggtgtattaactaactcgatcttcttaataatcctatgaaatactactgctattcccattttacagatgaggaaacagaggttaagcatatatgaacttacatcaaaataaatagactgcagggcaaggagggaggggagaatagtgtgggcagtgtacagtgcagaaacaaagttctaggcagaggaaaaaggatttacagaaagcctggcatacagggcagggggacggggcctgcacacggggctgtttcaccgttagacgttataagcacagtacttggggctatgggcttcctgaaggtcccaagtatttgagacctgaaaaaaatttattgacacctacataggaaaagtgaacttttaaattaataattccaaaattcaaatcacgaattgtttcaaaaattttacatgatagaattcatatttagtaagcgatacgggtatattttaatgcatttgattttaaaaacggggtagggcctactaagaacaggccaagccctggccccagtgggtttggatataatcctgagggcagctgggaaccactgagagaagcaggagaatgttctctgtggctacagtgaggagaatggattggagggaggccagactggaggcccagtggctagagaccagataggcagttacagtcttccagactgcgagacaatctctctttagtgccaagattagcataaaatcatagcattatataacccaattattctttgattcctgcatccccaatctgactcagcattctaaatttacttaagatctggggacaagggtttttggcaaatccttgaaggcaaatgatgttacagtcaatcagtatatgccttgagccagacagacatgggtacgggcctcagttctgctgcttgctagctatgtgactttgcacaagtgatttaacttctctgggccttggattccttactggtaacacgagcataatcgattcctcacagaattaagtgagaaaactatgtatgtaggacttcttatggagtgggtacttagaaataaatggtagccgttatcatttatgtgcctttgttctgaaatctgcttaagttttctctaggaagtaacagagggtagaataaattatttagtattttcatcaatcttctgagataaaaattattatcctcattttgcagataaggaaaagggctcagagattagatcacagctctgtgaagtaggggcacaaagtggtcaacctggaagagctggactttattttgcttgcacttctgtccatgcactctctccagcagttgacatttgccctctttgatggctccacgaccaatttcccttagtcatggcatgagtcagctgtgagggctgatggcacaccaccgaatactctgctgtggcgccactagcctccatttaccttcttctccaacgttttccagcctccctcataccttgccccccagttttatagcttctggattttccttattaaagagcttgtttctgagactcagaaccgcccccgactgggatgtcttccagagtacctccctttcaagggagcagataagtaggtcacatcgggatggcgagggaggaagctgacttcttatgggaggaggaaaaatactgcaggtcacatggagaatggaaaacaaaataacagggtttctctcttttcctaattctctcacacaatctcacagggacagcccgctgccagccactactactgtgactagcattctggaaacagcacaggcagtactgatttcttggaccttgaggacactagtggcaacttgaggataagccttgtctaccctgtgctcccctccatcctacctgcctcctcttcaggctactccatagcccccaggatatttttttctcctacgcagtgaagcgaaatctcagcttttacaggagcgtccacctcttggactgccccttgagggcctgaaagcacagagctctgcagggaagctctgtggggcaggagggcactgcccgtgagtgcctggagcagcccaggatcccatttacagagactcctttgcagcaaccgggttaggtcatgggctttgcaagattcctgctccccttcccaaccctagtgaaggcagttcacaacaaggaatgtgggtgagcattaaattacgtagatcaccgtgaaagccagagaaaaagagggacagaggaagggtgcggcattaaagatccaatgctaccaaccccaccctgccccactatcccttgggacggagccctgtttgaatcataacactgggcggtcacatttctaggaaactgcagctgaagaggaaaggtcctggttgtgtgagtgaggctgtgtacagattaggactgaaaatgtgtatccgggcagacaattggtctctggactccacacccgaggcacaagacaagcacacaaaacaaaatgaccaaagcctgacccctcaaacctgagggtaaacaaacctgcttccctggacaagggttgtggaaacagggagttcacctctggagaggcgcaggggttttccattctcctggcgtggagcctggtcaacttctagctcagagactcgctgttccaggatactgggagctctttcacagaagcttggaggtgatgctgcagactttgggctggcactctctcccacctgacttccacattgccccctgccctccctacccctgttcccaaggccctcaaactgttcaggggtgccaggcccctctgttccttctcttccacccctgcagaaggcatattcccccatccctcaggtgtctgtgcccaggtgccccgtgggaaagcccactcttgccttcagtagctctcttccctctcctgagacgcaaggctgggtgacaggagacagacattcatcttcacccgagcccttcattatgcttaatctttctagtgggggtgggcctgtcaaacacgtctctttcctaggttggagtaatcccaaagcacctctcatcatagtggctgtaaatcccacaagtatgtggcatgcacatagtagcactgacagtgtggtggtgccctgcactgacagtgtggtggtgccccacactgaaacaagaagtttggacttgagaggcttagaacctttgtcttcttagaaagtgactggcagctcctcctccctggcacctgctccaacctgggccccttgatctgctgacatctctgcgtgactctgggtgcgttgcttactccaggtctagtgcaggtgctacaggactacctgggagaaaggagccagtcttgaagtctccatttctcccatacatcagtcacttaacggatttaagtaagaccttagtatgcatcgggatcaccaggggacttgtgaaaatacagattgcagaaaccctcatctccagggtttctgatttggtgggtctaaggatttgcatttctaacaagtgatggggtgctgctgttccagggaccacatttgaaaaccactgagttcgagtatagcaaaaagaaaacctaggtttcagtcctgccctgccgcttccaggctctgtggtcttgtctttgaccttcctgagcttcacttctgcatccattaatggtgtagtaatgaccactgggtagttgggaggattcatttgcatcatgtgtttgaaagaccctttcacggtgcatggcaaattggatacatcaattagtcaacaaatacatttttttttggatggaatttcactcttgtcacccaggctggagtgcaatggtgtgatcctcggctcactgcaacctccgcctcctgagttcaagcgattctccagcctcagcctcccaagtagctgggactatatgcacccgccaccacacctggctaatttttgtttgtatttttagtagagacagggtttcaccatgttggccaagctggtcacaaactcctgacctcagatgatccgcctgccttggcctcccaaagtgtggggattacaggcgtgagccactgcgcccggcctaacaaacacatatttattgagtagtctgtctgttgttcattagatacccaatgccatgaagattctaaggcccagttaaacatcacacgtctctggaccttgattttttcctctttaaaacaagggctagacccgttcatcggggatgaactgaccgaatgaatggtcgtgttcatgagtgttctttgctctgcagaggcacctgggctctcagatagaggtccaggaaaggcctggacaaggaataaaacatttggctgtcacctgcaaatctaagcaccccatactcccatcagagttggacttctgcacaggacctggaaggcctattagtctaataaaccaaatttggccttcagggtccatcatgatctgattccaacctaccattacaatcctatttctcacttttctcttcctttcaccttagagtctaaacaaatctatctactcatccttccccagatatgccctgtgttttcctgcctccagctttttgttcacactgttttcggcactagaatactcttgcactagtcaaagtcctattcatcctttgcagctcattcaatgactatattttcaaagaagtcatccacctatctatctatctatctgtctatctatctatctatctatctatctatctatctatctcaagtgattttatctttttcttttttttttttcgagacggagtctctgtcgcccaggctggactgcagtggcgcgatctcggctcactgcaacctccgcctcccgggttcaagtgattctcctgcctcagcctccagagtagctgggattacaggcatgcgccaccacactcggctaatttttgtatttttagtagagacggggttttgccatgttggccagactggtctcaaactcctgacctcaggtgatccgcccaccttggcctcccaaagtgttgggattacagatatgagccaccgcgcccagctgggatgtcacatttctagtcttggagcatattcagatacaaaaaataagagttgtcctatgtaaaactattaaaaagtggaacagccacttaaaaggagatgcctacttatacataatagtcatgtataaactgtttattttttatggtaatcagaaacagtgaatatgtgtgtgtgtatatgtgtatatatatatatatatatata

SEQ ID NO: 4250 - DNA, 378 bp, Homo sapiens
ccccgctcagctcctggggctcctgctgctctggctcccaggtgccaaatgtgacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattctcccctcactttcggcggagggaccaaggtggagatcaaacg

SEQ ID NO: 4251 - DNA, 1975 bp, Homo sapiens
gtcactgtgtgaggaaagtggggcgccatcctcacccctgcacagcggcggcgactcctctagctcccaatgcaaaagcgtttaaagatgcagctcagaagcatcaccagcagcacaaggggaggtcccaagaaccagaacttacatcactgcctccgagttcagaggtttcctttcccaccttctcagaactttctgtttccatggcctcctctgccacctctgccacctcccctgatgtgctggcctccgtctccatcgcctcctcatggccgtcttccgcccggtgttccaagcccactgcagtcgaagcaaacgtgattgcgttaccactcagaaggtggcacagggactggcagcggtgccatctgggagtctgtgtgctcagcctccgagtgcaggcttccccggcccctgctgtggtgctaggtccccagatgagagatcacggtcatgaagatcagcccccaaggcagccccttccttccagcctgggctctggcgtgttctaggtgctcacttccatggctggcctgctcacagagctctacctcagcctgtggtaagcgcacctgctcggccctggtgctctatgatgagccaccagtcagttctgcagatgtgtccccgagctcctgccgagggacgaaacacggtggccctgctcctagtgccatgtgcacgccacgctccacacctgccatctgcccttccaccacctgctcccccaggggctccgcctcgtgactcacgctcaggcaagtctccgggcgcgaacagctggctgatggtgacatgctgcagcctggtcacatcagaaaccatgagggtggatctccggaggtcatcgatgtggacagactgccacagccctgtgaagagtgaagccacccacaactgtctttgtgtctttcccggctgctgctcagccctaagcagggacattgcacaccctggcttgtcattatcttgctgcgcaatgaatgactggcaccctgaagccgaaaccctggaatgggcctgcgcagaaaccacccaacccgatactatacacgacccgattctatgcccatcgacagcttcaccataagcagcaacggtaagacctgcaatggccagcgtgggaaggacgcatggataaggcctgtggttctttcacccatgcattgttgtatttgctgtatcacagttagtgaggggtgggggacactggcaaggtctgccttccattctccacgaaattattcaagtaaacttactttcctgtttctggaataccaacttttctatgtcataaatagctggtgaccattccttggaaaaaaagagatctgaagatagtccgacccccgccactctccctccccgccaaacaggcgtatcggtgcgttcctgacagtgtctgtcgggagtcgggagtctccacgccgtgtgacctacatgctaagaggtgaggagcttgcctagagtcagtccaggagaggtgcacgcagcctcccatcccaggattcatgttttcatggtaatcagtggtaagaaatctaattgcatctggaaagaatcctcttgaggttaacaataatattctaatttcagactgtacaacacagaaccaaatgagaaacagttccaacatgacttaaataaatacactgactgggctgggtgcggtggctcacacctgtaatcccagcactttgggaggctggggcgagcggatcatgaggtcaacggattgagaccatctaggccaacgtggtgaaaccccgtcactactaaacatacaaaaattagctgggcatggtggcgcacgcctgtaatgccagctacttgggaggctgaggcaggagaatcgcttgaacccaggagattgaggttgtagtgagctgagatcgcgccactgcactccagcctggtgacagagcaagactccatctcaaaaaataaatagatacaaataaataaataaatacat

SEQ ID NO: 4252 - DNA, 3244 bp, Homo sapiens
gtcttcttccaaagaagagcctttggtatttggcagagcctcgccaatttggggcgcacctccccttcctgggatgctctcagaaggcaaaccaattcccagaagagagggaaaaacagccacaacagagagaacctttgctgtccctgtttggaaagagattgggatttcctggagagggcttgcttctactgcaggtttgtttaaaagctcaacatctattctggaagagaacaacgcagactccaggaagatggagaaaaggcatttgctgcccaaggtagaatcccatcaccatactcctttcctacatccaatcacaaaatcagaatatgccaattctctattcccaagtaagtcaacagaccctaagattacattccctttctcccctctgcaaagcttcagggacaggagtccctgacaggcagctgacatttggggttgcatacaaaaagtcaagtcattgcaagagaaggaagtttgtttctattggaagagttagtgtacaacatataaaaacggagtgaggatggggatattgtagtagggagggggttaaagggcttagaaaatgatttttttaaaggtggacaggggaagagtagaaggcaaaaaaatgtcatccatgtgggacatcttctgaacgcccaaggagaatctttggggatacattccccccaagatttaaagaagtggcttcactcctgagaatgtacagggagcggagaagctaaaccaggagcaacatccaatttctttgtctctccttctcttctcactgcaaactctgtacaggtttggcataactatctaaactttctagtaaaaatcatagccttcatgaagatccattgtgtatttgattcacagaaagttggtattgaattgtaaaacacggctacaaatttctccctctccaacaggcgtgtcattttggaatgtgtcttgctgctcttctcatcaaaggtaaagtcctcttcttcaccttttaacctagagtagctgtgcaactttctttgaccaatcaaatatggtggaagtgatgttgcgtgacttccagatataagtcttaaagagatttttcactttctgctttcactctcttggaatgttgccctgagatcaccacaccatgaagaagtctggggcgaaaggccatgtggagtgagaggctcagcttcccagatgatctcactgagcacagcccccagccacctgccagctcaatgcaacctggtgatggacccaagcaaataccagcagaagaatcacctggtcaacccacagaatcatgagaaatactaatttgttgttgtcttaagccacagggtgaagactatatttgctcacataaattgtgtccttataacagaaaaagcttcttagggctggtgcggtggcttattcctgtaatcccagcactttgggaggcggacgcaagcagatcacttgagttcaggagttctagaccagcctggcctacatggtgaaaccccgtctccactaaaaatacaaaaattagacaggcatggtggtgcatgcctgtaatcccagctacctggaaggctgaggcaggaaaattgcttgaacttgggaggcagaggctgcagcgaaccaagatgggaccactacactccaaactgggtgacacagtgagactccatctaaaaaacaaacaacaacaacaaaagaaaaagcatctcagaaaaacgttcccctttttcattgattccatgcaaatgatacttcaccctattgtttacttgtcctgaaatttcaaagcagcagaaattctgctatacattatccttttatctggtatttattgaaaatgtatttggctatgatttgaaatatataacatagtgtcaggtttattttctcatgtaacgagtcaagaagtaggtggttgctgcctttctttcagttattcaacactataatcaatcactgtcttgtctttttatatttctgttcgctatcttctatgtgttgggtttccttcccggtgggtgtcatatcagggtcacaaaatggctgctattgcccagtaatactcgaatgctcgagcgagggcaggatggagggaggggctgctagctgtatctgtctccttttgtcagaaaagcaaaagctttccgggaagctctcctagcggcgactccttacatctcaaggccacaaatttcaaagagtggaaaagcagaaaacaagattctcatttttggcaccattgtgagacattgcctaggaaaggcatattgacaattcaaacaaaatcttaaattctagtagcaaaggacacagaggaatgaatatttggtacgggacagaaaggatctgcctaaatgccctagttcatttgaatgtaaaattcttaaaggctgggattgtgcctgttctcttctttgtgtataggactcagatcataagaaaaatctttgacactacaaattctatacactaaggcagtatccccaaatttcattcaatttttctaatatgggggtgctactgagcacaaaactagaaagagattataaatatacatattcttggtcagtttagactactatagcaaaatatgatgcactaggtggtttaaatgatctcctcttagggcccttgctgtgtccttgtatggtggagagacagttctctggcctctcttctcttcttataaggccactaattccatcatggggacttcaccctcacgtcctgatctaaacctgagcaccccccaaaggttccacattcaaataccatcacactagaggttagggcttcaacatataaatttgggggaagataagcgtttagaccattatttatttatatgttaaaaataatatagaatattcccagaagtcaatttttgctccatgtattagaatacttattaaaccttcctatgcccagcaaaattgtagacactgaaaaaataccaacagaaaatggtccagcttttaatgcatttaagctgaaataagaagtggtgaacacagatccaaattgaactaaaatgttatgtaatctataatagcaaccttttatctggtgtctattatgtgataatggtataacgtactttatctaatcttcacaacaacactgctaggtagttattagcctcatcttaagtgttagaaaacagagaacactgagaggctaagaaattcattcaaggccacccagggcataagcagtggagctgaagtttggacaagatttctttttc

SEQ ID NO: 4253 - DNA, 1105 bp, Homo sapiens
ggggtcacgtgggcggggtttaaactcacctcctctggagggagtgaggaggggggtgtgtggggggggtagtgcgcggagacggcggcgcgccgagggggtgggggcgcagtcggggtggcgcgcgtcgaaggcagtaaatgaggaggggtgcgcgagtcggcgggctccgggttccggctcccgccaagagctgtcttttgcaaactagcaagttccttccaccttatgcaacccagcaacccacttctccaagccgtgcgacactcacggcgcatctcagcggctttccttcctgctcccgctgggggccccagaagaggggtttgcgaggcctggctgcactgccctgctcctctggaagcaggaggaagcgcgcggctggaggcacaggctgcagttcccagagcccaggctgacgccaaagtgggaaaaaggcggggaaaccagcttggcgcagccggacgtgcatccttccgagctgccacttcggagaagcctttcgtgcacctcacctgaaagacggtcccactcgaggtgggctaggggtttcagggggagactttccatgcagaggtgccttttgggtgccgtgggtcaggtaggagctgtcctttcagcacccgttgcgcagccgcctccccaaatgctatcgaagcccccacccccaactcctctcgggtggctcccttaaggtccctgtattcccaaacctccagaccccgccacagtatggtggagagcggccgtcgaggtctaccagcactcacttccccctacactctacccctctcggagacattttgcccagctgcccaacccgacgcggccaccaagcctgggcactgcagccgcagctggcgaaatccctccttccacactgtcaagctggctgcctttcacttgcgcgaggaaaggagggtggaggaaagcgcccggggattaggaaacaagtagaggaacaggtggtgtgatggcaaaagggctcttccggtgccccctagtccaaagccagggtcttggagctagccaagtgcacctgagggagggtaggcaattgcagcagcaaaagaaggtgttcttccgttgcagttagcaaacaagt

SEQ ID NO: 4254 - DNA, 2650 bp, Homo sapiens
ggagaatgaagacatggtacaagatgcgctgcagcagaacccgggcgccttcagcaggctagctcccgccctgcctgcccggccccaccgaggcctgagcacgttcccgggtgccgagcactgcctccgggcttcccccaagaccacgcttagcggtggcttcttcgttgctgtaattgaacgggtcgagatgccgacgtgactcagcctcacaggccaaagcatcagcaccagaacgcacacccagcccagccccaaagagaaagaagagagcaaaaagctgcagccggtgcttgcacaccgccttgcacatagcagaggctccgggctcactccttcctggtgggaaaggaagatgcctgtcctctccgtggaagaccctgggccctcaccgcaggcagcagtttgcgttttgaaaggttattgggtcccttcctcgggctgtgttcttgctggtgagcaaaagtgttgcctgcagaaataaaatgcagaacgtactctacgatagatcacagttttttattcttaatgtcacaagcaggagaaaaatctcacattcatactaaaaattccaactagactcaacaggaatgaagtctctatttgtaatggaaagtcccagcctcccgctgccgtccagtgcgtgtactgtacacatccacactcattctcactcagggttcccggaccggctgtcctgcctgcggaactgaggtaaactagctcaggtactgacactaggagggtctaccttacataaggtacaggtagaagcttgattgctaggcccaggcccacccagaccctccaatcctaacaggtatttaggcttgaggttcactccctcctcagctgcacacgcagccaggtattaacgaggatcagagctgttctgaggggtgggaaggagcagccccgccaccactcactcaccctcagtcacatcggggagggggcaccagttacatttacatcacattatttataaaataagaattacatttcatataacatggccagaaggagctctagtcccccaggaaagctgccggggacagcatttgagcctcttctttgcacaggcataacttaactatacagctaattcctagttaatagcatttatacttaaccacctcaatgaaccaagcttgaaggaatttaaaaggcaatttagcttaaatacaaaaataaatttttgttaaaaaacgtttaaatatttttttcttttaatttagacacacgcattcatacttctcccaaagaggttgggcgtggcagcaaggcgcttgggcctggggtatgtggtttcagaaggacggaaggaaaggatgggctgcagagggccctgtttgggaaaaataggattttaaaaatatggttcattaatttaggttttctaacatctactttgggtgatgtagcctccagtgaggtcagttaagtgggacagaaacggcagagggaagaggtctttgcttcccctgggcccattctccctggctgccagcccttgaagtcagaacaccatgggaaaattcaggagtcggcacttgtagccgtcaagtggtgctactttccacattcaattagcgaggccccagaaaacttgaaacaggaagtccggcactaccaacatgccgccactcatacaactcaactcttcctccaaactcgattcaaagagcaatacacagagcatcagacaaaggaacacaggacaaggcttgaaacatacaatcctggagaggcagacgagggcccaatggggccaaagggtagctgggcgaggaggcagctgaagcagcggtgggcatcctgcctgctccaagagcttctcccttcacccctggctctgccaggctaacagtcttgagccaccaagctctgaggggccaaactggcagagggttggagatgaaacattgattcaggcttggcaggaagaaaacggcaggagcagcacccactggggtctccaaggcaaagctagattcaagggcatttaaaaacgaaggaatcctgcaaggaactggtgagggacacagcagcaagaaatggggaaacagagtccccagaagggaccagaggaagagaaccacttctcacagctaagccaagcaagataaagctttacggatagcccatttcccaaatcccatcaggtgcacaccaccgatccaggcgggctggaccctgccccctccagcgacgacggtctcggggaaaggtggaaggggcgcctgcctaagggtgtgctaagcgggagtcagggcagcggacactatgtacaggtgtttccttagttctccagcctccccagtagaactgttcaagtagaggtcccgggctttggccctccgcatcctgcttccccttccctgaggcttgtgcttcctccagaagggaaagggccccagggctgccactgccccctggcggctgaagccagagatccggggtaggtttgctttacgcaactggaagggtccaaggctcttcctagcaggtgccaaggtccagatttagggaaggggtggggggaacagggacaggggacaaaggctactttttgcgggtgtgctgccttcgggcctgcagtcgctgtcgagcccctggggtcttggatcccgcaccaatggaaaatgaa

SEQ ID NO: 4255 - DNA, 618 bp, Homo sapiens
gcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagcgcgttcgttcacatagctcccagttttaacatttcgccacctactgaagacatcatttgggaccaagctgatgagcccttgaagcacagcagtgcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacat

SEQ ID NO: 4256 - DNA, 2730 bp, Homo sapiens
caccaaatgctgaaggatgtggtgaaactggatcactcctatgtggctggcaggaatgtaaaatggtgcaaacactctggaaaatagtttgtcagtttcttacaaaaccaaccatgcaaggaccatatgatccagtgaacgcattcttaggtatttatctcagagaatggaaacttatgttcacccaaaaacctgtgcatgaaaattcacagcagctttattcataatagtcctgaactggaagcaagccagacatcctttcaggggtgaacggttcaacaaattgcagttcattcctaccacagaatgccactccagcactagagaggagcaagctattgatgtacgcaacaatttggatgaatctcgaggaggttatgctgagtgaaaagctccaatctgcagtttacgtaccgtattgctccatttctataacaccctcaaaatgacaaaagtacagaaatagatgacaaatgagcagttcccagggcttagcgatgggggatgtggaaaaagagggatgtggatatgaaaaggccactgcttggacaatgtttagtttcagcttaaaaactctcatctcaccctctacaactgcctctcccctccagcctcctctaacatgtcctctggctcatgtctaagtggatttgtcacacgtgtttgggaagtcattacccaggaaaaggctcctctcttgaccaatctaacccagccctcttcacatctctcttatttcctttaaacaccctttgcaggcaacgtcaaaaacatgctgtcttttgaaaacataaacttcttgctctctgagagctggaagtctgggcagagatgaagtgtaccttgttcagacccttctcctgtgcctaagccacctgtcagccaggaagcttgctggtggtggtagctctggcccagacccttacgatgaagagttgactacagcagtttattcatctttttttccaccaaagaaagagttaatctctcctccttccagctatcttgccaacagctctgagagagtaaagaatctgaccgaaagcatacagtataagtgatcgtgtcagcatttctccggcactaatgccctagagtctcttcactggaccaggacactgaagaggacagagtggcccagggatggcaaaagggaaaagcagaatcctcagactcaggaaacagaatgagaagggtgctttaggcggagggggccaaggcgacccaaactgagaaactccagggagtcattgttttcgaagtccttccacccatcactctccctctcctctcactcctccagtgccttttgcttttcaggaaacagttcgaaactgaaagcagtctgtgctggtccctggctgtgctgacaggttgaaattttcaacagggaaccagtgcaaagacaatggtgatttgagagtggacattgggctttaggtttgagtacgtgtgtatgtgaccctgtggggatttctttcttttctttttttttgagatagacttgctctgtctcccagactggagtgcagtggctcgatcccagctcactgcaacctccgccacccgggttcaagcgattcttgtgcctcagcctcccgagtatctgggactacaggcgcatgccaccacgccagctaatttttgtattttttggtagagacagggttttgccatgttggccaggctggtctcgaatttctggcctcaagttatccacccgcttcggcctctcaaagtgctaggattacaggcatgagccactgtgctcagctaatttttgtatttttagtagagatggagtttcacagtgttggccaggctggtctcaaacttctggcctcaagtgatccgcttgcctcagcctcccaaagtgccgggattacaggcgtgagccaccgcaccctgtgggaatttctttcttcaactctcaagcctgcacataaggacctgattcaggaagatccacacagaaactcaggaagactctggctggggaggtccccctctcacatgcagagtgacctctccatagacattgcccggagttgattaattgtttggttttcaaggcctgccatagagaaacttagaatacaacgcctaaggagtcgacaagctgcacatccaatatcatagagccacccactgaggaaattgagtctctttctcttttgcaaaggaaaaaataattaagcaaagattaaagcccaaagtgaatgtctttccttggactggaatcagacatatctgctttattcctctctggccttcagggcctccctaaggtccagaggggcctgggccacttctatttttgagagagagagagagagagagagagagatgaaaaaacaaggttacaaaattgcggtatattttaaatgagggaagttcacagatcaatttcttggtacacaaaaagcaataaagtataattaattgagctctaaaaagaagattgtggctggatgcagtggctcacgcctataatcccaacggtttgggaggctgaggtgggaagattgcttgagtccaggaatttgaggctgcagggagctatgattgtgccactgaactccagcctgggcagcaaagcaagacactgtctgcaagggggcagataataaaaggatacgtataaatgtatgggttcaatacttctgccaaccagccctgaagtttgtggaaggaaaataaatctccagaccccacaaccaccaagccaaa

SEQ ID NO: 4257 - DNA, 2492 bp, Homo sapiens
gttttgaaaatatctttaaaaaataagagtttttgaacaatgaaagtattgataaaatcacacatctaagttaaacacactctcaatcacctcactcatgtttcctgttttggttaacacattttaattgactttggtcttttcaccgtcgctcttccacctgcaatgctggactgagtgtcatgcattgtccgggaacccagatcctggaacttccggcagagtctggagttgtcacctgttgttgtgtaagaaccatctctgccagttcttatgaggagctgcctagcagagaattcaacattgacctgagccagcttagcgagctcgtacaacagctgggctggttattcctctgggccactggttcttacctctggttgttcattagtcatcaggggaatttttgaaaagtatgggagcctgtccacacccagagatttggttctaacgggtcctcagtgagccaggacattggtttgggtcccactggtttagttcccctcattaggacttttgctctggaacatgctgcattttcccaggcccagggcaaagaagaatgtcctacatgatcagaatttaagggactgttatgctgctttcctacctgactgttcacctagtcttttttttttttttccaaaatgtaacaccatgaaaagtttatctctctcaaaaaatagacacaatggtattaatgacaacagcagttgcagctcctggaggtggttccatttttcccacatgtgattttatttcactctgtcttgagttctcaagtttttcaagacaaaatcttccgagtcagtcatggctcttctctttatcctcactccgcttctctagttctttatcaggtccagtttgactctatctctaaaaccatttctgaatgtgtcaatttctttcattctaactggctctactacaagtccaagtcaccatcctctcttgactgggctactgcagtggactctggcctggtctctaagctttctttcttgagggatctggtcataccactccctatgcaaaaccctgttgtagagcaaagtccaggcttgttgctttatcctaaaaagccccatggcaagggcctctgcctgactccttgactttgtggacaaatgggtttatctatggggaaataagaatgcaacattcctgacatcatggaggcccagccttctatctagagttatataacatcttggaaggttccaaaggcattaagtcaagtccaggtttgtcagtttctccaaaagatgtcaatgaaaactgcatacgtcttgcagctgaatatctaaagtatcaattgcctgaaaaatactgatgagcaggctgtaggaagagtgtgcagaagctgcaggaagagtgggtcctgctcactgccttctcttttttttgttgttatcttgcactccccatgccaggggacatgggaggtggagaatcctcgtgaagtgcgtggggacagttgaccatcttccactcctcccagtctacccccagagcctctctctctacaggtttgcctggctcttaatttgaggacctgtctctgcagaggccccttggtgataaactcagggtcacgagtcagttctcatagggatgttcactctccagactcacacccactggctgcccttgcagacctgctgggtgccacagaaccagggttggtatattttcttttattagacaataagagctgcacaccacagcgcttgccttttctttttgcttttctttccagggctgtgttagtgctgattatggatgtattcatcagctctcttttctgttctttctctttctgctgccatttgtccagtttattcttgggtgtgtgtgcatgtgtacttatggagagctcagttcaagtaactttgtgggaaggctggccgggccggcttctgtggtcttgatgcaccgcccttgtccttcctcccacctctcctggcattcacacctgcttcagagtcccctccacacattcaatttggggtcctctacccctacttcggcccatgtgatcaccaagtggtccagagcagtccttggacctgtccaccccatgaaatgggaaccctcaaaagacccagatgccgttttagggggacaggatgtattgaagatttataaatggagcaatctcctaatcaaaataaacatcatccaatcatgctcacagggtggtggcaaattagtggcagcatattttgttttctttagcggtgatccatgattgatttatggattaaattgtgccctgtgaagtacatatatatctgtgaactgtctccctaagcatttcctgttcacctctgtgccacatgcctggctgaaggagagaattgtttctcctctaggcaggagctgtctgcatagctccttgggctgggatagtgtctgcttagggctgcattcggctttgtcttctgctctgtcctctgagctcagcaaaaggcctataaaaaggaagg

SEQ ID NO: 4258 - DNA, 1540 bp, Homo sapiens
ctttcatacctgcctactgatgtatggacttcagagtagtgtggcctatatcgattttctaggatcattattttgtttgttgtttttctcccttcctccacctattttctcttcataggacatgaggattctcaacctgataaaaatgagctttcctaataactcaagacccatctgcctaggaataaaccatcccagctgtgagagaccagacgaaacctgagaccagagactcgttttcttctaaaatgctttctccaaaagatttttaaacagaaaaagggggaaatgtgaaaggaaaagaaaacttgaggcccccaaaatcactaagctaaaaggaaaagtcaagctgggaatggcttagggcaaacctgcctcccattctatgcaaagtcatccctccgtgcactgagataaatgcttatctaattgcctcctttggagaggctcatcagaaactcaaaataatgcaaccatttgactctcacctacctgtgacctggaagatccctctctgcttgagttgtcctgcttttctggatggaaccaatgttcatcttacatatattgattgatgtctcatgtctccctaaaatgtataaaaccaagctgtgccctgaccaccttgggcacatgtcgtcaggacctcctgaggctgtgccacaggcatgcagcctcaaccttggcaaaataaactttctaaattgactgagaccagtctcagatattcagggttcacagtatccaaaaatccaatcacatctgaaaccgcctttgcaaaaattatcacagtgagaaaataatggcagtgaaagaaagctgatctagccaacctccctcttgcctttagctttcaagctgcttttacttattcctgggtttaagccaagctacatgtgggagtcatttagttgatagtttaaattataataacccttccccgaaactcaaccacccttgtaatactgagagaccaccaggctaggaggaggagaggagcctaaattctgctaaggtgtagacaaaaacaattgtgaggcgttattccagaagccacaagatatgcaacttcctcagttacccctgcagataatgttacttttgtagaacctaggattggccttctgagatatcttctcaggattttgcatgtctgatgaccgatggctccaccgggaccagccaacggcttctgtgtccccacccagaagcgactcagagaaagaggacagcttcgacaccctatgatttcatctctgacccaaccaatcagcactccccataccctagcctgctacctaccaaattacctttgaaaaatccctaacctccaagccttagatgagtttgatttgagtaataactctgcctcccacatggtgtggctggcatcatgtcaattaacctctttctttactgcagtgccatggtctccatgaactgatttttttgtgcagtgggcaggaagaacccatcgggcagctacacatcttgaaagagaagctcttcctgtgaggctgccgggtgccgtatgggagcg

SEQ ID NO: 4259 - DNA, 1666 bp, Homo sapiens
tgtgagtgattcaggaccttcccagcctgggcagcatttggtattgccactattttttttttttattattttagctcttctaataagtgtgtagtgatatctcctgatggtttaatttgcattgtcctgatggctaatgacatcaagacctttttatgtacttatggccatctgtgtatcctcctcagtgaaaagtctgttcatgtcttttgcctactttttaattggattgtttggttttaacaactgagttttcctaattctttatattttctagatgctggccttaccactcggtgattattttctaccactttatcttgttttttcaccctcttcacagagtcctttgcagaaagttttacattttgttgaattcaagtttattaattttaccttttttggattttgatttttggtgtgaagtctaaagggagaattaatagttctactgtgttgagttttccaatccatgatcacaggttgtctctctatgggtaattaggtcttctttaacttctttcatcaatgttttataaatttcagtgcacagattctgaatctgaaatttctttacagtgtacataagtgttttattttctttggggcatttctaaatggcattgtgtcttaacttcagtttccacgtttattgtggagtaggtagaactgtgagtaatttttatgtgtcagtccacattctgcaacctactgagctgccttattagatctaggaggattttttttggtagatttcttgggattgtctatgtagatcatcatgttatctgcaaattggatagttttatactgagtttttaccaccaattatgatgtagctataggatttttatggatgttctttatcaagtcaatagtccatgtctattcatgaatgtgtgttgtattttgtcaaatgtcttttctgggacaatttatatgttcatgagatttttcttctttgacttcatggtatgatggatagttgattgactgactctctaatgctgacccacccttgagtatctgatatatattccacttagccatgtatataacttttttatgtgttgctagattcactttactaatattttgttgaggacttttgcctctaagtgtttgtgagatattgatctatagttctcattttttgtatagtctttgctagtttcagtatcaggataactggcctcataaaatgagttagaaagtgttcccacttgttctaacttttggaagagattgtataaaattgccataaatttctccttaactgttttagtagaaatttccggtgaaaccatgtgggcctggggatttctttcttgggtatttccttccttctactttgtttgtatatatttagctcttttttttttggtttcttgaattagatcttagattattgatttgagacttttcctgctttctaatataagtatttcagggtatgaattccctctcagcactactgaactaggtgtacatattttatcgagtaaaagttttgatacaaaaaaaaaggagggaaacacactaattccccatgagtagggctatagatttacgctatgatttacttacaacagttaaactacccagactttgtgtatcaacatggacaaaattctaaataacagtgttgaatggaaaccagcaaact

SEQ ID NO: 4260 - DNA, 14074 bp, Homo sapiens
agcctctcatagcgcctgctacatgggaggttagctgtgaatgaaagtctctctttgcttttgcagaagacttggctagagttggggcaagaaaaatggtgctggggttttgacatgctctgtaaacacacatgttcagagcaaggcttatggccagaaatgaatgaaattcataatgaaggtattctgaggaaatatgatcttactctcaaagtctcaacaataccctgggtgataacaactggctctcaaggaacaagatagctcccaagcaactccagtgcccaggaaagatggtgaagagatctttgcagacaatctatcagttactggggcagaaaaatcattgtgactagtcatcttcatacgatagcttaaaccaacagactgagaatttatagtgtagcgaagggcagtctaatgcagtagttacttggatccactcttgctgttttgtgaccctgggcaatccagttaacctcccccatatattagctttctaatgtataaaatggagatgacaatggtatctacctcattgaatggtgcaaattaagcaaattcatgaatgtaagatgcttagaggacatccgacacatgagtgcaggacaaatgttggcttttattcaattctaggtccacaaacaaaactttacaaaataaagaggtttttgttgtttttcttttctctctctctctctctcttttttttttttttttcatcatctcaagaaatcaaaggcatgcacctggaaaaagaaaacacacttttgaagtcttctaatcactagggctctgtattttgttgcagtcctatagtgtgggtatttaaagaataaggccaggcaactctgtctctagtctttgttcattcatttgatgcgtccttgagcaccttactaagcaccagtcaatgttgtggacaatggggatatagcatgatgaagccagaaaggatactgccaaaaaggcatacattaaactcataattacacccaaatttaccaaatacaggatccttctttgctaccacaaaattcttaatggctttaagtctcaactttctcatctgtaaactaagggcaataacagctgctccttctgtatgttgctgtgagaggaaataaaatcgtctttataacaaaactttgtgagagctgaaaaagtgtttgaataaatgcattcatgatattaacacttccatttggctgctgagataggttcacttagaagtattcataaatctatcaaggtagggaatgaatcatgaatcacgtcacagagcttaggtggaaacttattccgtgactacgattcctcttaggtgtactgaacataagctctcctaaaaacaaagcctgtacataaaaattaaatttagtataagcaatttgaaaactgaagaaaagaaatgttcacccttttctgagatatttattttatcctcagagaaagaatgaaataaaatgcaatgtcttttgccactctcctcataaattctgtctgtctaaattcctagacacaacaatgacagaattcatgtaaatatacctaacctgagaggtcagatttggggacctcatggagtggtgcatgggagtctgcccagctgctgaccacactcagtgagtgtatgaaaccaaatatccatccatgaccggtcaacatggaaaccctcattgaagaaataactactttgctaaaggagcaggttatttcaagtatttcattgatttcagctctcaagtattcaacaatttttaattttaaaacaaatttaaatttaaaaataatttaataaattaatattttgaaagagaatgctcccagcttgcatatgaaatttcagttttccttatttcagagggcacacctttccttagtagaaatgtagtgttaaccacagcttataaagtacatgttttagatttgtttcaaagctagtattttaataaaatatataatataaaataactaatataacactgaaataaattacatccatcttcctacaaagtagtttatagcttaatgtgaaatatctctctccccaattcccactttaaatattgaaattgcttgcacatgctcagtgcttcacattcttacctcttagtagttagtacttagctgttgtttattataaaaaaacaaaatcaccaaatagctgtcttgatttttttttgcatttcaaagtcagctaattaatttccaataaataaaacagtgaaagcctagtaatagagcacagattttcctacttttaagtaaatttcttgcttttcattgcactgaaatattattttatccaactgctttgtccaccctggcaatcagtataactagagtgatattatttccctgtttgattttatacaatggtaggccattggatcaagtgttctgtgacctgtttatcgttgcttattcctggatagaattcagtagagaaaattcagaaactataatgatggacttacatcaaactattgcactcaaactatttaggaaactgtctgaagtctgagagtgtagttcattatttgtgcttgtctcacaagggcacaatattctatgtcattttttatatcatagaaaaggttaggtttgaaaacttagcattacaaatgtcacatttacttccagtaggaaatgtgcaacaatatgtgacaaaactgaataaaatgttgaaacatgttttccttttgttttactttactcatttttgtaatacaacactggttactggaaaatgccttacagctttattcaaaacacatgttcaaagatttgaatgaaaaaacttcgactctctctggaacatctaaccgatacatcatttgtgtgccttaaattttttcttactgtcaggaacacttttatgtctttaagatttatttaaactaggttattatataatgaagcttgtcagatcataggaacaaagtcaaacaagatgtgctatatcaaagtataacatttaacatatagatttaagtatacatatcaagtacaacgcaatcaagcaaagtttaatctgaaaatgcaaatgcttcagattattaaagccacatctgtcctttgaagcacaatttagattgtttatcaaaaagctatgtgtaattattctctcccaccctagactttgtaacaacagatttcttaagaacatttcaatttcacttcagagttgggattttaaatacttaaccaccaaaggacacgagaacacaaacggaaaattaaaaatctttacaatgtattctattataattgctgttttgttggtgaatcagggtaatatttcaaaaagcattactccgagttttaggaagaaattcccaatgcttttagaaatcaattccacatagttctagcatcaaaaatgtgtccttaaacatattattacaatttttcatataaagctttatattacatttcactctctgccttggccaacaggaaacatcaaaggcaacattttaggtagtaaagagaaattccaaaacactagggacagagctttgaattttaagtacttgaagttcccaggccttaaatttatataaaaaataagtaagtctgttgtattctcttatgtacgttcattgacctataaaattctcttaaatacacccattggtctatccattgaaaagatacatatactgtcctaggtaatattattaagtctgaacacttgagaaggaactgaatcactgcactattatcctagagcagacctaatttctgtgcaaaagtatgatctttcattttatccataagaactgaatatgacagaaatgctgggctctcatttacaaaatccacttaaatatgagggctcattttagcttataacagctcacatctattataatctcagaaagcagcaataacttgtaaaattaattggagtctctgttatctataggaaaatttaaaattaaatatgtattttaaaaaacaataaaagagaggcttattgaacttgaaagtagagattcactgcttgtcaatctagatcatgaaggattcctgtacaaatgcaggtagtaacaaggtcacggtagctcaaactctgcttgtgcattcaaattcaatccagaaacctccaactgctaaaaccataaacgttctatatattatcgcctcaatattttacatttaatgtatcaattataatccggcttcagtaatcaacatgggagagaaggaaagtggtggctaaaaaaacttcagcttaacttaaaacaattttttcaaatggattaactcattcctctctgatgccataggcgaagcaaacaaaaaactggatgatagcactaattatatattttttaaagaaactggtatcaacagtttgactgaaaggttaaaggggaaacataattctataatatcataaactctgtcatagcatattcagaaaaggaaattgttgacaaatgtaattgaggcaagtgctttatttcctttccctaaatgtagagagagcttgattgtatttctgaaactttaatgcaaactctacagtaaagtgaagaagggcttggaatgaaacacagtatagtttctccatgagaaacaattagtatgccgaagagcttatgtcgaaggaaacttctgaaatcacaaagcccattaagacacaaactggctgtggatctagaaatactagggatttcagggtaaggagggagcaggataaaagagaaggggggcggggcaaagagctcaattaacacacagccatttgagtagggactgctcttttcatgtccctcccattttacaaatgcccagaggcatttctgcagtggaacacctttgcaaattctaaaaataaagcaataaactttaactcctcaactttcataatattttgacagattctcccaactttaatttcctttttgtaatggtagtgtgatttgcattatgttacattgcttcattttgccattaaaaaaaaaaagttaatctcaagagaactgctctggaaattatgcgctactttaatagacatcccctcagaatggaataaaaataattttctctttgtaatcttatcctgtaatggttggtacgatctcaccataggcctgttttggaagcaaggtttgaattttcttaaagaaattttgaatgttattcttagaacagcttcttgtttctcacaaaaatcatttatgtaaagggaaggagcacactgatttatttaaaatttggggaaattgcgaaccaaaaaaaaaatgcattccaatttacaagttacttgattctgtcatatgaagtggcagtgtccttttcctttcctgcttaaaaaagcagctctggcctgtggaaggcaagtggcaaatgtaagctttatggcaaaacccactcaatgatttaaaaatgctccaggaacactgtgttggaaagaaatcagtggtactgaggtgtgaatggaggatgctctttaaaggaagcaatttgaccttttgttaaaaaaaaaaaaaaagtcagtatctctattttgccttttgtacccaaataaagctcatttattctgaacttttctgtgatttgaatttctacctattaggctttcctatattgcgatatgagtgtccaggagccaggacagagaataagacacattttttaaaaagggataggctagaaggatagcactggaaatgacattaacagacataaggggaataacatggaatgtgatagctagcaagctataaagtcactaagggggatgagactgacgttcaataggataagaaagcagtcctgaacataaaatttcttatcactactcttagctcactgtgtaaataaccccacacttctagtacacctcaaacttctctgctatctaaggaaggagtataatcatttctccccaggttgatcataacctgagcttcttcctatgactgcaagaaaatctccataaccttgggcacaacagagatgttacccaagagtagtcctgctgtacgacatcaattagaatgactgaggcagcctcctccacagcctttgttttctagatttttcgtgcctacagaaattccccatgaagattccactattccacacttcactgataaggaatgacaaactagagcactgcttttgtttctgagtttcaatttccgaaatacgaatagcatagtaatgtatgtaactgtaactcatcaagttctatatattttttaattcatatttttaaatagtgaattttcaattatcttcaaaggatcatatgccctacagtttatttctgacaaatcatctgttttattatttctgacatccttacctattctgcttaattaaatgatttatttacataaacgggatatttgcttaatctaatccaggattttaagagggagaaatgctttaggaataaaaataatttcccttgcatatatgaacaaacaaatagtacttctgtgtgaaggttgataaaaattaactcccagaataaagtggaagcaaaactgatgagagggacaggatggaaaaagtaggcagtttccagccttttgtgagtcacatattaactctgtggttaccgtgtctcaagaattttcaggttacagatactctccaatgaacaattaaaacccttgccaaagccaaatgtaaacgactttgaaaaaagttttatactcctcaatggcagacacacacacaaaaaacctgaagagtagaacagagtgactaattcaccagcacagcatttcgagaaacaagtgaactgcttgttatactgatgttttctccaatcctccacaaagcatatatgcacacaggaagcaattataagctacagaactcataatacattttgaaaaagggatatacatagtacattacttgtttgcctaaaagccatcagaatttaaggccaggcatggtggctcactcctgtaatccccacactttggggaactgaggacaagagatcatatgaggccaggagtttgagaccagtctgggcaacatagataaacccctgtctctacaaaactaatttaaaaatatccaggcatggtggtacacacctgtggtaccagctacttcgtaggctcaaccagaggattgcttgagcctgggaggttgaggctgcagtaagccattatcttgtcactgcattccagtctgggtgacagagtaagaccctgtctcaaaacaaaaacaaaaacaaaaacatacacacacacatgctgaaccaaacaaaactcccaattgacaagatgaaacagtgtgaagtggcctaagattcttattcacagttgcataacaggctccttgatctgcaatatgtttggcagcaatagcatgaacagatactgtgcaagttacaaattaactagaacatcattaactggtgctaagaagacagaacctggtgttatctttagtaaatgggtaaataaggaatttttttttgagctatggctttgccataatgccacaatgaatgagccacaatcatataattgcttcttctcaaagaatattcaatgggctacagtcaggtttttttgtttttgttttttttgagatggagtctggctctgtcacccaggctcgagtgcagtggcgtgatcccagctcactgcaacttccacctcccgggttcaagtgattctcctgcctcagcctcccaagtagctggaagctcccaagtagcttccaccagataccctaaatcaggcttccgccaccaaacctggctaatttttgtatttttagtagagacggggtttcaccatgttggccaggctggtcttgaactcctgaactcaggtgatctgcccactttagcctcccaaagtgctgggattacaagggtgagccaccgtgcccagcctggtttgtttttttaaaaccaaccactatgccatatcaatgctacccattgactacagtccagcttgtttgaaagtgtctggaaaagtaaatctctcaattaatttcataaaaggctattactgaaatcagcatgaatatttccatgtccagccttggatatgctttggtctttgacagcttgactatctctatgattgggcaacaaggacagggttttaaaggacaatgtctttttactctttgcttctctagccacaaggaatactaacttcaagaacttcctaagcacttctctttgatgcatttgccttttttattgttttagcagaattattagcctttctactctcagggtagaacattctatgaatcagaggacttcaatcatacttgctttatacttaatgtcctttctagtctttgactaagacattgaaataagaaataatgcaatgcacaatcaaaataattctatgcaagatctgatagctatcagaatttgaaaatatgaaatgctgtttgcttatccttgtattccatttatttaaaacatttggtgcatgtttttacatattaagaacataattatatatattagcatataatttcataaaagatcattgcctatcttaccttattgttgccttatttgtgaatgttatgtatataacaggaataacaagtacttgtgtatcattagaatcagacattagtttggtttaaaaaataagtccttttgtttcatctggtcaatacagttttattaaaggctaatcatttaaggtattttaatcttagccgcagaaatggaagaatctttctataaaatatacctgtagcagtatataatatttaagaacaacaaaaggtaaacaaatgtaaccaaatggataaagggggctgcaaaattaaagttagaaactaacatatcaatgattcatattctctatgccacaagacatgaaaaaaacattagtttttactactctgtattctggggacattcctttaagattgcatttaagatgattttagagacaataagcatttctttagatggagttgatatttagtttctaacttttcagagtttatttctaggcatagagtctttaactgtgggtagcacttatctgtacaacatagtgttctgcttctgtgattaacgcaaatatcacgtaaagatggagctgatgtgagccagggtctagagccctcaaaggcactaatgtatttgtttgcagagtgtgatgcaatttcatggggaatcaggtcaatccaacttttcagcacctatctacctcctcctcaggctgtagggtattgtattagtccattcttgtgctgctatacagaagcgcctgagattgggtaatttataaagatcagaggtttaattgactcaaagtttcacagggctggggaggcctcaagaaacttacaattgtggaagaaggggaagcgaacatatccttcttcacatgatgccaggaaggagaagtgacaagcaaagagggaaaagccgcttataaagccatcagatatcttgtgagaactcacttactatcatgagaacagcagcattggggtaaccgcccccatgattcaattacctcccactgggtccctcccaggacatgtgaagattatgggaagtataattcaaaatgagatttgggcagggatatagccataccatatcattctgccctgacccctcccaaatctcatgccctcacatttcaaaacacaatcatgacttcccaacagttccccaatgtcttatccagcattaacccaaaagtccaagtccaaagtctcatctgaaacaaggcaagtcccttctgcctacaagcctgtaaaatcaaaagcaagctagttacttcctagatacaatggaggtgtagccattgggtatatacacgtgttcaaaatggaagaaattggccaaaacaaaattacaggccccatgcaagtccgaaatccactagggcagccaaatatcaatgctctgaaatgatctcttttgactccatgtgtcacaagtaggtcatgctgatgcaagaggtgggctcccatggccttgggcagctccacccctgtggtttgcagggtacagctctgctcccagctgccttcatggtctggcactgagtgtctgcagtttttctaggcaactggtgcaagctgtcagtggatctaccattctggggtctagaggacgatggcctttttctcacagctccactaggcagcctcattggggaactctttgtgggggggctcctaccgcacatttcccttctgcattgccctagcagaggttctcaatgagggctcaaccactgcagaaaacatgtgcctgaacatccatgcatttccacacatcctctgtaatctaggccaatgttcccaaacctcaattcttgacttctgtgaaccttcaggcccaacaccacgtggaagccaccaagtcttggggcttgcaccctctgaagcaacagcctgagctctaagttggcccctttaagccacagctgaaacacaggtcagcaagtcttgagactgcacaaagcagcaaggccctgggtccagcccaggaaaccattttttcttcctaggcctctgggcctgtgatggaggggctgctgtgaaggcctctgacataccctggagacattttccccattgtctcagcaattaaaatttgcctccttgttacttatgcaaatttctgcaggaggcttgaatttcccctcagaaaattggttttccttttgtattgcattgtcaggctgcaaattttctgaacttttatgctctcttcccttttaaacataagtgccaattccaaaccatgtctttgtgactacataaaactgaatgcttttaacaacacccaagtcacctcttgaatgctttgctgcttagaaatttcttccaccagataccctaaatcatctctctcaaggtcaaagttccacagatctctagggctggggcaaatgccaccagtctctttgctaaaacacagcaagagtcacccttattccaattcccaacaagttcctcatctccatctgagatcagctaagcctggacttcattgtccatatcactatcagcatgttactcaaagccattcaacaagtctctaggaagttccaaagtttcccacatcttcctgtcttctgagccttccaaactgttccaacctctgcctgttacccagttccaaagtttcttccacatttttcagtgtctttacagcagtgccccactctactggtaccaatttactgtattagtccattctcatattgttataaagaactgcccaagactgggcaatttataaaggaaaggggattaattgactcatagttccacatggctgggaaggccttgggaaacttataatcctggtggaaggggaagaaaacatgttcttcttcccatgatggcgggaaggagaagtgccaagcaaagagggaaatgccccttataaaactatcagatctcatgagaattcactcactatcatgagaacagcagcatgagggtaaccactcctatgattcaattacctcccaccaggtccctcccatgagacttggggattatgggaactgcaatttaagatgagatttgagtgaggacacagccaaaccatatcaggcatgcactacacatcagtttccctgtcaaaaagcagttattattattttttctccatgttttttcatatattcagaagagtagggaagaagaaacaaaaagcaaagcatccttaattaaagcattcaagatgatagctgatctttcacttgtgttgaccaaatggcttatgcttatttcaatcactgccatctatcagtcttaattagcatctatccaataaaacacttcacttctgaaatatattaattactgttttatgtctttggttcctattatcctagctgtacaaccacaaccataaaaacatggcattttccagcacaaagggatagtatatgttatgtatgatttatgtaagtttcattaacatttagaggagtggtctggaataagctgctgttctctgactttatgccctaaggagttcttcagttttcggcactagaatcaagtctttcttagtgagacaatgatgaaaagctttctgctatgggaatttcaaaatcattcatgttataagtggcaaatccaaataaaaaaagaagactctaggtttagatgaaatactctgctctatacattttctaaccacagaaaccagggaacattcctttttgtagtatttgtgagtaatgcagggaatttagagtcatttatttccctgctagcatttaaatgaataattttagatcattttaataatctgataatgtgaagtgctgtaaatggcagagttttctgttatatttactgataattgttcacttggattgtcaagatcatagtgttagaacctcagaagttttgttatttaactttgtttaggactataaaaaaaattcactgagaccatgagaaaattctctgggatggatggatggatggatggataaaataaaagggtaaatggaaaactttctagagaaaaaaaattcacagcactttgcaagctctttctagcaatgatactattatagaactgggttatgcactttacttctctcatattgtagcttaaatttttttcttgttccactgtcagtgagatgagagaacagattactgttctgtaagagtagtgaaagtgtctgtatttaaaagtgggcagaagtgagtaatattatgttcaatggtgttgcaaactaaccagaattgaattacacttattaaaatattcagaaaaaaattatttctgttatttacacatggaatataaggcaaatttcggtttcaaatgtacaaaatgtaaagaagtaaaaacaaattggagagggcaggtgggaatattttaaaagctgtgcaagtggatttaaaactctacttaagagactagagataaatattctgtttgctcacaagttataaaagtagcaaaccatgatggtgcaggcttctcccatcagtaagaaaagagaaaaaaattatgggttcccagaatcaagaagacattaaaattaagtgtagaatgaactttctttcttcctgaacaaaaatatggaaagctaaggatgataatatttactgcaggacttttaagctctaagtgcataaaacagaggattaagtgaaaaaccaggttcataaaatgcattagtgttattttaaaagaatgccatagcaaaagtcattattttataaacttttcttgccataaaacacacatctagttatgtactggttataaagttataatgaaggtgaataacttctagggatgatggaaggtaattttactatatatttttgaatcacagttatatatatatatatatatatatatatatatatatatatttgttatcaggaacaaaattatactcagacatgcttctttcacattttccttccttgtaaaacctggatcacttgctactgcaattagttgatgccaatttgaaattcttcttggaaactatcataactgtgtaagcacctttaatttactgcacagaaaaacggaagccatttaagtttcacgaaaattgaaaagaaagcagttcagtctcagtaaatgtatggtaatatgctgaatacaatttttttaaagaaatgttaatctgagattccattatttcatttaatagtacagaaagcttattaagctaagaataattatactaaatagtaaaccacagacataaactttagcagtgctatctcgtttagcagtgctatctcgacgattacaatttaataccaggaatgtatcatgtaatgaatgcatattgaagatagtccatgtaaggcttcatactatcaattacaaaacaaaagtagtctcccatttcactcctatgtgggaggagttctacatccatcacattttccacatttaccatctgtgataagttctagctcaataaacttgaagttcaataaacttgaagcacagaaagtaagcaacaaagaacaaaagaaaacagcaaactaaattgtaaattatcaaatatacaacatgctttaccaaaaagaggtgttcagaaaatatactttctttttt

SEQ ID NO: 4261 - DNA, 1310 bp, Homo sapiens
atcagcacccagaccggcaggctgagcaggctctgtgtgggtgagacagcagaaccggtggggtagtcagcagaaagatctggacaccccagcctagatgtcccgtccccgagccctgacatcagccctcctctctttactaatgcatgatgcctgataacagaaatgcgttgtttaaaagaataagaaaactcagcatgctgaaggtaacacttcacaagctctgctcctgggtccaaggtcaggagagggaccaggggcttgagaagagtccatttggaaaagacttaaagttctccagaaacagcagtaatggtgatgacaactaacatgacccggcggtgactttaccaggtgggtatcacatgcgcgcccttgctccatctcatgacatcccttgagttaggatcagagaggtgaagggatatgctcaaggccacaaagcctagcaagggacagagctggggcacccagagccatctgccactaaaggctacccaaagcttaaggtgagacaacagttggcgggggtggggggctcccaaaataacccaaattaacaacagttggtggcattatagcctacaaaatgcttcctgatactttatctcatatcatagttgaggaaactgatgcttggagagggaaagtacctggcccagaggagccgagctaagtgacagggcccggacttgagccctagtgtccttgtttcatccaagctggttacacccaccacgatgcaaagactttgaagctgtgaggacgcgagcacccagagcctggcggggtcatctcaccaaactccaagcgcacaggtctggggacactgagggttggctttgggtgctgaggctccagaggcacccagagccctgcagaggatcccatgggggcagcaggatgaggtggggtcggggaactttgtccgagaggaactggggatgcagagcccggaaaaggctgtcatatggggacagcctgggaggtgtttaaggagccaggggctcctgggatcgaatcccagctctgcctgtcaccagctgggtggctttgggcaaacctggctccagatggtcattaataaaatggggacaataatagcctctccctcgtgggattgtgtgagaattaaatgagtaaatacatgcagaatccttagaacaacaccaggcatataccaggtgcccatcaaagttagatgtcatcattgttactgtgattttcattacaacgaggcacagtgggtaagagctcaaaccctggagtcacagagatgtgaattcaaatctcatcccacctacctaact

SEQ ID NO: 4262 - DNA, 10273 bp, Homo sapiens
acatggggaggcccagccagtcaaacccagaacagcccggctgagctcagcctaattctgtgactttcaggatgagtaacaaaataaatgattcttattttaagtcaaaattttggagagcaatcttcctcttgtcaatgtctatctcagtgctatttcagactcctttcgtactgtcaaatctcactcaacttttagcatctatttcaattggcatctcttccaagaagatttttctaatttcctcaagtgatgtgttatctcccctataattgaaccccattttgatatttgtgtccctttttagctttttttttaacttgttttctattagaggtgttagtgtcctactcatcttgcttttcctacagctagtaagtggacatccaggaggtacaaggatatatcccagacctggccagtcatgctaccatttcccataataatctccttaagaagtgagcaccagacccaagtcattcagatactacctgtaagatataggcactgagggaaagagtctggtttttcttttagatgaagagctataagaatggaatcgagactaggagaggaacatccaaaggagagaaaatgactgcagtgggagagaacaagagctacgatcaaaaagaggagagacaagcagcactgaggaagacagaagggtaagaagagatgatgtcagaagtgggatccaaagaaaagcttccagtgacccccaggagcactgagtgaccaagcaagtttgcagactagaaaacctctccctctgcacactgagaattcccactgcagtgaatggaaggtcaatgtatgtaaagcccacgtgagcagtggcggttcaagcccagagaaagaaggtgttgagttgccttggtaaagaatttatacaccatgtgttcacagcttcttgacaggtataattatcagtgttgtcttttactatgtgctgggattctgaagcacggtttcaaatttgtgactatcggatgtttgatcaagtagctttccctcaagggcctgaaagagaaaaagagtgaagagaaatcagtgattagtattcatttgtcaactacaatatgctaaaaatatcaaaagagcatatgctatgtgagaacagcaaggattattttgggtgctatcattcatgcaccatcttctacatatgaaaaaattcgtttgatgtttgcaaaggaagtaattatcaaatgaggatggaaaagccacagttgttccctaaaatgaaataaagaacaccagtttggaaacatttcaaatgtaaaacatttccttcttccatttccagatgattctatttttcctcatgaaggcaaagaataaccaacatttatgttacgactcttagggcttttagtagtgcttttgttgaggtagaagccagcaaaacctctctctgctaggctgggagcaccaatattccttctctgacgtggacattaaatctgtctctcttcataaggtcagcctgacaccacatgaaacagagtaggcaattacctctatggtcagagtttggggagcagtcttgccagatactacccccatacctgccactcttccactattagagggtcatttctttcagagagaacagtgatttttacatcttcgttctcaaagctgcagatatttttatttcaatgaatgccaagcaccatattgaaaacagattttaacaaaattgttctgtttactttgcgtcaacactctccagctgtcatgctttaaagagatgtgcccaacctcccctggggcctactgagtggattgaaaaccgtgcataaacccattgtgtttcctcaggagtcaccaacgagatattatataacaacacataagcattaacattttaactattataatatcatcattctgactactacttctatcactaatgaaaatttattgagtgctcactaagtgtcacatattttgctaagagtttcacatttttttttcatatttaatctccacaacagaccattttactgaatcttagattgaataacttcctaaaggtcatttagctacaaagtgaccagagatctagactgagttcttttttttttttttgagttgaagtaaatcttcacttcccagactcaagcgattcttctgcctcagcctcctgagtagctgggactacaggcatgtgccaccacctccagctaatttttgtatttttagtagagatggggtttcctcatgtgagccagtctggtctcaaactcctgaccgcaggtaatctgcctgccttggcctccaaagtgctgggattacaggtgtgagccaccgtgcctggcctagaggctgagttcttaatgaattaaatgataatataactacatgtcctgaaggaatgggactcagaacaggtgaattttagtaagtcttggatctcttcatctatccagggcaggagtcagcctgagagagagcactgggcattcaacatgtgggccactgacatacctgttgggaagaaccagctgcaacaaatgttagtattgccctcagtcatgatttataatttaactgattaacaatttatttttaagaaaagcttcttttccatattagtgtgtcttgttgatcaaattgcctactaactcttaaaagagccattgtggtaggcagaatagtgcctcctcgtccactaaatgttaagtccacatcctaatctccataaactataaatatgtttgattacatgataaagggcagttaaggttgtaaatgaaattaaggttgctaagaagcctatgttaaaatagggaaataaccctggattatttagttcaatccaatgtaattaaaagtggaagagggatgagtcaaagaaaaaaaatcacaagagaaatttaagaatattttgaaccaagtaaaaataaaaaataaaaatgttttgataagttgtgggaaccaaaaaatcaatcatctatgcttcttccttaggaaactagaaaaagggcaaattatatccaaagtaagcagaagaaaacaaataataaacattaatgaagattaatttttcattaataaaaattaatgtggaagaaatcaatgaaattgaaaataggaaattaatagagaaaatcaatgaaatcaaaagctgattatttaaaatgatcaataaaaaccaagcactgtggtgcatgcctgtagtcccagctacttaggagactgagatggaagaactatgtgagcccaggaatttaagtccagcctaggcaacatagcaagacccttcatctcgaaaaaaataaaataaaaagacggataaaatcaataaacttctagccaagctaacaaaaaggaagagaagacacaaattattacttctattagaaatgaaagtggtcacatcactacaaataccatggacattaaaagcatagtaaaaaaatactatgaacaactttatatccaccattttgataacctagatgaaatggacaattccttgaaagacacagtctgggccgggtacggtggctcacacctgtaatcccagcattttgggaggccgaggctggcggatcatctgaggtcgggagtttgagaccagtctgaccaacatggagaaaactggtctctactaaaaatacaaaattagctgggtgtggtggcgcatgcctctaatcccaactactcggaaggctgaggcaggagaattgcttgaacccgggaggtggaggttgcagtgagctgcgatcgtgccattgcactccagcctgggcagcaagagtgaaactccgtctcaaaaaaaaaaaaaaaaaaaaaaaaaaaaaagacacaatctgctaaaactcacatgagaagaaatagacaatttgaataggtctatatttataaaagaaatcgaatcaatacttagtagccttccaaagcaggaagcacccgaccctgataggttcactggagaattctaccaaaatttaagaaataagttataccaattgtctataattgctttcagcatatcagatagaagcagagcgaatatttcctaactcattctatatggccagcattacattaataccaaagccagacgaagacactagaagaaaaaaaaaccaactacagaccaatatctctcaagaacataaatttaaaaaccctcaacaaaagttagcaaatcaaatccaacaagatttaaaaatgttaatgaccttaatgtccattcagaagagattgattattgtatacctagaaattaaaactttacacagatatttaaaatgtagacctaagtctactaatgttaaccatattgtttaatttttaaaaatcaggttataatttagcatgtaaaatatgagtgaaaataagcatatatatatatatataaacatacatataaacatacatatatagaaataacatttctggagaaaaaactgtgtactaaaatgaagtgagattatagctgaaaagttaatttattctttatacttctctactgtctaaaaattttgcaatgaaaaagtgtcactttcatacacaaacatcaaatgtaaatcaatagaaataaattaacagttttgcaagcaccaagacaacaacaaaagtgaaagagggggacagaaaacagcgttgtgatgaaggcagaggtcagagaaatgcaatgtgagaaggattccactaccgctactcgttttgaagatggaggaagggcccaggaagcaatgaattttcccctagagcctcctaaagcccagtaaaactgtgttggacttctatcctacagaattacaagatatatttttaaaattgtatattcaattggcaaataataattgtatacatttgtgatgtacaaatttgtgatgtacaaataaatttgtgatgtataaatatattgaattgatgttttgatatgtttaaaatgtgaaatgattaaaccagataaaataattaacacattttatcaccacacatacttattttttgtggtggaaatatttaaaagctatccttttaacaattttgaaatagatattattatttaactcatcattctgtgcaatagatcactaaagcttattcctcctgtctaactgaaactttataccctttggtcaacttctcccctttctttccccgatcacccttctcctctacctctgataatcactattctactctctacttctatgagtctaactttttttttttttttttgagacagtgtcttcctccgttgcccaagctggagtgcagtggtgcgatctcggctcactgcaacctccacctcctgggttcaatctattcttttgcctcagcctcctgagtagctgggattagaggtgcaccaccacacctggctaatttttgtatttttagtagagacagggtttcaccatattggccaggctggtctcaaactcctgacctcgtgatccacccacttcggcctcccaaagtgctggaattacaggtgtgagccaccgcacctggccgagtctaactttttaagattccgcttataagtgagacatgtggtatttgttcttctgtgcctggcttatttcatttagcacaatgtcttccaggttcatccatgttgttgcaaatgaaagatttccctcccttttaaggctgaatagtattctgttatgtatgtctatttagctgaagctggacacctacgttgctcccttatcttagctattgtgaacaatgctgcaatctacatgtactgcaggtatccttttaacatgctaatttcaattcatttggatatatccccagaagtgagattgctggatcatatggtggttctaattttagtttttgaggaccctcctccatattattttccaaaatggctgtattaatttacattcccaccactggtgcacaaggattcctcttactccatacgtttgcaaacacttgttatcttttttcttttttaaaatttaaaattttactttttttttttttttagagatgggggtctcactatgttgcctagggtggactcaaattcctggactcaggcaatcctcctgcctcaccctcctcctcctgtgtagccgggactacaggtgcttgctaccacatctggctttgtctttttttgataacagccattctaacaggtgtgaggtgaaacctcactgtggttttaatttgcattaccctgattattagtgacaatgagcatttttcatgcatctgttagctataccttaggcttcttttgagaaatgtctattaagtcatttccccatttttgattgggttatttgttttcttgctattgagttgtttaagttccatacatattttggatattagtcctttatcagatgtatggtttgcaaatattttcttctaatccatgggttatttcttcaatctgttgtttcctttgctgtgaagaagctgtttagttgggtagaatcctgtatgtctatttttacttttgttgcctgtgattttgggaaggtatccaataaatctttgcccaaaccaatgttgtggagcgtttctttcattttcgtctagtagtttcacagtttcaagtcttacagttaagtttccaatcattttaagttggttttgttatggggtgagataagggtccaatttcattcttctgctttggatatccagttttcccaacaccattgattgaagagattgtcctttatccattgcatgtttttgatacctttgtcaaaaatcaattaactgtaaatatgtggatttatttctgggttctctagcttgttccattggtctatgtgtctgtctttatgtcaacagcatgttgttttgattaccatagctttgtaatagaccctgaggtcaggtagtgtgaggccttcagtctggttctttatgctcaaagttgatttggctatttgatgtcttttgtggttccatgcaaattttgggatttttttttcctacttctgtgaaaaatgacattggaattttgatagtaagagcattgaattctacagcattataggaaacaataaatttgtgttattttaagctactatatttgtggtaatttttatggtagccatggaaagctaatgcatctttgaggatgaagtaatttgaagtatggggtactattttaaaggtaatcgataagggtgatttggataactgcataagactgaatccccagacagttcacaaatatgtctgtgaagtggggtcaggaaaagtaagggtggcaatatgaataagagcaagaggctttaaagcccatgttcctgtgtttgaatcgtggccctattacttgttataatagctgtgaaatgttaggtacatttaaaaaactcctatatgcttcagtttccactttatttttaaatttttttaatttttaatttttgtgggtacatgatatatatatttatggggtccatgagatgttttgatacagacatgcaatgtgtcataatcacatcatggaaagtggggtatgcatcctcttaagtatttatcctttgtgttacaaacaatccagttgtactcatttagttatttttaagggtatagctaaattattattgactatagtcaccctgttgtgctgtcaaatactaggccttatgcattcattgtgtttttgtacccgttaaccatccccacctccctccccactcctccactatccttcccagcctctggtaaccatccttctaccctctatctccatgggctcaattgctttgatttttagttcccacaaataagtgagaatatgtgatgtttgtctttctgtgcttggcttatttcactgaaaataatgatctccatgttattgcaaattactgaattttttttttttttctgagacagagtcttgatctgccatcaaggctggagtgcagtggcatgaacctggctcactgcaacctccagctcctgtgttcaaatgattcttgtgcctcagactccaaagtagctgggattataggcgtgtgtcaccagctctggctaatttttttttttcttttttttgtatttttactagagatggggttttgccatgttggccaggctggtctcaaactcctggtctcaagtgatccagccgctttggcctcccaaaatattgggattacaggtgtgagccaccgtgcctggcatgaatctcattctcttttattgctgaatagtactccattgtgtacaagtaccacattttctttatccattcatctgttgatggacacttaggttgcttctaaatcttggctaatgtgaacagagctgcagcaaacatgggagtgcagatatctgcagtgggaacctccaaactgttctccatagtggttgtactaattagtttactctttaaaacaagattaaacatagtacctaatctgcataaggctattgtaaagattaagtaatttaatatatatgaggcacttaaaagagttcttggcacacactaattgtttaataagtgttagtcagctttatgattatttctgtccggtgttctgcttggaaactctgggttccttgcattcgattttattggagtcatcccctggaacttggttttcttagtgactaggcggatagttttcgtaataattccctggattagatcatcaggatcatgcatgtggtaatgctagaagaaggtagagaagggttttaaaggtaggcaaaataaagaaaatggggggtctttagagtgggaggaaaaagagatttggtgaggctactgtcaaatgccagcaactttgtaaatttaataagatacaggctggttttgactggaatgaattctccaccctagatctagccatggaggtcagggacacgattttggtcttgacttcctcagaatgttgatatctccagagatattcctctttcttcttatttttattttttgagaatctgggtgaaatattatatacatggagtcacaataaaaaactgaggtgcttcaagctgaataaatataacactctgatatggtttgactgtgtccccacccaaatctcaacttgagttgtatctcccagaattcccgtgttgtggaagggacccagggggaggtaattgaatcatggtggctggtctttcctgtgctgttcttgtgatagtgaataagtctcacgagatctgatgggtttatcaggggtttctgcttgtgtttattcctcatttttctcttgctgagaccatgtaagacgtgcctttcagtctgggcatggtggctcacatctgtaatcccagctacttgggaggctgaggtaggagaatcgcttgaacccaggaggcagaggttgcagtgagctgagatcgcaccacggcactgtagcctgggtgacagagagagactctgtattaaaaaaacaaaaaacaaacaaaaaatagtggctttcccctccagccatgattctgtggccatgtggaactgtaagtccaattaagtctctttttgttcccggttttgggtacatttttatcggcagcgtgaaaatgaactaatacaactctttctcaaaaaaagtgggtatagcacgaataaaacccgaattcatattctctgttaacatttctagcatattattgtgcagcaataatttttttacattttagaaaatgtaatgtgtatccttcaatattatcaaatatagaagttaggggaaaagactattgatttttactttaagagagtttacaattaaaagtaagcataagagaaaatttcctgcacagtacttgcattaaatcttttttccacttgtattcactatttaccattgccaggtgctttataacttttaccatctcagataaaaaaacatattatttctaatttcagagtagaaattgcatttcatttgataaacaataagataatatcagacaagtattttgattttacttggtttttgcttgactggttaaattttataaaaacctgagatgcttaaagtctaatagttcaaattagcttcaaacttttctcagaagcaactgtagtaagaattagcaagtgtgacaatcccatttagtccttaaaaatcaaattaattaaaatgtaattaagagctaatgtaagtctctttgactgaagtcaccataaaatccatgaatgacatgacttggatgtattttatttgtacctgaaatggtcactacagttttatctcaatgtgtgtgtattgcaagtgccatcttggcaggcacaaatacaaatttcatgttcacttaaatcgaactctactatatctcatgccag

SEQ ID NO: 4263 - DNA, 848 bp, Homo sapiens
gtgcgcgagggcgcgcgcgtcccgagccctccacccgtcgtgccggcgccgcccggaccgccagatgctgtgtgctgtggacccacctggggttcatggagtgggccacggggcccagccctaagcactgctgcgcccagggtcgccgcgcctcctgctgaggggtccccgtgccactggctctcaccattgccctcgcctgccgatggcctctgctgcccagcctggggccagctctaccgcctgagccccctgccccactccaggactcaccgtaccccgatggggtaacgtgacacaggccccacacgtcagaggccgctgtccccacggccactgcccgtgacccctggcccaaggcagctggagttggttcagttcaagttcattcttcctctggcccttgggggcttggggcccacctctgagtgaagggggctgtctgcccatccaccaatgtggagagggcgcccccggtgtggggtccagctctggacactgcttggcggccgggttcactttgagtttttaagttttctttgctgagcttttttggttgttctttttattttttgcctctttatgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtgggg

SEQ ID NO: 4264 - DNA, 257 bp, Homo sapiens
ctttccctcctgccgccgagtcgcgcggaggcggaggcttgggtgcgttcaagattcaggttcacccgtaacccactgccatggccgaggaagaggcctctgtaaaattgacagagaggggaaaccccataaagtggttggttacagttgtgtagtagttaaggactatggcaaggagtctcaggccaaggatgtcatcgaagagtatttcaaatgcaagaaatgaagaaataaatctttggctcacaaaaaaaaaa
